United States Patent 7,868,149 (PLANT GENOME SEQUENCE AND USES THEREOF) - sequence listing, part 4

SEQ ID NO: 1576 - DNA, 1853 bp, Oryza sativa
ttacgcctatagttagttctgcacaggttgcataagtttcctctcctgctccactgcacaataacaccggcttcagttcatgtataaatctcaaataaacttctgttcatgtataaatctcaaataaactatcatttgaacatggatgtaagtaatcatgcacagaaaaataattgaacgacctaggaatatgatgtgcagctttactgtctcttcattggatagcatgttgatttctctagccctgaatttgtatgcaacttaaagagaaatgttgaacaatatgatgtatgagctgcgaccaaatttgcacaagaatttgacataccactggtgcatgcttttcaatctacggccttgtcagcaaatgaagatacaaattttacctcagtttccgttagcacgcttttcaaactactaaacggtgtattacatgcaaaaactttctatatagaagttgctcttatctacaatattagattaattaattttctaagtttaaaataattaaaactcaattagttatgtgctaatggttttctcgttttgcgtgcccgtacttaatcttcatgttcatcacttgtgaacactagtggtcacattctggtttaaacttcaagtttatttccaccaagttttatcgtatgcatgattccttagtcgcaaattcatacatgactatctaagctagggaccatagtacattaaaccactgatcgaaacaagggcatacagttctcagttgcaagaacagaggcaacaatgctaaggagaagaacaactccaagttattggtgttcataatgcaaagtgatcaattcatatcatgttaccttgacatcaaggaaacacatgaatttacttagtaaagaaagctatttgaattttaccttgcatggatttctcaaagttctccagctgagacatgaatccctcattaggagccacttgaggtcgtttgcttctaactagcgacaacgcgttctcaaggctcatttgatgcttcttcatcagatatgcaacaataatcgtgacactagacattcagagaagttagttagtaggacaaaagaaaaaaagcaccacacatctgctcttaatgaattcaaatattctttacaaaatatctatatattaagaaacacgtaattaatcaagggtgatctcacctagtggaatgaaattgagaatttatacacattatgaaaaccatcataaaacagtcaaagctaacatctattagagtattttccttacgagaaaattctttatttgtccttaaaagttgatcgcttccatcgtttgccctcgtaaaattggctccttctagtgctccgcattcttaacttttatcctttatttgccctttccgttagttctccgtcaacctactgttaggtgggtgaaaagatagttttgcccttatctttttatgcacagcagctatttttatactttatttttgttgccaggagcaatttttatactaaactgatggttcatatatctctaatgaacctaaatgttattttagtaagaataaaatacatcagtgcttacaagttggaccatggtatcatctacgtccttaaacatgtataatgaacatctgcttccctaatcttggtttaatgtatcacttgagatccaaactatagatgacggagctcaggcgctgacgtggccatccatggtggcgagaattttgcatttagaccccttcactacaccatgcccgtgagaaggaaggcaaagaaacagaaattatgcgggctgggattgttggcgataggtccccatggccgatataggataaagtgatcctggctgcgtgattgttaccattaaggcag

SEQ ID NO: 1577 - DNA, 475 bp, Oryza sativa
tcataggattaatgatgatatgaagagggttagttactcgtctgtatgcccatggaaactttactttgatggctcagcttgtagagaggaacagggtgttggtgttgttttaatttcaccaagaggcaatatttttgagacatcggtccatttagaatatttttgcaccaataatcaagccgagtacgaagctcttttgcgaggattgcaaattttagaatccatggatgtaaagaatatagaggcgtatggtgattcgttattagttgtgcaacaagtttctaggaattatcaatgctttgatggatcactgaatatgtatttggagaaatgtttggagatcatagcaaatttagatgattttgttattaaacacatttctagggaagagaatgttctagctaataatctagcgcaacaagcatccggttatcgagtcagtagaggtaaattgtttatgattgaaagaccgatg

SEQ ID NO: 1578 - DNA, 2046 bp, Oryza sativa
tggtgacctttgatcactgacgatcgtccccaccctaatcgtcgtctctttgcctcttctcccacggctgcagtgggagtctatttgggggcatactattgcagagggacataaatacataactcttgactccgtggatgactacattagtgcccgagctgtgtcatttgcactctagacctttagttatacattaaaccaagattagggatctagatttgcatttttgaggttcatggaactacatgacacctcactccatgtttaaggaccaatagtgtattttatactttgagcaatgaagttttatgcaaaatcctttacaattagtatattgcatgaaattaactgccattggctgctcattaattgtcaagccacagccagaatttgaattttagaacttaattgtagattgattttcaatttttttttattttcaaccttggcttctgaacagctagattgaagtataaaagtctagccctaaaataacttttacttggttcatttgtcttggatgcatcttaacctttaccgtgaaaatctaatgtactaatttatttataattaaccagcaagatttttttttaccaaaatcaacaagcttttttggtacatagaaaatgatacacaaggtcaaaatcatgtttttcactcatctactaatggtatgttgacggaggaagggaaaataaaagataaaatttgagaatgaaggagagggagcagatttcatgagggcaaatgagagaactgatcaactttgaagggaaaataaaacgagtagacacaagcagttcataaaatccagaaaggacaataaaatggatcatagctcttgtatgcatgtatgtcatattgtccttggtagtgcataaaggtcttcagatataatttgtactatagtccacatcacaaagtacttaggttgattggtactgatttgccataaaacattacaagttgcactttctgttgaatggcatactattattggacggcatccatcacttgtacactgctaaacccttagtcatgttagataaacagtgcatgcttattattactgcaatgctgcgggtgacattgttgcatccaagatactaaatatcatcttctgaaccaacccatgatgaagaagataaagtttcttagcactgtatggaataccacactatctagctctatcttatttaacttgttttagaatttgggaaactaaggttccacttgatcaaacaaaccaactaggtattgccttgccacttaactgaatgagtacacacaaaaaaatataagtgattaaggctgttatttcgctattccttgttcccaaccggaatagtacgcacggaaaacggagcagtccattagcgcgtgattaattaagtattagctagttttttaacaaaatggattaatttgatttttttaagcaacttttgtgcaactccacttgataaaaaaaacgagaagatatttcgctgccaccaacttcaatgtgttcatacaaaaaatatataattacttatacaaataattgggtaaatagcattaaattgcaattattttgtcaatcatcacagtttgcaatgatatatgtcgttatatcagaaacttttgcagggcattaaaaaactgcaatactagtgcagaatttaataaataacttgcaactccatgaatagaagggttgccggacatatcaagcccatccatcataaccacatgctataccacattaaagtccaacctgagttggccctgtttgagaccaacttgctaaacgatctcatttccagttgagttgcagttttctaatagaactagctagatacccatcaattataatttatttcaaataaaaatgttataaattttaaacttcgaatttgttatataataccaagaagaaaatcatctgtaatttgaaacaaacatcaatgtgcaaataacattattaaaagctacatgcacaagcatccacttgtctgcagaagatccacaaactcaacaggtgtaagggtggcagagtcaccacca

SEQ ID NO: 1579 - DNA, 1515 bp, Oryza sativa
  unsure (1)..(1515): unsure at all n locations
gacaagggcaacagaaaaaagagggtataatcacatcaataggtatttgaaacaccatgacacagtcaagaagtttaagtgctccatgcttatttcatttctcttgacattacagttttccagattgagtgataatctaacatgtctggtaaacttacaacacaacagatgaaaagtacataatttagaagtaaatgcagcacatttcttaaacttgcacacagagttcaaataggtatgtgaacttaagcgatgcgcattattactcctaaatatgcatacttcggttctaacttagttcttactggcaatagatgattgaatggctcattgcttcacttacatgacttcctccctccatccctcctcaccctctctactctctctgcatcctgccacaaccctaatttagttgttgcatccccaaacaacttcctcaaaacatagctggctagctggtaagattgaaccaccatgacaaagtgacctcaggcactgggatacgttagaattggggccctcaacactcaacaggcaaagtagaggatacgtgtgaagaagaaaaattaatccagaaacacacttatcagtcactgtggttcgccagagagaaaacaatcatggctttatattgtaggagaaaaaggaagtaaaatgagtgtggcagaagagatggaaaacaaggagtaaatagtgcttcaaaagtgtggggacagaaaaaagcatatgggagggctttctcacaggtgagctttgctgctggtgtagctggaggaggagaaaagggaagtgtggggatagaaactagcatgggagggctttctcacagatgagctttgctgcgggtgagactggagaaaaatggcacatcaaagccacatgagcgcctgctaggctgccattccatgatcaattgaatttaagctgacccacatatgcagctgtaggaatataaatatgcatctctcaagtacatagacctgtttgaaccaaacatacttttttttttcttgaaaacgcaggactgcacttcatttcattatgaagagaaactgtaatgtggttatggtgcaagcaacacattctaaatttatatggtgcaagcaacttaatctgataaaccaagctggcatgtggttaccttcaatcttcttgtagttaaattcagctgcaaaggctggatttaatgatctggcaacaatcaagatatgggttatgttcaagctctttaaagcatccttgttcattgctgccccaacagatcccaagtatagcccctacgaatatgtcaaagatattctatcaaatagatggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1580 - DNA, 387 bp, Oryza sativa
gccaccaccgagctcagcatacccgatagccctggatgtgccacatcgaacttccccatcagtttggatctggattaaacagagagagggaaagtgtgaagaaagaaagggtgggtgagctggccctttccctgtggaactcaccactgcggaagaacggccggcgtcgacaccattgatgagcctctgcgctagcgctcgccctccactctgagtgaccggatccgccggaaaggaaatcgtggctgccgcatccagcacccacggcctccctttcgagtgggcgtcggcggcggcgtagcaacgagaccgccagcagcgagggcgcagcgatgacaccgtgcatccacaacatccccttggagcagcgaatggcagggcgcgtag

SEQ ID NO: 1581 - DNA, 248 bp, Oryza sativa
ccaattaattattttatgatttcactgtttccccagatgtgttcagaggaatctcatggaaccaccatttggctgtgccttcttgtgtaatgccaaatatacacgtgtatggattctccaaagcagaagatcctgaatatgacttccatgaggtaagcagcgagtattaccaaaattttttttctttaagttagaactgttgtatacatagttctgtttatcgattgacacacaccccttgaattgca

SEQ ID NO: 1582 - DNA, 2033 bp, Oryza sativa
acagatcagtcgtgccatacaatcttgaattgcttaaaaaatacgaagcacacattaatgttgagtggtgtaacaagtcaaatctgattaaatatttattcaaatacattacaaaagggcatgatcatgcaaagatatactttgagactacttctaagacaggaaatatgtcactaaatcatgatctagctcctcggatgagatattagaatacatggatgctagatttctttccacgtgtgaggcacttcatcgcatatttgaatttgacatacattatagagtgccacctgttgagcgtctaacagtccatttagctggcaaaaattatgttagatatgagaaatgttcagatttgcgggcggtgctcgatagccctgctgcgaaacgatcaatgctgactgaatggttcgaagctaatagaaaatattctaaggcacggttgttaacatattgtgagtttccaaaggaatggtcatgggaatcatcatctagaacatggcgcgagcgaacaccaactgcaaaaataggtcgaatctattatgtgcacccaacctgtggcgaactctattacctcagaatgctcttgatgatagttaaaggcacacagaattatgctgatgtacgcacatacaatggcattgtttataacacattcagagaagcatgtgaggcgagaggtcttcttgaaggagataatgaatgataccttctatttgatgaggccatactatctgcatcttcgcgacaacttagacaactatttgtgaccgttattctttattgctctgttagtaatgtgcgatcattatttgataagtattggctttatatgactgatgacatccatagtagattaaagaatgcattagataatccacgatgcattattccacatgagcacttgcttagtctcctcctgcatgagcttacaattgtttttgcaaacaatggtggtaatataaaagattttgatttgccgattccaacatctgcttcacacattcctggtagtaatagattgattgacgaggagcttgcacctgatccccttatgatgtccttgcgcgcagattctttaatagcacagctaaatatcgaccagaaaaagatttttgacaccataacctcctcaatcagtgcaaacaaacctggatttttctttgtgagtggacatggtgggactaggaaaacatttctatggaacgctatgattgcaaaacttagatcacaaaataagattgtgctcgctgttgcctcatcaggtgtagcatctctcctactacctagaggtagaacagctcactcccgatttaaaattccaattgacattgatgaaactagcatttgcaatataaaacgaggaactatgttgcctgacctcctcattgaaagtgcacttattatatgggatgaggctccgatgacacgtaggcactgttttgaagcattggatcgcacattacgtaacattctttctgaaacttgtcctacaaattcaatcataccttttggaggaaaacctgttgttttgggtggtgactttagacaaatcttacctgttgttcctaaaggttcacgcctcgctgttattaatgcatcaattacaaatttagacctatggaaacatgtgacgttgttatccatgaatataaacatgagactgttaaatccaaccctaccagaaaacacaataattgaattgcatgaattcagtacatgggttctagctgttggtaacggaacattgcctatgattgcaaaagaaggtgaagctcaaccctcatggattataattcccgatgatcttcttgttgtaacagatggtgacaaaatcgttgctattgtcaacgaagtgtatccagactttcttgcatcatataaaaaccctacatatctatcttctcgtgccattgtttgccctgcgaatgcagtagttgatgaaataaacaattatactattgatttactcccaggagaatcaagaatatatcttagctgtgatacaatctcaaaatgctcagagcaaattc

SEQ ID NO: 1583 - DNA, 14814 bp, Oryza sativa
acagggctcaaaatactgattgaaaacgatgacggatcatgtggaaaccaaacaagaaatgttgtttataccgagatactttctgctacaatggaagcggtgtgccctcactgccatattgcatatattttatctctatatttacctacattcttggtgtcacattgggcatcatttcctattgcaggcttggccgctccatgcgtagctttccctcctcagctaattgcaatggcttttgtatataaattttggagtaaatatattgtactcacatgtagtatatgctgtatcactgctgcaccaataggctactagatttctatgtgctgttttctcacttgcttagttcattacagtgatgcttcatatttacataaactaaatatcttcaatatttatttgcagccttccaatggcgtacgtgcttatttcagaccttatgtatggggacactgataaacggatcaaagcgagggtatctaggcaatgggactaccatgatctgaatgatgaaacaaagatctaccacactgatcttgtcttgctggatgaaaaggttatagtctaattaacactcatttcttctttattaatacttacatacaaacatggtactaacaaggtgctttatatacacaatatgcagggcaatagcatccatgttcaaatctatccacctgccatgattaagcttaggactcttctacaggaagggaaggtttactactttgactccttctctgtcagatatgcaaacagaacatataggccagttacgaaccctttgatgatctcattcactaaatggacaaccttagaagaatgcattgatgcttttgatgattttcctgccataactttttcattgacaccttttcaagacgccccgtctcttgtggacagaaatgctttctatgttggtataacctctttatcccttttttgtcttcctacgtttacttcttatacattagtggtttattgtttacatatatcttctctttaaccagatattatgggtgtcataactgaaattggtgcaacagacactctacgcccaaaatcaagaaacacagaaactttgaaaagaacaatgcagatttgggatgcaaggtaagctacaatatagactgaaatttccctttgttataaacttcctttaccttatattatccacactaactattgaatcatttgtttggctctttgaaacctttctaatagcaatgtcaggcaagcatccgagcacaattttcactgatcaagacgcagccattgcagcagcaattgcttttgtactcccggatataagtcattgtctttgtttgtggcacatttatctaaatggttgtaaaaatcttggtcatgtaattcataagcatcctaacaagtttctaactgattttaagagatgtgtctatcaggacagatcagagtatcatttcaacaagatgtagcatgaattgttgagtgaatacaagtttgaggataacgtatggatgtcaaatctgtatgctttgaggaagaagtgggctattgtgttccgtgactcttttacaactgatatgacctcgactcaaagttgcgaaagtatgaataacgtcttcaagaaaagatttcataggaaacttggtctttcggagctccttgtagaatgtgataaggttgctgctagccttcgtgaaattgagttgcatgcatattttaagtcacgaaacttgaaccccgtaacttgcatcccaaatttacctatgttgaagaccgtagctgactcattgttgacggtcgtaagcgattagtttcaaccgtcaatattaccaaaatagaggagaactagttatgcttgcaatgcatattcatgttagaataataatattccactagtattaggtttactaaccttttacagagaataaccataaagtggaggagaatcgacatcgaatcagacgataaatcaatcggacgatgtcaaggatatacttatcaatgaatgggccaagaacttagaattttcacgatcaattgggccaaaattcacaagtctgcaaagagtagaagtctaggaggccgccattcgaaaatgggctggattggaccagcccatggctcagccgaacccccatttgctccgttggatgcagggtttggcgtggacgtccaagattgctccaatgacggttagagggcatttccgaccattccaactgccataaccgtcattgggaggctataaaaggagctctcatcctcactttctatacacactacaagcaaagctctagccaaattcatgaccgttccacactacacctacatgatgatgaagatgcctggtcctcgaggtgtcatatcactacggagcgacatcaagcaagccgtcacatgtgacaaagaaagttgcgagatggcccagacccgcgagatcactctcgctcgcaaagacatccgactggctgcgaccatggcaagcgaaggagaagtgcctgcgaccaagctgtcaaagaccgaagaaggcgacgacaaaactaagaagattccactagatccctctgatcctactaagactgctgtaataggcgctgagttagattgtaaataggaaagcgcgctcatcacctttcttcaaaataataaagatatctttgcatggaaaccatctgatatgcctggtattcctagagaggtgatcgagcactctttacatgttaaggaagacgccaaacccttcaagcaacgactccgccgttttgcacaagacaggaaggatgcgatcaaggaggaattaaccaagctgttagcagcgggcttcattaaagaagtccttcatcccgactggctggctaacccagtcttggttcggaaaaagacggggcaatggcgcatgtgtgtcgattataccgacctcaacaagtcttgtcccaaagatccttttgggttacctcgcattgaccaggtagttaactcaacggccggatgcgagctactcagttttttggattcttactcgggatatcatcagatccgactaaaagaatccgactgcttgaagacctcatttattacgccttttggggcctactgctacatcaccatgccctttggattgaagaacgcaggagcaacctaccaacggatgatttagaggtgtttttcaactcagatcggccgcaatgttgaagcttatgttgatgatgtagtcgtcaagaccaagaagaaggatgatctgattgcggacatagaagaaacttttgcgaacatccgcgccttcaggatgaaactaaaccctgaaaagtgcatcttcggagtactgtcagggaagctgctcggatttatggtgtctcgtagaggcatacaggccaacccggagaaaatcaacgccatcctcaacatgaaaccgccgagctcccagaaagatgtctaaaagctgactggttgcatggcggcgctcagccggttcgtctcacgactcggcgagtgggggatgccctttttcaagctgctgaagaaaaccgacaatttccagtggggacccgaagcacaaaaagccttagaagacttcaagaaacttctcactactccaccagttttggcctcgccacatccacaggagccgctactgttatatgtgtcggcgacctcccaagttgtgagcacggccctggttgtcgagcgtgaagaggaaggccatattcaaaaagttcaatgaccaatttatttcgttagcgaggttttggccgactctaagacaagatatcctcaggttcaaaagttattatatggtgtcttaattaccgtcaggaaattatctcactactttcaaagtcactcggtcacggtggtcacatcgtttccacacggggatatacttcataaccgcgaagcaaacggatggattgcgaagtgggccttagaattgatgtctttggacatatctttcaagccacgaacttcgatcaagtcacaagctttatctgatttcctcaccgagtggaccgagtgccaagaagacatgccggaggaaaagatggaatattggactatgcattttgataggtcgaagaggcttacaggcactggagctggggttgttttaatttccccgaccggagaaagattgagctacgtattgtggatacattttcctgtgtcccataacgtggcggaatacgaggcgctgctccatggattaaggattgcaatctctctaggcattcgccgactaatcttccgtggagactctcagttggttgttaatcaagtcatgaaagagtggtcctgtcttgatgataatatgaccgcttatcgacaagaggtacacaagttggaagataaattcgatggactcgagctcacccatgtcctccgacacaataatgaggcagcagacagactggccaattttggctcaaaacgggaaacagctccttcagatgtgttcgtcgaacatctttacgaaccaaccgtgcccagaaaagaaacaattgaagccatggatactcaaggcgtaagcatgattgaaaccgactggagagaacctctcataagatttttgaccaaacaagaactccctcaagacaaaaatgaagccgagcagatttccaggcgcagcagactctacgtcattcacgagaccgagttgtacaagaaaagcccatcaggaattctgcagcgctgcgtatctttggaagagggaagacaattgctaaaagatattcattcaggcatctgtggtaatcatgctgctgcacgaaccattgtcggcaaagcttatcggcagggtttcttctggcccacagctgtttccgacgccgacaaaattgtgcgaacatgtgagggttgtcagttctttgcccgacaagctcacttaccagctcaggagttgcaaaccatcccgctgtcttggccgttcacggtttggggtcttgatatggtcggtccattcaaaaaggcagtcggtggttatactcatctctttgtagctgtggataagttttccaagtggattgaagccaaaccagtcatcaaaatcactgcggacaaagctagagatttcttcatcaatattgtacatcggtttggggtaccgaatcatattattactgataacggcactcaatttaccggcggagtatttaaagacttttgtgaagactttggcattagaatttattacgcctccgtggcacaccccatgagtaacggacaagtcgagtgcgctaatggcatgatatttcaagggatcaaagcacgagttttcgaccgactgcgtccctatgctggcaagtgggcagaacagctgccgtccgtactttggtctttacgcaccactcccagttgggctactggccagtcgccgttcttcttggtttatggcgcagaagcaatgctgccaagtgaggtagagtttgaatccctccgatttcgcaacttccgggaggagcgctatgaagaagatcgagtggatgatatcaaccgactggaagaagcccgtgaaacagccctaatccagtcggctcggaatttacaagggttgcgccgttatcataatcggaatgttcgatcgcgagcccttttagtcggcgacctggttctgaggagaattcaaactacacaggatcggcacaagttatctgccttgtgggaaggaccgttcgtaatagctgaagtcactcggccaggatcttaccgactcaagcgtgaagatggtactcttgtcaataattcttggaatattgaacaccttcgtcgattttatgcttaggcatttcgtttgtatctttcctctttgactactaacttcaagttttttccttgaagctttcagtcggggggatgctataataataatggaacatgatttttatcaattcaatttgcttacttgatttatcattgccctgcttgattttttggcttagtcaatgaggactgaaagttttttaataacttttgcgagttctaggctcaataaggtttgacaaacacttttaagaaatcagaggctaagttagaattgtctagcacaacataaattcatcagtattgtacaaattgatcttccatcatcatcagaatcactgttactaatcagtgtcagttctttcatcatcggaattatcagacccagtcggccgaaggtcggcatcttggaatctctcaactacgtcagcagcaatcttgtcagcagctttttgcgcatcattgatgaggtcgagggctgtttcttcgctcgtcccgtctgcaaacccatcaatggcgtcggtatcgattttggggtataaagatttggtcatggctaatgccatgcttgctcccatactcccagcctccctgatattcttgaagtaagtatccagagcgactcttagcttgtcaaagatctcggaagcgtcaagtgtactcggaccggtgttattgaagaacatggcttggatgagtggggtagcggcattagcgactttatccctggctccttcaagcctattgatcttgtcaactaagacatcaaactgtgcctgggacttgattttgcgatctgcatcaatagattcatatcagcgaacggctataagaacatggggaatcaattatcattaccttcatcatcttttaaggccgagtccctctgctttgctaattcggccttgtctttctccagagccttgacctgcttctctaggtcggaaatcctagcagcttgcactgtaatatttttcggttaattgatatcacaaggaaggcttcacgaatacgtcagacagatatggtatttacctttggacgaaccactcaattcatagttggattcttgaagctcggagattctattcctcagatcatctcagtttttctcgcgagctccttgtcctcatgtagctggtttttagtagattcgagagttccaagatggggaactaatttctcaagagttgtggttttcgcctcattcctgagatgaatcctctgcaatatgaatttatcggcgtttcagcaagatatggaaggggacaattaaagctatgcacaaatggacttacatttacaatatgagtggcctggctgagtgtcttttttagcaagcatacttcttcatcttctttctgcttgcttatcacgatttcttgaggttgcatatcgtcgtcccaccacttaattaggatgggagggcgcgagtcttcagccgcctgtatacggggaatttcttcttcatcaccaatcattggtcctaatgtatccacgtataaaggttagacgattgattagagtcatttggatcaacacggtttcgggcaaggtgtttacccgtgatgatttccgaacggggacgagtcgactcttgcgtcttaacgggagattctggcgtcgggtcactgctggtgtcttgtttatgagggttgtctgcctgagctccaacttctggaatctcttggcttggtctagtgcccgactggttttctatcgggggctcctggttaaccccggctctagcctcggccgactcgtttccggttgggggttgatcaccagatcctacattatcggttgctggctggttatcactcggatgatcctcagcggttggctcggtttcttttaagtttgttcccgtgctggtcgggtcagagtcttttcccgaaggatctatatcagatggtttcctacaagtttggttatcagtattattactacactaggtacacatcaatgcaaggaagatcgttatgtgatttgtacctggaagacttcctgatctttggcactggatgactggatgtttttttccttggagtagcctgcttcggcagtttcttggttgtttctcggtctccaggctttctagcggtatcgccttcgtcgtcactcgacaccaacttccttttgcgcgaatctggctggccggctggatcggaggtatttggccgggcttcggaacggattttgggaccctcgctcccttgaccggtttggtggtggggtgatcggcgttgagtgattgggggatccgacttcatcaaagcaaattcctaggcgtaatatccttcattgttaactaattcaacaaacagacaagaccatattttgtgaaaggttgaagtgtttgattacataccggtggaggaggattgaaggcattgaatggcacgactggcagcaagtgcgaatagctgacgatgatggcatttgagaagatcttgtacatcctttccttcatgaccttaaagtcaagagagtctggatcttcacgatttggatcatgtttgctgtcaaactcaaaagctgtgcgggatctctctttgattggagctaaccggctttttatgaagtgccgcgtgatttgttctccttacaaaccctgctcctttagctttatcatgcgctccatcagttccactgcttgggcagcctcatctcctgtaggcaatgaattccatgtgtcttggtagaccgtagggagacaagaatactcgggaagggctggttcaggattttgaacgtagaaccagttggcgtgccagcctttgtttgaggtcttcaagggcatggagaagtatttttggcttagtgttcccctgagttggaaaccagcgcccccaacaacacatggtttgctcttgtttggctggggcttgaggaagaagatgcggcggaacaaggcgaaatgaggcctaatgcctagaaaagcttcgcaggcatgaataaaattggagatatgcactatggagtttggattcagatgatgcaagctaatcccgtagaagttcagaattccccggaagaatcttgaggttggaagagaaaatccgccatagaagaagtgagagaataccacgatctcatgtgtatcgggggtcgggattgcctcgccgaacgctggtcgccacccgatgatttccttcgccggaagaacgccgtgcgccaccatttcttttagattctcttccgttacatcggagggagcccactgactctcgaaactttctctctcttctgccatggatgcaagttgaatggattgatttggtccaagatataggtggaggggaatgaggaatcaatgcggtggacatgcggagaggtttcgtgggattttttgagaatggattggggcggattgatgaaccctagctttgacggtgcggtttgatactgtagcaaggagtggggaaatggcgagagtctcggcggggaaaacgaagcgccgcttggactttggtactttgttagggtatcgggagtgctaacaggcctaggcctgtacagtacttcagcccaatattattaccagcgtggcccattgtgatccttaggaacttaggcactttttgctttagcaatttgtgctcacaatgatgtgacccgatgctgctaaaatcctttttaatgcgattagataattctttagaattactacgatgcaaataaaaggtacccaacagaaaagtgttatactatttttgtaagcttttttaggctacaaaagctgtttgggttaatttgagatgactggtttattagtagtcattctcttagcatgttatatgcttattttgattatggaaagggttatagcctaggctattaaacttcttaattaccatgatctttatcatatttggtggatcattttaagagtttcctactcggattcttgtcaaatgtgtctttttgtggaccttttaagtgtttctcgctcgggcccttttcatatttttattcttgatatattcaagtccaaaagcagtcggctgggtattatactgaatactacgtgtgctcttgtcgtttgatgtttggttgtaaaaccgctcggttcttgactacctgtttagtttttcaactaactatatagtcgggggctatacctaattaggtgcatctactcgatgcaccatgttttatttttgcccttcacagtctttgattctagtactcggcaggctaaagcaggaagaggtgaagcactcggattattgttttttgttctgagatggctatttcggcgactgcaaaggtctcgggggctagtgtggagattatggataccccatatctacatggcagttatatttcagctgggtacagggtaccgaatatagatagaatatctttatgaggactcgggttagattctaaacttgtatgtcaaggaaatacccgggatcctagttggttacgattgtattttatctataatcccatattccgttgggatatggactgtattttgtaaagcggaccctttcccctatataaggaggggtccgtgtgcctctcggggcacgattttttcctagataatacgatcaataatacactcggcggaatcatccccggacaggagtagggtattactttttgaataagaaggcctgaacctgtataaaattcctcgtctccaaacccatccactttcctatcttgatagccaccccttttattattgccgaaatcttgcttcgacaaaattgattcaggagaggaagggattagtgagtagattggaagaaaaaaaaacggccattcatactcagtggtgtgtgtggaggaggaaggtagagaggtcaccagaagtttgagaaacggattcagctcatcgaggtagtttcatttttggcattaaacagtaagattgatgagggagatgataggatgggtgatgggaattagtggatacgttgctgctttcatggaggaaaaacgtccgaggattgaagacgaagcagaagcggtgtggccgtgcgtgggcagtggggagtggggaggatggcggcttgggttgggctgggctggctttggcctgtgtacagaggaaagagatcgttagaaacgagagatcgaagagaaagagaaacaggagagagagatatacagagaaattgaactaggctgcaataatctctactgctttaaaattccgtagtggtgatggtgactccaaccctaacagacacatgtgatattatctgttggatcgggatatcggacggtgatcccatcgcacgcgattcgcttttctggctttcctcccccgcgattcggtttcctcccccgcatcgtgcgcgtggctccgtcgcgtcgctgctgtctcagccggcccacgcacagctccgccgcctgcgtcggccccgcgtccccgtgtgcccccgccggcgcacgcgcagctccgtcgctgccaatggccgcgcaagcctgcgccgcgtccaccaccttcgatccgtcggccccgcgcacccgcgcgtctccgccgactcccgtgtgttggaattaatagataggccttaacccattcgaagattaattctttggtaaattacaaaaacccacctcatgggatgacatgcatgtggaatttagtaccaccttgcttattctaggagagggggacctccttaaaagagaggatgcctcctagccacttgaagcatgtgtggtggagagaagagggggaacatgcgcgcgctcgctcgctcgcctggcagggtagagcaggcggtgcgtgtgtacatcgaatggtccgcaaaattggctcctcaaccttgtgtagatgtagcctccttttgcagttttgttttgctgcaggaaattcggatttgttttgttttggaaacattctgaaaaatccggtgcgtgaaaacggcgtggggtccagataagttacgcgcgacttgtccggttcggttacgcggagtggagatcgtgcgggcgccctgatcaagcgacctatctctatataagccgagccgccgcattcacgcaacacacgcaaaatcaatctaggtttgcctcctactctgtgctgcgccgtcgctcgtagactactccatcctccggcgtgcaccggcgatcgggggagcaggtctcctgaacctctgccttcgacgtcctgcaccgggagaaggcggcaataaggtttttgcgaagcgcttcgcgtgactgcacccctgttcgtccgcgacggctcgccttcctctcctctcgcgtgctgcgtgccttcatcgacgcccgcaaccgcgagtagttcctgccgagtaaccggtctttccgccacctcggtacgtgttcgatatgttgcacatatttaatctgtttatgttttactgcttagtttacatgcgtagatctaatgatgcgttcatgctagtttatatctgcaatgtcatgatttatttatggaataaattaaatcattatgtgcttataatttcaacaccgtggacccgcgaggctccgtggcctccacgtgatccctcgcgcctccgccgactcggtcgcggctccccggctccgccgcctccgcgtgggcaagccccgcggtcgcctttgtcgcgagtcgccatctccgcgtcgacaacggccgaagcggtttccagccccgtgtggttcggttgcatgcacatgcatttgattcccatcctgcgagtgtaagtgccatgcacgggcgcaagctgcatgcatgcgcatggcactgttcatgacgaaaaaaaaggaagaagaagaagaaggagaaaaggaggcaagaaagacagcacgactctgcgctgcggaagcggttccgcatcgtgcgtaatcgctaagcggcctacgccggcctcgctgcgtgaggccgcccccgcgcctacggccaagactccgcgggccacaccctccgccgactcgcgcccggcgccagccccgtggggcgcattttgcctctggctcggccccttccgctggaccacgccacggcgcagaggctcgcgccggcggactctacagtccttccgctggccccgcacagctccgccggccacgcctgccttaaagccaagctccaccagccacgcgtggcttcgcgcggcacccccggcactcgccttcgcgcactacggacggcgctgcctccatcaagcaccgcggctttcaccgctagaggggatggactgacctccatttctcgcgggctctggacggtggtacctccgtcgagcaccgcggctttcaccgctagagggggtggaccggactccacatctcaagagctcaagacggtgtcgccttttcagtgtggtctttgctgagcatgagggtatccgatgcaaaatgcaggcatagatcaacaccctaagaagcaggggctggaaatcatctgctccccccgaacctcggagccagcagatgagggggtattgttgaggaataaccccatacttagggtgttgtataaactaatgtataaaaggactaaaatacatctaagaggatgttgtatatatgtagccaatcaagagcaaagatgtaattttcttttacatatgaataaaaggagtcctccaagggcaagtgagagggatctctcccccattccattgattctctttctctctcattcactcttgtggtcctcatagggctaagcttgggctccctcccattggagggatgctctagccatgcatgttggattttgttccaacacctacattgttacattgttcaatatatataaagaatatcatttcacctttttatgcaatatataaacgatatactttattaaacccgttgcaatgcacggacacctaactagtaagaaaggaaaaaagaaaagaaaaagaataaaaagagaggaaaaggaaggaaaggaggaacaagaaggataataggattttctggaaaaatagaaatttagagattttggactgttgaggaatttctctggattgagaataaatacttccaaaattgagctccactcccaaaactcaaatagaaaccaaataactctaattaacaaacgataaaataaatggcggtgtgattaatttatttagtcaaattaaacctttttcatttatgaaatttccattaagctattttaggcaaataaacacgaatgctaattttcaaaattaagtaaattagaagacacgacaaacaggacctgataaggtgacaatatgtagtagtgggtcccacctaggacccaccataatacccacttgagcattatacattgctgttgccctaaaaaaatgaaggaataaggatagctgtgaagtccaatcctatgggaagctaaacctaaggaattgtaaaaaaaatgtgcattccgatataccataggaaaaatgtaggaaatctgccatttgaaatatatttttttaagtttgcatcaactgacatcgggcctcatctagccgttagctttggagtgcataaatagctctagttagccttgtgcaccattctcccctgttctttctatttgctcatcaaccgtgaaaaaccgtggaagaagcttgctgatcctttcttcttgtcacgcccagaaatttgctaacccgaatttcaagcagaatgtgtattaaaatctctatctaggatcagccagagtagacaaacgacaatttgataaacagatccacgccttacaaaaataataaataattcttacaaacgcagcggaaaaacaaataagctagacttaatcttcatgaccaaaagcatagctttctccataaaccacaggcatcctcaacgtccggaacaagctcaattctcatagtccggaacaagctcaattctcatagaactcaccatctgaaccaatctctgtctctctctggggtggagaaaaataaagcaagactgagcaccaaccaccatactcaacaagtcataccaacggaaatgcatgatgtaagatattcacaaaggaatggctcattggatatttccaataaaagcagcatttataaatcatattttgaataagtaaaacaatatatgtaattaagcaatattaaatcatcactgttcaacgctaaa

SEQ ID NO: 1584 - DNA, 3129 bp, Oryza sativa
  unsure (1)..(3129): unsure at all n locations
ccgaaggaacagaacataggtacgtacatacaagatacgacaaccaaaataaaacatacatgtttagtactgtcaacaagcaaatatctacaatataaagatgaaatatattatcccacaaatatatacatgcagttgaactaattttaatgtcggttttcacttgatggatccattaactatttatgtgttattgatttttaaattaatggacatattgttttatataatataatatctttctcatgcatgtacataatgtttgccggaagaaaaaaatatatgcacgtacttactataaagataaagccaaaataaaacataaacataagtacttaggccatcgaaaaattgacggcggtctttcaaatagaactatctacaatataaagatgaaatatattacttcataaatatacacatgcagtgttaaactagatctacaatataaatatcaaatatcaaatcaatcatctttaattgttcatctttaaaaaaaaaattaaatgatatatttaatttgtgatcttacaaacactcctaaatcaccatgtggcgctccaacaaatgctgttaggtcgctacgtggtactgtataatctcagcatcgattttcatttaaattggtggaccgttattatagaccattagattagatgtatatatactaatactaactgttaaaaaaacataagtacatatacaaacataagtatgtacctgagattgaaaaggaaataaagcttcggtagtactattcatagcaagaaaaaaactatctattatctatctatctatctatctatctatttctattatctattatctatctattatatattatatactaaactaaaagtccattaaacttcctaaaaacgctctgaaaccgtcaagtggcaccctataaacactcacaagtcgccaaatggcacctaataaataaaagaaacccaaccatccatttttacttaaatcgggtggattcattattttagatggttagatatattttgtaaaaagaaaaaacatccggagccaacatccaaaccaacgtacaaaagtacgtaatagttttagattatatactgacgaacgtacttactatacgtacatccatcttttccttccttattttctttttaagaagactaaaataaaaattacttttaacaagcaaaantagaaagattcagccaaaattaggaccaactactaggttnctaggcattctctacccatccggtcacattnaaaaattcctaatgaatgcctcttaaatcactatgtggntgctattaaattggagaaagtactagaaaaaaaatacaaagcaatcgaccaccagtttctacttaaattgatgcatttaggttgttatatattttttaaatgaaaaatccgtgtggtggtaaaatccattaaacattttataaacacctctaagctgctactatatgacattcttaaattaaagaaaatcttagaaatttgagaaaaaaaatactattatatactaaaagtccatgaaacagcctataaatattgctaagtcgccaagtaacaccttacaaacgctactaaatcgtcaagtgatactataatttgcccattgatttttaattaaatggtggatctattatttcattttcgaaggttagatcgttttttcttttaaaacacacatatccacaacctccctctcaagtacataccaacaagccttcttcatgagaaattaaaatcaatattatttttacattaaaataccacatatctccacccgctaggtctagcaggtcctgatctgtcattctaaacatgctacaaacacttttaagatgctatacgatgctattaaattaaataaaatactagcaaatattaaaaatgaacaaagcattagactatcgatttgttagtttttctaataagaaaaaactctaagttggtatatgaaattcttaaattatagaaaattcttagaaattttgggaaacaacatccaaccataggattagacataaatcgatggacacattattttcaatcaaataaaacattattttaggtcactagatctatttttttttaaaaaaaacatcttataaacgctcttaagatgttacgtcgttatcttaaatcaatgaaaatcctaaaaattctgataagaaaacaaagcatccaaccatcggtttcgacatgaacatctgacacattattttaggttgttatattaatcatttagaaaaaacattccaaacctccctccctccctgcctgtagtgtacagcgtgcgccattcttttgtctctgtttttttatctcctagacaattaaaattaaaattatctatatgggaaaaaacacaaatggatctccatctattacttatatcacgttaggcatctaacaactttctaccaattgaattaatttctcttaacatacatatgagggctacacacctatacaaattgaccttgatactttgttgttgcatttaaaacacatacttaatataaaaattcaaatatatttatgaggactgttagaatgataaatataaaattttaaaatacaatcaaacaaaaaaattatattatttgatttgttttgggttgtaagtatcaatctggcaagttaaaataccctaaattttctgatagcaacaacctcctttttttttcgagataagggaccaactccatagtttcgacacaatatgttcttatcaattcaaaaccacatgatttcaaataattttattttataatttatatgttgaaagagtaattataagaaaataccagcgttcaaagaatacaaaataagtttaattttagtttagaatataataaaaatatttcaataaaaaaccctgcacataaatattcataataaaatttcactcacattacataagaaggtgcccgcgcatgtgcgcgggctacctttctagttaatatattaatgcccatagatagatggactccttaattgtgtttcatgcatgcttgctgcttgtggcgagggtagtacaattcggaattcaaagacacatttgttttctcttgtttggagaatacaagtcagagaatttgagtgatccgaaggtgctcacggttc

SEQ ID NO: 1585 - DNA, 1709 bp, Oryza sativa
gacacatttgttttctcttgtttggagaatacaagtcagagaatttgagtgatccgaaggtgctcacggttcaaatttctcgtgaaaagtttaggggtatatgcattgttctgatacttgatcagttaattttgtgtgagaatggtcttcaggtgatctggaagttttttgcttctgattgtagcaagtaattagtagataaaatcttcaggaatttagtagatgagattttttttgagaactcattttctagtcttttatggaaatgataagtttagccgcaatccatgtacaatacgaacataattgagattcccgatatgcttaaatatgaacttaattgaaaaatccttattattcttatcattttctcatcaatctttaaatatgcttcataacttggatttgcctaagattaattcccagagtttagtgattcttttgtgcttatctctctagatcgtttttgccttcttccagtgcagttcaattgctcaagattaaattttgttgttgtgctaagtgcaaaattgtaaataatttgtgtgctatctatagtactgcttgtctgaattgatagataagtggactaaactgacttttgctattactaaatattcagtccatttacaatcatctggatccaatggtggccattatttaaaatgtcagtgtctaccagggttcacaattttggatctgaaatttcgataattatctgtctatcggcccccaccccccaatacgatataattttggccgaaatttttaatttttttcatttttttcgtgaatttgttaatatgttgttcaaattttattcaaaaatttataaaattttggaccgaaatttcggtatttcggccaccctcgatacaaatcagcaaaccgaaacattaaaccctggtgtctaccatgtcagaaaatggtatattggttcagtctgtagatcttgttactccatagagatgattaattattggggcttggagaaattttttgtgtttcagaactgtttaagtgaagctggtatctagtgcttcagaatgctgaaagaactactgcattgcacccagcatgtgtgatatccaactatgttagtttcatgtccacatttagttctgatgcagctagtctgaatgcttaggtcacttaattaaagcatgggttttccttgctcaagcacaatcctttcttcctatagaattggtacccactacatatcattactgctataaagcagtacaggaataagccacatcatcgagggattgcagccgttagatctcatccgagagataattctagccgcgcgatatggttccatcggccgtcaatctcaggtgtgcgttcacttattgcatggttgggccaagccatggcccatttcttttctccagttggcccatcactagtcctttcttcctatataattggtacccactacctattattattgctataaagcagctacaggaataagccacgtcattgagggatcgcagccgttagatctcatccgagagataattctagccgcgtgatatggttccatcggccatcaatctcaggtgtgcgttcacttattgcatggttgggccaagccatggcccatttcttttctccagttggcccatctctgggcacaaagatgcaaggcgatcactgctcaacccaccttctaaagccctaagtccaatggcgcagct

SEQ ID NO: 1586 - DNA, 37866 bp, Oryza sativa
  unsure (1)..(37866): unsure at all n locations
aagtaacttagtgaaatctaaaagtaatttagatatattacaaaagtaatttatattttttttatcaaaatataatcatgtgagatcttgttataaagatttaattgttacgaacacaacggtgtaatcggattatagatcggatgagtagtttaagagaaaattgtatttgaagtgtaggtggatagtgtttattatagatggagcggtagctggtttaggctgtgtagccatgtccttttccgaagcagaggaggcgccgtgacagacgtttcagattctgaaacggacgaaggcacacgaagagatcagaagtattgagaactggtatgccttttattccccccacacatcacgatgccttcttccagcaatggcaaccggacctccgatccaagcccctggtcatcgactctacgtatgtgggcactcggagaaattcatgtctattattttgctataatcaagttttggttctggacttctggtctgagttatgcagattcgaattggattgcctgccggtgggtgaggtaactctaaaatcgtacgcacataatatacttgatagagtgcctaggtttccatccttctcgcagacaatttcttagcttggcttttggacttcctctgctgccgcagacacttcacagttcacaccgtcgtcccagtcaatttgcatccagtgttcatgaaggtcagatcattccttggattttcttttgtcgcacaacattttctatgtgatacattctcattcttattgctatcagagtttgatttttccacagtcatcatcgcttcccctaatctgtggagtaataatgatctttcatctaaaaaaagattcactattttttccttctgctgtcagcttggttttggtagctaatgttaatattcttttcttttttcaagttggctaataagtttagcaattaaatctttccctttatatatatcttactccctcctttaagtgtaaccatgattttttatgcacaactttgactgtccgtcttatttaaattttactattcatattttatcatcttataacaataaaaatattaattaaataagataaacggttaaaattaagcacggaaacttatgattgcacttaaaatgggacggatggaacttaaaatgggacggatggagtatatttttatcttgccgacagatggagtatatttttatcttgcccttaatttaacaatggatcatggctgatccgagatccctaagtatatatcttcgacgcagaacagcagaacctgcctgcttctcctgtagcttcactgttctcacgatacattgagtaagttgatcccaaaaaaaaaattaaatgattaatcttccattgcagcatactaatactgagcggtttttcttttgtaaacatgcatcgagttttacataaagcaatcatctgcattgcctttgctttcttttatgtttttcatgcccagttcttagtgtgtgcatctttaaaagaatggtagctatttggcatgtaatgttccacagcaacgcggctgagtataactagttttatgtaattgttcatgctaagcatctagctcaccttgattactaaaaagatctttgttcatgacccagagcaaactggctattgtgaaggtaatggggtgagtgtactgggttcttggatcaccagacagtctcatcatgagaaacgtcaagggcctaatttgtgagggtgtggcatcctcactgtcacgtccataaatttaacccaaattttcagataattttgtgtattaaacccctgtctaggaatcagccagggtacatacacaaaacaacaaattaatatgcagatccaaatgtaaataaagcgtaaaatatttacagaataggcgcttagtcctcacaccgaaaagaaagtagcaacagcagaaaaagatgatcctagcggggcttcagctccactccacaggcaaaactcaattggggtttgagccttagtcctctacttcgtcttcagctcagaagcactacacttctgaaaggggaaaaaatagtaaggctgagtacctccaccgtactcagcaagccacaccaatgatgcagacgtgcaaggggagacgaagggaggttttgtggctatttgcataaaggcagttgtaaaacattttattgagcaaaacagtaaaactattgattaattaaggtaatattaaatctccactgatcaatgctacaccatgttgaacaggcccaaccatcccacctgaactaactagttcattaagccaatttattaagggtgagactaatcacggtgaatctggtcgatcgcccataaccgcgggcacggctattcgaatagttttactctggccagaggtgcacaactgtacccacaaaacataatccaccggcatgtcactgtgcctggctagacacgtcaccatgtcaagtgattgtggcaagacccttcacataaccctcccctaacaatccacaccacactgatgtttcacccccaccccctaccccagagttgggcagttccctcgtgcaccgtggtgaatccagaagctggacaaccggacacctcggccgacccaactccattacgccctccctcaccatcggtgcctaggaaagggttgagctatactacaagtcaagtagttacccactctcgcttgtggtaaaagcactgtaagtcttccagggtttcccgtaaaccggtccttaattaccatgggtgcgactagcgaaaccgtacactcacagcccaccatcaagtcgtattttaattggataattacgaccaatgaaacatggtcggatgtctcgagcacgcagcctgtcaaaatactagatgtctaataacgtaattatcttattatgtgagctagtggtaattaagcatggctaaacatatataattctagctaggtcacataagtaacacaagctaagccaattatcaccaaagtttagcaaaggatggatatcaagtaaacgtggcacaagcgagcagataggtaaacccataatcccatgtaattagcaagacatgcaattttaattgcaaacaataaaacatttataaagtaggctcaatatgctcaaggggaatgtatgacttgccttgcttcttcaaacaatcttctgaactctttcctcgcgaacatgatcttctgaaacggcggaaactacacgctggcacgcaaaacgaggaaaaagtctaataaaaaccaagtaaatagtaaataaaaagtaaactaacatgtagacgtaaattttagatgaattttgcaagttgaatggcccaatttgaagttcgtatgaattagttatgaattttacaagttttgagccgtttaaattgatttctagaattattattgatttattacgcaattattaattatttttccaaaggaaaaggttatcgctgacatcatcgaaggggaggccggcgccgacatgcatgccccgcacgtcagcgacacaaaatggcggccgcacggtggaccaagtccggacgcgcgcggcctggcggcaccatggacctggaccataggtggtccacgggcgagcgaagcagcgccagccagctgagaggcggcggcgcgtggccggacgaccacaggcaacgagaccgggacgagcggcgccacgggaagcggcaaaacgggagggggaggaggggtggaggaggagggagtcctcaccgagcgccaaggtggcgagggagtgatgggtggcagcggtgtctcccgggaagatgacgcaggcggcccccggcgacgaccggtgggcgtggaagggtggccgagcacctcctcgacctggccaaggggatggaggggttagggagagaggaggaggtgcgaggcggcggaaggtgtaagtcggaggggagaaaaatggtggagctcaccggtgaccgagggaacatgggtttcgatggggatccggcggtcgaggtgcggtgggatgcggcgaacgcggtggatgtgttggcatcgcgtgtggtggccgggaacggtggcaaatggtagccggaggcggcgaacacagcgacgacctcaacttcgcggtgaaaatggtgatttggctttgtttttggggcggaggagtggatgctggggtgcggcaaggcacggtgatgccgatgatgcaagaggcgcggcacggggacggtgggagctgcggcagcgcgcggccggagaaggtggtggttcgggtttgtggtggcggcggggtttcaatgctgaggaagtggtggccgaggtgcggcacgcgacggcgaagccgtcggtggtggtggcacagcgcggcgacggctatgccggcgatggcgtgcgatcggagcatgctggcgagcggcggcgaagcgttgggcgtggggagcaggggagagcgcgaggggagcttgggcgaggaggggaaatgagagaggatggctgggggatgctttttatagggctcggggcttagaatcgtggccgagaggggcggagtcggccgacaacgtggcggcgggagagctccatccggcggcgagatttggggaaaatttggagaagtggtggaggagtggatggcaaccacgttcacgaggtcggacgcgagcgcgggatgggggaggtggcggatttggctacggagtgggcggcaatggcggtttccggcgggtgataggaggttggggatgacagttggagccacgagtcccacctgtcaaccagagggagagaggaggttggtagagggaggcaatgcagacttgaggagaatggggagccgagcgggccgaggaggggaaaagaagggggagggggcgagggagacaaggatggggttgggccgaaaacggcccaaaggaaggaagggagattttgatttgttttctttttattttaattgattaaatgaactttgtgatgctaaaattacttcttgagctctgaaaattcacgggaaatttcagagagtactttagggcacagagaatattgtgaaaatatttccggccatgattttcaaaggaaaattttaattccctcgttatttcacttgattaaatgctttaacttttatttaaatcctagaaaatgcattatttaatgatttttaatcccgaatgaaaatcagggcgatagactcaccatgcggcataattgaagatactgctacatttttgcacaaatttagacatgtttgtcgaactgcggttatctttgagctgcattttggataaattcagacatgtttgtgaaatcattgtctttgagctctaggccttgacgatactgcaatatttttgttttagtgattattaatccaaagtgcaattctcgcacggaggcatcagacatggttacgttagctgaattgatgcacgcatgtgtgaaatccctgccaaaacgagcacatggttttaagagaggggtttgaaaaatgcaatggattcaaaccccatagggattggtgtcacgaaccgcgacgaatcaccggcgtctcgcctagcgatttggtcgattttggaagtttgggtgattttggggaagaacaggggaagtagttagtacagagtagagagagagatagttggtttttgctttcttcttcttcgatgattcagcccccaactcgaaggtctgaacttatagttgtgctttagcacttatatggccagcagccgcacgacccaatagcaacgacctaagtatacagcagaagtctaaaaggggtacacacatgagtaaaatagaagcagcgtgacattccctcccccttaacaaccagcatgtccccaggctggtgcttgtggaaaacgctgccgaagttgccgcaaattctcccacgttgccaagtcatcgggaagattagtccagcgaatcaacccatatggcacagtggcaccaccccgcttgatcaattgatgccgcagcaccacttcaggctgaacatgagcatcctgttcaacacattgcacaagtaagtcagaacatacaggagtacctagtcgaatcaccttcttgaggagcgatacatgcaccaccggatgtacgagactgccttcgggcaattccaggcgataggccatagctccaattcgacccaaaatcttgtaaggaccaaagtagcgaaagctgagtttctaacaagtgacaagagtgcttagcaactgacatctgcacatatggttgtagcttcaagtaaaccaaatctacaacagcaaactctctttcggatctgttcttgtcagcttgatgtttcattctctgttgtgcacgtaccagctgttgatgaagtaattcattcatctgagagcgctcctgtaaccaaacctgaatgtcaggaactgtgctcaaccccagatcagcaaccccaaaggatgtggcctttctagcaaataagacttcatagggggacttgcccagcacactgtggaatgatgtattataccaaaactgcgcctgggaaagccactgagaccattttgtctgacaggcatgcactgtgcatcgcaaatatgcttccagacattgattaagtcgttcagtctgtccatccgtttgaggatgtaggaggagctcatattgagtttaacatatgcaagtttaaataattcctgccaaagagcactagtgaacacacgatctctgtcagaaataatcatactgggcattccaaacatgtcatagatgtgttggatgaaagcttgtgtaacagtcaaggcagtgaaagggtgagatagaggaatgaacttgtcaaatttggtgaacttgtcaaccacaaccataatagtatcataacccccagactttggcaatcactcaataaaatcaagactgactgttgtccaagcttgtaatggcacagaaagaggttggagtaatcccggactcttacagtgctcagtcttagcttgttgacagatttcacaaccctgcacataatcatgcacatccttcttcagtttgggccaggagaacaagttcttgatcctgtgataagtggccgtgacccctgaatggcccccactccactgctgtgcaaggctagtaggacagcctccttagcttcagtgtggttgcctaaccatattttccctttatgtctgatgattccttggaccaatttgaaatccccttgcccatctggcaataaactcagttcagccaacaatttatgggtctcctcgtcctttgtatagccctcttgtatgatttccagccacctgggaatactcatggaaatggcagatgtttcttcttcacactgcctggacagagcatctgctgccttgttttctaggccctttttatactttatcttgtactgcaaacccatgagcttcaggaaagccttgtgttgtaagctggtggttaacttttgttcactcaaatggctcaaactcctatgatcagtaagtatagtgaacactgaatgctgtaagtaagacctccacttttgtattgccaacagaatagctaaacactccttctcgtatgtggatagggcttgagatttgacccccagtgttttgctgatgaaggcaatgggatggccctcctgcattaatacagctccaatgcccttgtcacttgcatctgtttccaccacaaattctttgctaaagtcaggtagtgccagcactggtgagttgatgagagcttgctttagtgcttccatagctatctgctggggttggagccactggtacttgacattcttctttagcaagtcggtaagtggccttgccagttggccatagttctttataaaccttcggtaataaccagtgaggcctaagaatcctctcagttgtttcaagttttttggaggtggccattgttgcacagctaccaccttagagggatcagttgctaccccttcaaccccaattatatgacctaggtactcaaggtgttacttggcaaatgaacatttactaagcttcagatgtagctgatgttgagccaggacttgcaaaacccctttaagatgctgcacatgcttagccaaggttgggctgtagattagaatgtcatccacaaataccaacacatgctttatgatccagggagcaaaaatagtgttcataagtccttgaaaggtagctggggcattactgagcccaaatggcataactctaaattcgtaatgcccttgatgagttttaaatgcagttttatgttcatccttctcctgtagcctaatttggtgataccctgatctgaggtccaatttagtaaaccatttggccccggccagttcatctaacaactcctccaccactggcattgggtacttatttttgacagtgatctcatttaatcccctataatcaacacaaaatttctaggtgccatctttcttttttaccagcagtacaggggaagcaaaagggctctcacttggcctaaccactccctactgaatcctttgagctatctgtttctctatttcatccttctgagcaggggaatacctgtagggtttcaaattgactggtttcacccctggttgcagaggaatggcatgatcaaatgccctgtgaggaggtaaggaatcaggttcttggaatctatcctaaaactcagttagcaccaccttaatgcattctgggacttcttccaccgattcttcagtttcctcaattgcacacagttgcaatagctgtgacacagctccagatttagttagcccatgcaactgtttagctgacatcaacttgcaatgattcagttggtccttaaccccaaagagtgtaattcttttgtcatggtgagtgaatctcaacttctttctcttccaatccacccacattgggctgaattccttgagccattccatccccaaaatcatgtcatagctccctaaaggtaagattttcagatctgtgacaagatttaccctgacaccaccattccaccttgggactcatcttagtacacaacatcttccctccatcagctatagttacctgtgacacagctgtatcttccactggtatgttcagcctttttatcacactctcagacaagaaattgctggaactccctgagtccaccaaaatcaagatatgttgcttttgtattagcccttccaatctgatagttttcctaccagtaaccccagtggctgcacactccgaaattaccaattcttcatcactactggtttcaccttcctcctttactggttctccatcaacttgaagttggaacacctccaacaactcctccagaatgtggagttgtactgattttgggcacttatgacaaggtccaaacttttctccacacttgaagcactctccctagctcttcttgctgccttcaaagattcaaacctgtcttcccactttggcttttcttccacttttttagtttcctctagaactggccccaatatacctttcccttgatatccaatcttcccaggtgccgtattagcctccttgaaactccctctggtggaaacatagaagttcttcttcccagcttcagctatcagctcctcctgtattttggcgagagataacgcagcatcaactattctcggcttatgtagcttaatagcaaatttaatctctccctttagccctccaacaaaatttgtcacaaaataagtttcatcgtaccctttgttatacactagtaccctatgcatcaactcctcaaacctcttatggtactcgtctacacgcccagtttttgtaaaactctctaactcctctaagtggtcctgatatttatctctcccgaacttactatgcacagctacacataactccgcccaaccttctacactgtgcaactcctcataggtctgtaaccacagcgttgcattaccaacaaaatgcagcgttgcaaaggaagcccacgtttcaaacggaacttgatacatgtgaaaatacttctcagaattggactttcacaacttaggattctctccatcaaattttggaactctgtttttcgtaatctagtacccccatgatgctgactcccttgagactgactccgccatctctctgaaccttccctcaaatcgaaatgaatcggagagtggcggaagtgaggcttacccttgaccagggtatgctcctgagccgcagaggcatcagttgcaagaccctggtgattctcgaccttgccttgcccttcgggcggtggtgtcgctgctgttggtgatgccttcggctgggattccagcgccgtgatacgggtggagatcccttccaccgtcttgttcagatcccacatccccgcatccacgttcggaatccacgattccaagccccgcaaggtgcccaggatgttgttgtgactgcttgtgagttccgccaccttctcaccaagcgcctccgtctcgccttctgtcgccaccactctctccgtcagagttgggttccccatcttcctctccgtgttgcgcaaggaccgacggctctggtaccaaagatgtcacgaactgtgatgaatcaccggcgtctcgcctagcgatttggtcgattttggaagtttgggtgattttggggaagaacaagggaagtagttagtacagagtagagagagatagagatagttggtttttgctttcttcttcttcgatgatttagcccccaactcgaaggtctgaacttatagttgtgctttagcacttacatggccagcagccgcatggcccaatagcaacgacccaagtatacagcaaaagtctaaaaggggtacacacatgagtaaaataaaagcagcgtgacaattgggtgatatgggagggactcactctccatggatagattcctctggggtttagtatttcccaagcaaccgaacaaaaccttaaacaaacccatgccactggatgctttaagtttgcctaaccgtcaaccattgcgtgaaaattataaggtgagtcagatattcagaatcggagctgaaaattcttttggaggttaattttgttgcaagagtcagatagtactgttcttggtttgaaaagagaggtggttttcatttcgattgagctgaagacgacgtagtaccaacaaaaggagtatatcaatataatcgataagcccaactattaataacaattccagtttagcttttgcgtatagaagaaactaattaattaatacaagacataatttaattaactgatctccaatcaaatacttgttaattacattatatatatattctaacaagaaatttttgagagacatgtacgtgtgacctagctacgtatataagagctttaatttaatttttagttacatcctcggccttgcggttgggtgtattgtcgttgtatccgatgcccttcctcttggtcgggaagatcaagaagacgaagctcgacaagaacgccatgccaagaggcaggttcttgaggagctccttggtgttgccgccaggattctgcccgaagaagcagttctgcagcccgacatcactgaacgcaacggtgaggaacaccatcgccgtgaagaaggagtgcacgaagtccagcggccgtagtcttagctcactgtgactcaatttcttcgcttcctcctcttcccgggacatgttgaacacgttcaatccccgccgtgtcgccacgccgtagtagagcttgccgtcttggccgacgacgctgtccgtgaaggagaagaagagggagaggccggccaggacgccgaccagcacggcggtgagccacttgttggcggcgttgcactcgccgtggttggtgaaggacggcgacagcgcctggtaagccagcaccgtccccgtcggcagcagctgcgccaggttcgccgtgcttgccatcaccttgtcggtcaccgtcttcgtggccacatctgttttcgacgacgtcgtggactcatcgacggccttaggcgtcgacggagctaagttattggtcgtcaccgccgtggactcgccgttggtgttcgatgccatgttgatcacgatggcgcccggaggagatgccgccattgctggagcttttgatgcggcgtcgtagtaattaatcaactggtgaagactgaagagagatatatgtgtggtagctcgagttcctgcgcttatataggtgaaaacatttggaatgattccatgttgtgcgcgttgatttttctatgcttgaaactagatgggtcgtgaccattcatgcatggaattcagatcaactgagcaagtgtggtcagctgttcagcagtaccgatctgcatccactgcagtttttttctacctacatgttactactacatcttactccatcttggagttggagtacttggaaggttggaattctcgagatattttctcaatttacattgtaaccaacttggagcatcgcaatcgccaacgggctaaatttgtcttcactgtaccggtgagaccataagaaaatgacgtttttatcgtgccactgatgcatgccttttttttcctggaaggcgagaaaatgatttttattttcggtctgtgtgaagaactagggagtactctggctatttttttagtacaacttggccgtgcgcgaaaggtttatatccgggagtagagagaccgctttgaacctttcattttagatagaggaagatcatttaacaggaaacccagccacaattttttttttagccttacatgtaaagctcatgtatatattgcaatttatagttaatcgtaaaagacatgtgtattgatcacatgttatattttgcaatttatagtaatcatgtacaacactactcttgatatataggcgtgtacaatactactcttgatatatagtcgtgcagagaaaccatgtcatagaacaattcaatttagttctagtaaccttctatgataagcagtgtttaaagaccaaattgaattgttttaacatgaacttgccaggcaaatacaatccaataaaccgtatcatatactgtttaaaaatggaggtagtacatgtttattccctacaagaaactagaatttcttgacaggcaaaaactgccctaaaaaaacatcaaaatggccaagaaaacgagtaatattagtaacttaatttgttttgaccgtaaaaagttaactaaccgttaagaaaatcggatttgctataattatggcgataaattttcttcttaatcacagtcgaattttcgtccctacgatggtgcggacattcatgctcacatgggacatcagcgcacgcgttttacggcttgttttcgacagttcttcacgaatcacgatctagctatgtagctgcgcctgttcgcttccagcgtgagggtgaaaggcatgttgatatatgaccggtgggtaaaaaaacttagttatgtctaaatacatagctagaagttgattttttttgacggagggagtacactttagttacagcataattacactataattacatcataattaatattggttacatttgtaatttttattatatttagctgtaattttaatttatatgtggtgatcaattttaatttgatgtatttatttaagtttgtcatcttaaattagccttgtgttgtggaaggtgactgttttcttacctagatttatgttgcatgtcggataggtagtcccataaaaattctggattcttatagtgatatgaaaaatcacctatcttaagggcctctttgaatcgtagaaatgaaaaaacagagtaataagaaaaacgcaggattctgacagaaatacaattgtaaaacagagaattacaaaacacaggaatgaccgtttgattggaccataggaaaaacgcaggaatcagattagaaagatagactcggagaaaatttttcaacaggttaaaccttttgctaactttcctccaaaatgtatatagaattacccatttcataggaattttaaaggattcgagaggattcaatcctttgtttcaaaggacttcatagatttttttttttcaataggattaacatcctctaaaattcttatattttttctacaaattaaaggggctctaaatgtttatgtactggcagtacaatatgaagggcgccctaaatgtttatgtatttaaaatttttatcgggtttaatttatacatagcagatggaattaatttgtaattttaaattatgatgcactgcaagttttagagagcatttgcgacccatgaaaacaagttattatcacgtgcgagcttcccctgaatgcagtaaccatgtgcgtgcagtgcgtgcgcgcgtgcagactatcttaattaattgcaagggagaccccgacagtaggagtactaaattagtactgtggaggactaattaatttctttctaagccgccggaggcaatgccacaaacactaatctatcagccactagcaccaattgacagtgcaaactagggaaaaaaacacatgcgtgaaagctgacattgtaatactccggcacgaagaggccgaccggtctgacgaagtatatagtagtaataggcaaccaattaacccggccgaccagtcgccaagccgcgcgtggcacgaagaggcggctggctgacagtccgccgggcgcgcggttccggagaatcggtcgtcaatcgccgcgcgcgcgggacgtcgaccgatcgatcgacgtggatgactggcggttcgccgtggaggttataattaccttggatcgtctctgaaagggacttcgccgtgtgggaggaaagtaagatgcgatgagacgcgacgcgacgcgatgtgtagccatcagacccgtagtcgtagataaattccatgtatgtgtacgacgtacatgtgctcagaagaagcggacaacaaaatggaaaagggagaaataaacatcctagcatttgtctacggacaaacgttgtcactactaagtaagagttgcaggttcctgccatgttcctttcgatcctgaccagtcacgtttttgctttgacacaaacgattgttgcgatcgcttaattaattccaccattaattaggactacgtgatgcctcacactttgctgcggatatatggatgaatacattttatacgttatagaaataataaaatgatatatgtatatgtttaaataatataaaaatgacgtggagataataatttgacattatttgcatattgattatataattctaaaaatataaaaaaaatgtaaattatatgtcatatttgaatgatatttaaaatattcttagataataattgctagtgggtgataatgtggcaaacttgtctgcgatttaaaatactctatataataattgctagagggtgatgatgtggcccattccattcctctctctcctcccatcggcctggtccgcctcccctcgcttgctaggccggcccacctgaacgcacactgcaccacacaccacagacgccaacatgcggacccacctatcatctcccacctcccgccgctcctgttgccctcgcctaaccatagcgccgccgttgccgcccgcttggaaggggggatttacaacccgtgtttccctttccctttccctccatttcccctcctctctctctctcctcttgaattggccggatatcctcccgcaaatcttgccggggccattgaaggccactggatttgacaccaccagttccccgctctccagccctccccctcgtcccctaccattatataaaccccttccacaaccccctctcccatttccgccacttaccatccacactcgacccgaaacgagctcccgtcgttgctctctctctctctctccgccgccgctgtcgccgagctccgaccgagcttcgccgtggtcaggacctcctttcgtctcggcgccaccaactctggctttgtagcgtctccgccaacctcgatcgccccttcaccacacccgaggactgttcgaaccccgttctccccgagctcacaccaacttttccgtcgccaccaccgctttgggtgatccacgggcctcgcccttcctttcaccgtgctcatgctctctccgaccgtcattccgccatgtggcgagcataggagcgcgggcgctgcctcccaccggtcatgcagtcgtctcctccaccgggcgtgttgcgtggccgccgtgtggggcccgcctgtcagccgctgttgtccacttcgggtggctgatgcgcggggcccacagcaccggtggacggctctcaggtgcacccggtccagcgtagaccgattggatgccgcgtgagtccttctcgtggacccaactcacacgcgagttctctggtgcaaatgcaattatttatttattaataaaaataattcaagaatttgaaaatattcacctaaacaacacttaaacttcagagggccatatcttggtcgtttggactcggaattgacctgttcaagtctctaattttttcttaagaagtcaagaacctacttttgtactttgttcttgtgacttatttggattttattagagtaaaaaacccttttcttttcgttggtcatgtagacgctgcagctttggaagatccgctctacttggaggttgaaggcaagtcacatctccattgaacatattgttgtcccatgattttaaattattgcataaccgctttatttaaattctcgcgttctcattgttttatttagcttttcatattaatccttgttatagccttatcgttgcaatggtttatatcacttcgttcaccctaggaaaataaaacccaacaagtgtgtactctatatatggttccaccagtatgaatttagctagatgcttcgctagttaactagacaactttgacttgttttataatcttagactttaggagttatatcatattacttggatattatggagtggttggcttatgttggaatagggcatacaccctttcccctattcaaaaacaccccaaatggtcttaggctaggctcggggtgacgaggtgcatggttttgacttttgagagtagcactttggccatcataaggaccggtctttgggcctttgttgctatgtaataccgtacttctacatgtctaatgggtaaggcttagtttgtagtttagtctagtcatgaacaaaaggacatatagagatggatgaagtcgggtgatggatatctctgaggcaaatgaaggctatatgggcgggtgtccgatagtcgagatgtcatggcacaggacaagcattcgggtggccactctcgaaggatgttctgatgacgtggggcttagccttaacctacctgtcccgggagcctcggccataggcaggcgttgggtcggtgctcttgtgcaaggctaggatgggtgaagaactatgtgacaccctccgctcatttaccatggtggtaagtggcacgtggcaacgcgtgaggaaggcatgtcttgtgggtaaaattgtacacctctaataaaagtataatccattcgaatagccgtgccctcggttgtgggcaagcttaccaatgtacacaagttagtggtttttctcttaaaacttggttgggtttgcttgggatgagctggggcccggtgttgccagtttggtctaactcgttgtaggccttgggtttatgcaggttcgtgtgggttcacgaccttgattaataatcttgtgtagatctaggttcggagtttcctaaatagtctcgagcaaataagtggtttaaaatgctactttaatgcaaaacctaacgccctattattattcccttgtacttccttgcatttactgtgcgtttgccggtatgacttgttgagtatggtggttgtactcagtctcgctcatttttcttccaccccagaagaggagctcttggaagaggatgggttcggtgtctagctcgtgtctgccgtcaaacacctgtcgtgttcgccctagtcttccgtgtttcttcatatttctctatgagctgggcctttgggttgcccgtgtaataagtactatttatgcttctacttgttaaactttgatttgtatcaacttttatgtacctcgcctcctggaacatggaataatgcacgcacgtatgcaatgcatattgagttatctccagttgtgacacatgacgattagatcatgccacattgggagccagtgatgagaatgtaagacaaagttattttttacaaagctttgagcatgcagctcatgtgcccctagtcttcccttgttagtgccaaaccaaatcacacaattaaaatatatccctccaaggtgaatcggttagttaattgctaacaaaaacataccacttctggattggaatctgtcgacgttttttctcacgactacgatatttgcatggtatggggattgttggtactacagaatatgcggggttgaggtaaaagagatagagactgatttttatataggttcgggccccgtattcatcggaatcaggtaatagccctacccttgttggctgttgacggtcgttatcgatcagtttcgacagtcaatattactaaaatgggagagaactagtgatgcttgcaatgcatatgttaatcagaataataatattccactagtattaggtttactaaccttttgcagagaatgatcataaagtagaggagaaccgacatcaactcagacaataaatcaatcggacgatgtcgagaaccagacttgtgtgtgaataggccaagaactcagaattgacacgatgaattgggccaaaaattcacaagtctgcggagtggagcaatagaggaggccaccagccgaaactgggctggattgggccagccccaggttggttcggccgaaccaatcctggcaccgttggatccaggttttggcatggacgtccagtattgcatcccaatgacggttggagggcacttcggacaattccccttccacaaccgtcataaccacctctatataaggagctcactctctttacttcaacacacacctcaagcaatagctctctcattcctctcaagtttagtttagtagtatctagctggtggaatagaaatagaataggagtccggagtccggaagccttcggaagagttcgggtatggctctagcagctttcctttcctcttttgtaagctttgtacttttattagaatactcttctatatacatttatggtattgaaatactttccgagtatatgagtacctactttacattacgttcatgttatactgaatatacggctagcttatctgggagatgctttggtgcgggtatagtgtttgcttatgcaattactctatgtcatgacgatgatattagagtagtatctggtagtttagacgtggtgtctagattatgagatatcattatttggggttatatattgcagatgagagatgggccgctaatggtgacacctcagtacgggtattcctccgcgcctatatataatccgaagttaatttcctgagaagggtattcctccgtatttagccccggttggatggtgatgacgggctgtcgtaagaaactcggcagtcaggggtggcttctcgaagtaccaggagggcatcggatagagggtattagctagtatattagttaactagaatgtatgtatactatgtatattagaagtataggaatagatttgttttctcttttctttccacctagcttagataaattgttatgaggatgagtagaaatgcttgtgtgtcactctacccttggattatcttaacccctgcttagaatatgattatcaaaataatatataaattattagttgagttctctctacatgatcttcccacgggataaaataaatatgatacccttgtaatactctcgggtgaaatgctacaatggtatatccgtgcgcttgcggatgaactctataaccataatataccagaagtgtttctgcgccattgcttggaattatatttctagtaaagtcgttaagaaataccaacaattttgcagctctgagctgtaggcgcttcgcttctgcttcatcctccgggagccagccgttcgagaggtactttaggaacagggttcgccagtcctctgggtcttcatccagctcggcctggtcgattgccatgatattcgggctctctatgggcacacttgatgcgtacaggacctcaaaaaagatgcttggcgaatgcgggcctccacaaccagcagatttcgtcaaggcatatgcttcctcattttggtctctaggtaagtgttcgaccgttatgccggcgaagcacttttccatagattgaacagcctccagatatctcttcattccttcctcttttgcttcaaaggatttgtcaacatgacttgccactagtttagagtcggttcggatgagcaagcaccgaacccccaatgctttcgccttttttaggcccaacagtatagcttcgtactccgatgagttgttggttgtgtcgaactgtagccttgcggcatagcggatcggcacgccccctggcaaagtgagcactgccgtgcgcctgcccctttgtgcaaccacgagccgtcggagtacatcacccaaggttgttcgacaggctcgggttcaggggcgaatgccagtgtccattaggccacaaagtcaactaggacttcagacttgatggcagtgcgggcgacaaaatgcaggtcgaatggagataactctgccactcacttgctgagccagccagtaatttctttgccccggagcacttcgcccaaaggatactgggaaagcaccgtgactttgtgggcctgaaagtagtgtttgagcttgcacgaagccatcactagggcgtaggcaagcttttccatttcgatgtatcgtatcttctccccttgcaaagcttcggagacgaaatactctggtttctggcctgactctgtttcttggacgagggctgcactgatcgacactggcgaagctgctaggtagagtagcagttcgcttcctggtgctgggctgaccaaagcgggtgggctctgcagatatcgctttagctcgtcgaacgctgcttggatttaatttctcaggatttaatttcatacccactacacgtaagttgtcgaaggtctcctgtaagtcggacgcatggtcgaaagccatgcggctttttatgacgatattgtcgacataagcctccacatttcgccccagctgcttataaaggaccttgtacacctgcctggcgaaggttgccccggtgttccttaggccgaaaggcatcctgaatggcaaaaggtgctgaatggtgtgatgaaggctgtcttggggatgtcggccggattcatgtggatctggtggtagccggagtacgcatccaaaaaactcatgagttcgcagccagctgtcgaatccacgagctggtcgatccacggcaaggggaaatcgtccttcgggtacgccttgttgaggtctgtgaaatcgacacacatgcgccatttgccgttcgatttcctcaccagtaccggattcgctagccactcggggtggtcgatctcctggatcaccccagccttgagctgcttttgcacttcggctttcgctgcttcttggcgatcagcggacatcttgcgcagcttctgtttccttagcctggcatccggcttgaccgccagatgatgcatgatgaggtctgtcgaaacacctcccacttcgtcggggccccaggtgaagatgtcaatgtttttcttgagcacctccaggatgttctcaacttctctttcgcccatgtcgccccccagcgatacaaatcttgtggaatcggcatcgttgacctgctccttgatcaccctgccgtggggggcaggcttcggcgcgtgcttcgctcggtcatgcggttcggcctcaacatcgtgcaccgctctgttgatagcggccaaatcgccctttgatgtagccgaaggttgaagccccttgaccacgatcactcctgcagggccaggcatcttgagcttaagataattgtggtgggagatggcttcgaacttgttcaaggttgcgcggccgaagatggcattatagttgtatgggatgtcgacgtcgtcgaacagtatttgctcttcgcgtctgttttcacctgtgccgaaggctaccaccaattgtgcttggcctaggacttgaactgcttctccgccaaaaccacgaagcgaggccggtgcttgggtaagggctagggtaggcaaccccatcttggcgtatgcttcggcgaagatgacgtcggccgaactccctccgttgactaggattcactggatttcgaagccagctacgtcggccgagatcaccagggggtcttgatgtgggaacaacactccttcggcatcttctggcccgaaagagatctgctggttcaaatatcatggggccccttcacccgccgaagtgatgttgtgcaccattcacagctacatcttcttttgccattttgacagttgattcggtgggtcggcccttgtaatcacttggattactctgcgttgtacatcttggcgttgttcggccgggggtgcttgttcttgaatggcttcgcgaggtgcttcgacagctgctccttgttgcggccttggatcttatgcgttgccgctctgccgaatgtttcggcattgctctgtggtgtgcgaagagcgtccgtggaaggcgcagtaaaggtctttcctgaccttcttgcgaacaggctgctgatggctggttgcttgttgggcgtcgaactccttgcggagggcttgaacttcttcaacagccatcacggccttgcctgcactatcggttctgaatttcctccacgtcatgggagcttgacctgacctttgcggttgtccttggttcgccggctgagactggcaaacagcaagaggagttggctcggcgacttgtgcttgtacttgggcttgagcagcgatgacagaggctttatcgtactcagcctggattgcttgccgtcgcttggaatcctcttcgccccttgcgtattcgtcaatgatgcgaagcaggtgctcaaccgtctgcggctccttgttggcgattttccttgtgagttcgccctcgagcagcccggccgaagcggcattgatgatagacgcctcagttatgtcctgaacttggcatcgggcttgcgagaagcgacacatgtactcctttatcgaatccctcggccgctggcgaatgccgagtagatgttgctctgtcttcggctactcataggtgcgtcgaaatttatggacaaagacatcgcgcaattgctcccatgagtaaatgctattagctggtaaattgaagtaccaagaacgggcgaggcagtctagagcaagatgtattacctttgccttggtattttcgtcgccatgagcggcttcgatcgcggactcatagatggacaggaactcttttgggtccgtttcgcccgagtatcgcggaatgggtgggaacttgaactgggatgggattggatgaatcttgattcccccactcagcggcagccccctttcgccccccgccttgctcacggcaacttgctgtagaggcctgtttggatatggcatggcgaagggcgaagtcatggcttgcacgtgcggtttggccacagtgttcggctgcctggccgctaacggtgatgcctgatgagccgccatggatgggtcgaacgaaggctaggtccatgccatggcgacctggtttggcgcctgattcgttccgaagcctggtgtcggtgcctgtggtcggatggttggtgcttgagtggcattgctgaagtcgaattgcggtccttgactccatggtgaagcccccggaccaggcaggttcgtcggtagtcaaatgggtgcaccttgacttgtgttcccctccggttgggtcgaaggggttacttctggaatgttgtggggttggttgagctgctgaagaaaagcatgaagctgcgcttgcaaaactgaagctccttccgccattgcttgcgacatttgaccaggtggcggggggcatacttgggcagcgaccggccgaacttgtgactgtacatgaggggtcggatgtactgtggcggtcgaaggctgtccggcgaagtacgctggtgcttgcatgacttgtgacggaagggcttgaatcggcacttgcgggtagacctggggtgggatgtagcctgccgaatactggagaatgggggccgaggcgaccttggcttgccgggccacttcgtatgcctgctgctgctcttgcatttgacgaagcatgtcctggagtcgcaccatattctaacgcatggcccccatgttggcttcggcttgcgctttgaggttggctccggtgtgctgtgcgcggtcgaagctatagcctgctgcggcgaagcagcctggggcaccaccagttgacttgtcgaaaggatctccgccctggtctagagcgcccttgccgctgctaccgccttcgccgcatcgactgtgttcggtgcctgccccgtcgaagcagtaggagccgaaggtggtggttgcggcgcaggggccaaagtcgatggtaccacatcggcttcggcaccaagtgccgaaggctctgctccctcctcggctgccatctccactcctgcttcactctccttacgccttgcaacattctcctttgcgaccttcttcggtggcattcgctctcagtggtttcgctcggaggtccccacggttggcgccagctattgtcgaaatgacaaccgcttaaagtgtattaaattgagaatttttcttaggatccccccttttacatgaccctaggggtctatttataatcccattacaggttcccctattagggttaggttttacaggggaatttatatgattgcccttatgaaagggacatttacatgggtatatagtgtaattgaggtacatgggcttctagtgggccgactggggaacgctggcccagtggcccctgggcttgatcggctaagatggcgtcttgggtctccttgaagttgaacttgctatggcgaagccatctgccttcgccatacattcttcgccatacagtctttgcccaagatgcctccaaccttgtgggataccagcacgatccttcgcccttcgccgtctttgcttgatagtcttcgccatggggacttcgccccgacagactcgacgtcttgggcttgaacccccactggttgcatggtttcggcacgtctggtcgaagggtctcataacataccgccaacagttcccatcatgaacttcagccccagttggctttgggatcttggtttgaggttctgacgacgtgtccgtcaatggtggaggtggccttcctgacatgtttaccgtcttccaccgggcgtgccaaaagcgtgttgatgcgtaaaacacgaggcctgggagatctgcttaactccagtgcaggtccaaaatcttgcctttaggttcgtgagcgtgccaagttcatttgatcctgcaatcaacaagaaataaagacaaagaaaccgcggttaaatttataaatgatagccgatcggctagttgccgatgacatcatttatctctgagccgatgtcatgtttgaatcgatcggcagatataaataagtaacaaaagactaaatctacttgatcggctgtagatattaacaactaataatccttatatcgatatatacttaaatcaagtggttgggatagatcagtcgccataccgagacagtataaatcacttagattgaaatatatattaacaacgagattatagatgctcatagcatagcagatcagatagatctagcatgtatcggctaatactccgataccactctatattaagatattaaagcaagcaaaatatatcaaaacggaagcctaacatactttgttgtactaagatcataatataaaaggcagatctagcatgtcaattaagcatatgaaatataaggctaaatcaggtaagatcgggtgaaaccccgatactaccctaatcggcaaccaaaagcaggctagaggttgagattctaatcacgacttataacgtcaaactcaactgatgcagctataagtatgaaaagaaggacaatatctagacaatcaagcagttggatgtttcatagagtggtgaatatcctgtacgatctaagccaacatagatatttaacctaatcggctgccttccaatgatagatgttagccgattgaaggttagataacgatattatcaaagattatatagaatatatgataacccgacgaattacataaacaagattagagtatcataaagatggaagcactaatcccgagaacacaagccgccacagcaagttttacctctagttgaagatcgaaaccgatgcagctaaacccgaaagcaagaactcgtcgaaacgaaagtaaaagggtggtgatgcgccgacattgtatttgaacgtgtgttatcgtattacatggggctcggggtctatttatacccgagattacaaaatatgtccgtgtcggacacgtctcttatcactaacaaactctaaaataccataagtctttgcggcagactcttgtccaaacatatctctaaggaaattacatgaaatatcctaattaataaatacaattgcctactcaagactcaatccgtgcatagcaatcctcatgaagcacattaactcaacctgacaacgtgtaccacgccatattgttggtatcggctgaatcggccaacctagtccgactcgaactctgccgatcttagtcgtagccgattcagactttagccgatcctcactctgtttccggaacgatttctatcttgaattccacttcgatcctatcttcatctccgatacttggattaccaaatttggttgttaacaggttgtaactcgttgccatctggaccaagatcttcaaccattccctcttgaacaccatcacctttgtcacctaattcaccagcagttactttaccagatgagcttgaaccaacttcatcggcagcaaccactttcagcttgtatttctagacaattgtcccttggcgggtttctttgaatgaattcatgaacttgtccttcacgctgctcatcatctgttcaagctcttgcctatgttcagccatcaatttgtccagtgtgactggaataatatttccttcatgaacttcagatccggttgaatttggaagcttgttttgaggatctgttgacttcgaagcttgcttgttgcccgacatatttatcgtgtcccactgggtgtgccaaaagagtgttgatgcaaaaaacgaggcctgggagatctacttaactgtagtgcaagtccaaaaatctcgcttttaggttcgtgagcgtgccagttgatttgatcctgcaatcaacaagaggcaaagacaaagaaaccgcggttaaatccataaatgatagtcgattggctagttgccgatgacatatcattcatctctgagccgatgtcatatttgaatcgatcagcaaatataaataagtaagtaaggattaaatctactcgatcggctgtagatatctacaatatgtaatccttatgtcgatatatacttaaatcaagtgattgggatagatcggtcgcgatgccgagacagtataaatcacatagatcgaaatatatattaacaacgagattatagatgttcatagcatagccaataagatagatctagcatgtatcggctaatacttcgataccactctatattaagatattaaagcaagcaaaatacatcaaatagaagcctaacatactttgttgtactaagatcattatataaagggcagatctagcatatcaattaagcacatgaaatataaggctaaatcaggtaagatcaactgaaaccccgatactaccctaatcgacaaccgaaaagcaggctagagattgagattctaatcacgacttgtaaggtcaaactcaactgatgcagctataagtatgaaaagaaggacaatatctagacaatcaagctgttggatgtttcataaagtggtggatatcctatataatctaagtcaatgttggtatttaacctgatcggctaccttctagcaacagatattagccgattgaaggttagataacaatattgcctaagattatatagaatatatgataactcaacgaattacataaataagattatagtatcataaatatggaagcactaatctcgagaacgtaagccgctataacaagttttacctctagttaaagatcgaaatcgatgcagctcaacccgaaagcaagaactcgtcgaaataaaacgaaagtaaagggtggcgatgcgccgagattgtatttgaacgtatgttttttttattacatggggctcggggtctatttatacccgagattacaaaatatgttcgtgtcggacacgactcttatctctaacaaactctaagataccattagtctttgtagcaaactcttgcccaaatatatctctaaggaaattacatgaaatatcctaattaatagatacaattgccttctcaggactcaatccatgcatggcaatcctcatgaagcacattaactcaacccgacaacgtgtaccacatcacattgtcggactcggctcaatcggctaatcttgtccaactcggactctaccgatcccagtcgcagccgattcggactttagacgatcctcgctctgattccggaacgatttccatcttggtttccgcctcagttttatctccatctccgatactgaaattaccaaatttggttgttaacagcacggaataccgttgtagcacttcaccttcgggtgaccccaaaaggatatcgaactcagggaacgtgtgtaatctacctaaggctaagactatccaaggacaacaactgatgataggtaggctaagctagagaggactttctatgtgttttagttacctacgctaagcaagataattccctatctgttgcttcgggcaccgacccttgctggtctgccagcatggttccggctatagctctatgatgtatccgatcgtggagaattactgggacggaattcagggctgtcaccacctgccgcctacctctgacaaatccgtgggatacacaacaaacaaaggtcacctctaacctagacaccacgtctaagttattaattactactctaatacttgtacaggaacttccttctttatccagagtcctagtactagagcacttagtatgaatactaaacaatgaacccgcaaagatgaaaatctatcttacttagacaaagtaattaaataacataagaaaggaacacgaatgcttactttatagaagaagttctctgaacccggagcagagtgtaccgaggtagaagtcagatgagcgccaaacttccgggcactcctccagagcttcccctccattctctccatctctggctggccatttttggtcgccgcgggtttcctcccaagccctaacccctctcctctctctcctagggtgccgtcgccgcccgtccgtcccttcgcgtcgccgatcatcaccgctgccttcgccttccgctccggccgccatacccgccggtgaggttcccctctcctccctctttccctttcccccgtgtgcaccgccgttctccgcgcgtgcaccgccgtcaccttcggccgacgccgctgccttccgcgctgtccgccgccgcctcccgcgccgccggttgccgtcgccggcgaccgcatgccgccgccgctcgccatgcttagccggtcggcttgaagtcgagccgagccaggctggcgccttcctcctcccctttgaaccaccgcctggtggggcccacccgccaggccacctcctcctcctgttgtgtcgctgacccgtgggtcccgcatgtcccccccccattggatgatgtcagctgggatgatttattgcgcaataaataattaaggtttttctctttacagtgaaaacacagataatcttctaaaaatcatatctaattcatccgagctccgattaagtccattcaagtctcagtaaattcataaaaatgcattgaatccattaaaaatggttttgtttcctatttcagtagacttatagcatgttttgcttgtgtgctttgtttgtcgcgtagatttcggctgtttcgtcgatccgcggtttctcgaagacgttgctgtggtctcatcagtgcgagagcaaggaaattcatgcattacaattgatcatattgtacccaatttacaaatgtcccgcatttctattaaatgttgcattgttttacaatatcatgtgggatgggtcctactactcagtcatatattatttaccttatgccattgataacttgggtattaacatgattagatattagtttagggaatgcttagccatgcttagttcaactagtacacaaaaggggaatcacattaatgcatatactttgattattggcatagctttggattagtgccaccgcaatggtgttagttaattaaaatacactacatggtgggctgtgggtgcatggttttgctagtcgtgcccatggcgattaaggaccggttcgcgggatgccctggaagaacttatcgtacttaccacaagccagcgtgggcaatggctggacttgtagtgtagctttcctctagccgatgtacccaggcaagggtgggcgtgatggagttgggtcggccggggtgtccggttgatcggcttccgaattcaccgtggcacgagaggggactgcccgctgccttgcgaggagtgggggtgaaacttgaggtgtggtgcgattggttagaggggcttatgcgaagggtcctgtcacggcctctttctggtatgtcatggtggcatgtcggcgtgcggtaacgtgtcgtggggctgtttcttgtgggtacagttgtacacctctgatcagagtaaaactattcgaatagtcgtgcccgcggttatgggcggtcgaccagattcactgtgattagtctcacccctagttagctaatgaactggtgtagttcaggtggttggttgggcctgttgcaacgtggtatagtgttggacagtgattggttaatattgattaattactacaactgttttactgctttcaactactgcttttaaatgtctgctttattgcaaatgaacctctagccacagtgggtagtactcagtcttgctctcttttcccctacaccagagcagaagttcttcccagttggagccgtgtcgaagaagttggttttgttgatgccatcaaggatgcctgtggaatggagtcgcccactgcaggagtcaagtcttcaggcttagctcgttttaccttttccgctgcatttgtaatcttttatatttttgtaagacgtggatctgtatgtcaataattatcgtttgtgtaccctgactggtcctggacaggggtttaatgcacattcagcttagaaattctggtttgtgaatttctgggcatgacaataagtttgtgcacctcgagtacaaaactaaaaaaaatactccctccatttcaaaaaattttagaaaaatgtaataatatttaacaaacatattatcaaaatatattcaatattacatttaatgaaactaatatgtaatttggtatggtaatatcgctactatttttttataaacttaggcaaatataaaaataagtttgactaaaaggaaaggtcaatctaacttataatatgaaatgtataattctataaataaaacccgggtagaattatttatagaattctatgaaatatataattctataaataaaaccagcttatgatagcaaactagcagcggggaccgccaggctccaccgctgcatctctagtaccaactgctatatttaccattatcgataccttagaaaaatgatttgtcattggaaaattctattagttgtatagtattgttggctccactattgtaaaccagtaatctatagggtatggtattcatctaatgatgggtacaataagaataaagaataatgtacgtcaaacagtaataattttactcgacaataaattgaacggaggaattagcattgtgtccttcaagcacctccaatctcgctaatatgcaaactaaattagcagttagcaatactgtaatacagtgtaagtataatggtcctatggcatgtgatctgaaacttgtgtaggcttgttcgtttctggcgccggacggggagtggtgtcggtgtatccgatgcccttccttttcgttgggaagagcaagaagacgaacgtcgacatgaacgccatccccaggggcaggttcttgagcagctccttggtgtcgttgccggcgtcggggaagaagcacttggtgagcccgacgtcgctgaatgccacggtgaggaacaccaccgccgtgaagaaggcgtgcacgatgtccagcggccgcacccgcagctcccgtagcttggtgcgcgacaactcctgcgcttcctcctcctcccgggacaaattgaacacgttgaacccccgcggcgtggccatgccgtagtatagcttgccaccgcgtccgacgacgctgtccgtgagggagaagaagatggaggaggcggtgaggacggcgacgagaccagcggtgagccaccggtttgacctgtagcactggccgtggttggtgaaggacgtggacagcgcctggtaggccaacgccgtgcccgtaggcagcagctgcgccaggttcgccgtgctggccataaccttgtcagtcatctccggtggcggcctagccgccggcagcgcaggcgcagctgtcgccttacgctcgccgacaccgttgggcatcagcgtcgtggccatgcttatatctgcctcaggagctgcctcgccgtcaccattggtttcttgtggttgtggcatatcaatcagcttggtctcaagtgaggattccattacttggttttccttgtgcattaacgaaatccggttgataattatgtataatacgttacgttcttgaggatttatataggtgaatcgtttgcagttttttccacgcgtggttggtacgcgtgcattggattaagaggaaatggtcaaccagagactaagctgagctaggtagttggaaagttggaatcattcttagctttggaattggtatactagttgatcctcctcccatcctaaattattgggcgccccatttttttttaaaatcaaagtcggtaatttttaactaatgatcatactaaccacatctataataagtattatatatgttatatcactagatttatattttgaagcacttacatatgatgttaatttcatattcatcggaaactttacatagaataaattaaaagtcaaagtatgctgctcatctctacaaatggattcatgcaatccatactgaaaccaaaccttatgtttcatacagacttttcgaagtcttgaaatgtgatgtcgatgcttcgccgatgcgatccatcggcagagttttttcccatatgttcttttacgtgccaacgcatcattttaacttgagctttgtacctaaagaaatgcctcagccgtgatattatagggaaatatcgcattaccttagcagaaactctcgtcttggaaggttatccgtcaacatcaccggagtcatctcgtctaatcttatattgtaacgccatacaaactgggcatgtttctaagttctcgtaatcctcaccacaatagaggatataatcgttcgaatatgcgtgtatctgatctgtacttcaagtcctagagggcagactacctgttagcttcgtacgttgtttcgggccatttatttccctccggaagaatattctttatgagtttcaataactcacaaaatgccttgtcagtcacaccatttttttgccttccattgtaagaattccagcgtattacctaactttttatgccctgttcacagcctgggtacaagaacattttgtggtccgttaacatacgctcaaatttcgtgacctccttttcactttcgtagtccttctttgcgtcgtacaacatccgacaaaaatcatctgcactgtcattttctgcaacaggcccgcctgtcgcgcctgttgtattttcttcaaattcaccgaattgagcctaatctggaatgttgttatctttttcttcattttcaaccattggaaactgtcaaggttacgggtagggtataccctctacccttcgatatacgtcacgtatcgatatggtatgctcacgagtatacggacgtgttcgtcatacgttaaggaaattcatcatggagttcacaggtagaaggagtcctattcggtcaaaactgggtcgtcattgtgtcatgttcggtccggcttctccgagtcctacttggagacagttgacctgcgatataaaagggacccctcggaaggacctaaggcatcgaatctcagagccaacacatccaccacagcctacgaagccgaagcttgtcagagccaagtcgccgggagatctagtcgaatcaactcgactacgatctcgtcggtatcatcgagttctgctattccctttgtaatctgtggtttccaccatataatcccatatcaactagattagggctattacctgccaaggggcctgaaccagtataatccctgtttcctgtttgcttgatgtcgtactacgtagatcctcgtaccagcgtaccccaataccctctatattcggtctacgggtatcccccgtcgacagtggcgtgccaggtagggggacttggtgctcaaggttctactactatgacatccagtttcaccgacaacagcgttaacaccaatctcaaccaaggagttcctacttcaacaacactggtgtggactcaagtcggcgaaatcgtctttccggtttacaccatagtgctgatctcagctggtccgccaatggccggaaacgagaacgcagtggctagaacccggggtgactccatgtcgaagaatccagccgccgaagcggagatcggaacgtcgacaacatccgagcccgagaaggatcctagtgcggccaagccttgtctttccaacaggaatcacgagccgatgaggattacttccgaggtgacaaggtcctggtgtcctatccacaaaactaggaaacacaccctgcaagcctggtgggtctttctcaacgttcatgctgaaattcgtgcctgcaaagagtgtggaattcaacatacctctccaactcgtgatgtccattgtcctattcacaagacaaaaaatcacgacctctcgagttgcaaggtctttctcagcgccatgaagacaccacctcctaaggtccagcagtcacgcatccccatcagggatgaagacaaggaacaaggagcgacgccgattttagatcgatttgttggggtaatcgacatcgatccccacgaaccatcagtcttgcacttgctcgaagactatggatcatcgacaacgagtacgccgcgtgaggtattggctattgacgatgtcggcacgtcagtgcgcaccaatgcggaagcggagaatcaagtgactgctccgacccagcacatcagagccatcaacgcaatactgagggaaaccccctacgatcccattctgaacgacgatcaagcacgttggatagaacgactacaggaatcagtgaccaacctcagcaacgtgttcgaagaggccgctaccgcagcacacccagaacagccaccaactggcgatgctaatggtgaaaaccctgaacggcgggaatcgcctcatcgagccacccctccacctcgcggcacctgcgatctcctcgatcacctgaatggccgccgagaggcacgacacacacgagacaacgagaaccgttcccggcatcatgtctcttcacgggccattcaagcgaagatcgaggaggccattcaagcgaagaccgagaccgtgataaccaccataaccacgatgatcgcgaacggcggtgctgggcgatactggtcgaggacatcgccataataacgacgatgatggagatcggcgccgagacaataacgggagacgacgacaggattctcgagaacccggctgacgtcctcataatcgtacgccggaaccaagcgacccatcatcatcgtcatcatcctcgtcatcttcatcatcagatagacatccacgaaggacttatgatcgccgacaacccaccgccccagcgctaggtgtagagctttcagtcgttcacttcgggatgtccgatggctactcagagattattcgaaattgtcgatcgatgcgctcatgcggatgacgcactgaacgacaaaccgaagaccggagaagagaagaaaccagccaaggacgcacctgagtcaagcaagaagaaaaatcgcaagagtgggaaaaggaaagctcaatcggaagttctcgcaacagaatatgcggaccctcccaagcgcccagacccacaaggcagcgacacgaataaagcatggtgccccatacacaagtcggacatacattctctagaagattgcctcgttttcaaaaagtcgctcgcaaaacacatggcatcggaaaaaggcaaacgagtacacgtggttgagaaggacgctgaggcgcctactcaggaatcggactcagcatacccagattccgatcttcatgtctcacacatcttcggaggttccacggcatactcctcaaagcgagaatacaagaaagtggagcgtgaagtctgttcgacgtggcagggggctacgccaaagatgaagtggtccgagcagaagatagaattctcggaagaggaccaccccaagattgctgtcatcccagggcgatatccgatcatggtcgaacccactattcgtaatatcaaggtcgcacgagtcctgatcgacggcggcagctgaatcaaccttctcttcaccagtgccttggacgcgatggggatcccacgaagcgagttgacacccactgatcaacccttccatggaattactcctcagtcattgtccaaatcattgggcaaaattacgttgcctgtgactttcggccaagcaaatagcttccgaacggaacagatcacctttgatgtcactgaattcgatacagcatataatgccatcattgggagaactgcactcgcgaagttcatggccgcatctcactacgcgtatcaagtgctcaagatgccaggaccgaagggaacaatcactattcaagggaacgctaagctggcagtacaatgcgacaagcggagcctcgacatggtcgagcacacgcctagcccacccgccacagctgaatcacccaagaaagtgagcaaaacaaacaagacgccgaagccggacggcgcaatcaagatcgttccactctccagtgccaaccccgacaagaccgtcaagatcggggcatcactaggcgagaaataggaactcgcactcatcaccttcctccgcgacaatgctgacgtgttcgcttggcagccgtctgacatgccgggggtacccaaggaggtgattgagcacaaactcatggtgcgacccgatgcaaagccagtaaagcaaaaactgcggagatttgcaccagatcgaaaacaagccatacgagaagagctcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1587 - DNA, 158 bp, Oryza sativa
gaagcaatttctacaaacgaacgaccttcaatttagatatatgatgatcacgaatgatgtatcatcatgcatgtagtaggccaagacgatcaattctaacttcagctgatgcataaacactactgtcattttcattcacccactaaagaatatacaag

SEQ ID NO: 1588 - DNA, 2395 bp, Oryza sativa
aacttttagtaaataaccgtcctatgtagatagatgcatgcttagccataatccttccatagccacttgatagactaaaccactgattagctaaatatatatgtatcccataaatgctatgtaggttaactctaaataggccacgatgacaatagaaagattaagaaactttagccttagcatgattgggatccattagtaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattctttgaacatgttgatcccaattgcgaaattattttgtttaccaataaaattgcatgcaatgatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggctggaggacttgggtggtgtccggaaaaggctagtgccgtccctggtcaattaaggaccgagccatgaagttaagcatgaaacgaccctcgtacaaccgtacttctcgaatgggtatagacctagcggattagatagctgagcggaggcagtatccatgcatagtggtttcttgatgtgtgaggcaggggctctacggtggggcagccattggtagaaccgcgaggcgggtgtctacagtggtgtcgtcattggtaggactgccatgtgagaatctaaaacataactataacttaatgcatgtgtgagtcttcccttcccgggtgcgccagaactcctctcactgctagaaaccgtgtacgcctagagtgcatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatacccgtgctcgcggttattgagcaccgggacatgtattacacttggctagactataaattcttaacttgtgggggatgggatattgcatgatgaattttatgctgatggagccacttcccgagaggagggaaggtggacatcctcagaaaaccatgacgattcaatggcgggaagctatccttgggatcacaatggatggtggacagaatcgtcgttgtttaaagtgaacactggtactaaaatttgatcagtctatgctaggttttaggcttgtgaaaagaattgtaaaattagctttatgcaaaagaacctgaagccattctttgaaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttccgctgttgttctctgatagttgttggcctacctgtccctaatgtaagtatttaactcttttagcctaaattcattcgtgatatgttgtgatccaactatgtatgtgtaccaactgctgatccagggattggtacggataaacacagaagatttccgatttccaaaatcgggggtctacagtactggtatcgagtacctaggtatcaagtacttggtatctagatcggtctgatacctgtaggtaccaggtacctagatcggtgtgatacccataggtaccagacttagtactggtatcgggtacctaggtatcaagtacttggtatctagatcggtctgatatccatatgtatcaggccttgtactaggtatcgggtacctgatacctagaccaatctagtactcaaattggccctggtgttagcatcataacaatcgaaacaggtgcgttgtgtctctagtgagaaaatgtgcactgacgtgtggtcccttgtgaggacacgaagagacgtgggctgacaaatgaaccctcacatggggtgaagttgataaaataataggagagagtagttagt

SEQ ID NO: 1589 - DNA, 1195 bp, Oryza sativa
actcctccccacgtgcgtacctggtccgcccacttcccctcctattttcccataaaaaatgtttcacctagtatacttataatgtttcactatttataggtctaatgttgcagtgaattaaaatattcttttgcaagaaaaaacccacatattttggaaactctctattaagaggatttggtttattttttgttccatcaaaaatgtttcacataatgtattcacaatatttcactatgtataaatttaatgttgtagtgaacaaaatattctattgcaacaaaaaaacccacatattttgaaaatcccctattaagagaatttggtttatttttttgttccaccgaaaaatgtttcacctagtgtgcacataatgtttcactatgtataaatcagatgttgcagtgaactgaaacattcttttgctatttgctgaaacattgtttttatataaggtgaaacaacgcccgatttaaacgagtgaaacattttcgatctacttagtgaaacaattccgatatacctagtgaaatatcgtgcaacatttaaaaaaaattcaataataagctaaattttttttcgtcggaatatatccatgtgtactcaatgcaaaacgcaagaagaattttatattcgaattagatgctcttattaagactaaataaaccacatgacatggctacttggttagtaggttgaatattataatattgatctgcgatctaacaagtcatacactctcaccattcaccctgctaattttatccttacacgacagcaacacgtcgtggatgactcggtcaaggttggtgtccccgggcccacctggcagcgtcactcgtacagccttctctttccactcttgtgcacgccgccgtatctcacgccccttcttcccctccatggcctcccgtatcatcgccgccacctcccctcgccgcgcgttaccgccgatctccatcccgatgccccactccgtcctcttgtaccggcagttcgtctgctgctccgcgaagaagggccagctcagcatcggcacgccggcggctaggctctccagtgtcgagttccacccggagtgcgtcaggaacacgcccacggcgtcgtgctcgaggaccttctcctgcgggcaccacgccgggaggacgccacggccctcgacggcggcgtggaactccggcggcagcgcggcggc

SEQ ID NO: 1590 - DNA, 6814 bp, Oryza sativa
gatgctgtcgtagctcacgtacacgacggggctgggccggtggccgtctagccactggaggaggccgtcctgctccttccagaggttggaacccacgccgtgcagcgggcttccggtggggacggcgcggcggacgtggaggtggagcgggccgacggcgtagaccggcggcgggaggacggcgcgcatggcgtccagcgccggccgctcgaggtcgtcgaaggtgttgaggatgacggcgtcggggagggacagccgctcggcctcgcgcatgatgaagttgagcatcacgtcgccgaggtccgtggtgcggatgaagctggggtagtcgcgcagctggacgccgtcgcacatgccgcgggcggcggcgccgtcgaccaccgtgtcgaggtacccgtcggtgagctgcgccgcgtcccggagcggcaccaggccacggtcgatgagctcgcggtagaggcgacaccccacgaagccgcaggcgctggccgtccacagcgcggcgcacggcacgccgatcaccctggcggcgtcgtacgcgaacgacatgaggccgtcggcgacgaggcaggtgaccggcggcgaccccgacgccggctcattgagcctcgacagcagcgcaaggaggtggccgaggcagttcgtcatggtggactggcacagcgcggggatgtcctgcgtggcgtcctcgtcctcgccagacatcgccggtagcccgtcggggatggcggcgaagacgaagcccggcacgccgtcgagcgcggcggcgccacgggaggcgaggaggcggcggtggttgaactcggtgttgacgaaggtgacgtggaagccccgggcgtggagcagcttggcgaggtgcagcgtcggcgtgatgtcaccctgcgacgggtacggcacgcacacggcgtgcggcggcttgtcgccggtggcgcccatcgccgatgccattctatgcccgttaattagtttgcagcagagaaagagagatcgctagctgttcgtctggtaatggggagattacattggagtctgttttatagtcaactgagacgtgttaaagttggggtgtggctaaggagagatggatcgcttggagcgatcaccccttgtccccctatacgctcatcccctttcttctccgcttcttctcttcctactgcaccataaattttaaaaaaaataaaaataaaattgaaaaaaattatgtatagaaatactatatgtaaaaaatatttgaattcaaattcaaatttaaaacgaatatgtaaacttttaacttataaacattgggtctataaattaatatttgaattcaaattaaaatttgaatcgggcatgtaaacttttgacttataaactttgggtctataaactttaggtttataaacattagtacagaaatactatattaaaaaatatttgaattcaaattcaaagttgaatcggatatataaacttgttgacttataaactttgggtctctaaactttatatgtgtaaacttgagctgcataaatctatctatctatcaatctatctatgattatatatactaaaagtccattaaacttcctacaaacgttactaagccgccacatggcatttctataaatgtttctaggccgccaagtggcgctctaataaaagtccaagaaaaaataaaaatattccattttcatttaatctggtgaacctatattttttaaccgttagatctaactaaaaaaataccaaatagaattatatttagaaagcaccacgttctacgtcgatccatcccatacgtgtacgtgcatgtacgtgcatacttcgtacgtggccccttcccttcctttcttttttttctttttttttcactctcatgagataaaaaccaaattaataatttcagccaatagttgtaaaaatatatgttattccgagttgtattctatcacaagttcattaaacttcctacgaacacacttaagtcatcatgtgacaccctatatactctcctgaaccatcgcgtggcactctaataaattagaaaaatcttaaaaattatgagaaaaaagaaaaaaatatctgaccatccattataacttataaaccggtgaacctattatttctaaccattagatatatcttaattatctgtttccaataaaagaaatctcctctctctatatatgtactcctccctcagtggtatgtacgtgaatttcctattttatagctagcaaccccatataaaaacttaagtgaccataattgttagtaagttatataacaaaccacaacgatgcagagaaatcaaaatattgaataggttttcaacgtgcgtgctgcttgctttaatttggttatccaaataggctaacctattcttgctaggattatcaatgcaatgagcattaggtctacaaatgagggtgtgcatgcacgtgttttcatcctcctaagctctactagttttatcttttactggctaaacaacaagcaccctaaataatcagcaaatttgcgaacacatctaaatttagatccatggtgcctttaaaaaaattaatgattcaaccgtggtaaacttctacggaaaaaaataatttctagggcacgtcatcctaattaccatttaaatatatatatatttagatgttcattaaacttcatacaaacacacctatactaccacatgctacgcatataaacattactaaactgccacgtggtattatagtaaatcagtgaaccatatattttcaactattagatttatcttttttttttcttaaaaaaaccaatatccacatccctcggctctatcccaccagcacaactctcctctccccactggcccacccttcccaccaccccatgcacgtacgtatacatacatacactttttccgtctccaataattctttctctcatcttcctattttataaataataattttaattataaaaatattatgaagaaaacaaatctaaccatcaatttttaattaaattggcagacttataatttcatcaattttcattcaaatcagtcgagttataagtttaacaattagatttaaagacataaatatttcaaactgatgaacgcattaaatatacctcaataaaaacaaagtatccttgccaaataacaatgaaacattgaaaaacatgaaaacatatattatatattcttgaatcgttttacatagtaaagatcgattaaacgtgctctatagcactctcaagtcaccacgtatgatattttaaaaatttgaaattcaaagagaaaataaattatatatctatccatcggttttcacttaatttgatgtcccattatttttaactattagattgcttttctctttataaaaaaaactttaagccaccacatgtcatgtcttaaagatccttagaatgagaaaacaacaaatcataggttcgcacttagattgtttacaaagattttctttttaaaaaaacaatgtaccgtccacttcccctccctgtccaatcatatgcacataacactattgcattgtgaaccctttctaatatctgatttgagttctacgctattcgtttctctccagtctcctccctattttcagctacaaaactaaagagagaaacaaatattaaaaagagcataattttaagctacactgataattttattttatatatcatgtaatcgattttagatgatggtttcttttttacataaagtcgccacctattaccccataaatcctcctaggccttttaaaccgataagcccattatttccaaccattagttctatctcatcttaaaagacaagtgtgtattcataatacatcatcttccaaaataatatattgcacaaccatatttcttcatccaatattatttgcgctaggttgcatggagtctcacacactctctacatggaacgttcgcatatggattctttctcaaattaaacaataatataaacccatgcatttagtggagcctcatatcccacccaattcatccatcaataaacaatgacaacctatattcaattaaaaaatatcttacttttgattttacacataattttctatacatgttttctaacacaaaatatgtctacctacttagtagatgatgaagaatattataaatatttgcttgtagggattaattaaatatgatatgttataaagataactaatagtttggttagacaattataaaagcaatgctaatgaaaacaatttatggagaaatcatatattgtagatgttcaaacatagcgtacgacacatgcccgcgcgaatacgtggtctatcttcttagtttattaacataggaaagtaatgcgatgccaaaaaaagaaaccacgtggaggagggggtttgatcgctccaggcgatcgatcgcctgttagccttttcattaaagttgtgcgcgtcaatatttttccctgtgcctgacaatttgagaggggaagtttagtgaagattaagaagatatacaaaacgagataaattattaacgtatgattaattttttaaaaatttaacactcgatcaatataaatttttaagcaactctgatataatttttttaaaaaacgcaccgtttagtagatcggaaaacgtgcgcgtgaaaaacgagcgattttttctatcaatcttctagggccaaacacattggaaacaaaaaaagccttaaaattcgagcttcattaatagcttgaaacaaaagttatctaaatggcactgtttgagctcaagtttgagccacaagagtgcaacacaacaaacgcccaaaacaccttacgctatcgaagaacaactcatagttacataacaaactcatactgcaactgggggataataacaaagaaattgatggccaagcagttgttgcatatgcagctctaatttctcatctggatttttccggtcacttcatgctccgcagtaattgcagcttgacaatgagcaactgaacaagtcattgaaagcatccacctcctccgtgtcaccttcagtatggccaacgcctctcactgccgacacagtaattttacactgagtagagccgcacccgttattggtacgtgggtgaaatagttagagaaaaaattactgtaaaacaatttggtaacatcatctaggataacatatattaatctatattcaaaagtccaacactaaattaagtgtgaaaaataatgtctgccctcattgtggcaagctcaaagtagaccacccatatatatcttattaaacagaacacagtagagaagacctccgcggttaacaagtgttgcaattggaaagaaaattacgaatacgtgatccaatcttttacaatatctgtctctatcattgaaaggacagtaccttacaaggacgttgtacaacattacaaagcatcatacttgtggacggaaatgcttaaatttatagataaacttaaaatatgcttcacatacttatatatattttttctggacggagagaatactgatgtacttccgtttgggtgagcataaaagaaattcttcatggcacggttcctaggactaaattgcagagcgtgatcgagcctgcatgtggctaaacgaacaaaagaaaaacaaactttaaaaatgagagagagagagagagatcaggaaggcaaaggaaagcgagttgggggagaggttgttttagtatctcaacaactatgcacgactacgtcactgatgtttaaagaactaggaaggtagcgcatcagcgcgggcatcttatttagtggtgtttgaaattttgttacgaatgtttatgtatatgattttttttaaaaaaatattttttctcttctaaatatgtgtatatcaataatttgtttgggattgttttgaaagttagtttcgatcactggacgtacagacgtgcaaagaggggatatgtttctgggcatttaatttatctatacatatgttggaccgatgggtacgtcaggtcttttgagggggtgtctgtgacatcctagttcgattagatatggcctatgttttatttaaaggatgtgatttgtgttgtgtgcacttcagtagtactatcttgctagttaagcaagagtgcaactaacttgtaaggcattgtccctctaaccatatcattttcgtgttgactattttacatgaagcgacaacgaaagtgtaagtggggtgatatctgtaagtgagtgccggttaaataggctgtgatgtgttgttctagagaacggattgttacaaattgtaaactaaaattacatgaatcatgtcatcttaaatttatgagaaaaaaatgtcgcaacagtggatatggttcatatgaaactatcatttatactatatatgtttcttttttgaaaaaaattagcatcttaatttaaacttttaagtaatactttttcttgtatactaaagatgcatttatagattttaggatatattaatttaagaaatttcctattaagaatatggtaatatggcttctttatctaattaaagacataatcacatacttctatttgcttgtactacctccatccataaattaaaggattcaaattttatacattttaatactactcatcccatcgaaccatccattattcattttttatccaataatactctaaccatcttctaactctgcacataccacatatttaatgagccttatttagagaggggaatcttagtatatttttacattctttcttaattcctataaaattgtaggattcattataggacagacatagcaattaaaaagagcttcattcatagatggatttacagatttatgtgtac

SEQ ID NO: 1591 - DNA, 6843 bp, Oryza sativa
  unsure (1)..(6843): unsure at all n locations
tcctgcagcccgcgaaagctagtgggttcgtctcatccgtgaggagggaagtggatatgtgaattgtacatatggattttgacagcctgatcgatcggtaggttttatttttaagatatagatctaacattttaaaataaggtccaccggtttgggtaagattttttttctcaaaattttttatataaagatatattagagcgtcatgtggtgatttaggaacgtttatgggaagccacgtggtagcttgagagaatttgtaggatatctaacggatctttagtatataataatagataattcatgtcatattaattaacatatcactcagtaattaaataatttgtatgtgtagtgtccctgataatatccaagtgatgtcccgattttttttctgagttcacccctgaaaattaagggtatatacatccaagtgacgtattataatttttatatagaaatatatgtaccaagagattatttagctatctaattaatttttatactacacgtatttggtgttagccaaaaaaataggaaatatggaaggggagggttagagggggagagagggagtacgtacatacatgtgcacattttttttcgttttaaaacgtattaagtgaacttgtgattggagtgggggaacgtacagattttttttttggaagataagatttagtggtgaaaattaataatctaatgatttaaaatgttgggtccaccggtttataggaaagtgccacgtggcggtataggagcatttgtaggaataccatatggcggtttaggagcatttataggaaatttattagacttttagtatataatgataatgatgctcaaatttctaagaatttttttctaatttttaaatgtgataagttcgatgaatctttattgcgtagaatgatttaagatgacactaatattttaatgtttcgtggttgtttggttgttgccagtatgttcaaatgatggatttaaatttttatagagccaaaatagtaatatagatgttgatttacttaattaattacaaataaaattactgtttaaataaattaaaaaccggattctgttttgatgcgatatgatcaaataatgtattttagtttttgtacatagtaaaatatgggtgatatggattttaaattattagttatttttctattgaaaaattagttaaaaaaagagttgggagaaggagtaagacgtaagtacatactatatacgcacgtacggctggaggggtgggaggatagtttgtttgttttgatagatttaattagttttgtgttatctataacagatctaatggcataaataataagcccactgatttaagtgaaaatcaatggtgggttatttttagaaatttttgatattttttaatttattaaaataccacatgccacatggcggcttgagagcatttataggatgtccatgtggtagcttgagagtatttgtaggaagttttatgaactggtgagcaacaagcctgatgggagaaaaaaccaagcaaattggattggcatactctgtttattgcgttcttcacttgctcgcaactgttacaattatgcgttcggcagcagctgactcattctccacatgcatactttttgaactactaaacgatgaatttaaataaaaccagctgcccctcctctcccctttattggcaccagctgccagataaaataaaaaacaactttttttttctccccgacctcctctctgccacccaggctgcctcaccgccacaccgtcctcctgcagggcaccgccgcggccaaagctgaacctgctctctagccgactggcgcacaactccaccctggcctcgacccttctggtaaagctcgcctttttttcttttctgttgggcttttgtcactagttgtgcgacttgatttcttgttagagtgagcatgctgtttttttttttaaagtgtaccactcataggtaccggcatccatgttaccatgtcatcagtgttgtctaacgggcgcttgttttaaatttggcacctaaggatggtttctaaccggtaccaaagtcgatttctgtagtagtggtccgagccacagacatgctaaatagcgtccacgacttatcagctagtactttcattttctggtttctccaggaacgtacctgacctcatcaagatgatcacatatccacgagatccgaagacagaccccctcctatgttattactcttactgtttctggggttagaatgcatatgtgatcatctttagctagaacttcacgagaacaactgatgccgtatgtagggcgactgctcttggatcctcccagtccaaatccttatggtcgagtatagttgtctgatacatgtatatatctctgaaaattgtaataacatactacctccgtttcaggtaataagatattttaactttgacatactacctccttttgatatattatcatatttatttataaaattagtcaaatttaaagtagtttaactttaatcaaagtcgaaacgtcttgtaacctgtgcaaaccactcaagtacaagaacagtagtctatagaagttccagtatctgctgtgcctcgtagcatactttgtgataagagagatcgcagtccaacatatcaccttgctgatatttcaaagagcacacaacatataaatatagaggaaaaagtgtgcccgattgcccatccaattacgatattctctccgatcagactgttttgctcacaggataacattcttttaaacattacctgaaatactcgtccataggttttgagaaattactgacttactcgttctttataatatattttaacttgcttgtaaggtttgtgtcgttcctgcaacagcgaagggcgttgccgctgctgaagctgacagaggggactgatgctttcatcgacatgtccctgtaaaactgcaacgattaagaagccgtacgtgacttgaaatatgataaatgcagatgaggaatctggaaagaactgcttccttcgctatattttctagtttccggccgtgtttagttttcctctatttttaactttccatcacattatatcacatcaaaaacttttatatatacataaacttctaactttttttccaaactcccaactttctttaaatttttaacttttttcaggaactaaacacacccggagtatgtgagtctgaattagttctctgaaagtggtcggtgttttggcatgttctgttctgtcactaaaaaatgtaagctctaatggcgccttttacgccaactttggtttcttattagttcctttcaatctagttgcccagcatagacccaatcaaagccgggcatcattttcactaaaaatgtcgaagggagacaatcgtgggatcgaagatcaactagaatgtactcaaccaagtagcgatgttatttatttaatcttcattagtgatccctttgagttttccacgagagcatgtagttgagatataaaatatcttcatcttggggacttgcatatcctctgcggctacatgattgcaagagaaatccatggccaacatatggagaaaacgctgtgtaatagatactataaaaaccaatattaattttatcttagctttattaattgttatctctgttgcgatgtaactaatttcagtaacacaaaagagaaagggaaaagagaaacatcgttggtacgtatgatatcagctcagcgtcaactcttagtatctatcttatataagtccattaaacttcctacaaacgctctcaagccgccacgtgggattcctataaacactcctaaatcgccacgtggctctctaataaattataaggaaaaaatccaaacaataatttccacttaatcacggtggacccatgcattattttttaccattagatttatctaacaatataaaaacataaaaagcccactttccatcccttcacgtgacgtacgtgtatcaacctccacgtgtagatacgtacgtatctttcctcccccctcacatcctctccttttccccccctaaaactgacaacgttatatattataaaaaaattacatagcttaacaattataatttttaaagttcttttagttgttcttttatttataattcaataaataattcaagtttcatattatctatattttattttactatataaaattgaaatacatcatttggacattatatggaaaccaaacaagaataagacattataaaaagaatttgatgatatgcttcattttatcttaagtcaatccagatgatcaaaattgatcaaacttcctatagagcgctttttaagtaaccatatatcacgtctacggggaaaaaataatttggtggttcaattagctttaaccattagatttatctaaaaaacttaccaattaaatttatctgtaaatagctccacatctataatgtgtacgtgcaggtaagtagttacatacgtactaaaaatagtactacgtacatgcatacttacgcacaccaagccccacatctttatttctttttccctttctcacttaaattagatgaaaaaccaaactaataattcaatgagcacgtgtgtcatcaagcacctaagataagaaataatactaaataggcaatcatcaacaaatgataagtagaggttgccaccaagccacaacaaataatagttgactacaaatagattgcgagtatgactaatagggttcctacaatcctaagaagccacgtaacgctttgataaataacacaaaatctaagaataaaagtaaaacaccttgccatcaatttacacttaaaccggtggatccattatattcaaccattatattagatctatcgaagtaatgccttgctcctaaaaacaattaatccctccctatatacgtacatacacgagagatgtaaaaagaaaaaaaagagagtgtatataccatttcgcatgtatggtagattttttttcagcgttaactcctagcgatgttgtcgaggaagcaatgtcgtcttggcaccacttgtatttttttataatgatgtaaaaaacagttgggcgctcatataaacacatgcatacccatcctgtgaatacacatacacacattatcccctacaaggggaaaatatttgtaaaaaaccaagaaaaaatatatagatccgagagactactattcaccatgaaaaacatacctacttacgtaggtacgtgcgtgcgttcgtacgtacgtacatacatacatgttacatacatgcgtacgatcgaaaatggcacgtggaaccacattatatctctttatatttagggaatcatcttaatagtgttaataattagcataataaattttgacaatataaattattctttcgtatattacccatgaaaatgcataagtgaattagatgtatagtaaaagaaaaaaaaaaccaaaacacatattaactagtatgttcatatgtttgtgaaggatggtgataataaagtgatttttgtttgaatataataggcattatcatatagtatatcaaagtttatggtctatattacagaataaatatttttttattataaggtaatgattctcatagtgaatatggcgagatatcttttagtactctttttataaacaataagtgaattgcccgcacatctgcgtgggcttccttcctagtttattaaaaaaaatactacatgggatgaaaaaaaagaaaaaaatatgatgaaagaatatttgggggaattaatagctaagagaacatatgtgtcgacatctttctagcaaacctgaaaatattttaccttagttttattgatggttatctttgttgccgcgtaagcaattttaatgtaaaagaaaaaggaaaaagagaaacattattattgatacgtatgacatcggctcaatgtcaactcttagtatttattaaaaaaaaattactacatggggtgaaaaaaaagaaggatggattaatacatataagagaacataaataaatgtgtcgacatctttgtgttacatccgaaaatattttacccttgctgtattcatggttatctctgttctgttgccgtgtaagcaattttggtaacataagatagaaaggggagaaaaaaaagaaacatcattcatacgcacgatatattagctcaacatcaactcttagcattttaaaaggaaaatttactgcattggatggataaaattaagaaaagaacgataataaaatattattttggtaaattaatagctaacagttcttgtcttatattgtaaaagggtagttttcttagtgacaaccatttactaagggctccaacgagattctagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1592 - DNA, 74 bp, Oryza sativa
aaaaaaaaaaaaaataaaaaaaaaaaaaaaataaaaaaaaaaaaaaaaaaaaaaaaaaaaaaaaaaaaaaaaaa

SEQ ID NO: 1593 - DNA, 4376 bp, Oryza sativa
  unsure (1)..(4376): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgaatgagccatgttgcgtcaacacaacatgctattcgatgatagtcaagaatttagagacgacccagctccacgcttgatgcttttagagccggcactatagtaatgcccaattttaggtaacgctatactttcgttttacctgagctatgcactgcgtccacgaagaaagctgcgatcaggcgaggaatcgcagtctcctgaagtacaccctcgaggtattagcacgatcgttaaatgaacactcaagtttttagtcctgaagcgaccgtaaagcttcctaaatcaactatcttattctcacctcttctgaataagctacatgggaccctgcctaattatgcatgaatgcattcatatgcttcattaggagtttaggactatacattggtctatgtatatgtcgatgtgtccatttcgtcaaaagaaaagagatcccaatacattgatcatgatgtttggaaagctggagctaattaagcaatgcatgtgacactagaattccccatactttccatgcctaaactcaaaccaaaatcaacatgaatttatcgaactttcaatacatataggaagttaagcgattaatccaataaaaacttcacactctcttgttatatatactagaactttaggcgcgcttcgcggcgccctacccgtttgttattggtaaaaagtatcacaagtcaggatatgtatgcacttatattggtaaatgttgagtacgaaaggacttcattctagcacaggctgtgatataacttgaattccgatgttacatgatgatttgaaatagaccctgaatactgtcagataaaaaatacctaataagttcagaaaccacaattatttataatacccaaaagagcaagaaaaggtataataatgtattgaaaaacagtttaatcattcatcctcttttaaaagaggttaattcagttccattacggggcatgaatcacaactaagttgtaatgtaaaggactatgtttgcaatcacttaagaaaataaatattcttcaatcgcacatggagactcagaatttgtatgcaccaggtttctggttttcattgcccgtaaaattaagttcctagcaatcctggaaggtgagtagacactttactggtgtgcacgcgcgcatgtttaatgtgacatggagattattacaggcagcacactgtggaaatggcagagttaggtataatggtaaatcactttttaccccttttcactggaaataatggtgttcactcatgagggagaggcaccctcaaatttccttactaaacagttataggtgtaaagaatgttcctacttcctgtcctgctaccaaatagatagcccagttctttcgtgaactctgaaaagacaatgaaatgcttttgcacttgcacatagtggaaaaattggtaaacaaaaaaaagactgccagccctggtttcttcctcttatcccttatattaatttaaaaggaaaagattgacatcatgttcacaaatttccaaagatttgggtataaaatgatacatcttaaactgcaatgcaactgcttagcatagtataacatgagaaagcacagccacaaggttgcttgatagttaaaaatctacttcacatattaggaagaaacatgcccctacagttttgacataccttagcatcatatatggtggcaactaatcctttttacatgaataagaaaaaggagtcatcggatttgacatttataataggattgcacttattactctctaaaaaggtctgacttatctgcgtgcataacaatacctttcgaaaaaatacatcatatcagatgaagagctatagaaatacaatgcacaattaagctgaaaggagcatatagaacaaaaacacattaacaatgtacagcacctactaaacctatttgattacatcaatccactgaattatcagctaaaatccacttctagatgctccctcaatcataccagcttacaaagaacatttttcggactaatctctgcttcaatatctggtatttggtacataggcccaagaaaaaaaaaatcagagagaattttccatgttctgatttgtgattctaacttatgcagttattaaacataatccaaacaaaaagagaatattttctatgttctataatttgagtcttaattcagattagattgacctgaaatctaaagatgtcatgaatcttcagattttgcatttgattctgtgacattatatcaaacagctagatgacaccttaaaaaacacaatgaagcaaaaccatcaaccatccaaaccctgtcctgactcctgaccatctccttaaaatatgtaatggagcagagcgaaccacagtggtttcatgaaaataatcagttgacactttcagcatgctgtcagctggttataacacacctactgggagcagttatgccagagctgttgcctcggctgaaaaccattggagtgaacatctaagctttggttgttggaactatatacaaacacaaccaaagaaaaagatatgcagtacaaatcagaaatactgtagcattcctgattaaaaaaaaaggtagactatcatttgtaagggaataatggtgtatgaaaaagcaaagctagcgagggaactggaggcaggaaatggaagatacatgccaagcatacataagtgagtgtagaaaggaacgggttgtggcttaactcaccaaaagtgaccatgagaagcaaactacaaatggaccctgggcaaggcgacaacacatggttccaatatcaccagatctggaatcgttaaacagtggtggtgccgcacggccgacagagcatcaagctaaccagcacccacagtattgacaaacttgagcaccttctatggcagcaaccaatcctttttatacagataagacaaaatcaattatcatatttgatattcatatttataattagattgcattttttctcttttttgaaaaaagattccacttatctattgaccaacacttcaaagtatcacctagagtagaaggcaaactgaagagaaaaacatagattttaacaatctttcaccttcttgtacatagaaacacaactgtaatgtacattaatctgctttttcattagccgatgaggacggtaattttaacagagctaggaagatgcaaaataaatggctcagcaaaaaagagtaagttgtgtctcctaggcaagaagttttttggatttaaatcaacagcaactatgaaattgtaagtcccttaaatataattgcatgaaagcacataaaccatttcttgcatacttaattaaactcctactcttaaacccaatccagtctagagcatacattttcatttaataaagttttcccgaataagtaacttgagttatgtcacaaataatgttttcactattttcaagtcagggttatgtttgccaggcaaagtcaatagggacccccaacatccaaagcaacattataccagctcggaaaaaaatctgagcatgtcaggttttattggctgatgtgcactgagtaacataagaaaacttaattcaccatcatttcacataataaacatctactgaatatgccagtattttacacggcaaatataagaatgctagaaaaagaaaaataatttgattcaccatgcaactttctccgcttgaacttttacagccatggttactcaagctgtcgatccacccccaagaagggtcatcatgctggaacaaaagtagtccatgcataacaataacttttcagagaataaatcatttcataggatgaaccatagaaacacaaagcacattcaacctaaaaagagcaggtgtgtaggtgctcgacggcatggcacacaatgacgcaacctcaaactggcctaaattataaagtggttatgaacattcagattttgcatttgattctgtagagaactacaacaaatagatagatggcacctaaaaatcggatttaaatatgcaaatataaccagcttattcactacttagaatcccatgttatagctgaatctaatagttacagaggttcgcaggcagtgatcaagaaatatatgggggtatcaattttaattaaaaaacatttgcagttctacaggaaaagatttgccatctatatatgtaccaagatttcaagttctaccaagaaaaatgcagagtccctaagcagcgcatgtaggtgtatgaatcttg

SEQ ID NO: 1594 - DNA, 11091 bp, Oryza sativa
gcaagaatagaggaaaggtttgcactcatctgagaaaaaacatggctggcaggtggtagacacagaacggaaaccagatcagtcatgcatagatccaacatgaaggggatttctgcttctttttttcccttgcacacatcagaacgacttccccaatgggtcaaggggtgaggcaacagattgacctccttactatcgaactccatcaccgtgccgcggatctagtgccacgccgtccgctccctctgcttgctgggaggagagcggtgggggagtgccaggagatgggggagaacaggggagagctcgagggggaggctgtcgtcggcgaaactccatcaccgcacccaaatccaatcctgcaccatcgagtcccccagtccccttgctccactgggaggagagtgatggagggagcaccaggagaaggggaggataggggagagcgcgaggagcaagttgtcgttggcgaggagaagccggggagggaaggcaaggcggcggcggcgcaagagcggggaaaggaagagaaggggtgggtgaacagtggtggctagggtttgaggggaatggaggggatagggatgttctgttttgcagaaaacacccttactttccttttttcagagcgcggtcctatatttggaatttcgtctccttcacgtaggatataccaagacattgagggcttttacaaaagaatacaaaatacagaaacatacagtgagggacttaagaatgattatcaagttaatcaaggacttttttgcaagattgccagctccagcgcccagcgtggacatcacgggaagcgaacacgccagccgaaaaaccgcagaatcgctgtggtgcgagcattctatggtcctctttaatatctccgatatactgcactcttgtatattcccactggaaagagctgaaatttatatggctaatatttatgagaaattttcttctattctgctgtttctatatgtacaaaagtactatgattttattatattaattaagtattttagcacaaacagcgtcttggagtgcagatccatatcaatttatgcgattatattgtaaactgacataacatttcttattaaaaagacacaacctcataacatcaccatactgtttaagacttgagtctaaaagcatgtaacttcacttaattgcatcaaccggttttcccaggggttggagagctgctccccatgctcgaaatatatttgcatgctagcaatttacagaatatgaaataagatatgaccaggtcagaaatcaacctaagcaagcacaagacgccactagcacataggggtgaaaacggtacggaaactttccggattccggacttatttccaaaacggaatctgttggttggaattttttcggaaatggaaacgaattcggaaatattttctcagaaacagaatcgaaaatgataagggcagttttgtcggaacgtggaatcagtcggaaactttctggaaattttctcggaataccctggattttttttagcactgaatagtgaataccatggtgtttggcttttttatttaaaaaaaaatatttgttatgcaaatctaccacggtgtttggcttttatttttttaaaaaaaatatttgttatgcaaatttgaagttacataagaatatattttttctgcattgggatttatcaacaacattactctcttaaatatagataatttattccatagatttgtgttttgtgatgtactgttgagacttaacaattggacttatatgattgtgttttataataaattgttgaccgttgagacttgagaattgaatttatcagtttgatgggtttttgtattctaataaattttcgttaccgtattcgcgccggttcgttttcactctgttttcggtttcgataatattcgattccgtttttgtatccagcgtttccgattccgaaaaaaaattgaaacgaaaacgataaagatggtttccgtaccgttttcacccctactagcacacatgttgcacaatggaaccaactcctaaatccaataaagcggcggttgggttcctaatatacttgagggcaacaccttggtctccatgtgcaggaaactttttttcatgaaatggttttcccaatccgatgttataaaactgtaagagcgaataaatagtaatatattgccgccttgatatagtttctatccttgaagcccaaacatatatatcattggtagcactatgcttttgtagggttgcatttcatggtatcctctgaaagaaataaatgagacaactataattgagtagttaatacaaatatatgtatgcagttatttcatattgctactatctatagagcataacggagtaataataatttacgttaatcaatttaagctaatgcacaacaagaaaaaaaaagtttccaattgtacagcattcactattttacggggtgtacgacattgcatcctgttgagcctaatgttcaactcacaaagactagggtgacaaggtatcatgggtaatcaaaagttatcaaggtaggatataatgaaaattaggttacgctacccatcattagttcgtaaataaaataatgcatgtattcaaaacaaaacaattgataaaaatgggatcaatatgttcaaagagtgcacttgcgttgatcccagtcttgcacgacatcttctgaaacaaactgctcttctgctccaatgtctatacgatcgcaaacgaaaaacaaataaacaaaagaaaaatctaactaaagaacataaaatgaaacaacaaattaaaccaggacgtagagctcgattttagaggacttaaggtggaagaatggattgaatcagagttcgaatggaaaatttatagccttcagaagtttgaattcagagaaaatctgagggtaaaagaaaaaagtaatattccgggaatattctttggatacttaatttcggggattgaattttttctgacaagaaaatatgtgtggggcccactgacagtgttatggagtatggtggactcggtgtatgtggactcagctgatgcgtatggacatgaggtgatacagggcaatgatgtggcgctgacagggatggatctagggttaaatagatccaatggttgagattgaatcaagggtttggatggctgtgattatttggggattttttgtcgcgggacccacagatcagctacacaacggaggaggaagagcagccatggctccatgggcacgctccggcacaacggcattgacaacatcgttctgtggcgacggcgcaccgaggcactggctagctgcggtgtcggtaggaggaggcagaggcgaagtcggtggcacggcgacagtggaaatagcaggaaaaaaggggaggaaaaggggcgacgaccggcggtatctatagagggagaggttagtgttagggcgatgcataacaccaatttaaggaaggacgacaccggttctccttgcgcggcttgtggaagttcagcggcggctatgcctcagcgtagggcgtgggctgagtcggtccccatcgacggcagcgtgggccagcgacgcggatgaaaggagaggccaggctgagggtgactcgtgggctccgggattggcttcctgggcctgtgtaacgccctgaaaatcgctctaagtttaaattgtgctttaatgcatttctagaaatttaaaaagcctaaaagagcctccaacaattaaaattcaccaagatttatgtcaagttggctagtgggtatttttaataagttccccatgcttcaaaatgtgtaaccaatttttacttgaattttcagagcatcctaaataattttaaggcaacaaaaacaattaaaggaattttataaaaaggaaaagctaaaagaaaaccccttcctcctcttgggctgcttccagcccatctctccctctcttggcccagcccaaggtgaacttattcccccctccccctccctctccttgggccagcccagctcattccttctccctcggactaagtccatcattcctccttcgcgcgcccagtcagagacaggtgtgctccctctcgatgacaggtgggtcccacccgtcatccctaacctccagccatcctctctctctccggccgaattcctaccgacggcaacctcagattcgcctcctccactcgccgtttcatcaaattaattgaggggaattaatttccacctcatcctgtccaattcccccataatttcacactcgatcccgcattatttgcggtggattttgatggtgttcatcaatggtgagctccaccatggccggcgtcgatctccctccccggcacccttatccctcccctctggcctataaaagggaccctcgactccctcctccctccccacacaccgccgctctgtccctcctctcttcgcggccgccgcgccgctctcttcttgtgccgccgccgtcacagctccggtcgcccctcgccggtggtccggacctcgtcggagcccggcgtcgccaccatccgcttcttcgcttcctcctcttccccgtccacccctccgtcgagcacgaggaccgcgggaacgacgacgacgccgacaacccgaagttcctcgtcgtttctccctcgccgccagcaacaccgtcgacctctcgccgccgtgtctgctcggtgagaaccgtcacctcctcctcttttcgtttttccctttcctgtagtccgtcgcaccgccgccgcgccgttggccgtcgccggcgagccgcctggctcggttgctgtcgtgcctgtgcgtcggtgtgccgtgagccgccctcggtgtgctcggctcacggtggatcgagcggctggcaagtgggacccgctcgtggaccggtccgcgtgcgctctctctcaataattcaagttttcctttagaaaaataattcacaaaattgtaaatttccatttaaataacaactaaacttcaaatggccatatcttgaccgtttgaactcagaatcgacccgttcaaatctctagtttccccttaaaaatgagtagaacccatttatgtgctttgtcgcttctgttcatgtggtttttattagcctttttatatttcttcgtgttggtcgtgtagatcccgctgttccggaagatcagctcttcatcgccgttgacgccgaagactttgtgagcgaaggcaagtcatatctaccttgaacatgttgaatcccatattgtgaaaattatgtggttttacttatattgcattgctttatagattataccgttcattattaatattgttttattagttattcctatgctctttgttatggccatgatgttgatttgatatccatgatcattgtgaaccctagtaaaattataacttgactagtctagtatcctacatgatggactaactagttgttttaggtaaatgcttagtcatgcttagttccaacctactccctccgtttcacaatgtatgtctttctagcattgcccacatacatatagatgttaatgaatctacacacatacatatgtctaaattcattaacatctaaataaacgtgggcaatgctagaaagtcttacattgtgaaacggaggaagtagaacttttggataaactagactatggtggttaacaactaaaactggattagttatggactattgactggtttgtcaatagatgggtgataaaatgctttgtacaactaaaacatatttttgggctgggcttggggtgcaagcaggttattttggtagtcacaccccggctaatataaggaccggtcttcgggcctctgttgcaaggcatcttcgtgcaaccacaagtctagtgggtaaggcctgactagaagtttagatcttctcaaaacaaagaccattggttggaagcgtgtggggcctggattaaggccaattttcactcggtgcaaggggggacctgtctcgtcctgggggatccggcatcctttaccttgtcggggaccggcgggcggcgaaacctcagcgggttctcctgttttgggtagacctagatggatagtcttgtcacgacctctattcgagtactgtgatagtacccggtgcgtggtaacgtgtgttgaggttgtgtcttgtgggtaaagttgtacacctctgatcagagttaaaaattattcgaatagccgcgccctcggttatgggcaagctgagcaatgtacccaaagttagttttgttttataaaaccttgggagggtgaaatcatgatggtgtagtcatgtggagattagcctgggttaagacaggttcgcaggctcatgcgaccttgatgatatgaaaatattggcttagaacaggatcgtgttttagaatgagctttaacctgattaaaatgtttaaactatggctttatgcaaaataaaccctattaggccatttccttgtttaccctatgcattattgttgcatttccggtgtgacttgctgagtacggtggtggtactcagtcttgctcacaaaaataatccagaggatggacctgaggaagatgaaggcttggatctctagttcgctccgccatcaagtgcctgttctgtagtcttccgctgttttatttgtttatctttgagtgtgagggcctaagtcgcccatgtaataaagtacttgctttacatttccgcaagtgtggcttgtaataatcaacaatgtctatgtgtacctcgccttctgggacgaggattaatgcactgagcgtttggaaatggtgtatatttccgggcgtgacaagttggtatcagagccaccttgaccgtaggatgagcaagtggtctaagccttaggatgatattttttttttagaaaatagttctttaattgtggaaactttttttattctatcttcaccctctcttgctttgcaaaattgtttactaattctttgttctgtttttttgaaaaatagatgaccagccttggcccctacaatggcgtctcacttaaggggttagttctgcagcttcgccacttgatcgttgagctgggctacaccgaagaagtccagtttgttggtaccactgtgccagacgaaggagaaaaagagttggcatccccccgatggtcagtcaaggccaccttgctctccaccaaccctagcttggaatcattggagctaacgggagggactgacaccttcatcgacgcatgccaagaagtggtgcttctgggcattggcaggctgcttcaacgacactggacacgtctgcaacacactccattccgctatcatcctactcgcagtttggcggaggactatgccaccttcagggatgccgagcacgagaacgacaccacgatcgatcacctggccaagatggtgcaggcgtatgatgatgctcgtgtcgactactacaagatggcgaagagaggttttattcaagcttctagtaggattctacggctaaggaggaagaacctgtgtgtgaagttggagatggctagcctgaagcgggaattgcgtaacctcgagctcggacatggtcaggttggagaaggaagctctgttgtggggtctaagcgttgccgtgttggaccgtccttgaagatcacgacacgcaagcgagatggccttcctccgatggtgcacgatgctcaagcgtcagccagggtgattgtccagaactacttggagcgaaggggattgactgtggctcttgccaatgaagatgactccaacgacaactcctatgacggtgatgatgagtcagagccgacagtggacgacaacgcaacaaaggacgagtagacgcgtagtcttagtacgcgtctatttttatcatttatcttctacttgagtttgttgccttgtgtgctttttggtatggactatatcgacccgttgtgatatagctgtacctttgtggtgcttaagcaacttgaactctatgtaaccaacatcacatcaataaaatttaaataagttggtttaatagctcgtgttcttgtcctaatatctcccttctttcttttcctctcatcttgggtactacagatggtaaacacaaggagtattgctactaacaatgctcgtgctgggaactcagctcagaatcagaatcagaacaagaaccagaaccagaatcagaaccaaggccacgcaccaccaccgccacctccaccaatccatgatcaccccaacttagcacaagtgctcgccaatcaaaaccatctcatcgcagctttgctccaccaaatgcaaaacccgcaagcacctgctgctcaagctcccatacacgctccaccacaatcaaagctgtcggaatttctccaagtccggcctcccactatttcaaacacaaccaaccccgtcgaagcaaatgactggctgcacgcggttaacaagaagttggaccttatctagtgtactgatgaggagaaagtcgcttttgccgctcaccaactgcatggcactgcttccgagtggtgggaccacttccaggccacccaaccagctggacaagttattacttgggctcgtttctctattgcttttcgcagagctcacgtacctgctggagttttagccctgaggaagaaagaattccgtgaactcaagcaagatggcaggaccgtcactgaatttttgcacgagttcaataggttggcccgctatgctcccgaggacgttcgcaccgatgaagagaagcaagagaaatatcttgaagggttgaatgatgaattgtcaatccatctcatctctggtgactacgaagacttccaaaaactagtcgacaaggcgatccgcttggaggacaagcaccgaagatggaaagcaagaagcgcaagttggctaatgcgagtcaattcgtgttgtctgatagtgtgtaggtaacttatggtcagtcttggttaatggtgaggatcgagactatgctcagggaggagcagatgtccagtgcggttgggataccatgtgagaaagcgactagagttaggatttttggaggtcaacttcggtcaacgtgggatcgggactagacaagggagcagttgaggtgcaaacggtcagtgataatgggtgacgaagttggatatgagatggcacatagtggatggacaccgtgtgggagagatctttgcaacgggcttcacgaggtgtttctacattaagcgttggtgttcgtgaaggaaaacggaaggaaaactgttgaggattatatggtttctacagtgcttgatgtactgtagcgatggtactgtatcatgcagcatatgcatagaggattatctgcagctgcggtatatggaagagatatttacaatttggaaattgtagattggtttggaaattcagcaatagagtcctattgggaatatgagttgtatttctactttgagtaggaggttttcggtataaatagagaggaaggctatgccttgagggtaagccaagtttgagagattagatagggtttcgtgaaaacttgcgaggggtgctgtggctgcactttataaacaatacttgagcaataaagatcatatttaatcatcaaggcatcgacgatctattctagtttcgtaagttttgcgtttatgtttgattttggcattaacttgtgattgttcgttttgctacgattttgttcaatttagtccatcgaaaacctttctaatacttcattgatcagatctggaaagtttcattcgttggttcgtgcttgattcgaatttgcttaagttttatgtttagttcagatttgctgaaattccgagacagctgactttcgagggtgttttctcttaaaccgttttttagtttacatatccctccggtggagttgtttcttggtttgtctagtttattttgtcaacttttcaacttgatccaacggttggcataagagaaattgacatttgacattaagagaccggccatgcctcggttggaccgaccctaacaggtcagatagaccgccagatctatcaagattagattatttgacttccactgacttaatcgttcatccccctcttgtagccttggttacttgtgttctcttctacacattaatggttagagatgcttacattatgttgatacacaacttatttcgtgtcagataagcatcgataccaatattaaccggacattatctggatgttcttataataactaaaaaaagtatggctgctaaaatcgtattatgatgattgtaaattgtattgcaagtttgtgttaaataaaacatgcaaaatgaaaatagcatggactctttatttgtcattttccaaaaattaatatttgttgaattcaaagttaatactatgatgctgtaattatcgtcaatttttaatttagtgttgtattaatttaatttggaaagtagaatttagcaagttatgatccagggcttccttcaatctcctttttagggcagttagtctcgtatactgagaatcgatgtatattaggcaaaaacattgggtttatggttttcatttttttattgcttatgaagtttgtcaggtcaacaatcttctgtccttcagcgttgggagtttctattttctccaacggtttcttcaagctattttggacttaattacacttggaacaacatcctacaaatgcaagcaaagttgatctggttaggtataaaagtcatcttctgtccaagaactgaaggaaatgatcgcggcacggaaattcccaaatgtaattcttgtgtaaattgcaagccaactttatatgtgcttctgtgcttcctgaaatccactaacagatttgagataaaattttacgaactagtcgaggttttcatgcaatcttcgctgtaaaatagagttatactagtattcttcttatatgtttgaggcaaaccaatttactgcaatatagtgagaaaatatggacccatcgaacatagcggtgttaatctttcttgtttttctccaattgatgttgtggaggtggtagaatagtctaaattgacacaatctaaattatgcacgatcaatgatgtaaattcttttttccatcggaatattgtactgtttctctagttcttttagctgagtattgtggctttactaaaatttaattatataattg

SEQ ID NO: 1595 - DNA, 4310 bp, Oryza sativa
ttcctgcagcccaagataactatgtatgctttttaacagatgcaagctgggatggtgagcgagcatgaaggcggctcccttgtttacaagtttattagtgaagggggaaatcatccattctggggcggatatggcccatccgatggcagctatcgtcaatccttggaactctttgaatgtagcgaaaatcatttctgtagctgtaaattgaattccttttgcgcatatgaaagaggattaactcaaacatatatgatgaactggggatgaacatatctttggtgtgaactcattatcatctagcgagtaatatctattagctattgctagctcatgcctgcaaggaaatttctaaagacggacacgattaaaggttgaagatatgctcgccagctacacattaaccgggcattttttttcaggaaagcattaacttacatttattcatttgatatttttggatttgcaaaataattcctttccacatcatggcgattgttgcaaatatgatctcccactataaacccaccatattcccctttccttgatttcacatcaatctaaccatctctcctcaatctacaggtgcattctagctagaaagtagtgaactgcgaaggccatggcttgcaagaaggtgaagcttcagcggatcgtcattgatgtgaagcagcgggtgacattcatgaagagtctcaagggcttgacgaagaaggttagtgagttcgcaacactattcctcatggtgtacggtgaggttgaggtgcaagcaacgaaggtttggccgtcggtgtgggaggcgaccagagttctcgagcacttcaaggccatgccgcatctggttagatccaagaagatgacagacctagagggcatcctcaacgagcaggtcgacaagctcaaagagcagttgcacaaggtgggacgtgatgctgatgaaagcgagaccaagctactcctcattgaagccatcaatggccaccgcccgagcctcgagggtctcaccatcgagcaaattaccagcctcggatggatggcaaatgcacacctcaagattgtcaacgaccgcctcaagaagctccgtgaggaaggcctcatacctgcatccgtgtcattgtcgagcacggaagtaccaatccagagggagggattgctggtggatgttgcaaggggcattggctcaatggggtacaatcggttcggaggtagcagcggaagcggcactgctagatccaatggtgacatggcttagcctttcaacagtgttgcaggattctcacaggccaatcaggaattttcatttgccacccaagtaatgcgagactcattatcacttgattgcctggacaacatggcaaaggtggactttttctgagataatattttgccagagaaagcatggtcaactatcgattttggagggtgtcaatcactcctttatttacatcccaatatatcattcctttctattttgtatcccatcatcccatttccctttttaataataatttcgcttttcccttttttagatccctacaagctagtcttggttcatgtatttgttgcatctgattaccagcttaatgcttataaacgatgaaattcctatctagaaaatgagcaactagaaaaacaagatctgagtggataaattaaaaaaaagatctatgttcaacacaagaaaaatcttaagtgcgaggaaaatgatttttttgtcgattcagcctacaataccatatgaaatagttgaaacatgaaacttagtaaaactttaattttcccacaggatcttatgccagaagatgaatcttttcccgtgatatttgttgtcctaacgaggcagacacgtttttcctatctttttttgcatcgtgctggttttaggtgaccaaccacatgtaagctatatttggaatgcaaccacccataacagacatgattaaagcatttatgtggtgcaagtgcctcatattgccgatacatttttgtgtttttaatgaaagaacatacagtttgttgggacaaaatattatctcagcgaacatggcaagtgctccctccatgggagacaaggagagagctcaaccttgatcgaagacctgtagggacgaggcgggagcttgaggaaggaaaatgtggtagtgtggagcggttgagaatgggtttgccccaccttttgcccatttgggggtttaggctttttttgaggtgctttgcagccatatagttttggggaattttagtcattgcacatgtacatttggtgtcatgttacacaatttatataattctaaaaatattacctaggaatgaaataatccccaacacacttaatccttgaattccatgctgcttgggccatattatattgattccttccaattagcattctccattgtcttctctgtttttattttttaaaaaatagatctcatataccgggcaaagttttttattttccggatgtaccatggatagtcaatatgccttggttacttgtgttctatcctacacattaatggttggagatgcttacattatgttgattcacaacttattttgtgtcagctaagtacccataccaatattaactggacattatcttgatgatcttataataactaaaaaaagtatggctgctaaaatcgtattatgatgatcgtaaattgtatttcaagtttgtgttaaataaaacatgcaaaataaaaatagcatggaccctttaattgtcatttaccaaaaattaatatttgtagaattcaaagttaatactatgatgccgtaattatcgtcaatttttaatttagtgttgtattaatttaatttggaaagtagaatttagcaagttatgatccagggctttcttcaatatcctttttagggcagttagtctcgtatactgagggcaaccgacgacatgattgccctgtagcttgctcaatcatctaagtgaaaatggtatctatatgaaaattcttggaaacattaacccacgtaacaagttcgaaatagcggactttttctgcatccgacacaaacatgttgtgcgagagttatctttccagatccacagataccatggatgccaattcataataacatttatgaacagcgggacttgggttgtcatcgtcattgatcacattttttctctgccgacgtttcatacttcatcggattacctagcgtggtggatctgcaatggaatcgatatatatagggcaaaagcatcgggtctatggttgtcatttttttattgcttatcaagtttggcaggtcaacaatcttctgtgcttcagcgttgggagtttctattttctccaactgtttcttcaagctatttttggacttaattatacttggaacaacatcctacaaatgcatgcaaagttgatctggttaggtataaaagtcaccttctgtccaagaactgaaggaaatgatcgcggcacggaaactcccaaatgtaattcttgtgcaatttgcaagccaactttatatgtgcttatgtgcttcccaaaatccatgaacagatacaagataaaattttacgaactagccgaggttttcatgcaatcttcactgtaaaatagagttatactagtatacttcttttatggttggggcagaccaatcaatatagtgagaaaatctgtacccatcgaacatagcggtgttaatctttcttgtttttctccaattgatgttatggatgtggtagaatagtctaaattgacacaatctaaattctgcacgatcaaagatgtaaattcttttttccctcggaatattgtactgtttctctagttcttttggctgagcattgtggctttactaaattttaataatataattgatgacctgcaataaatatctcgagataattttggaccaaaggggctttaataggagcctaatattacattgctagcttcaatgttctctccactcaactgcatagatggataaacaatccaataaatgtagagttgataaaaatatggtttccgagtaatctagtgttctctttcttaacaagatagccatgtgtgctttttaacagatgcaagctgtgatggcgagcggagcatgaaggcggctcccttgttcacaagtttatgagtgatgggggaaatcatccattctgtggatatggcccatccgatggcagctatcgtgacaggatcaatccttggaactctttgaatgtagcaaaaatcgtttctgtagttgtaaattgaattccaattgcacatatcaaagaggattaactcaaacatatatgatgaactgggcatgaatgtatattt

SEQ ID NO: 1596 - DNA, 16214 bp, Oryza sativa
ttagtaaaactttaattttcccacaggatcttatgcctgaagatgaatcttttcccatgatatttgttgtcctaacgaggcagacaccgtttttcttatctttttttgcatcgtgctggttttaggtgaccaaccacatgtaagctatatttggaatgcaaccacccataacagacctgattaaagcatttatgtggtgcaagtgcttcatattgccgatacatttttgtgtttttaatgaaagaacatacagtttgttgggacaaaatattatcttagcgaacatgggacaaaatattatcttaacaaggagagagctcaaccttgaagacctgtagggaggaggcgggagcttgaggaaggaagaggatgagaatgggtccgcaccaccttttgcctacttgggagtttaggctatgaattttccattagttgaccgttaaattcttatgagaaaagcccattttgccctttgctttgaagaagcatataaattaatagagtgtattatcggagggtaaaaatttgttaaatgggactattatatttatgagttagttatgcaccatattatttgcgataaatatacatttagagatgacataaaaaataatacttaattattacttattgaaagttgtttatgttgcatataaatatatttgtcttatacaacaatctatctattgtattactatcaaaacacatatagttggattccagctatattcggttaaggaaattaatcgattaaaggaagcttatccactagtgaccgtgttcaaggaggatgcgccatggcaagttatctactaattaggaatagtttgtcagtttccttttatctttaggaaagtatgtttagtgtcctataaggactttatgttttcctttcatctttaggaaagtctctttcttatcctacaaggactagtatctacccatgggtataaatatgtacacccggggtcattgtaatatctccacgatcaatacaattcggtggatcgccaccttttaccttttctactttattttatttatcacggtggaacttgacacctgacgcggggctacatcgctattcgatctccggcgaaggggtaagtccaatgttctaccggcctagtcaattgtattggctacattggtgtcgttcaaggctgcatcagtacatttgacttcttggatttctatgggatgttgatatatttgcttggctatttatcatatgtcttagttaatctagtcttagtttctcaatttagctctatcggttgtctctcgctttagggtttctgccggtatcggctaaattattttactagattagattagctaaggcttctaccacccgaaaaatcagtcaacggcttgattatctagatattgtgtttcttttcaaacttagtgctgcatcagttaagtttgatctactaagtcatgtttagaaccataatctctagcctgcttttggactgccaataagggtttcatcagggtttcagccgatgaggtatctagatgttgcatcggtttacaaggattgcatataagttggatttagacgatgataacaaagatttcactgtttaatctaatcttctggattttatgacatcggatctccaaccgatgtattcttcaaccttcggatcagtgcttattctatcatatcaatgttagccgattggtttctactggattatattattgttatttattattatcagccgattgtctcaagtatcagaatctaaattggatatataaccgatagctccaaaccctatcactatcggctggtatcggcatcgactggaactactccatcggctcgtcagccgataggctcattgacctgctatttgtatatcttgttagtttcaggataaacctgactgacacgcctgtatttcaccaacctttggacctgcactggagctaagcagatctcccagaccgttatgttcgtcgacttagtttgcgccagcacagacccggcaccactggccgagtgcggatttttcgtcaacaatatgctacataaaaaaacattcaataactaataaataaatattaaatttttatatcaaatctaaaactaaatttgtcgcagttaatatggtgcataacaaactcataaatataatagtctcatccaacaaatttctacatccaacaatgtactccattaatttattatgtttctcgtagcaaagggaaaaatggactttttcataataatttagcagtcaactagagaaaagggcgtggaagcgatccaaactaaaattcaggggtatgtaagagaatgagcaaaattcagaagcaaataagagattaggtgaacttttatgggtacataggaaattttctctatgagtaatgtcctcgtcatatcattttttaccaggagtttgtaagagaggccccacagcccttagcatcatcatatatccatggctacataattaatccaataaaagtttttattttggtacaagagtttgtccatgttcctagggaacttctgacgagaaggacactaagttgtgccacatcagcactaggatggccagattagcattccctttttttctctccccgccaagaacaacgcgccttgaaaatcaaattcactgctcagtagtttttgggcccatctaatctacatcttccccttcttcttccatggttggccagtgcttgccctctcctaactaccaagcatcaaccaggctcgagctctgtacaccagctacaagtgagcgttctgttgacgtagaatcgtgctgccgccacacacgttatgtgcaacccatggcgcggcacccagagacgcgccgttatagggcgcggatagatgtcgccgaacgagcactcggagagaccccgtcggggtgaacacacgccggtttgtcctagactcaacaggccagctaggatgtccggtttaaggagaatatacttgggataggtagcaagaaaaagtgagatagaaaatatagatggtttggttattaaattgattttaacgattgattggttttgtttcaatccgccttagctcacttatatctataggagggttgaaattgcttcccaggttctttctcacgttcaattagctgtagaaaccaattagaactctcaaatatcaagccttagcaagaaaacccaagaactgataaatcaaacttgtagtcggactctaccagtctaaccgatcacatgctgccggtcagaccggcccctgctatcggtccgaccggcctcgtatgacaagtctaggttctttttaaatttagcaaaagttttcaattttatattctagagccaaatttgagtattaacacgtccaagtgctgcaaatccagctatagctgcagtcggtgccgcaacgcccctttctccactcaatcatttgtccagatccatgttacttggttctttagttcatccggtccactctctttcttttcttagcttgtgtcccaagggcaagctccggcagctagcgaacagcaaatggtcgcatcccctacacctccaatgtacacgccacagccagcaggttgcctggtaattttgatgccgaacaacacatggttgtacatatttgaacttagctcgtactgttctttagccaaacaatttcatgctaatttcaaattctttcatttgtgctcattcacgaatttatcttgactcataattgctatttgggtctgattttgaagggaaatcggcaggaagcatccgagaacaactcactgcgcacttcctccatttttgcagcaagctagtactattcagtggttttagtcctcaagaaattgggctatttgttttttcaattttgtttcgttcttgtcataggctctccggaccttccattataattgagagatgaaatgaataattcaagtcatcaaacaagcataataaaatatccgacgcctcgagagaggaatattggagacattgctgagcctttaacctgccagtcaacttcagcctgagatacgcccgtcaaaccactcgaaggcagtgaccagatgtgttacacattcaggagacttaacaaaaatggctaaagatctataacatctcaaatattcttaactcatactcatgtgaatctagttcacaggatgtgcactagattcacactttcatctcaagcatgattatacatagcaaacacaaataagatgaaagcgattataaactacatctactttagttacattggccgaccggccaaataaatatatagaacagcggaagcttgtctacccaatccacaagcacaccgactaggggtttaccccattaagttcaagtactagaagaagcagtcgattacccgcatcactcaaagactaagtctaaaacctgcaagcaaaagattaattcaatagcaagagtcagtacattattagggcaagcaccaagacaagcctaacaccctacttgcaaggcatataatcaaggaagacataatatggttctttttagcataaagcaagttttatttgcataaaacatttccaaatcaggtttactttcaaataaatttcaacaagctagtacttgtcatattgggcatcaaaataggcattaatcatgtataaatatgcacctcattgccttccatggcagcaaggagcaaggagatcattctcaaatctctttaaattgatttaaaggtaaatttcagcatttaggagaataaacacaagtctatactcaatagatatccacacgccgctcatgaccgcgagcacaacgaatcgattagttttaactctgcagagtttgtacactttacccacatgatgcgaaataataatcatgcaagagcatggcacgcgatacataagtacccgatttattacccgcaacaaagcttttccaaaattcatgatttagccttacaccagcacgatacgtgttactccatcataagccatacacgttatatgacctagaaccgttaagtggcgggctcacgccttaaacttaacgccgtggtggcggacacaacgggaacccacccacgtggcacaataccgttgtattggacagacttagtgacctaaactaccacgtcggggtaaataggaagttcctctgagttatccgaattcatacgcaccggtctaccagaatgtaaggctaaaccataaataatttactaagcttgagctatcccatactagcacatgtggttgtactgtatacgaaatgaactgacattgagtgaagtccttaggtcggtttgggtgcactctccccctatcggtacacaactaatcaccatatgtgcaccagttgaggcccaaacctaaaatccatgttttccatcattttatttatgaaaatcacaagtattaaagttctgtccagattatttcaaaatcaatttttcatatttgtaatgaacccataatgacaaggaagaccattctaagcatggctaagcattataataacctagtgactccaaaattcatatataacgtggtatagtcatattgttcctaaggataggaatgatggatatggatatatgtggggttaaggtgataatgtaaataataggagtttgtctaacaagtttaacacaattttaatttgttaatgtacaatcgacatgcaggatttgcaaacattttcaataacctccaaaacataggttcaaacattttcaataacctccaaaacataggttcaaagtgatcaaagagagggaggtgggacttgccttgaatcaggaaaatgtcagcacctaaatcacttcttcaccgtttaagcaatcatctaaacaaagtacacgttatgcaattaaacaccgaaatatgcgaaaaatccaaaatgctctaaaatggatgatttgtgcacagtgaataggtactggtctaaaatgaatttaggtgaaagaatttatattttatctcatttcatttgagaattatgaattttagaagtttcgtcggtatagtgtaggatttacttaggtactattgtgaaatgctgttgtaaggtgattcttgttaagtttatgtttgctggggtgaagatatgtgttttctaagaccaacacatttggtttcataatttttagagttaatatgaattctttatgtattttacaagttataacgtgttataggtgtatagtgttctataggttcatagctttagaggtttaggtccagaacttgcctcatctagctagtgatgtataaaatgagtattttagttaactaatctaaccttagttcataggcttatggtctttattaccatggttcatattttataaactaggggagctctagtccatgctagcaatttattatatcaacctaaaaattattatatgagctaagtgccttaagttttggtggatggggatggaactatgcattatgcattcactggtctaacaggttttatttgtgtttcattatagctagagtgtatttctatatacatttatatatatacatattgctcaatcgatagctataacctgtacagaaggttccatattttattttactatgttgaagcccactgtttgctggttctatagatatttggttcacttcatttagactaaagatgaattttctacaaattttacaatttaaggttgctctatgatggttattacttacataagaatttagaggcttttatcatacagtaagtatataactttattttataacttggaagtatatgttttggtgattctacagaacttgggtttactcaaaaaggatctaagatgaattttatataaacttctaaagttcatcttatgcaaaactagttattttaaagataatagttttagaggcatttgatgtaaagtgtttatatgttttattttactttatttttagagaacatgttggtggatctgtagaaactaagtttgctctaaaatgagttgaaatgaattttgtatgcattttataaatttgtgcatgctttatgtgtgatttaacttggataaattttagaggctaaatttgtactgtgagtgcaagtttttattccataacatcaaagttcacaatttggtgagttcacagaaatttgaatcatcttaaaatgagctatatttaattttatatggattttacaggttttaggtacttttcttttataatttcagatttttgtttccaaggggtccactgtcagtgagagatcaatatacaaaaagatccctgcggtttctaagaatcaacccgcagacctaggctcatatgtcagtgagttgaaaagttgcacattaaaccttatagttgtttaaattctcgaaacaaggtccctgacttcttttctcacgcacagaggcagaacagccatggctgagctcgatctcgagctcaccggcgacaaacgatggctcgtttgggggtgcgaccaaaagacaaaatgaagatcatgatattgcgattccattcctctacttttcttggtcagtggacatcggagtaacgccggcggcgagtccgaaaggaggatgtttcggtttggtgatgcatgtgcttctacaatcatgtattggttaatggggtgcatgcatgtatgttctataggctgaagggtgctcaccgagatgctagacatggctggggtagctaggttgatgacggcggctcatgtaacggctcggcggcggcaagaacctccgggtgaacggcgatggctcaatcagctccaagaactatcatgtatgtgtgtccatgaggttagtgaggccccagggatggtgtatacgcgaagaatcggacaatggctcaccggaggaggcggaatcgacaatggcgacggcgaccggaggtgaagaagacggtggacgatctccacactcgtagcaccatccttcgagattcttgaggggaaatggagaggaggtcgaggcgaagacgctggcgcgacagcttggtccggcttggtccagataagcgggaacggcgatgatgtcgctgcggcggtgcacagagcgcgctctagagcgaccatgacatggcggcgttcccgctgctgtagaagatgaaatggaatgggatcaaaaccaaagttgttcggcatggcgatatgagaatggaacgagtatgagttagagatggagagggctcgacgacggttggcaatgtccctcttcttggcggccggcgacgaaagagaggtagagagggagagctggagcttcctccctcggttggatcggcactgggatggtgggtgaagagtggcgacacagctgggtggaggtgaagcctcggttcggcgctgccacgtcgaggccacgcgtcgtacacagccggcgccaatctctctctctctctctcggctgtctatggtcggctggaagatttgcacagggtgaggatgagccagagtggctgccaagtgggtccaggtcgtggcaaactaagctagggtgagagggttgggcagaaacgtgggtgaacaaaagatttgaatgattttcaggattatttctctctcccactttagtaattcaattatttaatttgtgggtaggataatttagtgtggatttttctgaaggtagatgaagatacctagattccattttctttggttgcctcaaaaattatggatagattactcacagaaattagaggaatatgggttctttggaaactagtttggatttttaggagacctaaacagagaagataaattctagaaaaattatatttagtcatgataattaacctagtattttaataaattatttcccctatacacttccatgcagttaaatgcacttttcaacaaggtatggttttagccaattaggagttataattagtctattatttgtctggtttaacttatttatttgaggtatcaaatttagttattaaattataccgaaattactgtgtgttgtatatgttaattagagcctacatgaatttttcaatgattttatcttgcacagattattttaaataattagcaagaattattttcctttcctaaatgtatgtaaatgtttttaaaacttttatatttagactcttcttaacctgaggtgatgttgatatgttagaattttagtttaccttacacatgtaataagctccttaactatttatgcataagtttactctagtatttaattaagagaatgcttataaaggtaactaaggtggaatatatcctatatgagttaatttatttgttcacttccaggttcatgactagtcttcagatggatgaccaaatagttttgtggggcttgacattggccttgttgatatattttaagatgtatggttcctattttaacttcctctagctagcactaggccctaatggttcagttgtttatctagatcttagttaatatttatgagacctattatgaaatgcaaatcgaaaatccaaatgcaatccaaatgcatatgaaggactcaagtcaaacatggctatgagaatatgcatgcttacacataaacttatatttttgtcctaggttagagatgcaaaggttttaatttgttctaaaattttatcatgcaagagttatatcaacttcacctaggttttaaaatggaaatttttggctctcaaaaatagaaaagttagcttccaactattttgacagaaaatttttaaggtctagagttcgggtatgttacagttctgtggaatgatagcctcaattaggtagcatattttgaaagtgtgagcgtgtttgtaagaagaaatgttagcccagtttaatttccagctttgttgctgtactacaaaagcatgcaaattgaagattcagttcaagttaagttttttctgttcataataaaagtaacattgttgttaattaatcatttttttccttgaacattgaggtaaatgaggataatacaacatgtataaaaaattaaaataataaaagatttcattttgtagctgaaaacctaggggaatgtactttacacgtaggatgaacatgccacatgtacaactatctgtagaatttcgaactctagggaacaaatatcttccccaaggtattcatgaaaaactccaaggaagtttgtctttccggtagaattgacccctagggtgtcttccgtaggggttaatctaggggaacctgttccctagagttatcttgataatcctagtgtatttggccctagagaagatgttcaattcaacatgtatgaggaatgtcctcttcatatcaatttctttaccagaacttagtaggggaagccccacagcacccaccatcatatatccataggtacacaattaatccaataaagtctacttgggtaaacaatccaataaaaataaagttgactaaagtgtaaattgtgttggtgatacacaaacttgtcggatgggtgtagtatagtgcacgaatttaaaatgctagttttgaagcacaaatttgtctacatgcttaatcttattgatttaaaatagtaatatcaatcgcttcttggttcaacattatgataatgttagccatacatttgaacgatgtgctttttgttatgaaatatcaaattagttagaggtgaagaaattgtcttattcaaactatgatggccatatcacatcaaacataccacaattgttgtactacctcgatctccgggcctaatcgacttgcagttatgacaaatttctacagtttcttgatgtataaatttacaacgaattgccacgctgtccatattgtactcaccccaaattggtaccggcctaaatataaatgttcagaaaagaaacctgcatctaatataaattatgggtactggttactagcaaaaactagcaccaatactttatatgccggttattaaaaaagttggcacctatagttgatccagtcgtcagtggagtacttgtgaacacacctatatgtaccagtctacttaaaaaaaccggcacctatatataattaggaagttgtaggtaccggttcttagatttgttcctaatttatatggtcgtacatgcatcctttgaaggactaatcgtaggtttatcacataatgtctccatgcacaaggaggtacatatatgatgcacttggctcggtgaggtcaagataattgtgtttttttatcgctttcatcaaagaatcataattctgacatatacagatttcttatggaatctatatacttccattgcaattgtgattgagagaaaaattgatagggtgtattatatgggtttattgctttcgctcatggtattatacttgtggctactgcgttagcaaaaacaataagataaattgcaaagtagtgtatttttttaatgaaccgtgcggtataatattaatggttggagatgctttgtgtatgttgatacacaacttatttcatgcctatattatataattggacattatcttgacgctcttattataactcaaaatggtatggctgttaaaagcgtattacgatgatcgtaaattgtattgccagtttgtgttaaataaaacatgcaagacgaaaatagcatggactctttaattttcattttccaaaaattaataattgtagaattcaaagttaatactacaatgatgtaactatcatcgatttttaatttagtgtattaatttaattttgaaagtagaatttagcaagttatgattgatttagactctactctcaattagtctaagctggtataattcaacatttttatgtactaaaaattacaataataatatcccgtgcgactagttcctctaataggggatcatcaaatctttaagcgtcatgaggcactccatgttacctggcaaggtgacctaggtcaagtgaggtgaataaataactcatcagaaaggcaggtccccaattggctgcatccacatatctcaaaagtcttgtcatatatatagctgtcctcctactgttatgcctgctagaggtgatctcttcaactttttggcagtttcagccccaatcatctctaatactccttgatcttgttcacctatctctgcaccatcaagtgagtaatacacttgatgacttggatgtcacaacacccaaagctaataatattgcatctctggttggactagttgctaggatcttgctgccagtcttatcaaccttcaatggagaaaggggtcctccacgattatagttttgtacaagaggaaacgtttttcatccaaggcttccttcagactcctttttagagcagttagactcttaaaccgagggtaactgacgacatgattgccctgtagcttgctcaatcatctaagtgaaaatggtatctatatgaaagttctagaaaacatgaatccacataacaagttccaaatagcggactttttcttcatttgacacaaacatgttgtgcgagagttatcttttcctacccacggataccatggatgccaattgcagaataatattttatgaacaccaggacttgggttgtcattatcattgaacacatttttttctctgtcggtgttccacatctcgtctgattacctagcgtggtggatctgcagtggcattattgggcgcatatatggcaaaaacatctggtctatggttgtcatttttgttattgcttatcaaatttggctggtcaaataattgattgccctgtagcttgctcaatcatctaagtgaaacttgtatctatatgaaaattcttggaaacaagaacccacataacaagttcgaaatagcggactttttctgcatccgacacaaaaatgttgtgcgagagttatcttactagatccacggataccatggatgccagttcataataacaccaggacttgggttgtcatcgtcattgagcacattttttctctaccgacattccatatttcatccgattacctagcgtggtggatctgcaacggaatggatgtatatatggcaaaacatttggtctatggttgtcattttttttcttgcttatcaagtttggcaggtcaacaatcttatgcgcttcagcgttggtagtttctattttctccaacggtttcttcaagctatttttggacataattacacttggaacaacatcctacaaatgcaagcaaagttgatctggttagataaaaagtcaacttctgtccaagaactgaaggaaatgattacggcatggaaactgccaaatgtaattcttgtgcaaattgcaagccaacttcatatgtgcttttgtgtttcctgaaaaccatgaacagatataagataaaattttacgaactagccgaggtcttcacgctatcttcgctgtaaaatagagttatactagtatatttcttacacggttgaggcagaccaatttactgcagtatagtgagaaaatctggacccatcgaacatagcggtgttaatctttcttgtttttctccaattgatgttgtggaggtggtagaatagtctaaattgatacaatctaaattctacatgatcaaagatgtaaattcttttttcccttggaatatagtactgttttgctagttctttttgctgagcattgtggctttactaaattttaataatataattgatgacttgcaacaaatatgttgagattttagaccaatggggctttaataggagcctcaaattacatagctagcttcactgttctctccactcaactgcaataaatggataaataatccaataatagtagagttgataaaaatacggtttgcgagttatctagtgttctctttcttaacaagataactatgtatgctttttaacagatgcaagctgggacagcgagcgagcatgaaggcggctcccttgttcacaagtttatgagtgatgggggaaatcatccattctgtggcagatatggcccatccgatggcagctatcgtgacaggatcaatccttggaactctttgaatgtagcgaaaatcatttctgtagttgtaaattgaattcctattgcgcatatgaaagaggattaactcaaacatatatgatgaactggggatgaacgtatctttggtgtgaactcattatcatctagcgagtaatatctattggctattgctagctcatgcctgcaaggaagtttctaaagacggacacgattaaaggttgaagatatgctcgccagctacacattaaccgatcatttttttcaggaaagcattaacttacattgattcatttgatatttttggatttgcaaaataatttctttccacatcatggcgattgttgcaatatgatctcccactataaatccaccatattcccctttctttgatttcacatcaatctaaccatctctcatcaatttacaggtgcattcttgctagaaagtggtgaactgcaaaggccatggctcgcaagaagatgaagcttctgcggatcgtcattgatgtgaagcggcgggtgacatttaggaagcatctgaagggcttgatgaagaaggttagtgagttcgcaacactgttcctcatggtgtacggtgaggttgaggtgcaagcaacgaaggtttggccgtcggtgtgggaggcgaccagagttctcgagcacttcaaggccatgccgcagctgggcagatacaagaagatgatagacctagagggcatcctcaacaagcagatcgacaagctcaaggagaagttgcacaagctgggacgcgaagctgatgaaagcgagaccaagctactcctcattgaagccatcaatggccgccacccaagcctcgatggtctcaccatcgagcagattatcagcctcggaaggatggcaaattcacgcctcaagattgtcaacgaccgcctcaagaagctccgtgagcaaggcctcatacctgcatctgtctcattgtcgagcacggaggtaccaatccagagggagggatggctgatggatgttgcaaggggcactggctcaatggggtacaatcagttcgaaggtagcagtgtaagcggcactgctggatccaatggtgacatggcttagcctttcaacagtgttgcagcattctcataggccaattaggaattttcagtcccacccaagtaatgcgagactcattatcatttgcctacttggccaacatggcaaaggtggactttttcttagatgatattttgccagagaaaccatggtcaactatcaattttggagggtgtcgctcctttatttacattccaatatatcattgctttctattttgtatcccatcatccgatttccttttttaatcatattatcccttttcccttttctagatccctacaaactagtcttggttcatgtatttgttgcatctgattaccagcttaatgctaataaacaatgaaattcctatctagaaaatgagctactagaaaaacaatatatgagtggataaattaaaaaagatctatgttcaacacaagaaaaatcttaaatgcaaggaaaattattttttttgtcaattcagcatgctgtaccatatgaaatatttgaagcaagaaacttatttaattgtcccataggttctcatgccaaaagatgaatcttttcccacaatatttgttgacctaatgaggcagacacgtttttcctatctttctttgcatcgtgctggttttaagtgaccaatcacatgtgcgctatatttggaatgcaaccacccataacggacctaattaaagcatttatgtggtacaagtgctacatattgctgatacattttgtgtttattatgaaagaacatacagtttgttgggacaaaatattttctcagcgaacatggcaagtgtccctccatgggagagaaggagagagctcaaccttgaagacctatagggaggaggcgggagcttgaggaaggaaacggtggtagtgtggagaggatgagaatgggtttgccccaccttttgcccatttgggggtttaggcttttttcgaggtggtttgcagtgatagggttttgggtcatttttgtcattgcacatgttcatttggtgtcatgttacacaatttatataattctaataataatacctaagaatgaaagaatcccccaagacacttaatccttgaattccatgcagcttgggctacattatattgattccttccgattaacattctcctttgtctgctctgtttttttttttttgaaaaaaatagatctcatataccaggcaaagttttttattt

SEQ ID NO: 1597 - DNA, 5196 bp, Oryza sativa
ggggactcgacgaggacacggccgtcgcggcagtcggcgatggacggacggtggtagccggcgaggtggccgaacgcgccgaagaaccggttccgcgtccggtgcgcggcggcagcggcgacgcccggatgctgcgggagtgccttgaactgcggccgccgcccagcgtcgccgccgccgccgtcgtcgacgcagaagccgaggaggcgcggcgggtggatgacacggaagcggcggaggaagagctcgccggaggcgacgcggagccagtgcttgcagacgatcgcgacggcgacgaggtggtcgtgggactcgaggcggaggaggatctcgccgaggaggtcctcgtcggagagcacggcgctcgccggcgacgacggcggtgcgagctgcggcggccagctttcactctcttcttctccttccatatttcttgggagtttcaggctttctttgcatgcatggatgagtatttcagtgcacactgccaatacatatatataccaccctcagcatgagtagcatgtgaaataattcacatttgaatggttcttttccggtataaacatttccaaattgttgtcctactcaaatgaaacatgtacaaaaccttatatattaaggcatgaattaatggttgtatcaggataatccatggttttgaacggatttttgctttggataaagccactttgtcagtgtatctattagcaaggaattggaatggtgccatgtgaatctatgttgttttctagctgtacatggatgcatatgctttaatatggcctcttctagagtgccaaactggtgccatggatattatgtatgtaaagactgtacgatgtcgatatgcagcatgttgaccgagaatattgtattagcaaaagactgatatatacactacttgctagtagtatgaagtccggttagttgtccatgtactttttattagtttactaacacaaattagcatatttgccacgttggctgatcatccctgacattctcgacggttggcatatgcaccaatgatgctactgaaattctgtccggactaccggctgacgcgtgcaacgacctagtcaaatgatgtaatcagtacagtagcaacgcaagacgacctactgcaagcagcggtagctagctggtgactgcctaatcatgtgaggaagggcttttaggattgttagattgatttcatttcaaactatactattttttttagtaaaattgctaaatacatacatctatttagttttttttaccaaaactctggtaaaaacataaaaaatcttgtcaatctcgtccaaactttgataaggttattttggctacaatctgaacatgacatttataaccttcaatgaaatgaaaacccatgaaaacatgaattaaaaaattacaaattctgaaaaaagcgtagattttaggtgaaaagtacaggctgtcactttagttccttctaaaattgaatttgattttaggcttaagattggatggaaatatatttcatggctatacagtggcggatctagaaaattgattcgttggtgtcataacgtgtctatcggtgtcatagtatactaattatggttagatcatggtgttataacttatggataagcagttttgctatacgttttgtcgaaagtcgtcggtgtcacctgacaccggccctattactatagctccgcccctgtggctataccaaactctagtgtattttttcattaatttatatataaaccttttaaatatgattttcacaaatttttacttactcgacggtgtttaccacatatatttccccccttttatacatttatacgattctttgcttgctggagaacttgattttccaaaccattggggattaattagtgaatcactttacttatttcaaccgtcctcaaaacaagagttccacgggttcagaaacctctggttgtccgaaattccccactgctgccacccgtatcatttaaggtgtcattttatcaaaggtagtcaccctagcaacagataatgccaatactttatcatcatgaacacataagaaagttcaggcaaccgttcgtatccacgtgcttagtagtacatataccagccttgatgtatgtttatgattagcagcttgcccaagctgacttgcatgaacaactagatagtttcgtatcacctttcttcatagtcaaatgactcatgcttacctgctgcgcctcgcggtatgagctacgtacgtagatgtaggtggcgagacgctttgcacaatgctcctgaactcatctcaaatctgttctttggatctccaaagctcgcagtaatgccctgcttacttgcatatttgttccctgttgcctaccaaacctaaaaataaacaaacaatcggtttgcatgtagttctgacaaatgggaaactggatgtgacccattcaacagtatttcttacacagcaatgcgatccttttctattcgatccttttctattcaaaccaaaggatattggtttgatctgaactttcttttgtacaagctggatacaacgattggcaaggccgtgtatcagatggtattggctggttgaaccgatcaccacttggttcccttttgtagccaagagttggtacatacacaacatatagatgtatacccatgtactcacatagtatatatatatatattatggctggcaggatttcttttgtttttatgatggacctgttggattcattctgtggctgagacttctcaagtcgtacatttgtgacaacgagcagatgaaaattgatgataataaataattatttttttagcaaagggcaaaatccctccatttccattaagagaaatgacagggattacaagataaagaacacagggagtacgttcttgcactccaagttcatagtataacaaaagacatcttgccgcaaaacacatctaaagagtggcagttaacaaaaaataaaaataaaaaacatccatcggctacttccaggaagaaaaggcgccattccattttcagttgccaggggagtcttctgatacttgctcgccatccatattgtgacttgaacatctcacttgtgacttgctttagcggctggattccccaccgtagtcgttcttgtttttccaccggtttctgcaaaacagcctagtcattcatccatgagcgagccctatataagatgtcagtaggatcctgtggtagaatctgttcaaagcacaccttgtttcttgctttccaagtggaccacagaactgctgccaccgccactagcaatagttgttttgtaactttatcacaattctgagtccaagcacccaaggtgtgttgtacattcttcataggtttcagatcaaaagcacaggacaccacattccaagtaaatcttgtcatgggccaatcaaagaacaaatgttgtattgcctcttttttgtcacaaaactgacaagtttcatttccttttctccaccctcttttcttcaggtaatttttagttagcacgctgttccttatcagtaaccacaaaaaaatcctgattgttagaggtactttgatgtgccagatttttttatgtatctcccctatcattgaacttgcctcctgcattttcatagctgtgtagaaagatttgatactaaaaactccatttttggtcaagccccaaattatttcatcctttatattgtcataatattttttttatgttattccagtccaacaacttgttacctgacaaaattctcctgaaagttatgctcccccatccttcctcatccttttcgttttacctggccagtgttatctgctgtgtgtgtctgtgattctatataagtgtggacatttttgtgacaaaggttccccccccccccctcctccccccaacaaatacaactgtcttcccaaaataatatgtttgccccatttactggctttttccagcaataggtagacatctatgagcccatgagcccaggttcatgatagtacagattccaccactgccacataaagacatataagatgggtcatctgtaatagctcataaaggagcccatgaatatgtagatgcagggaatgacccataaatatgaggtactccctccgtttcacaagctaattcattttaacatttcttacattcatattgatgttaatgaatttagacatacatcaatatgaatgtgggaaatgctagaatgacttatattatgaaacggaggaagtaatatgcaacatgtcatagcaatcgtatgaaccgtacacaggtcatatataacaagatgcaatacgccatttgacttatgaaaaggtacgtagcttagtgattgtattgacctaagtagtacccaaggttctgagttcaaatctccgtatgattgaattttagattggcttatttgcggggctaagttcctaatttaaatggccgcatatatccggttggatgtagaagctaggtaaaaaatacccttctctaaacaaaatctctttgcctttttaggttggcatacgtgagatgcctcgacttcctcaatattctacatcttcctcctatttgttccgatgtatcccatgtttattcacccttcaatgctcgatctctctggtctctaaggtatttgaggatgtcctacttgacctgtcgaatctagaattaaccgatgaacgttcaccctgatagagtgatgggtccctcctagttcatcgttcagtgagatcttgccttgttatggcgtgtctccgagtgccgccactagtcacatataacataatcaaggtgtggtaatacaatttggtgccaacacggcaacatggtaaaggccatttctgcatttgaggatgttctacttaacctgtcgaatctagaattaaccgatgaacgttcaccctgatggagtgatgggtccctcctaggtcatcgttcagtgagatcttgtcttgttacggcgtgtctccgagtgccgccactggtcacatataacataatcaaggtgtggtaatacaatttggtgccaacatagcaacatggtaaaggccatttctcgagctaccagtgacagttgcatcgtgtccaatggtactgaacggttgtaactggcatcacttcagttttctctcttacacagtttgatgcatttcttaagagaaaatcatcagatgatgtattgtttcgggtgaatagctaa

SEQ ID NO: 1598 - DNA, 10273 bp, Oryza sativa
atcctaaatacacacgcacacgatttcatggaaactcagagcgcaggaacacaaacaacaagtttggtgctgccctaacttctgcagcttttgggttttctcttctcattatatagcagaaataaacacgcagattctacacacacgggcatgatcgatcctacctccaacaatgccaacctacgtggactgaacacgtcttagagtatacgatgcaaaaacgaaagaatcgcagaggatataacaaagtccgctactaattaagagataaaatgcacatgcacttcacaacagaaatatgctaacaggaaacatattcgacttgacattgaaagtgtgatctatgaagaatgacacaaatgttcgacgctgatagcatcctcttcagatacgtagattcacatgtgttctgtatacatcaattaggacatcagctccttctacacttcacacaagaacatatgctgactctgtacttgaaagctacggagtaattgacagataatcaccatcttttgccagtacctatgcaaatgtgcccatctaggactacaaatattaccctagtatgcattatctgctatgtagggctagatctcctgagacatcccaatccaaaactataaggttagacaactttgatacatgtatacttcacagtaggatgtactgatgaaacaaacacctcaagtgcaagaaccgtggaagccacacatttgatcacatttaataggcatggttgtacacaacattgtggttcgattttgaatatggttgcattaaaacatgtccatcccatacatccagcaggttgtttgtttgtttgcctttttttttctttgcttcagtctatcctaggtagaatttttctttcaacttttcacctcaactgttattcgtacgttgtagataggtattgaactcaaactgaatatcagctattcatggtgttaatttgaaattgagtttcaaggacacaaactatatgaagcaatttgctcctaattacagttggaaacaaggaaaaacagaggaaacagaggagtgtctttttttttttatgtgtgcactttgttatgcagagatcgggagtgttctcagattttcgagttcaataaaacttccatcttctattatatactaaaagtccattaaactttctacaaacgctctcaagccgccacgtggcgctcctacaaacgctcctagatcggcacgtggcgctttaacatccaaccatcggttttcatttaatctggtggacccattatttttaaccactagatctttattttaagaaaaaaacaaatcaatctatctaaaaaaatcccacgttactcggccgtgtcccctggacctgtacgtccttatgtccgatgtacgtacatatcccctctatgtccttttcttttttccttcttatatacttagattagatgaaaaactaaaaagttaatgttaaccatatgttttaagttgtaaaaatatatgttattttaagttttattctaaatagcgcatctcattgaaacatccataaaaaaatattaataattaacattatagactatatgattgtatatcacaattaaattggacttataattaaaaaacaatttaaattttgagtagcattttaaaaatttactcactccctatcgtgtaatactgatatatccaaatgacattattaaatttatcaagaatgtattttcatatattccatgtttctgtattcatatattttttttggaaaattaacaaccatatatatatttttacaccatgtggatgcccttttatctcttaagcttcattcggtctatctcattggatgagcttatctaggacacgcgaaacaaagcatgccatcagcgtaagattaattaagtatcaaatattgcatatcccgtgcttatctaacaaaaaatatatagaaaaatggttctatacacccaggagtacatgctgtatatatataagggtcatcctatatataaaaaacaaaatctagcaacttatttatacataacccatggatttattattttcaaccattattttatatctatatctacgcaagagatgtcataaaggaaaaaaaaaagaagaatgtgtacaagatcagctccatcgagtagttttttctttctttctttgtggctctgagattttcctcaaattgtgcatatgtgtagcaaccacccttggcgagtttgtcaaagaattcacgcggccgcagcaccgcttcacgccatctcgctaaattttttaaaagtatttttttactaatgatgtataaggcaatcacgtttccttaaaaaaagcaatcacgagcgcatatataaacgtgtgctcacccatcatataaatacacatacacacacctgccctaagagaaaaaatatttgtctccaaaaaaaggaaaaaatatgtgcttagtatttgctagaaaaaacatatacacatatcatcgaaaatgccgcatagaaccacattatatctttttaattatgtcattctcatctatataatgttaataattaggacaaataattttgacaatatagattattccatcctatattacccatgaacatacatatctaaatcagatgtataataaaagaaaaaacaaaacaaaaaatatattagcttatgtgtttgcgaaagatggtgagagatcagattatatataaccaggacaattcgtaccattcttattgtttaagggtgtaattcagactttttccttaaaagtcttccacataaggatttataataaaaaattaatcaacactaaacttcctacaaacgctcctaagcctccacgtggcatcctataaatgctcctaagccaccacgtggcactctaataaattagagaaattcttaaaatgacacaacatataactgttgatttttattaaattttatggaccattatttgtaaccattagatttattagaaaaaaacatatccttatctgtaggcccacctcggcctgttgttggcaattgcatgtacatacgtacttgcgtctgctcaatccccccctaattctttcaccccttttatcacctattttttctcctattttcattcttttagaaaagcaaaaattgtatgccaaacaattaagcaaatgcagcatctaaattataatgctaatatttgatttgcttatgtctttagatattttacattttaaaactcatgtcctctttaattcacctgtaaagagagaaatgtcacattaattggggctacattttctgacttttgcgtgtcatttaagcaattttaaaactataaaaattaatgatatatatttttgtcatcgtatataacttgataatagttaaattatatctaataaaagtaaaatgaacagaactatgagtaatattaaaaaaatagccccaccccaacattgtaacacagtaaaaagtgcgcatcttataaatgcttctaagatattatgtcgttctcttaaatcggagaaaatacgctcttaagatattacgtcgttctcttaaataagagaaaatcgtaaaaattctgacaagaaaacaaaatattcgaccatcagcttcgacttgaacatctgacacataattttagtttgttagattaatcatttagaaaaagaacatccgaaatctcccttcctccctgctcgcgtacagcgtacgccattcttttctctctattttttatctccttatcaactgaaattaaaattatctatatgtaaaaaaagacacaaatggacctccatctattacttatatcctgtcaggcttctaacgactttctactaacttaattaatttctcttaacatgcctatgaaggctatgtacctatacaaattgatcttgatacttttaaaacgatcttattaggagataaataaatattcataagaaagatgatcatagcatcccaattacacatatgatctatgaagtcactaatcataataggtattcatctagcaatatagacaataggttaaaaataaatgtgtggccagttgaacatcataccaataagcatgtgggttgcacctaggaatcttaacagtgaaataaccttgaggcggcttttacaattggaaattgagcaaatgttgctagatttaaaacccactgtaaatagaaaaattcaaacattttacgagttctatttgaatgaaaaaatatataaaaaataaaatacaatcaatcaaaaaattgatattatatagttcttaaaaagaggctatgttaagctccgatcatatacaacgtaaaagaggctagctattcctatttcctactaatgttgattagttaatgtcatggataaaaaaatatgcaaattctaaacacgtaactcatgagatatctatctatctacctattatctatctatctattattatatactaaaagttcattaaaccttctataaacactcctaggtcgccatgtggtatcctacaaatgctctcaagtcaccatatgtcactctaataaaatagaaaaaatctaaccatcaatttttatttaaattggtgaacccattaaatttgatagttagatttatcttcacgagaaaacaaaatctccctccatccacgtacgcctccacaatgtacgactatccatttttagagcaacgtacgtatgatccatccgtttccctttttcctttttttaatatccataataataataaggattaaaaaaatacgggtctaaaacgcccatcaacctactagctagcgtctcctaataagtacattaaacatcatataaatatttctaaacatatcgcactctaaagttagagaaaatataaaaatactaaaacatttgaccatctttttacattattttaggttattagatatttctttttcttacggaaaaaaaatcccaaacttcctctacgctcccatatggcgttaaaacccattaactatccttataaatacttctaaaccactatgtgacacttctaaattagagaaaatcataaaaatttaagaacaatacatttaaccattggtttcgacttaaattgatggacataccatttagattgttattagactttttaaaaaaaagctaccaaacctcctttcctcccgccccgcctctacaatgttaaagacttaaagtacattaaacatcctataaatatttctaagccactacatgtctctcttaagttaaaaaaatcgtataaaattatgaaaaagaacaaaacatctgaccgtcggtttcgacttaaaaacatccaacacattattttaggtcattatatcaatcattttttaagaaaaagatcccgccctcctttgtctagctagctctcccactgtcccttttcttctctttcttctcttactagcacttcttaaaatctatattcaacttatgttctgtttgaactattatattttttaaatgaaatcaatactttaatatccatattgactatatataaatgctatcataaaaattacattctggatccacatccatcttgaggcctccattaaatataaaaaataaaattcgtcattataaatcaaaatatcgtatcttaatttttaataataccggtagacccattacttatatcccattagacacctaacaactttctatgaacttaattaatttatctcaacatgtatatgggggctatttacctatgcaatttgatttcggtacttttatcaataaatgatcttttaggagataaaattatatatatgatctatgaattcactaagaaattcgagaaaaatctttaaatgatatctatttttatgtcataatgtgtacccctctagtgttaatttttcatagacaacatttttaaactataaacgtgctcggttgaagatcatactgattgtaccaaacatgtgggctgcagaaagaaatcttagcagtgaaacaaccatgaggtttcattaccaatatattaagtcaatttcatataagaattaaggaccatgttcacttattctttttggtaaaacttgctatgctacatggtaaattcctaagatttagcgtagaataatctagaaatgtgtagttattatatgacctctattttaatattcttactcaattgaagatatttagatcaaatcatttcaaatatgcttgatagagtggagttttccaattttttaaaaaaatggacatgaaaaggattaaaaaatttatgtaaaatttttaaataattgttgggttcaaaacccattctaaatagaaatattcaaatatttttgcaggactaatagaatgagaaatctcattctaaaatttcaaatagagtgtaacaattttttgactttttgggaaaatgttcgggctaagatatccccgtggggatttgaaataccctaaattttctcataggaactgcatatattatttcgacataatattttctcataaattgaaaattatacggtttcgagtaattttagtttagaacaaaatcataactaattttaaaagcacattaaataagttcaattataatttagatataatattttaatactaggtcacccatacatggacattcataataaaatttcacacatattaaattaggtgcacgttcatgtgcacgggttacctttctagtttcttctaataataccaaataattcatttttttagaaaaaaaacaatagcaatgtatacgtcgataatttaatatgagcgaatgggttattcgataaaaatgacacacttgtctgatagaagagcaatccatggtgaaagacaaaaaagataaataaaatctgatagctaggcagttctctggcttacttgtgggctttttcattttgtacagaattgaaacactactttccaatgaaaagttgtttatttgcatgagtagttgtattctttaaataacttccaagcagccatataaaagttacaatgcttgcacatcagatagaggtcgagtcatcctaagagcaggtaaagcaggataggctagccgctgatgatattgccacatcagttctaaggtggtgtttggatccagagactaaactttagtccgtgtcatatcggatgaatttggagtattaaacataacctacttgtaaaactaattacataaatacgatgtaattcgcgtgacaaattttttaagcctaattaatccttaattagtgtagtttcctgtagcatcacataggctaatcatggattaattaggctcaatagattcgtctcgcgaattagtccagagttatagaatgggttttattaatagtctacgtttaatatttataattagtgtccaaacatccgatgtgatagggactaaaaagttttagtcacatctaaatagggtctaaggatggctggagaggaaagagagtcttagccgcagacttcaaagagacattctccacgcatgtaaactagaaaactaattagcatatgattgattaagaattaatcattataaactcgataaattggtttatatatttttttaaacatcttctatataaaatgatttcgaaaaaaacaccatttaacaatttgaaatatgtgttaatggaaagcgagtaagttgaagtttagctgctaatctgctgaaatgaagtttagctgctgctgctgtccccacatggttgtaacgcccccacggatatagcctgactaggtgggacagaagcaaacttaccagattaaagatttactcttttttttggatgtacacatagttggacagctagctatcatacgcatcagctattagagatttagagctatctcttgctgacatgtgggactaccttttttacagatatcagctggtgatattattaaatttgttatgttatggccctattggataaccccacgaaagtggcagctgccgagtacaaatattgagtctagcatagtttaaactaggcgagtaggaaacaaagagctaaactctcctcagttccaagcgcagccaaatcacctcgtcaattattctcgtactgaatgacaagtctgcactgtgctgattgcaaaaaacttagaaggaattcggagagttgaagccaacgcagttcctggtgcctccaaaacccaaactaaaggctttcaggagattaaatttgaaatgtgaaccattgcaagttcaactctttccctgtctctccaaacactgcttgagacgaccagaaatgaagaggtatactagctagtatttatagtggggtttggccttataaaataatggcctgaatgtcaaggaggatataatttggccaggaatgctgccaaatgcatgggttctgtctcaaggctttaccagagaggagaaagaactctagtagtacttgacttacattactctttgccctttcgtggatatataagacgtcgatccacgttgctgccactgcttggctgcatccgtcagcagaagacatattgcaaaattctcaactaatttgtaattaagtgccagactcaatgaattcattgaagttcataagaatcctaaaaaaaaatcaatgttacatttttttcaattttcgaaaataccagaacaacaacaaagattttcaaaaatacgtattataattcacaaaattcagatattcttttgaaacgatacatttccaaaaaaaaaaaacaatgaagggcaaagcaaacagcaaaacacctttgacgaaaacagaagtaagaaaacaaataacatgaacatggctggtattaattgttgaccacaacatttcttgttacaattaattggatttattgcttgctttctacaccaacaatgcttgcgagtctgtgcttgcacggaacagacacaacacatgtactacctccatgtcgtttataataatatttaagtcaaacattgaaaatataaatcatgaataactcccaagttgttgagtttgaaaatgtaaagattataggaatagatgtcttgaaaaatacttttataaaattatacatatatcacttttcaataaatatttttatagtaacaagaagttaaaattatgttttggagaccgtgtcgctgtccaaaacgacttctacatagggagtatctgtatatagtctgaaacatgtacattctagaacaaccatttctatcattatcatattgtccaattttgaattattaataattaaacaggtaattaaccttttctgggtgcaagagaaagaaatgatgagaacttaagaggggcgtatcaacaatggtgcaagtgtcaagttcatagaagttgcgtacggaacgaaaactcaagcggatgcataggcaatcttccgtatgtatcgaccacctaaccggagataactggtacaaacatctagaacggaatataaatatgagactggtacaaagcagctaatacgcagctagggttagagctcttgatcaagacctctcctcccaaaaccataaagttattacttttctggtacatgtgtagataggatcgatgtagtaaacagtgggaaccttttatatctagtgccttgcagcataggggctagctactccctccatcctaaaatataagtatttttagctataaatctagataactgtgtgtccaaatttatagtcaaaagttgttatatattgggacaaaggtagtagtatttatgctcaacctttacttggcatttgccaattcatagaaagaattaaacttgtataatataatatagttcttcaaattaagatagagtggtattggggctttgcttagacagtatgtatggtatgaaagaggctaagtttccattattaacaacgaaagaagaaatttattcctaaacgtttatgacatatttagccctttagaaatcagacacatctcatattaaagaaaaaacaatgaacactacttgttcttacgataagctaatgttcctcttcttggtctcccccctccatttcgtagtgttcttcgttgtgaacaatataataatagttgttttcacccgttagtgatggtggtttctctagtagcgttggccgcatacgcattggcagtatacaatgtaaacaagttattatatgatcaatataatctacacaaaatagtattcaacagagatcgaaatatagatgctgtcaagaatagaaacaaaaaagcctccaaatccttactgattaaagaactgtattttaaccaagcatttttttagaacaggcttaatgtctaatgaactaatcagcacttaatgggtta

SEQ ID NO: 1599 - DNA, 18786 bp, Oryza sativa
catctattaaaaaacggagggagtaaggtgtaactgaaagcctggttgagcactctttgcttgtgaggtagtctttacctaagctatgtgccaccttgttcgtagaccgatagacccgaacaactttaacttcctggaaagcactgcacttgtttatgatcacctggataattgacccatacaccgacttgttataattgtgatccctcatcatattagccacctctagacaatcgatcatgataattagtatagaaaactcaaagatatagtcgtattggctttgctagcttagagagcatgtacaatctgaaagaggctaagtttctaatattaacaatgcaagtagaaattgattcttaaaaacttatgagatatttagcccatcagagatagacacatctcatatcaagaaaacaataaacaatacttgttttcatgataagctaatgttcctctaaaagttaatatggtggtttctaagtgttggccgcattggtagcaaacgttataaacaagttattatattatcaatataatatagccaaaagagtactgaacagacatcaaatcatacatgttgttgagaatagaaataaaaagtacattccaaagcctccgatgccttactaattaaagaactgtataatatataaccaagttgagatattaacaagtggcattttctgaaggccaaacttttgcactgttataataacaaacgattcttaatttcattgaaatacatactaaaagaaatcgaggccatgtatatatataaatgctcacaaacgggattcccttcattcacggttcatgaacttctctctgacccttttgaagcatctaccaaaggtttactacgaacgatacgaagtacgtacagtagtttaccaagggatttgctttaattctcttctagcaggatcacttgtacacaggatcactcctagcagtgcagtggttggcctgtagacgtgcgcatctcaaactagttttcttccagcaacaacccgcgatgttgttgggaatagtccaacattgctaatctagggggagttgaaccaacttaaaagtaaaagtgggggaagcccttcacctcttgagctagcttttggggtgtagcgaggctttctaccagttggttttgggccaacaaaagatagtgttgttgtggagaaattgtttagtgcagttcccgacaagtttcttcacattgttggcaccatcgagcaatggggtgatgtgtcgaagatgtccgtggcggaggcaatcgggcgcttgagggcgttcgaggaatccttgaagggtcggcgccgcgaaccggaggttgagtatttgttgctcacacgtgcacaatgggagaatctctatatcaaggagaagaaaggagaagacggcagcgactccaacagtagcgagcgcaaggttgataggaagaaggtaaagtgctacaactatggcatacatggtcattatgctaacgaatgtcgcaaaccgaagaaagaagaagcgctgctcgctaccgcggacgacgagccaacgctcctgtgaagattgtttactaggtattccaaaataaagacaacaagattagtgctaacagatgtagcaccagaaatcctgacacctcccaatccaaagcgattagttttatagtgttgcatagataaacggtgtatataattcactaataattcagtatgcctcaacaacatgtagatgaagttcttccaactgctgtgccatgtatatatataacatgtagatgaaggcacatgctagtgtttaagaactagtatatatatgcatgatgctctgtatgctactattatacaaatttgcacatgcctgcagattgctggttttttatattttagcccttttcaaaaacttattcggtagatagacccatataaaagcttattactggaatatacccttttctggatgctaaggttcatggcgcctacgtccaatgtctcggtgccaataccctcgacactgtagcagccaatatgtggaggagtcgacaaccaaggaccaatttgtaaaagtaattctaaaaagggttgaaatgtaaatatcttttcatacaaataggtcctcaacacatgctggtgtcaagggcctatttgatagaaagcatttacgtttgacctttttaagaaattaatttacaattatgttatctacgccagtctctttaataatgaccccgttacaccagtgcctaagctataaacatgggcaagggctgtcaacgttagtatcgttggctctgagacattgaacctttgtgccaataacttggctctgagaaaaaaaaaggttcattcttataatatatttgtaaataaatgtttaaaactaactaaaatgtaaaaatttcagctgcagattgcatgtctgtttgtagacttaaggttgtaaaacactgaacttttggtaaacagaatacgcacatgagtctagacgaccgtctccttttttgctcatcaccaatggttgactgattttgaaatggaaaattggtttagatgtcagaaaaacacaatgtactacgctgtacaagctataaaaaacactatatacaatgttaataatagtattctctgcaccataaaccactataataaaacaaattttacagacacccccaattcgatcacggatgagcgtaaagaacatccatttgtaaaaaatatatttggatggtgtttagtacagatccactaacgcaaatcaattttcgcacgcggatctcttaataagcttaccctcctctccttatcccctcaactcctccgcttcacatcctcatcctctttcccatttactccctctccctctctcttccagtctcatttattcactttcctctctcttactctctcatgcgctcctcatcccctttacttctctctcacttgtaggccggtagaggtgcatgaggaggttggtgcactgcggcgacggttagtctagcggcgctcgaggaggctagcagaggaggctcgcgttgacgctggtaacagcatcacctcctcaggagctgccagccacctcgcagatccggcgatgctggccttctccctcgcagacccgatggcaacggccttcttccatgcaaaccagcacagccagccttctccctcgcagatctggtggcggcggcctcaggagcggtggatccaccgccactggcctctcttgtagatctggctatgacaatgatgggtggccctggccctaggaggggcggattcacatgcgttagcgtcaagtgtggcagtggcgttgacgacgatggcggcaagcttagcagtggtggatctagtggccacagccccgggaaaggcggattcgccgttgttggccttgggtgcggccagtggcggagccacgttgagtttgggtggtgcacaggaaccccctaaacttacaatgtctcacttaaaaacactagaatatgcagctttgcatcgaaatttttatagattttcaatggttagtgcaccacccttactttgatgttagctctgcccgtgggagtggcggggtctcaacaaagatgatagtggtagcggactgcatagacgatggtggcggcaagggcggatttgagctagggttttgcctatttgaatttttatttttgttgtgattttcgttcttgcaaacggatggcataactgaccttatgtgaaaattaccatctgcatggggttttgctactcgtatgggaaaatgttgatttttacatttttatagataaactcggggggcaagcgcttgcattgcccgcttgcaaaaatccgttgtagccttttgcagaaatgtaggctgtatcatcatttggtttaggcaaagaaagtacaaggaatagaactctataacttttcccaaggatcctccatctgaatttctttccctgcttgggtaccccaggaggcgcaggcagccctttcaaaaaaatcaaagaggccaagccggctcggcaatcatgtggacagtgttgcagttatggtctaccgtgatcggccataacgtcgatagaatttgcaaaactaaacttgaaccagttcctggcacctccgattcccaaaactcatcatcaactgatggctggtaggagatgaaagttgagagctgaaccaatagaagttggagccttccactgtttctatccaagataaccgactcagagttggaacaaacagaggttgagcaagtatttatataggcatccatgtacgtatatagctttgacatgtctgtataagttgatatcttctgcaacaatttgggatacatatagtacggtacggtacagcaacatcagtatatattaatttatatgcaaacataaataagagttgcgtacatcaatttatatgcaaacatagatataagttgcgtattactgcttattgggcatagtgtaggtctggcatgaagtgaattaagtgatatatggtgaggtacgaagtaaattaagtggcactttattcagggtgttagaatatacaccaacagaccaaatttggtttgctgcagaccgggatacagctaccttgtttgaggcttagagcctatttatgaggcccaattcaagaggagaacttgtgggccaatggccttaattttcatgaaattgatttaactagcaattttggagaataaccccaaaaaagattgggctccctagagattgaaaaactattcgcagtttctgctattgataatgcattaatatttctttcttgatgtgtttatagcctttaattcgtcaaaactccagatcccttcttttcaggacacggtgaccattgtgaagctcgtagcgctaagaaatcatcttgatactagcacatatcagctcaccacagctagcttcgcccatttcgagctgtgtccacttcgatacagggacatggttatttgaatctaccctacgggatcatctctagatgatcaccctaataaggtattactactctttgatcagtgcttgctgttaacctgtaaacatgcccatctcgaactaacgagtgctacaggagagcaagaaatcgtatcactacaactcctgagtcctcccaagccaaaaccgtaaggctatggatatatgcagtgcaggacacaccggcctaaaaaactatatatagaagttcatctatcagttgtgtctcctagcatgaatggacaaaacagcagctctgattgctattttatgctatagcaacgacatttgttatgatcctccatgggatggtatatgtaaacaatagtgtgtagtagtcatgccagcttgtaatttcctcctcctgtccacaaataccaaataatattgtttgtcttttattgagatatatagtgaggatatatgaccgtaattttaaatattaaacgaggagtggttagggagtgcaagcgtggtcgttgaaattaagattacgtaaaactaaattacagatggttgctgggagatctatactctcttttatttaagtatacgacgttggttaaaaatggagggagtagtactttggaagtaaccactgtagttttggtacagcattgttcaagttgatttccgttatgatatttattttatatagtcggaccatataaaaaaatatcttcataattatgctcaaaatattaaagaaagttttctacgaattttaaaattttcgccattctaaaagaaggaaggcaaagaaacttttccacatacagacttctaaaaaaccgcatacacttttacaatgaactaggaagatagcccgcacatttgcgggggcatgcgcattagtatgtttcaaaaatagttctaacaaaacaaattaaaattaaagtaacttattttcaattttgaattgagtgttctttatatctctctttcgtgaagaaatctcaacaaactttcattggtttttttaccatcctgcaagccctctctttaattacttctcatatatgtgcaattagttatgcatgtgaatcaatatagatagaaacaatattttaaaaaatatttattgtagtacttataattattgggttcacctatttgaaggaaaacgaatggtttgtttttttatcataatttttaggatttttaatttatttgagcgctatatagcatctaggagtgtttgtagcacaccacgcatacgacaggttgagagtgtttgtagggagttatttgatttttactatataatagatagttaatatagcattgcttattgtttatgtactgagttgctagctagaaaatttggatataaaagtgagccggtgagataataggagataaaatgatgggtccaccatattaagtgaaaatcaatgatatgatgttttccttttttttctcagaattttttagatttctctaatttattagagggccacgtgacggcttagtagtgtttgtaggagttacgtggcggtttaatagcgtttctagaaagtttagagtaattttatatataatatggtttttttggctttatcctttaggagttacgtacgttacgttcgtacaaaggtaacatgtaatttttttttgttttttaggtagtacatacgaacattgctctccatccatatgcatagcataggaaggatctttttggtttttttttctgtttacgaatagtcattgtaccttcctctccatccatattagaaggaatgattttaatagatttaatctaatagcctgaaatatcaggatcactaatttaagtaaaaatcaagagctagatgttttgctttttctcagaatttgtaggattttctctaatttattagagtgccacgtagcggcttgagagcgtttttaggaagctaagtggctgcttgagagcttttgtaggatgattaatggacttttaatatataatatatttttttagagaaccgcttcactaattcctagattagaacaagtttaatatgtaaattacatgaaaaactgcttgtacgtagattaattttgtataatccctatcgagaagatcgagatttttactcgcgaaggattgattgcctttgaaatggaaaaaacatccggtttggacgatacacaatgttttactatgtgctgccacatggtaggattcccagcaccataaacagcttaattagtagtaaagcctggagcagcatttgctctaggcaagtatgtaaaccatgaatggaactccatcctttccaagaggccaaagcggcttaactggcaatcatgtggacactgttgctcttatgatctaccgcgatcgcgctccacctagatagagtttgcgaaactaaactcgcagctgttcctggtgcctcccattcctagaactcgtcatcaagtgaaggcttgtattggagatgaattaaatttgagagctgacccaatagtacgtagttggagtcttccactgtttctctccacatatatggcctagacttcgaacaaacagaggtttttgtgctagtatttatacagagctttgctttctactgtccatgtcaaaacaagttcactattctacacttatgctgtatatagcacgtcacgtgtctgcacaagttgatcttttctgcaacaagatagctggtacggcacagtacaacaacataagtacattagtttatatgcaaaggtaaatagatgttgtgcattgcttattggacttagtgtatgacaggcacggagtaaattaagtggtatatgttcaggcacaaagtaaaattaagtggtacattattctggtgttcgatagtgtcaaatagacacaatacaatttccgatgcttcccacccaaaacatgacttgctgaggtgagaatatataatgaagggcttctggacatatagactatgagcgtgatccggccatccattgctccctaagttaattatatggtctgagctggtatagaagcacatgcaagagcatgtactgcaggtgaaaactactgtaagaaacatcaaattgcaacctaattaactatgctatcacctgcagcacaagccaaaataaacgactgtacatgatttcagagtgtatgttcgagttcatcacgtgtaaaaatgaatgtcaagacatcatgaaagtaagattgagatttttacgaaggcaacgaaactgtgtgaaggcacctcacacaggttgattatttgtcaacgagatggtagagaatttgttgcgcgtgtcgaccttaaggtgacatgagatggcgtagaatttctcaatgagcttggctggctttcggtcagggaaaaaagcaggaaattcatcaattatatccaagattatgtgaagggttttacaaggatttgcaatttccccgatcaagtgtcggggagttcaccccatagggtgtcggaggtggggacatggttatagacccacgtggttaggagatatggtaaccacttaaaatatactccaattacaagtatcactcggtggaggcaattacacatcaatatataaactaatcctagtccgcagccccacagcaatatgtcgacgcacacacgatatgacagccggtgctcatcgatgctgcatgtactgctcctccttgtcggcgtatccttgtcagccccaatagccacgacgctgcatgttgcattgccccactagctatgccgatgaagctggaatcccttaccatagttggcctcggagaacttgctcgggtgacggagtccaagaagcgcaagagctggagactggttcagccccgttcttcacacaggggcctggaccgggttaacacgcaagatagcaggagtgagcagtttcgttcctgtccgcactgcacccttgcaaaccctagattttacaaacattgtttttttcttggtgtatgtggagctaggacaaatactgcacaacaagcgtactagtattcctaaagcttcccactcctgaatggcggtgagaaatctaaggtgactacagtgcatgatatggcctcttgtcttgggagcttcacattttctttttgcgtgctgcagcaaaaactgaaacaggactgcctttttatagtgatcatgtatgcatgaggtatataattatactgtaagtaaagcagggctgccttttttttatagttatgtatatctcatctttttatttataactaattattataagtaaaacatcttattaatgacaaaaaataatttaatagaaaataatttgcatgtaaaacttttatatgtgtgtcctttagtaatttttttaaaaaaatatgggaaaacaaactacaacgatgaaaacctgaaatcaactccaaaattatgtttcaaaactcgaattatcacttatccttataagctgaaggctaagtgaagaaaacctgaaatcaactctaaaaattatgttttaaaactcgaattttcagttatccttataagctgaaggttacacgttgcgagccgcatatgaaaactacactgtacagatttcactgttgcaactttaagctacgacacaagataaaataaaaccattgtggctacacatatgcaaggacttgccgttagtaaagtcttgaagggaaaacccttatgtgggagctgatgatctttggtatgaatggcaacgaaaactgatgcccacaatgttcacaatcatatgctccgtatgccggaatgtttgttagttgaaatacaaatttgttcattgttataaggagatgtgtcacattcatcatacgagcaatcctataaaataaatcatttccataactaatatttagcatatattcctccaaaatacagaccaggcataatcattagcctttccaaaacttgttttctcgcttttcactagaagtctagaaacttttatacaccaaaatgtctacgaatagaattctgtgcaataaatttggacttgtaaacaaaccttcaatgctccacacatgccatgcgtacaagaaaaacgggtgatgcaagtctttcagttatcaaaaaaccaaactatccaggatgcaacagttgatacattgttataatgaatcataatgaacggactaactcacaggcccttggagagtagaacacagctcgttctacagaaaactatcctacatacaagaatcgtaaagaagcaaacatcataagttgtgattcacagtcacagcatgcacagacgaacagattagctaagagttggcttgcttttttttttcagggtaagagttagcttgctaactcagggcctgtttagatccatttgaaatggcaaatggcaaatggcaaaagttttggtggcaaaagttttggtattgaaaaagtactagttggtgtttagatgcatcctaaacttttgccattctagcactaaagtgagagagagaaagagagagggagtggtcccaaagcactttttggcacaatttgctactatggactagcaaatgtcaaatgccaaattgccaaattttgctactagtgtttagatccaaaatggcaaaaagtgcttcagaatgacaaaacttttgccattttggaggatctaaacagggcctcagactacattgtaaacaatcgtaacaactaacgctaccctaatcgcccatgttatagtctccaccagctaaaccagcaaaatcgcttgtgtcccatagcggaataaactattcggtatctctaagattcccaatgtctcccaatcctgaacagaatctagtgcaattatctataagtatcacgaagtatttctttccccattcattttgcacatatcgaaatgaataagttctagcgttgccaaatttcttgcctcaaatgtgttgtgagccttgcgacattgtttcgtttgaacacaagcatgacacttaaaacctttgatgaaagtgaatttcgacataaaacttatgtcagctaagcgcatcgtacaaccaaaattcaccactctctcatcccaaagacccgaaatggcatggctatcctcctgtcttaatttcagccccgaggtgttgcggtttggctaaacctataacaacattttgaaactaaactcattgcagttcctagtgcctcaaattcccgaaattcttgaaattacatatagcgtaatcaacgatagttgaggtcatattttatctccatatgctgatcgactcagagaaaccaaaatgtaggggtaattctactacaaagatttgtatttatagcagtttgctatactcgggagtagtttcgacatatctcaagttcagttatagctctctactacataaatggggtcttttgtctggccactccccctctcattttccatacgtgaaaacctctcccaacttataaaaaccgtccaactaaaaaaacaatttcccaaaaaaaaaatctacgactgtatagagtaaaccaaataacctacttcgcccaaatctttcgcatccacgaaactacagaattaaaaaaaaagaaaaaaataaatccttcccgtctataaaaatactgttgcaatacacgggtcaataactatttaaaaataaaaatataagttatttagtgctaattgggattaaacggtaaggtaacaaaatcaaacccttgtaccacattactttacactgggaagcaacacctcggaatccatttggggagccaaatctcccacgcaacacttctataaaaacgatttcgcaggtcgtgaaagatctattggagttcttgaaaagctcttaaatgaaatgaaagtgcactgaggaccatggatatggcccataggatgatgaacaggcgtttcctgcaattacataaacatgcaatggaaattagaacaaccggacaatccggtaccactgcagacagtccaacaacacacagaagcggacaacccggcagctactggacaatccgatcaacacagagaaaaacatgaactcgcctagtggaaatataggctcgtactgtccacctcggtgctggacagtccgacaacactaagtgtttgacactctaacaatgataggacaatccgaccctgcatagaaaaaataaaacctatagatagagtactttgcacactacttatatactagagctagaaggtgatcaacaagatataagcatgtacaaatagatcaccaagttactcaatatgacagcatcaatgcaaagtacaaaaagcaagagaggaggcactgatttagagcgctaaatatgaaatttgtagttaatgacgtttttatttgatgtcatttagagcaccaaatatgtatgtagagatgaagtcaaaagaatagcatgcgtgccaaagtaatgaagtatttcatagataagatgccaagaagaccacgcatggagtaacaatattagggtcccaatcctatataccgcttgcatacatatttcgcatgacttgtgattatcagaaacaaattaacactggaattcattttgacaagtatttccttaagagagatgtctgtgaaaatgtgattgtcacatgcggttccttctaaacgcataagaaaattgttgattaatttttacaggcctaggtcacaggtggttcactaaagacgtctataaattggtaatcatcagtctacaaaattatagtaatgtattaaaaaaccattgctgctatcatagtaatttgtcatatgttctgtgcatgacaaggttgcctctgttgtttgagtgtatcgccctcaactattttacacaggctgttgtatatatgatcaacaaaatgaagtaaatacacttttcagaccgagtccagtaacattagtatatagatgcctcagtacgcgttgggataattcaaagccagagatggttggtggttctcccacatatataacattgtggtatttgaaatgggaatttttgcatgtcaaatgaaaatatataaggaagagtattcatatataaccgttaattacaggtcctttgcgtcacaaatttcagaaaaaaaaatgagaatatatagttgaaggtggcaaattaatactcaagtgaatataaaaaaagctttaaaattttaacacatacctacaaaataaaaaaatggaaataaaaataaggcaaaagtaagaattacgattccaatcaagtttaatacatgccttgatgttagtttatggtcatgattagaagctgatagcctcagctggctagaataactagtttcatcatgctcatgtctcttttagcagatcatcacctttcttcatattcttacatagggatctcgggctcccactcctgcctcatagagatgatactgatctagatggggccgtcgatatgccctatctcattctaggtggcagattttgaagagtgctactaagttcaccccaaatctgtactatgcatctctagagctcgcaataatcctctgctatcttacatttctgcttcctgcgtagcgagcagatgttcctgatgcctatcaaacctatgataaataataaaaccttatatatatatatatatatatatacacacacagacacacacatattatgtacagcagagctaccattttctattcaataactcagacaagtctgaccaaatggtggcaagggtggcatattcaagttttctgggacagcagagctaccgttttctattgaattggaagaaaaaatattggtactgtaactgttgaagtatagtctgaatattttaatttgttcaacctagctagacagaacgctggaactcacccctgcagatcgatgtgttggactggtggtatatatactggtataaggctttgatatgctagacatgtgtcagatgttggtattgggtactgcaaccgactacaactatcggtatatgcaccaatgtagtcacactcacacatattcattgtcatgctatttagtgttgtatactccctctttccacaaatataacggattttcatttcttttaagagcttaaggctagaaaaaacatgatgtccctgatgaatgatatataattgaggatagggagatatatatgatttgatgaaaactaaagttatatattcacggtatactactcaaaagggcgtacgatctatctagagtcaaagacaataaaaggttacatttatcatttagcactaggtgaaaccccgcacattgctgcgggagtttagcatgataacaataagtaaaaataatatgtaatacagctagacaacataagattatgtaaagttaacgtggtttatgataatttaaatttaaatagtatatagaatgatgattcaaatgtaaaagtaaggtgatatgactttatgaaagaagaaaagtatcgagatagtttggaccgtagattaatcatctaaaggttaaaaataattgaggtgatatggattaattagagaagaaaaggagagagataatttggaccatagattaatcatttaagcactaaaatattgatgtgatatgtcttaacgagagaagtgagaaatagcattaactagctaagactactaagtgaggatgaactaggtacatagcatattataaaaataatgaagatatatattgaaatattttgtgaattatgtgggatgatgatttaacatgcttgcatttaaaagctctaaaatttaataaattataaaattatagataatatagcatgtttacatgatgtttaaatttaatggttgttagtggatgatgatggtgcatcttgttaatacatgatgatgggacatcttgttagtacatgatgatttggcatgtttgcatgttaagccttagtaacataggatttgacacagacaactgcggattgctaaagaaatttgtttatcataattaattctctcttgctataaagttatagcccactaattcctaaagcttaacaagcaatggtgttccatcattatcatctaacaattattacatttaagcatcatgcaagcatgctatattatatataatttaataatttattaaattttagagatttaaaatgtaagcatgttaaatcatcccaccattcacataatatttcaatgtatctctctatcaatttttataatatcatatatacgtttatagttcatcttcatttagttcaatttttttcttttttctcattaagttatatcacatcaattgtttttagttcttagatgattaatgtatggtgcaaattatctctcttatattggaacagtcaagccatccaaacgtccgttgcatttctctttatgtagtatgtgactctaaggtgctagcatgtaaaaaccatctacccatgaataaaggcatgtacctggtcctgcaaagctagtgtttggaagcttaaatgcctacactaatgtgcttaaccatataattaaataattaattggaggtcctaacaggaaatgcatcattgttggatagtgcttaacctggtcatacacgcaattttgttagcttcgtaaaaatgttactcttttcgtttcattcgtttcatattataaggctaagacacttttatcaatgaatagaagacatatcagcaaatccactccgttgtcgagtctaggttatctgtaagtggtgaaatgatgtatgctattttagctgaaggtagaaaagtttagagaggttcaaatgatggacatctccagaataatttaattatgaaagtaaaaaacctagataagatgaatgtaccttaatttgttactcgaccgtgggcatgcaccagccccaaatcatatacagtagctatttcagcttgtcctggtggtagcttagggttagtttgagaagagggggattgagaagatacgcaaaacgaggtgaaccattagcgcatgattaattgagtattaactattttaaattttaaaaatagattaatatgattttttaaagcaatttttttatagaaaatttttgtaaaaaatacaccgtttagtagtttgggaagcgtgcacgtggaatacgatgtccttttctcacccaacctcccagaactcatcacaaacgaacgcagccttaattaatttaattaggatactatttcaagtttttgaaaatagtcacgttgtcacatgcagtatatgctctgccattggctttcttatgcacgctatgtgtctaaacccactcatcccatatcattcccaaagcaatggcaagaagttggccatattttccaccccaccgttggggttaagggtggaaaagcatggggaatttaatttggcccattttgaagaatgggattggaattttaggttaatttggttaccaaccgaacccaatagtatgggggagaaattattttttctaccttcggtgcggtgaacttcggagctaatttggaaaacaagagataaatgcaaaaagttttctgctcctgaagtagcttcaacgtacgctcttcttccaaagaaccaaagacagaatgttgacctacatattagcagaagcatcttctataatccatattgtaatacttggaatcttaagacaagccaaaaaaaaaatttgtgtcaggggcttacggccatttttattttattttatttgtctatcctcatgctaatacagaaatcacatcgacaaataatatatcggttcaaattgaacatcacttatataaatattttttctgacatctcttctctcttataattaattaactaaccacttagaacacggtaaagaaagaaaataataaatataattaacacacatatttttttctgacatctcttctctcttataattaattaacttaccacctagtacacggtgaagatagaaaataaatataacttactatcgaatcaactccacggcgcaaacaaagccaatcgttttcgccacgcgtttctcttctcataatgtagctgcagaggagatgcaaaacacgccaacatgaagaattttatatattaactagatgctattataaagactaaataaagcacgtaagatggctacttggtaagttgttttaatattctaatattgttctgccatccaatgagtcatagaatgttaaccgttactatcatttacgaccctgagagtattatccttacatgacagaaggtgtaaaaacatgacggatatttctcgcccgcctgcccgaccgtattaatctgggataaattcggatacccgagtccttacacggatattggatacaaatacggatattttctggcagatatgagatcgggtttggaaggatggtatccgacggatatagagtgtccggtaaattatacgggtattacccggtaaactacccgtacattacccagattgctgccaccaccactccatcatgtcaacaaccaaaggcagccagggagggggcaagcagtcaccgtctcatcgagggtgccgcacgccggcacgccgcgcgcgtgcacaaccactcgccactcacgagcgccgcccagcaccggccgtgacggtacgatgccgatggcgccgcacatatgctagccgctagtggctacgctgccgcgcacccgcgtccgccggccactgtctcgcacatcgccgcgtggatgcgcgacggccgtcgtaccgccgccgaccaccgtcgtactactttgatactgctgtaatagcactgttacttatggtgatgtacagtagtagttttactactgatatgcagctatggtgaacaacagtctacagcattgagtctctaagagcccactactagctccaattcatctatagccgatctaatagctaatttatataatagttgcttactatactattaatatatactcccacatatcatacacacgttgtgtcttagagtccgtgcttgaccgttgctcttctctctcatattttatctcattaaaatatatttatagctggctaatagtcttctattgtacgtgctcaaatatattcatattatacatatatggaatggttgaacggctattatctatatgatatatatggtcgttgctttgatttgatgtccgaataaatattcgcaatcgatagagttcgtatccgtattggtgcgtattcgttccgtatttattcccgagattattcgggtctgtatttgtacccgataatattcatgtctgatccgatcccgattataaaatatgggttaggaatgggaaggatgagaaccaaccgaaccagacccgttttcacccttgcatgacagcaacacctcgtggatgatccgatcaaggttggtgtccccgggcccacttggcatcgttactcgtacggccttctccttccactctttgagcctcgccagcagcgcgaggaggtggccgaggcagttcgtcatggtagactggcacagcgcggggatgtcctgcgtggcgtcctcgtcctcggcaccgggcgtcgccaacgggaaaattaaacttgtacaagttgcaacaaaaagagcaaattaaactgaaaatagttatcgtatattcgcagctatatttgttatttttgttacaacatgtagaagttgaatttaaacttacatgtttgtggagtgatatatttcatattaatctatgttgctaattttttttaaaatattttgatgaatatttaggtgacatgcacgaaacgaggggatatcccctcaagggatgaaatcaccttcccgctttaatggtgctgttagctagaatctgttgctgctgctgttgctggaatgatattgctactgctgaagattggtgctgttgcttctggaaattctctggcatctggaaattatgttgctgctctcaggaatttgtgctgctgcttctgaagctcatat

SEQ ID NO: 1600 - DNA, 5609 bp, Oryza sativa
ttcctgcagcccgctattttttttttgtgctgctgaaactgcagtgctgctgctgctaaactgcactgaaattgctgctaattaatgctgctgagatagcttctgttgctgtgctagctgctccttctgctgaaactgctgcttggactgctgaaaatataagcagtttcagctgaaaattagctgctgattctggaatatatgaaaattagctgctgcaggaggaattttgctgctgttgctggaatgtaactgctgctgctggaaaatgctctgttcttgctggaaatgctgctgctattcttgctggaatgttgctcctactgatgcataaactgctgctgataaaattgttgttgctggcttgctgctgtgagtgctgattgtgcttctgctgctgaaaattgatcacgaaaatgcagacatgtgtgttgattgtgctgtgtggtagcagctgtgtgtgctgctgctgtgtggcagggatggtataggagatcggcgacgagcagcagggcgcgcgccgagagatcggccagcggcgtaggggcagggagcacgcagtggagggatctgccggcggcgttggggaagtgaaaaaacggaaatatctgttggtaagagaagagcccacttttagttttggggattaaatcttgattatctgttggagggaggagttttttcacttcctattttcagtttaggaaacccaaaaatatttttttgggagattataggaggactgctggtgaggctccaagggagagcgagtggattagctggtttatttctaaacataatagatcaaacaaattaattagtgggtccacatgttaatagaaatcaacggttgagattttttcagaatatttaggatttttctaatttattaaagtgccatgtgatggcttatgaacgtttacataaatttctcgtggcagcttaagagcgtttataggaaatataatagatatttagtatataatatataaaatataaatagattagggattgacagctattggaaaactatccaatcaactacgtggcgcaaataaaaccaatcgtttgcgccatgcatctctttccataatgtagctgcagaggagatgcaaaacgcaagactacataaagcacataacatagctgcttgattagttggtggaatattataatactccctccgtttcaaaatgtttgacaccgttgacttttttagtacgtatttgaccattcgtcttattcaaaaaaatttaagtaattatttattcttttcatatcatttgattcattattaaatatattttcatgtacacatatagttttacatatttcataatttttttaataagacgaatggttaaatacgtgctaaaaagttaaggccgttaaacattttgaaatgaagggagtattgatctgcgatctaacaagtcatacaatgttaagcactctcaccattcacgctgagagttttatccttacatgacagcagcacctcgtggatgactcggtcaaggttggtgtcccagggcccacctagcagcgtcacttgtacagccttctgcttccactcttctgcacgctgccgcatctcacgccccttctccccttccatggcctccagtgtcatggccgccacctctcctcgccacgcctcgccgccgatctccatcgcgacgccccactctgtctgcttgtaccggcagttcgtctgctgctccgcgaagaacagccagctcagcatcagcacgccggaggcggggctctccagcgtcgagttccacccggagtgcgtcaggaacacacccacagcgtcgtgctcgaggaccttatcctgcgggcaccacgcccggaggacgccactgcccacgacgcatattttgcatgctgcttttcttcactattttgcatacatagatccaccacaaaaagaggggtttaaaatcataaaaaaatacatagcaagagtggaaaggcatgtatctaaccaatgtagaaaaatctcccgaagatttcgagttcaaaacctttccccctatattttgttgttttcggagagaaacttcggttgaaatgaacagttctcagggaggaagaagactataagaaaatgtttttgcaggcggaccatataaggtttcgcccgtgaaacaatctttgcaggcagaccatatattacgtccacctgcaaagatcctaattatcgcaggcagacgtattatacggttcgcctgcgaagatagttttcgtaggtggcaccttatgtggtctgcctgcaataagtttttttttaggtggacggctagcatgatcttggttgctattatcgtaggcggccctttttctccgagggcaatgcccgcttgggaaaaaaatccccacgttgggaagaacgatttttctagtagtgctggtggtagcttaactgattaggctgcaatttctagtttataatagtcacgttgtcacatgtagcatatgctcttgcaagtgctttcatatgctgtgcgtctgtaccctctcatatcgtatatgtcattcacagacatggccagaagccctgtactattgtcacctcacccatcgcgcttagggttgggaagcattggaaatattattgtgtccgtttcggaccatttgattcgaatccttagatcattttgatcataacccagaccagtcgaacttaggggtgagaagcatctggaatattattgtgtctgtttcggaccatttgattcgaatcctaagataatttttccagaccacatagtatgggggagaaattgttttttcatccttcggtatggtgaaattcgaagatttggcaaacacgttttcttctgtttatatacgctcttcttcaacaaaagcaaagacggaatgtggacctacatattagcataagcatcttttatagtcgcagcttaagacacaagccaaataaattgtgccaggggattacgaccatttagtttttattttatttgtctatcctcacgcaaataaagaaaccacttcgacaaataatatatcggttcaaattgaacatcactaagataaataatttttctgacatctcttctctattatgagtaattgatttaccacctagtcctcgttataaagataaaaaataaatataattatcaaatatgtttttaataatcaggggttgacagcaattagaaaactatccaatcaactccatggggcaaacaaaaccaaacgtattcaccatgcatttctcttccgataatgtagccgctgaggaaatgcaaaacagaaaaaggcatcccgtgaagacgggataagtggataaccttccattcttatccgttctctttctgtgtctctctctctccccgatcctcgcttcatcgtcatccaccgccccaccctccctctgtaacttctcttttcgttcctagcagggggttgggacatgattcccatggcaagccctttaacaagattggaattgtccagcgctcgctatgctaatgtcacgtcgccggtggtggccatggggctctcgtatgctagggtccgggaagagatgcaacgagttcaaggtgggaggtgagttgaggtgtgtcgcaaacgatgtctgcgaccatcacacttgtgtgggtgtcgaggatcagggcagcgacgctccgaatcaaggatggcaacgagaatgaatggcatccctccacctctaaggaagtagccatctcattttcgcgcttgctttttccttatttcctttctcctcatggctctcatcggtgtgaagacatggtactcacagtatttaatgtctgggtatcatgttcttgatacctaggtatcaagtaactggtacccagattatccggattagtaccatatgtaacaggcctgatacctcaggtatcaggtaccaggtacctagatcagtctaacacccataggtaccagacctagtactggtatcgggtacctaggtatcaagtacttggtatctagatcggtctgatacctgtaggtaccaggtacctagatcggtctgatacccataggtaccagacttagtacttgtaacatcctgaaaatttccaacaataaaaatcactaaaatttcaaactttttaaaacttttgcatcatgctggttgttatgattcctattgcttgccaaaccgtaaatgatcaccaagaaggtaaagaaaagaactacatttaagcaatagatatgatttatgagaatataatattgttaaccctacaaataattacgcacaagaaaataaagccagacaaacggaaggttaattactaatttaaattagggattaaatactaaatacgtgaaccatgtgttgcgtgctatgacgtctaaatacacatgaaatgatgaccatttataatggaactctatctataacatagtttcactaggagtaattaatgggatattactaaactctaatggtctatataaaggtaaaccaattcacatgaaataatggtcatgtaaacaaattaagctttatacataaataagaatgcgttggtgtttaactaaacaattagattaatagtgtaccgagtctaaatttgctatttgtagaataaatagattaaaaatatccgtgtaaaatataatgctacacaaagaaactcgaccaatatgccattgaattaataaggacacatcgttatattaattccgatattacccgaaagtcttcaaaaatatataagttcactttagggcgaataatgtagattaatctaaaaaggaatcatttgtgcgataaataaataaatatgggtaatattaatctagggtgaatacattggttagaataacacaaatattgagtaaacttcatttgtgtaaaaattaggatttatagaataaaatttatataggaaataggcttaaatagggttaaatagccggctagcactgttcattagcccctaggtgttcgacgtggtcccctagccctagcccctcctctgccacgctgcctcgcgccccacgcgccgcgcgccgctccgcctcccctctgctgcgccgctgccttgcgccccgcgccgccgcgcgccgtcttgtcgccgccgtcgccctgccgcgtcgccgcgtcatgtcgccgttgccgcgccgtctccatcccgccgcgcgccgacgccgtcgtcggtcgcatcctctcgagccccactcctccgcgcgtgccgtcgtcgtcgccgtcgcatcgacatcatcgcctcgccgcgcgctgtcgccatcgccgtcgcgtcggcttcactgccgcgtcgcgcgccgtctcgtcgcgcctcgcgccccgcgccgccaagccatgtgccgctgctgcgccgtcgtccgtcgcgtcgcaccacgccgagccccgtgtcgcgtcccatcgccgcttcgagctgcgcgccgccgctaccgcgccgcgtcgccgtcgcgtcgcctgtcgccccgcgcgccccgcgagccgtcgccatcgccgtcaccgcgcgccgcgcgccatcgtcgtcgcgctgccgcaccctcgagccccgcgacccgtcgctgccacgccgctcgcctgtcgccgtcggcctcgcgccccgagccgccgcgggtgc

SEQ ID NO: 1601 - DNA, 913 bp, Oryza sativa
tcccaccccacgtctcgcatcgtgcacccaccattatcagagtaaataatttacttcgataaaaacaacttctctactggcggtatatattctatttttctcgtacccaaccaactactctcgcccccactctgttttttcctttttttttcggatctgaatcgatccaccatcccagcccacagatcagcgacacaccatggaggaggacgacgacaccgtggcggttgatggtggtggccggcgagcggtggccggcggcggttgaggcgaaggcactatttcgagcctcgctgccggacgctaggcaacaccttaaccagcaaggaggtgttcacctgggctaatagcaacaaccaacgactgctccacgtcgacgacattgatagaacaagcaagtaaggaaataacactctgatttgcatctgcatactttccttcaacttcacacatgaagccctaattttttttgcaaatcaaattaacatgcaatctccaatattacctgatctcaattgatgggctgcacaggttctacatttgcacatcgtgctccatgtggctggccgcagaggatagggtggagtccactggtgatggagattgtttgctatttttcttttgctcatcatctgtattacatgaacgagaatgtttttgcattttttttgtgcttgctagatgatggatagctgctattgcgcaacgtcgagctcatctctataccacaccgctacatccttccatgattccataatggattttcggctgaatcatttattttcttttctagtttgattcacctgtgagtaattttatagtttgtgtgtgattgagcctgtaactttttcattcatacgactattttgtgatacagatcaataatactcttagtactagtttttacatatta

SEQ ID NO: 1602 - DNA, 602 bp, Oryza sativa
tcactggcgctttctacaatagtgctggcacataataaaaaagaaaattgtggatgtttttgcaagctttcacaacctcacaggggggaactttggaagcataaacagggccatgataacactgttgccgaagaaagactcgccacgctcggtgaatgatttcagacccattagtctgatccactctgtggcgaagcttatatccaaaactttggcaatgagactggcagcatggcttggtgatttggtctcgcatgcccaaagtgctttcatcaagaagagatgcatacaagatttacttcctctatgtgcgcaacatgatccggtccttgcacatgcaacggaaaccatccctcttcttcaagttggatataacaaaggcatttgattcgatatcttgggaataccttgtcgaaatgctgcagtggagaggctttagtcagcgctggagaaattggattgtgcttctcctatcgactgcatcatctagaatcttactcaatgggatagtgggagaaccaactacacacaggtgaggcctttggcagggtgatcccctctcgccctacctcttcatcctagcaattgacccgattcaacga

SEQ ID NO: 1603 - DNA, 699 bp, Oryza sativa
atttgctaaggggtgctagctaaaatttatgtggtcatgtggtgaaaatttatcctataaattaccatgaatttcgggttgttggaccgccgttgtcgcgggatgaccttcggcaactgcctctgtggctggtgttggggagggcgggtttgcgccgagcgttgacatggtttaactttcgcgaaaaagattataaatttcctaccattagactaaatagcattagagccaatgtaatacggggtatactatgaaagatatggcctcagttttgctcagaaatatgcatcaattatattcatttgcatgaagggataaaaagaggaaatcataacatcaaaagagcaagtgcagaaaatctgttcttatgcataaaaaaagaacaagtgtagatactctattcttatccataaagaacaagagtagaggtatataaccactgagtcaatcatgcaaatttaaaaaacagcccacaataagggtacagataaactgttcttattgagcaattcattacttattgagccacaacaggggcaaaaagaagaatagataaaaaaatgaacaagtgtagataatctgttcttattgagcaattcatcactggccatttaacaaggaacacattgggtagcagaagcaggggcaaagatactccacaggggcagcaacaacataaaacaaggaacaggtgtatta

SEQ ID NO: 1604 - DNA, 492 bp, Oryza sativa
ctaatttacaaattcaaaatcaatgtcttttgagtaagtggctatttaagttaattaatgagcaaagtgtttggcaagatctgttaaaaaggaaatattttaataataaatctctaacccaggttaataggaaacaagggaattcccatttttgggcgggttttatgaaagttaagaatacgttcctaaatatgggtttctggattgtgaataatggtgaacaagttatattttgggaggataaatgggttggtaactattcctttaaagataggtacccatctttatatgctatagaaagaaggagaaacttcttggttgcaaatgttatgcattccgtttctttcaatgtttcttttaggagagctttagtagcgcagaacctgactaattcgcataatttgtatgcttcaattgtgcatcttcatttgacagagtagaatgatatttttagatggaatcttctcgggtcattctatgtacttaataatg

SEQ ID NO: 1605 - DNA, 35819 bp, Oryza sativa
  unsure (1)..(35819): unsure at all n locations
nnnnnnnnnnnnnnnnnnnnnnnnnnnnnnnnnnnnncaacggataaaaatgttatgctgaacaaataacagtaatgatttcttaaattgatagagagttagatttcacgtttgactgccgcacattatattataaaatgacatctattggagaacatcatctagagtcaaatacaatagttttcaaatcatacaggtaaacatgacttattagaaaatttaatgctgtggcaataaaactctaaagctaaataggaaaccaattgcatctaagatttgtcaggcaaagtcagagactcgaatttcaactgttggcatgccacttgaggtggtatgaactcctaatgcggaaaaaggcatgcctaatggctttaccagagacctggtaaggtaatttccatttagattggaaaaaaaataaaaaatcgttttcttaaatcttaatctagttcaaccacccaaagagtacagtcgtattttatctcaagcttgtgggcacatacgacattgttcatgagttggtgcaagttatgtttttggaggttggtcatcagcatagcaaatgttctggttttgtactgctgcatgtccaaattttgctatgatctgtttattttcatttttccaaattgtgatatgactagtacaaagttagcacaatttattcccttccaagtctatgttgagatagaataaaactgggtagcaagatgagagttaagggataagaaagaagacaatgatatgtgatggtgggaccattgcccactggacagtcctgagccaacaaggatcctagtcggtggcacatagtaccaaaagaagggctgtttacttagagaggcttaagttaaattttcttgaagtttaagatgaaaattaaactcactcaagagttagtgaccaaaattttagttttgccaacagattatttcgataggcagagatgatctcgttgattcacatgaaaaagatttttgtaatacaacaacttctgattgttttttactaaagtgctcatataaaatgtaatagatttaccattcctttatcggatctttatctactacttaaaatgacaaattggtggtggtaattttgctatgtactccttcactttagatattccatagatggattcatgtagacttggttgatttgtttgctagaccttttgcaaaatgaatgcattatctgcacttgtggatatgtggttgctgattgatgtaacatgatttacatacacaacttagtaggcacttaggcttgagaataactatgtctgtgtttaaattgggagttacagtatatttatttgagacccactacaaaacaggaacactatgctagtcaaagttatgtgttagagatcatgttgatgttgaaataataatacttttgaacggagggagtaaaatcacataagtagcaactatcctacaaggtataaatgtttgtttcgttacactagagagatgacagaagtatagtttgcacttaattgcatatgaatgaatgatcattcacaaacctgtgacaaagcatctctccaccttcctttattgcagagacagcaagctagttcataataaacacttgcagctccaacaattcccctttgttccatgtccttaactgcttcaactgcttcatttactttcccttgttcccagtaggctcttactagaactgagcacataattaggaaaatgacatgaatctcaataccaaagaagtcaaatgaactttatctgaattgctacctttataagttattgctcttggaggtaccccacttttttgcatcttctgaaagaacttttggacaaagtcatacttcttggctttaagcatgacctaaagtaactccagtaagtatgatagaatgccatatcaaagtttagtaagaaagaacatgtctttattatgattgactgactgcgtatgcaataccacactatatacttgagattacaacccactggactacacggaggcacttaagggtatctttatgaactattaggctaaatctaccgacatttgacatgaatggaatgcacagaacaagaagacgacgatgagtgtgagctaatgcgggaaataaaggcatttagttcagagaagaggaaactttgcatcacctcttttttgcaagcttctttgacaaggaacgttggcagaaaaatggcgttacatgtagcagtacggtggatgctatgtttacggatataatcatcactggatggcatgtttgaaagagaaggaatggtacaaaaaaaatgctaagagggttaaagaggtagcgacaaactcagtctcaacactcctggctagctctttttggttttacatttcttcctagctcttctataaaataaaattaaaaactacttatattgtttatatcatggcaggagcatctcccaatatttcccaaaaagaaaaggagaatgtgatgatcagaggactacaataatatggtttcgatccccagacttataaggcagatgcatgtaaaacaagacaggaatcataagctgatctaacctaatttccatcaggagcagacccagctaaactggacttgtgaacctcacacacgcatgctttgcaaataaatttcaccttccataaagtgttcccaaatatgtacaacacatttccaaaatacccatagaacagtaccaatcagccaaatgacaaaatggacagttaaaaagcatacctccatcgctaacccaaatgttgctcctgtaggtatcaaactattccttctcatttgctgaaacacccaaaatacccctttccactgctgtgatagaacgcatgcattaaggacctataaaaacaatggtcaaagtgaagacatgcaaaagttatacagttaaaaaaaataaaagacgtgcaaggttatgaacaagacttcttccaagagagtgcaggaaaacagaaataaaacaaaaacatcaggcgccatccttaccgagttataaatcagaacatctggctccaaggaaggatcccaatctttgcgacgcatcttcattacccttttcgaaggcttctgtctcatatactctataatcttgattagctcgtttagaaggccagctcgaccaagtgtaacagcaatactatggtatgcagccatatcagggtatatttgagcatcactctgatttaacgtaagatataatgcttataccattatgttttctcaattttaggctggaatataagagacaaatggagtaaattctaaatgggcaacaaataaattctacccgcatgatggtgaaaactcgaagtgcttcagttggcctccatgcttttccaaggattgatagtaattttgtatacacgaaccttgatatgttatattccattagtcaagcatcagtacttgagttcaatttcattagataacttgtgcttgcagcgatctgaaacctagtaaactaggatatacctgctttttcgatgcttgtagatgttctcattgtacacccactcagtaacagataaagcctgcctccaatttcctcttgcctcaagcccttccagtatttgtagcagattatcttcattatatattaggtcagcttttttcatcaatctagtaagcctccaatcacgcatacttagatcatcttcgttcagcctgacaaaaaaaacttacttatgcaatatggaacaaagacaacatttcacgcaattcaattcattgtgaacgatttaactcaataatggcattggcatttaggataatgaagagtgcaatgaagttaaatgcacataaggtgaatcctaaaccgctatctatctaaattctgccatatctcatattcttgtaaatgtgattattaaaatcataaagcaaccaccactactcgaaagcagtgaaaggccaagaacgcctgaaacagcaagagcacgaacagggagggattcttcgcttatacctcctcaccagcgactcaatcctcctctcctcatcccgaaaatccgaattccagccgacgccagcacgcccccgcctccccaccgccgcttcctcttcaccctcctctacgtcatcatcctccagtagccactcgaacttgccggccctcctcgccgcgagcatctcgcggaggccgtcgaggccctcgccttcgcctcggagggccccacgcgggggtgccgaggcgccgccgtgccacggccggcccatgagcgcgcggtactcggcgacggccgcgcggaagcgggcctcgtcgtcttcgcccaccaccgcggcgccgtcctcctccctgggcagcgcattgctggccgcctccgcggccgcggcggcggcggcggtgtccttcctggcgcggcggagggacttgagggcctccttcttgcggagcgcgtggaggattttgggggtcggggagacgcccttgcggaggaggcggcggcggagcgtctcgctcgtcggggcggggcgcggccggcggcggggactcgggatggcgctggggttgtggagttggagggagaggtggaggcgaggcagggggaaggaggggataaccatggccgcgcgaggagacgagcctctgccgaggcggcagcgggcgcttccaaagcgtcactcataaacgctggacaggaaggaagagaaatatctgaaattttaaaaaatatttaaaaatatataaacagggtaaaaagaaacttattccaaatataccgtgacctcaatagactattggctattggacaggagaggatagccattgccaagagcacatgaggcgagtcggcagtggcactttaaagtttaaagtttagagttagtgtcactaatacgtgccaaatgctcggacgggaagagaaatataggtaggaggtttatgaaaaaaaagacaaatatccttaatttgataattatagttttagccttttagtttcccagaacattttatattatttattcatgaatatgcacagaaacacatggcactacacacatactacacgttagcaaatgtgcaccttaacaaaccaccacgagaattaaggccaatggcttaccatccttactaaagtcttattaaaagatcatctgcatatgtgtaaatgtcggtattaaaatttatggtaatttggaaccataccattataattttgcaaagtttgatatatgtcatcggtatctcaatgacatgtaggacccacatgagtcaatgacatgtgtgtcaggatggcatatctcaaattttgcaaaattataatggcatggttctaattttccctaaaattttttaaactatggtgtctacaactccattgtcacactagtattgtttccccgctgcatttcatatgctcgattgtgaatctataattttatttattaaaacatacaaataattatatttaactcatctaaattcatctctttagggcagatccatgtatttacaacctaataactcaatattaataatgtattacttggcatgagtattaagttagactatacgataaaaggagatacatgagatacttggcatttttttcctgcatctgcctttttctaaggtgatggtatagttcaaggctatgttcctgaaattggagagaagtttagggaaagttggtagtttgaaaaaaaaagttgggagtttatgtgagtagaaaagttttggatgtgatgtgatgtgatggaaagttgggagtttgggggaagtttggtgtgaactaaacagggcccaattcaaaagccatagagcattcaatagagggaaaccacgtttttcaaagccttctttaatctccaattctccatcataaccttcataccatcagtgttgtgcagaattattctctcctaatctaacattggccattataaaaagggcattcacatgcttatcatgccaaagagagaagacattatatttcaaatacaggtaacaacaactacatcatcatcatgttacaagaagacattgtatccattggcatccatgagagtagattcctaagtcgatggcattgatgcccctgcttgaagagcgttggaagatggttggtggctatccatatctatccctagatttggcaaagccacataaggaaattttcataggttgattatggcgcattggcacctagttgagccgtgaaggattaattacggggtgtgtggatacatatttagctgccacaaccactcgcctctcttggctcgactctagtcataatgggcattgtcgaagggcaaaacctatcttccttattttgctatgagggaaagcacatttaccggtgtaacacacagccatagtattggtacttttctccataaatctatctcaagttcatagatctggctgatcaacaaaggcatttttcctactttagctttggtgggtctatttttttcaaacgacatatctcatcctaccaccgagtagactaactcactgcttttcttagaagatttctcaatttttttctacattcgaagctgatggtaatcaagcagtattagctatgcggacaacccctgattccctaatgaaatcattctacgagaagcttcatagatgtgttaggtgggttgtaggacagtaagggagtaagctatcaaaatgatatatgatatgttcaagttgtcttagtttttttttctttgctgttcttttctttattagttatggtaatatattaatataggtgtagaggccgaatgtaatttatcttcttgataaagtatatgtattctaaatatatacatgacatatatatatacaccttggtttgtccacctcaaccaaaataggatgtaaacaaaagtattagaagcgagtaaaacagaagatatcgtgcacgggaagtccataagaaggtcaaaagatcaatgcatatcatatggcactagtactacccaaatataatcccaagctacctcgctagatgcaggatatgagaaacaacattatgggtgtctatcttgatagggatggatatatatagaaaatgccagtttatgagtgtaactaacttaaatggagtgatattgctttaaggcttctttgaaatgcatgatttcaaaaaacacatggataaaaaaaatacagaatgttgagtatgttgaatcccattggatctataatcatatgatttctcaaaacatgtgtttacatggctcaaaggaaaatatatgatttttgagattatgtattacttagattaagattaaaagaagacagaaatggagatgttgctttggaattctcttaaaatatgggttggagctcatgtttaaagttctttagaattggggtatatgaataaattgcaaaggaattttgcaagcccaaatcccacaaaccaagcaacctccttatgatttttttttcctaagaatctaatccttcaatccaaagaaacataaatattatcataacatctttggttgtatatagaatatatgataaaatcatgaaaaccagattaaagaaaatctataaatcgtttggaggatgttatgaaaatgagattctgtggtacgaagatagtgtagcgagttatgataatttgaacgtattgtactatagggactactcgaaaacattggctacaacagcatagcctacagccatgtagcttggctatcttcaaggcaaccatccagactggctacagtagtataagtgtagcagcattgttgtacaatctaatagttgtttaagattatcatatatatatatatatatgacaatcactatttatatatatgatatctattttcagtatctacgtaagttagatctttctatgatacacgatgagccgtttgtttttgggatccttggaacttgtattgtgtgatgtccactggagtatagctgggtggggtagtaacccattcggaaaaccccactaatccagtccccaactcccaagccgcggccaagccatttttcaccgttcaccgtggattcgagttgactcgcagcgtgccgcgtccgagtccaaagccaaactgtcatccatccgcatcacctcaccggtataaaggcgcgcccctcccctcgccgccccgcgtcggatgccgccgccgcgaccgcgaccgccatggcgtaccgccggaagccgcagcctccgcagacgccgccgtccttggaccaccaccaccaccaccacaccccctccgtgggcccctcgtccccgccgcaggactccctcgccgcgcaggccatgcgcgcctccgccgcgcaccgcgacgccttctccctcttcttgggctactcctccttctccgcctcggcggccgccggcgccgccgcggctcgccggggccaccacgagccctccgtctccacgccttcccccgtaagcttccccgctgagactcccccccaccccttagatgtgtctgatgcgtggcccggatctggtccgctcggggcggtttgtctccccgtcctagccgcttcttgaaatccatggtggtgaatcgattagggatatcgatttagggccgcatctcttcgttttgattccagttaggttcgcgattaactaacttgtgatgcttgactacttctgtttagtggttttgccgccgcctctgctgttcttgggttgggtctccctgacatcatcggaccaaattgttgtatttcttgatttggggagcgaagattctatgtttatactgtcgcttttgttctgtgttgtagggttcttcgggttatgaatacacatccatgaagaacttgaatgaggctaagtacggattttggggggcccttgctcggaaagccaagtcttttctggacgaggatggttcaccagggcagtatgattccccggcgaggcagcagccgtcaagagatgcgccgccggttggtgtccaggtgggaactgctgtcctgacattctcttgcagttaattgaactggtagattctaatttttatttaatgcgtgtactgatcatttcttgaagagattagcagcacagtctaaacttttgacttttgctaatgatgttaacacttattctgtcatcatggtcagtacttgactacttgttcattcatgctataatctgcaccttgtaagtttgtgttgtgcttaactgccattattgtgtttaggcagtttactttcagatgttcttgtgtcaatgccaacatttttattgctattgcagtatacacgctcacaacaaccaccgtctgaaacatggaaatccgagacacctccatctcataagaggtccgaggccatagcttcctccctcaactatattggtggcacaataaaaagtgcacttgaagtaagttgctatacatcaactacttacctaatcctatttaaacgatcacgtgaaagtatatctcctttttccgttaatgttatttaagaactgttcaaataatttctattctaaaaatatcctggtagcattagcaaaccatgtgttagaagtatagcaccatggaaatacttttatctttcttcttttacctttgtctcaacttggaaaatatgaagcattttacgttgttgtctatttcatatcacaacagcactagaataatggtgatatgactggttaatttattttatgattgaggcatccttctgttatgcttttatgttatttacccatgctaacatgttttaaatcttctttccaggaaggccggacgattgtagaaaataaaacagccgacattattcatgaaacacgcaaattgaacataagaagaaaaggagctggctcaactacacaaggagaagctccacaaagatttactcaaaggaatcttccacaaaatccacttgactacgaaactcaattgaaggcatctcgcgacgtaaggtggccaatatgtgtcactagatatgttgcttagtgctacattttgcatcttggaatccacgtggtttccaaatttaatctggtggcatttttgataaacatcatttttacctgatagctgttcaagttttttttttgtgttgagcgtgatatctgtgtgattatattctttgcaaagtatttttcattaaacatagcctttcagtgcttatttcatcctgccctttattttttctctggttgacgaacagtggcatcagtttagtaatcttttgtctctcatcgccctttctgttggagtggattagtgacccatattttgcacttgcaggttgcaaatgccatggcagcaaaagcaaagctgctattacgtgagctgaagactgtgaaggccgatttagcttttgcaaaggaacgttgcgctcagcttgaagatgaaaataagattttgcgggaaagtcacgataagggtgataaccctgaagatgatgatctggttagtaatttttctttaaaacggacaagcaattatgaaaatcatcagattcttgattgctggagttatgtattaaaatgttttgggcttcttctgtgcatctaaagttttactaaataactactcttttgacttgaacacctgtagtccaactttctgaactaataataaatagctgttgagtctacaaattatagcttcacatgctcaattcaaacttatcttggaactgcctaaaaaaattatcatggattttgactcttatataatgtatgttcatcagtgtgaaatgtggccgactcatgcttatcttaccatagtttattaaaaattgcccctgaggggtctaattacattttgtattatattccgagtttttttttgtcatattagttactacctctgtcccaaaataagttcatttttcacctaccccacacataccaatacaaaagcaaaaggactagaataccctccactttaccaaatctcaatggaattgtcccccactttatctactcccaatgtatttatccctactttcacaaactccgatgcaatgatcactaaacatgaacttgttttgggacaaacaggagggggcaatgaacttattttgggatggagagataatgttgatatcttttttgtgaatggaacctgtaattttctgtgccttagagcaagtttaatagtatagcccactactaactcaaaatcatctatagccaatgtaatagtcaattcatacaatagttgcttactatactattaatacctggtcccacctgtcatacatacattacgtcttggagtccgtgctgcagctggctacagatctgtagctcgctgctcttctctctcttcttttatctctttaaaatatgtttatagctggcttatagcctgctattgtacctgctcttaccaatatgacaggagtccagggtggtacctgttaccttccgctgtggttaatcatacttttttttttaaaatttgcagatccgcctccaactagagacactattagctgagaaggcacggctcgcacatgagaattcggtgtacgctcgagagaatagattcctacgagaaattgttgagtaccaccaacttactatgcaggatgttatatatgtggatgaaggcattgaagaggtcactgaggtctaccctacacaagtattaccacctgcaccttctcgggctggttcaggccttggtcgctctgtaaccccagctactcccaagactgccagctcatcaccttcatcaacatccattgttgtaccagaaacttgtccggtcgttccagcctccccaaagtcgctttctcggacttcatctaagcaatagatcaagcccggcaccaccaaccatgctgaagattaaaaggtggttagtggtgcgatacaatccggatgccattgcaaatgtaaaaccaaagctgcgccgttgctgtgccctgtatgttagtctctgatgagttgtgtcctggaaatgtgcggacaaatgatgttcatgcctgagatgtttgtatgatccggtgtaacttacacagtatttataattttactgcatcatcgatttggtactggcaaggtgtgcatgcaattggctttgttttgcccgtgtcaatttgcactctgaaacgaacacatgttgatgcaacccttcgtgattatcttggcagtttctttggttggcgaatcgaagtggttagctttcttgtgatagaaccaattcacctgtgattaagtcttagatttgacacaggtgctcatctttacagctaattattctttgtggtgcgatagcgaggtgcccgtggtgtctccatcaattttaaggtccattgtctagtcctccgaagatgcttataagggggtacatcgttccaatcttccgaagatacttataagggggtacatcgtctcaatcttccgaagatgcttaaaagggtagtatgtgcggggagtgtgcacgtgttgtgagcgtgtgtgtttctattgtgttatataaaatagttaattcaaaatttgggtgggggttttttgaatgggggtaatggtgttgttggcttcttgccctaattttatgttgcaattgtggatttacctacttctttctttgtagggtttatgatttgccctcacgtttttaaatgaagtggatgtttaccatgttttggatggtaattaggtaggcctggaactattgaatctaccttataattcaccaacaacagtcctacattctacatacttcatacttcattgatcggtcaggattgtttcactcaaatccgacgttccagatcgtaaacttaaaacatgcacaaacttataaaatgcataaaaaaaattcattacaattcaaaatgaagcaaactcaatttctacagaatcaccatcttatactcttttgaaaagtaaaataaaatagtatacatactttacatcaaaatgcccctaaaaatattatctacaaaataattagttttagataagctaaattttggaaattcatataaaatacatttcaactcatttttgagtaaactcaagctctggagaatgaccataatatgtacttacaagttatgaaataaaaaaatatacccagagtacaataaaagcccctaaatatttatataaggaataaacaacttagggtacactttaacttgtaaaatctgtagaaaattcattcttaatccaaatggagtgaactaaatttatatagaaccagcaagaggtgaactttcccattataaaataaaatgtacaaccttctgtaacagaaacatcactaaactttaattgaagtaatagtcacttaattatgaactatgaactatgcaatttatataaaaatgcaaccaagctaaaataaaccaaaataaaacttgttagaccagagaagtgataaatccatcctccaccactaaaacttgacacacttaagttatataaggattcataggataatacatcaagtcttcaacataaaacaccctctagttcatataaggtaaagcaacaataatacaatctttaaagttatgaactaaggttagattagttaaaaagatcattttctttattcatctcaaacaaagtagaatatattctggacttaaaacgccagagccttgtacatacagaacactatgcacctacaacacgttataacttgtaaaattcataaagaattcataattactctaaaaattatgaaaccaaatgtgttaagtcttagaaaacacaccactacacctctgtgaagtcaaatctaataaaaatcaaatagcaaaaatatttcataacactactcagtaaaaaatactatataccaacataacttataaaatttgtaactcccaaataaaaagggataaaatggtaattcattaacctaaattcattttagaccagaacctacccaccttgcacaagtcatgcagtttagagcattttggatttttcgcctatttcggtgtttaattgcataacgtgtaaacaagatagatattgcaataacggcgaaggaatgacttaggtgctaacattttctaggaacaaggcaagtccttcctcccctcttctttgatcacattgaaacttatgtttttgaagatgaaaagtgttgtttgcaaagttgcataatatttgattaaaacgatatttgaaaacttggtaaatggtagtcatgaccttattgctgcatgatctaccttgaataattgttgttatcactgtttgtttgtaaccttaagaatggttagagtactcttcttgtgctcaaatgggtctatgcttagagaagttttatggtgttgcattcccaaaaatagtaaagatccacgcctccacaattaaaggtatcataacaaaaggtatttaagtattgctatagatacttaggcaggaagggtaaaaagataattttcttaagagataaaaaaggatataattgtcataatattagtaggaggtacattgataccgcatcagtagttcattaccatcatatgctctaattctccattgcattatttgtgataaggatgtaagatcccgggctttctgataagtgttgataaacagtcgatttgggcggagtcgcgacacaactcgatccggcttctgaacgaacacgctactgagccccgcaattgcagcaccacgtctcctctggttatcaaccatgccgaaacccggttgacctcaccgagaaggctaatccctgcatgcgtatcgaagatcacaagtaagaacaagatagattgcaaccaaattgcatatgaatgattaagcactcgaatttggggttccacataccgatctagcggtgaaaccgttcttgacagaataatctaagcaaaacccgactctaaacgatgacatctactgaataaatatgactagggacattctaggttgcgcacacccccttgggctaagcccacgacataattacaagtccaaaacccaaatcagattcagactggatgaaatacgtggcttgttttccagattcctggtagcttggtaggaattttgacgtgggaccaaaaccatatgaaagtagactccataagctttccaaaaagtactcatgggccctggaattccttctatatcagcagctaggtccgtttgaaattgatgctgtcaggaggcccgaatccgaatccaaaacgtgtagaactttatctcttgtcttctatggaccaaaagtgacgcggtaagatggaagtgggcttggagaaggtcttggtttgttctccaatcaatttctttgatcatccatgaattcgttagctcggtctcttttccttcgcccaagcaagtacctctgcaaacaaaaacacacgaaacttattgtgtagcaccgtttgttcaaatatataacatgtaaatctaatatagaacatatgcaactttggttgattagtacataaggtggtcatggttatatccgagctagttgtgtcctcatcatcctccccttcttgattggaaaccgtccttggtttcaccttgtcatagagcgtattaaacttatttttatttatcacaacatctggtgaggaacatttcttgatgaccatatggttggatcctaaaatctttgtagtcgaaaactacaacactccccttcttgcaaaccaatctataactcatttaaacaactagaggaactagatagagaattacttatacgcatgcggtcctctagaccacatttcatcatgaaaaggaagtatagtcaaatttgaacaaatatatacttgatgcacattatattgtcatttactatcataattgtcaataatatgaaaaatcacatcagaagggcatggcaattcaaatctagcaaataatttcttctctaaatagttgagtggataaagatcatcaaattgaatatgaccccaagtatttaaagaagatagcaatttaagctcttcattttcgctagcaatgtgaatacatgtttaaactcaacacatagtggttctactataaaattaacatgttcattcactagttgtggcatggatataagtgaagcatcgcacaaatcttctttatcactagaaacatcaggcaaattgttttgtgacaaaggtatttcaacaattgtttccactatgggttgctctaacgtagcataagtagtggacatagttggcacatcataactatgcataccttgagtagttgcagcaccattatcattaccttttttcttaggacatgactagatagctactggtagctggtttgtcttatccagctaccactccatcaagtataaatacaatagtgtgtgtctttttttaacatctttaataacttatatcttttaaatcacatattgttcttaaaatctatttgcaccattgtgctccactcaaaatatgcgataaaacaagacccatattgaatatatttaaacattttattaatttaaaagtaatttattatatgtagaagtaggaagtaacttttacatcttatacatgattaattctcattagttactccatcaatattatttacaatccatcaatggttttatcttcttttctcatactacatgaaaaacaaaagtgaaagggaaaaaacaatcaatgtttaaaacagatttacagatttatagaaagttacttcgaattaatatcgaagttacttttaaaagttgttaaacttacttgtgctaattaaatttaatttctatctcctacaacgaatttacttctaatgttgtgacaatgttactttctttttgttttaagttacttttataatttatctaaattagttttagactttactaaatttgcttttatatgtctaagaagtaatttagtgaaatctaatagtaatttagatatattataaaagtaatttataatttttcattaaaatataatcatgtgagatcttgttataaagatttaattgttacgaacacaacggtgtaatcggatcatagatcggatgagtagtttaagagaaaattttatttgaagcataggatgaatagtatatatttgaagcataggggagaaacttctctctctggcgtagcagagtgcgtcatgtggcttaagattcggactattctggccttcttggcaatgtcggcatgtggaacggacgactataccagcgtgcgtgggatcggacggctctagatgcgttgcgtgataagaccagatcgagaggcctttcgagatagattttacgtttttcttatctttagaaattataggcgcttggtcaattgaacattcttcaagcatgcatggagctatagataggtctttttgctcttcgtctttattctcttcctcctcatcgtcttcaacgtcggaggtgctgatgtagccatcttccgtagcaacgtatgcccgttgactagggcaaaccttctgcacatggccaaatccatggcagtggtggcactgaatcttgggcgtgcgtcccgtcgaaatgacagatgaggcactcttggtggatacctgcgaagaacctttacctaaaactgcaggtcgtgggggaggtggttttagcgctacagaaactccggacgtaactggtcgcttgctcgttggtgggggtgcccaaaaagagatgggcttggaaagcctcgaagatggcttcgcccgtggcgtgtacgtgctcgccttgttcttgatctgttgatcacgcccctgcaattccttctctgcaagcattgaaaactgaaacaactagttgacagtgttaaattccttattatctactatgtcccgaatatcgcacctcaatcccatgtaaaagtgacaaatagaatcctcggttccctctactatgctacatcgtatctatcccttttgtagctcaccatagtaatcctgtacatatttattcccttgttctaaatacatctgtttcttgtgtaaatctatatgatatgatggaggaacaaatttatcacgcatagctaccttaagttcttcccaagtagtaggcaaagcaccctctgcagctaacccagtcccccaaaggaaaaagtacgaaatacccccccgaactatagcggttgtctgaaataccccctaaagtcgaaaaccggacataattcaccctcaactatcaaaaccggttacttaacctcctaaggcagaattaggggtggttttgaccggtcttcgtacacgtggcagtacagcgtggcaaggggacgacacgttagcacggggtcactatataacagcggagcgctctctctctctctctcgcaaaatttcccctttctccccgaaaccctagaacgggcggcgattccggcgacttcggcgaggctgggtgcggcggggctaggcggcgctctaggcgggtgggggtagcgcgctccaaggcggccacggcgtcgaggccggcgagctccactgcgaccacagcggcgcattgcaaggcggctgggatgaactaggctggaagaaaccgggcatttgaggtatgtgatttagctcgatttgaagtgtggattttttggtgaagtagttggagtgtgggatggattgatatttttttgagcagttcttgctagatattagtcagatgcgttgggattgttattatagtgcagaaaggtggagtaagtgggaatatgggggaggttgatttttgtgttgggattgttaggtcctgcatgcatagggattgattttgttgattttatagtaaaggtggaagtatggtggttgttttttaactgtcaatcttagggcacagatgcattgggattgattttttagtcttaactttttttaggacaattttaccatcactgcaatggatcgtctagagtatttatctgttagatttcactttggcggtgaattcattaacaattggagggaaacattttatgttggtggatctgagggtatgtcttacattgaacgtgacaaaatatccttgcctgagttaattgggtatctgaaagatcactgcgaagtgctccctggtatgcttttgcactggctttttcctgggaaagaactggcagatgggctgagggtgttggttgatgacaaggtctgtgactatatgtcaaagtgtgttgtggatggaggagtggctgaaatatatgtagaggcagtagtgggaggggagtccaatgagtctggtagcagtgatgacagtgactttgaagatgaattggaggacatgtctcttgctgatgatgaatgggatgatttaaatgatgatgctgtgtttgaattacctactgggaagcctattctgttattcagtcaacaccagagaagacaaaaagtgatttagatagattgagagcttggagtaccccaagcccaaaggataaggggaaagctgtggtactatgtgaagagagggtgaagagtgcagacttgtctggttctgacaatgattacgttggtggggactcttgttcatcaggagaagatcaagaggttgaggaaattaggaaggcatacaaggagtttaagaagaagctaaaggatggtgaggtaggaaatttagatgatgtgatctatatggggtcttcaagacagattaatgatggagccttggttcagattcagggtgaggaagataatagcccatatgagaacagcagtgcagatggtgattcatatgaagaggatagtgatggacagttggtcagaaagaagtccaaataccccatatttaatgccaaccagccccatgttaggcttgctcttgggatgaaatttgatgggaaaaaagagtttaaggaggcagtggtccagctagccttgcagaacaaaagattcataaggttccccaaagatgaaggttacaggacaagggcaaagtgtgactgggcaacctgtccatggagttttttgctatcaaggaacagcaggacaaatagctggcaaatagcaagtcttgttgatgagcacaattgtcctccaaggaaggataacaacctggtcacatacaagagaattgctcagaaatatgagaagacgatcatagataacccaacttggagtattcagagcatgcagtcaactgtctctgagcaaatgtttgcaaatgtcagtgcatcttagtgcaagagagcaaaagcatatgtcctgaagaagatatatgagtctagaagggatgaatactccagaatttttgactatcaattggaattgttgaggagtaatcctgggagtatagttgttgtcaagcttgatactgaccagccaagcccagtgttcaaaaggatatatgtttgcctagctgcttgtaagaatgggttcctattgggatgtagaaaggttgttggtttggatggctgctttttcaaaggttcaaacaatggggagctattatgtgctgttggcagagatgccaacaactctatgtacccaattgcatgggctgtggtataaaaggaaacaaatgactcatgggattggttctgtgatttgctatgcaaggacttgggatttggtgaaggtgatggctgggtgtttatttcagaccagcagaaggtatactcttctaacatattttgttcagtgttatttactgtatttcttgatgtgttgttgttattaaatggcttctatgtggttgattgcagggaattgtaaatgcagttcagcactgggctccaagtgctgagcacagaaattgtgcaaggcatatttatgccaactggaagaagaaattcagcaagaaggagtggcagaagaagttttggaggtgtgccaaagctccaaatgtcatgctattcaacctagcaaaggcaagactggcacaagagactgttgaaggtgcaagggctatcatgaacacagatcctagccactggagcagggcttggttcaggtttggctcaaactatgattctgtagacaataatatttgtgagactttcaacaagtggatagttcaggctaggttcctacccattattagcatgttggaagctattagaaggaaggtgatggttaggatacatgagaaaataaccttgatggacaagtggctaggatcaatttgtccaaacatacataagaaacttaatgcatacatcatcgattcaggaaactgtcatgcaatctgcaatgggatggacaagtttgaagttaagcatcagaatcataggttcactgttgatcttgagaggaaaacttgttcatgcagaatttattccttcaaaaagacctacagctgttgtttggaacctgttgagggaatggaaagctggcctacatctgataggccaaggccaaaggctccaggttatgttagaatgccaggaaggccttccaagaaggaaatgagaagagagctacatgaaaagcccaaagcaacaagggtgtcaagggtagggtcagtgatgacttgcaggttgtgcaaactccttgggcacaacaaggcttcatgtcacaagaggagacagcaacagcagggcaatgtgcaggtactaacttgttcatgcagattttgcttaaatttattactagcacagcatcataactgatattttctctcaaccttacaggctcaaggatctcagccaagctctacacaggatcaggcacatgttgcagccaaggtaataatggcttgcttcctgtttgcacttgcttcagtcctatgtctaactgctaccacttgctgttgcagcatatggcaaatgcttcatcatctcgaaagaggcagctgaaagcttcaacatctgcaagggcagctggaatggttggggttgagcagccaagaaagaagttggaagttaggagatctcctcggctaaacagaggatgaataggatattaggttcataaaacgtttggacatgcttactggattagcaataggcagaagatcaccaccttttgtagagtaacatgtggtatgaaacttctgtaatgtgatagctgtggcatctaataggccatcttttgtgtaataactgaaggaattacagtgctctaaagtttgaagcaacctgtgacatttactgccaccactcttgtttacttgctgatgtaatcagatacaatgggttccagatgtggcaatatatgtcattatttatcatcacttttgctgtttccattatctccaactgccataacatgccttgattcccagtcacccaatatggctggtccatttgccagcacaggtcatcaaatcacctgatttttaactgtcatctcaaacaaaaccacaattttgcattcattccaatttgcaattacaaattctagtagaacagctgacaacacaacaattccattcattccagtacccattacagattataatagaacacctgacattttcttaactccacactgaccacatgaaccctaactttcatcacaacctacaattttagatacatagttccaaccaagagaacaacaacagctactaaaacatacaccaacatcatgatacatgtctgttgtttgttaatcctatcaactaaaacacaatttgcagcttccatcttctctacagcagctctcagaccctgaacctcattgctttctttcttgggggtagactgcaagttgtgctgggctactgtcctgtcccgaagtgcagcctccaggccattcacttgctcacgtgcagaccacacagcattcctcaaatcaagcaacagctgcttcatatatggttctgccttatcatcacaccactcccaaaatccgcagcccccagacttcacaaaaaaaggggaagtgaaagagtcaatcccttgaaaacaaatctaaaatgcaaaatcaatttaaaaggcacaaaatttaactcacacgcgcattgtagcatgtaaaatatctcctcccggggttatggggactccaagaaatccaccgagctgccttcactttacaatcacagaacacgggaggctcataatcaagaggcccctccctgtatggcaccggcggctgacgccttcctcgctcaccacctccagcccaagaagacgatggcgagccacgcgatgtacctgagctcggcatgccgtggtcgcagtggagctcgccggcctggacgccatggctgccttggagtgcgccgcccccgcctgcctagagtgccgcccagccccgccgcacccagcctcgccggagtcgccggaatcgccgcccgttttagggtttcggggagaaaggggaaattttgcgagagagagggagagagagagagagcgctccgttgttatatagtgaccccgtgctgacgggctgtccccttgccacgctgtactgccacgtgtatgaagaccggtcaaaaccgcccctaattctgccttagggggttaagtaaccggttttgatagttgagggtgaattatgtccggtttcgactttaggggggtatttcagacgaccgctatagttcggggggggtatttcgtactttttcctccaccaaatgatagcaaaatctttgaactccctactggcttgtcgaactctatattgctcaggcacaaggtgggcactaaacttctgctctattgccatctcccaatcaagatatttctcagcatcataataaccagaaaaagatggcattttaaacttaaccttagcataaggatcatcgggcacactattattgttaccttgttggtgttgctgattttgagcaccacccattcttgtcattgcaaacataaaaacagcaacaaacagtgacggttatccctaataatctgctacgctgtgtagtggtgcctctcaacagttcagccaaatggagcaccttaccaagctcttacaagtgtcttactagcaatgctaaggacaccttaccaagctcttacaattgtcttactagcaatgctaaggacagtacaaccggtggctggtttgtgacaccttgaaggacgtgatgtggcgattgcaaggatcaaagtggtgctgaccagaagtatatatgtggagcttgggaggcacaatatatagtagcaagaaacgcagttgtgctaatcagaaaatgcaaagttgaataatagttcaaagtactagtcaatgtgctggcctagcctagactcaactctagctcaagcaagcacccgacaacactaaggactagatatgaatcaatgcataactctgcactctgaaaacatactcaaaggatgaatgattttttttctttcttggtgcggctttttttaagcacctttctgcctttttttttctttttttaggtgaggctttttctttctttttctttgcacctttctgccttttctttttttctttatttttttactattttttggcaacaagatctagccactggcctcgaacagggactcaaatgtaaaatatagatattacagggactgaaacgcaaagtgcaaaattaaaattagatcacctttaaaatggaatgctcacattatataggttccgttttataaaaatatctcaagtccgctgaagatttttccttaaccagtgtaccaaatagaatgatctagaaggagagaagtcggatggatgggtgttcggcctgaacccaccatggtggattcggccacggcagactagaggagggagcccaactatgatggagaaaaacgataccaatctactaacagaaaccaatctatctcctcctgttcttcctcacgtgaacaagacacacacggtacggtacatgaaaccctaccccttcatgcaatcatgcaacttcacaaccgaccaacgaaaacttatgaaaactataaaaacggaaaccctgtgatgagtagattcgatttttcaagctcccggcaacaactgacgagatgcaaaactggaccccaaactgacgtagaactcacatacttgagtgatgaaccttagacctaagtgatgaacatatgcaatactcaaaacaaaaaattaaatctaaaactaaaccaacactcgacacgacgatgcaatctaaaattcaacatagcaaaatctaatagaacaatgcaacggctcaaattgtctaggtaaagaacaaatatttttgtgtggcaattttctggttatgggaagataatttacctaacgggcaaccacgctctgataccaactgatgagggatgtaaggtcccgatcttccgataggtattgataaacagtcgattcgggcggagtcgcgacaatactcgatctggcttctgaacgaacacgttactgagccccgcaatcgcagcaccacgtctcctttggttatcaaccatgccgaaacccggttgacctcgccaggaagactaatccctgcatgcgaatcgaagaacacaagcaagaataagatagattgcaaccaaattgcatatgaatgattaagcactcgaatttggggttccacgtaccgatctagcagtgaaactgttcttgacagaataatctaagcaaaacctgactctaaacgatgacagctactgaataaatatgactagggacatcctaggattgcgcacacccccttgggctaagcccacgacacaattacaaggccaaaatccaaatcagattcggactggatgagatacgtggcttgttttccagattcctggcagctcggtaggaattttgacgtgagaccaagaccatctaaaagtagactccataatctttctaacaagtactcatgggccctggaattctttctagatcagcagctaggtccgtttgaagttgatgttgtcaggaggcccgaatctgaatccaaaacgtgtagaactttatctcttgtcttctatggaccaaaagtgacgtggtaagatggaagtggacttggagaaggttggtctaaaatcaacttctttgatcatccatgaatttgttacgctcgatctcttttgcttcacccaagcaagtacctctgcaaacaaaaacacatgaaactcattgtgtagcaacgttgttcaaatatataacatgtaaatctaatgtagaacatatgtacctttggttgattaatacataaggttgtcatggttatatccgagctagttgtgtcctcatcaatttgcgtgctttttttgtgatttacatattgtttctaagaacatggtcgattaaaatatcagcaaattattgtgtggtttcatgaactttgcagttagttaaggtatccaatcggagatatttacgaactaagtaaataaacaatcaaccatgtaaaaaggtagtgagatcttatccatgcgtttgagcctataggcgtcaaatagatcttttgcctccaattcaatcactcgaccatggcggcttttctccctttatctctttctaatgcaatagtttaaaccctagaataattgaatgaggagaaaaaagtggatcttgatatttttccctaacgaggagaaaaaagcggatcttgatatttttccatagcgatgatcatattatcgtatagatgggaaatgtaccgattcaactaagaaaggtattcacataaaacaaaattgcctctaatttattagttaattactccaatgccatcggttacactaattttattccgtaccttgcccctttcttaatcaacggttcatattgctccacctcttactacctctacgtacctcgcaaaaaccgtaaaacatctcataagcttataagtatgcccattgcttagccattgaagcatctaggcccccgttgttagttttggtaattaatgaaagcgctaattgtggactaaccattcctctttgagttatatattttgtgttagtgccacgtgatatgtgagcatggaggattaccgaaggactaaaatttgatggcgcaaagcaaaggatagatgatggtaaactagtggttgaattctaaattgatcaaggtgttgggcaatcaaaattgtgctagtttaattatagctttgccatactattaatggggggtaatgacctagcaaagagatgattaaattgccaccctaggtcatttgcatttagacttgtgctctttttaataactcaaatcttgctatctttgggctgtctgaccagggccggtctgactgtgggctgttggccagtccgaccggtgggtagcggccggtctgaccgccggctatatgccggtctgaccagcccccctggtggctgggatggtgtgctctaggatcgccgatcaagagccgccagagccgaggtcggtcagaccgagctgatggcggtttgaccgagccaaggtcggtctgaccggccaccccatggcggtctgactggccgggccaatggggcccaaacggctagaaaactagttgttgtagagtagcatggtctgaccggccacacacctccggtcagaccggcagtacactgagttgggtgatttcgcccccaacggctggttttggtgggtgggagtataaatactcccccaccagcagcaaggggactctcttggcactcacttcaattgcatacaccccttgcacctctcccacacttatttgagcttagtgttcatccattgtagtggttgagggttgatttagccaagagtcaagtgcattgcttcattgtagagctagtgtagcacttgatcatctctgagccacgtcattgcttgttactcttggaggttgccgcctcctagatggcttgtggaggagttgcccggtgaccactcggagaagattgtggtggaggcccggcaccggttgtgagtgggttggagttcaccacctttggagtgaaggaagaacttccccgagtgatcgaggcttgggtagtcctctccgtgggccggctcccgccttgcccaccccttgacgaagggggcgtgtggtggcttcgtggttgagcggtggagttgggctcgcctcaacggggattaggaaaccagcgagtttctgaacctcagtgaaaaattccttgtctattgtctcatttactttgtgcatttacatttgtccaatttacatttcataaagacatacttgagccactttgaccctaggattgcaaaacataacttagttgcttagttagtcttgtccctcaccgagcctagcaacttaggttagttttgattacgtgacattatcgacatcttgatcctgcagccatgcttagaattaagcaaaatctcaattaaactctttacatgatgaagttgggaatttaatcattgctggacagatttggaaatgctacttatttgtgaactaaaggtgttagaatgtggttttagacttgggcggcaagtggtatgcatatgatgttagttgcataccgatagggggagtgtttgcccaagagcgtaaggaccgaacttgtgtcaccaacttaaagttattcgtacatccacatgtgctttttatggggagccttagttgattaagttacttagcatctaaccttgcatatggggccgtagtagaatgaattagtctgagcgatgattcataggaacttcctatttaccgcgaggtataggtgactaagtctgtctaattcaatggtatagtgccacgtggtggggatcgtttgttgtttgccatcctggccttaagtttaaggcatgggcccgccacttaatagttctaggtcatatgcctaggatggagtcacttatcgtcgctgatgcaaggctaggtattaagtaatgtaaaggcttcgttatgacatctagaccacattcaacgtgtagaatgtggtggacaggtggagtcttgcaaactcaaaacaaactagagtgttcatatcatgtgggtaaagctgtacaaactctgtagagttctaaaaactaatcgattagtcgtgctcacggtcatgagcgctttggtgaggtcacatgagtatagacttgtgttttaaattgtgtttgtgaaacttgggattgaaatggatgatttgtgttgagttgtgtgagtatgattatgattatatgacttgttgccaaggaagacaacaagggtatgtttatgatgatatgatgttatttatgatgaatttacaaatttgttttgttaattgaatcaactcctttgcaaaagtattgtgaaccaaaacttgctttatgctgaaatttaactacatgttgccatcctttgaatatgtcttacatgtagtatgataggattgatttttggcttgacagtacattatttttaataatgtaccgactcttattattctggaatccatttttgttggttgtacgtttagattaatttgagtgatgagggtttcgcgtgcttcttctaggacttgaacttaatgggttaacccccctagtcggagtgcttgtgtttgggtagtcaagcttccgctgttctctgataaatctatatttggccggtcggcccatgtaactataaggtagttgtaatttgagatcactttcgtcttaaatgtatttgctatgtatatctatgcttaagatgaaagtgtgaatctggtgcacatcctgggaactagattcacatgaatacaagttaagtatatttgagatgtcgtatatcttaaaccatttttgtcaagtctcctgaatgtgtaacacatcttatcaccaccttcgtggggtttaacgggtacatctcaggctgaagttgactggcaggctaaagggccagcaatgtctccaatatccttctctcgaggcatcggatatttcattatgtttgtttgatgacttgaattattcacttcatccctcaaatataatgagaggttcggactgcctccgtcaagctgtgtgcatgataaaataatgaaaatagttgtgtgtggtcctgtgtggacgaaatattctttttggttggttggttggttggttaaaactatagtgatgttggttggttggttaaaactaagtgatggcaaatgttgtttaaattcaatttatatcaatttattgtatttaaatctgcgaatgcatttatgcaaattaaccctaaccttcctttgaagccttatatcatatattgtatattcccgtacaattgtgagtactttatgtgctcactctcgttgtctcaccaaaatttcagagaatgcctgctgtttccagaagtttctgttgtggaggaagttgaatagtttgcgtgccctagtcaactgcccgtggtgtgttgttgatgctctgcgcttctttttcggttgtttatctctgtgcttcatactctcatcactagacgcgttcgggatctcatcaaatagttctgaagcgtagatcagcatgtttgagaaaaccttatccaaaatttaaaaacttttaagtcaatgtttgaaattacgtatgcggatgcgtgtgagacttgctactcgtttctctctcgcgcacgtgcatattaggaagccccatgagtatatgatggaacccgtgataatttctcggtcgagattgatatgaacatatcgatctacgaagtcatgacaatcacatccagcagtcgtgtgatcagaacctttcaaaactcaaacacatgcatgcggaatgttcaacttcatcgcacgaattcttatttgggacaacaagagacgttgccggcggcttaattaattaattgatcgttccaaattaatataaactggccacaagaccaaagactaattattcggacaatcagttcttttccatctacaccaccccgttggagactttgaaatggacaagggattgatcagacactggaagttcctttttgtgaatactgaataactacatatgcatttgcagcatgcatgcatcgcctaattacttgattaagaagtcagcaaatgagatcatgattaggtcagtattatccccgatttcttaattttggatgttttgaacaagattaaaatcaaactactatcgatgactttaaaaatatttagcttaaaatatattaaaacaacatttatagatttatcttataaaatactataataaaaataaaaaaaatatttatttattgtatatactataatagaaaacttagtccatgttattatctaaaagttaagaataatagaactcgagggagtagctcgtacgttccgaccatgtaatgatcatctcaccaatccagttagatatagccttgctgtgttctggagggcaagttcccaaccttgtctcccgacacgaaaaacaaatcacgtgattatagtgagattaattaaatattagcctaaaaaacttgaaaaataaattaatatgattttttaaagtaactttcatatagaaatttttttaaaaaatataccgtttagcagtttaaaaagtgtgcgcgcggaaaacgaggaaagtgagttggaaagaggggaaaataacacagcctaaaaataccacttgagaccacttgataaataaattcattgatgcatgctgcaagtctacgatatgagacaacttgccatattattcaagattagagaaatttaacttacagaatgaacaaataccttctgaaacggagaaagtacgcgtcaacttctttgttcaaagtgtatagaattgattgagcgagagggattgagcgagagagaattatacacaagaatgtagagaatgaatgagcggatcctttattgataacagtgttacaatatataggggggagagaggcggcaaccagaagacacgatggtttgggaaccatcgtgtccgttgctagaatcgccgtgaggcgataagaggtgtggggcacgaccaaccgtcgtgtcccagaattggttgctgctctatccatatagatggatgagatcacccaaatatttcataacactcccccttgatcgaatccagcttttatcattgctcatttagggtttgtcacgcccggaatttctatccaaaatttcaaatgcttacatgtgcgttaaatcctcgtccaggaatcaatcgaggtacacaataacaaattgacaatagagtactattaaacagctaattaatattcgcaaaataataaattattacagagatggatagttcctctcaaagaataaaattctacacagcggaaaaaaaacaaaaacgaaacagctatggcgactccactccacaagcaacttgacccgaacaaagcctaatcctccagatcatcaccttcactgaaatactcctcctctgatgaatgaatattgcaagaatgagcatatgacatactcaacaagccatacaacaaatatgcaagtgcaaaggataacaaaggatggcatagtaaagctcatttgcataaacagaatttagtaaacattttaaagaataataaatcaattgaataattaatcagtattaaataaacaccatacaacacacctatcttgcataggcccaacctcatttgaacaaccaaccccggttgtacaaatcaaacctccataccaggaatataccattccaaaccaggagtcatattaattatcacaatattatcattaataaatagtgtgagactaatcacgaaaaacattgtcaaactcacccataaccgcgggcacggctattcgaatagttttactctggccagagatgtaccactgtacccacaagacatagttccacaacatgtcaccatgcgcctcagtaccaccacgataccttggaaaagaactatgacaatacctctcacacaacacaactcaccacagtgcaccgttcctggatcataatctccccctctaaactagaggcaaatagactccccagcgacccccacggacttctcaccgctttacagtctgacaccccataatgaatcatgctatacaaaaggtaaagccgttgcccatactggcttgtggttggcacggttaatgtttcacaacagtagctcccgaaccggtccttaattatcacgagcgccaccatcaaaaccatatactcacaacccacctttaatcaggttttaattatcaattaattatcataacacgattagccatcgtgagctaccattgaatataaccataattaataatgtagtatgattcatccctttaatgagctaatgtttttaagcatggctaagcaattatacatatagcatttagctgaaccaaaccaatatataaggttctagctaatcgaattataacccataggaaaataaagtcatcttcggccattaattaattaggaaaagcttaccacccgatgacattcgaaaataatgcataagttgaaataaaacattagctttaaacgggttcaacatgctcaaagggttgtttgggatctgtgtgacttgccttgagcttccgcaaacgcttccgaaccttcctcaacgaaaacgctctcctccggaacgtcggaaactaaagcaaaagaaaaaaaatcaacaaaacagtacaaaaacaagcataaacattacatgtggatatttttaacatgtagatctcgattttggatgaatttagcaacttgaaccactcgaatcggagtggcgaatgccgaggtactcctcctccgtgcgcacccgacggcggtcacggacggcaacggcgacggcgctagcggcggcgcgacgcgaccggagtgtcgccggcgacggtggcgactagggcaacgtggcggcggcgctatgggcgacggctcggcttgggacttgaagcaaacggaagaggacgactaggggatgctatttattggcttggattagagagatcggactccaaccgagaggaatcgagccgggaaaaactagggttaggtagagagataaactcgaaaacgagtttgatttggcttatccaggcaaaattgatctccgaaaccttaggggaaaggaagaggataaggaggagatgatttcccctcaagcaatcgggactcgggggcgaccggttgaggtggaatcggaggaaaggcggcggcgctcgggctcggctcggcccggccagaggtaggggacgatcccgacatgtgggccccacatgtcggcggctagggaaaagaagggcgccggctcggcttggcccgcacgcccgcgcgtgaggtgggaaagatgtttggccgaaaacggcccaacggcttaggaaaggattttaaaaacttttccaattaaaataattcgtgaaatgatgtttcatttattaaaaatactttccttgctcaaataattcctagaaaaaatctagaaaatggataaacaagaaaagtatttaatgaaattttatctagctcaattttatgttaaaatttttcctagattattagagtttaacttgtaggcttttaaaataatttctaaaaatgatttaaagatggattattaatttaggcgattttcagggcatgacaaacctaccccccttaaacggaatctcgtcctcgagattcagaagaactagcaaaaagatgaggatgagctgactttagtaagcctgtcaaccactacccaaatagaatcatgtcctgccgacgttctggataggccggtgataaagtccattcctatttcctcccatttccactctggaatcttcaacggttgcagcagaccggctggcttctgatgctccaccttgactcgctgacacacatcacatagagccacatattccgctatctctcgtcgcatgctggcccaccagaattgttgcttcaggtcttgatacatcttagtgctcccaggatgaatggaatacaatgtttcatgagcttctttcatgatagtatccttcaactccttattatcgggcacacaaattctttctcctagccacacagttccttgctcatcttctatataaccgatggcttttcctcttctcatgttctttttgatttcttggatatcaggatcattcacttgagcctctctgacttgatcgaaaagagtaggttgagcttctaaagcggccacaaaacctttgttgactattcccaagttcaacttttcaaattcctggcataacttccaaggtagatgtcgtccttctaacatattacaatagcttttcctgctgagagcatctgctacaacttttgctttacctggatgataatgaattttcatatcataatccttgatcaactctaaccatcttcgttgatgcatgttcaaatcaagttgagtgaaaatgtacttcaaacttttatgatccgtatacatctccgtacggttaccaaaaaggtaatgacgccaaatcttcaatacatgaaccacagctgccaactctaggacatgcgttgggtagttattctcatgagggcgtaactgcctagatgcataggcaaccaccttcccatcttgcatcaaaacacaacccaaaccaagtctagatgcatcacaatacacctggaaacctttccttggatcaggcaagacgaatacaggcgcagtcactagccttttcttcagttcttgaaaactctgctcacattcttccgtccacttatacttcacatccttctgaagcagtcgagtcattggtctagcaatcttggagaagttctcaataaacctgcggtagtaccccgcaagaccaaggaaactacgaatctctaaaatcgtcttgggttgcttccaatttagcactgactccacattgcttgggtccacggccactcctccagctgagatgacatgaccaaggaacttcacttcgggcaaccaaaattcacatttactaaacttcgcatagagctggtgctcacgtagtttctctaaagcaagacgaagatgctcttcatgctcttcttttgtcttggagtaaataaggatgtcatcaataaacaccacgacaaacttatccagatattccataaacactttgttcatcaagttcatgaaaaaggccggggaattagtgagtccaaacgacataacagtgcattcgaacaaaccataccgtgttgtaaaggcggtctttggtatatcctcctcacggattcgaagttggtgatatccggaacggagatctatcttggagaaaactgtagcaccttcca

SEQ ID NO: 1606 - DNA, 26391 bp, Oryza sativa
atgacacaaagaaagacactgtttgcccattgctacttgttaaagtcaccttacggttagcacaatctataactcctctgtgacgggttaaccaatccatccctaagataacatcaagatctttggattctagcgagataagtgaggataggaaaggaatttcttctatttctatagtaacggaagtacagtactgcgttgaggatacttgattgcctagggtattaactagtaaaggtctcccaagactaataacttccatcccgtgatcgctcgcaaaaattttagacaaaaaggaatgtgtagcaccggaatcaaaaagcacatatgcgggtatagagttaacaggaaacgtacccaaaaccagcttaggtgcattctgggcctctgcagctgcaacgtgattaacatgagccttcggtgctggagcattggagttgttctggaccggagcattcttcacacgtcgaggctttggacacttatcagcataatgtcatggatcaccacaattgaaacacacccctggcttgcttccctgttccttcctgataggttgattctgtgttggagctgctacaggtcgtgtgaacacattatgattgtcgttgctgcgattaccagtgttgttgttgtagaactggcgttgagggcgagcaactgaagaggatcctccctgtgggtatggtgcagcttgaggtcccaaaacaatgtgcggcctctggctactaccctgttgagccttgaattgagcagccctacgcttcttctgttccatcctattgtacttgtcttcttggcgaatcgccttgtccaccaactgctggaaatcccggtaatccgtagccatcaatgcataagacaactcatcattcagtccctctaaaaacttctcctgacgttcttcatcagtgtgaacatcttctgggcataacgatctaagcgattaaagtcatggaggtactctgtgacagaacgggatccctgattgagtgctctgaactctctcttcttaagggccacaacacctgatggtatatgcgtcttcttgaaagcagcagtaaactcccaccaagtgataggctctcccgcagctctgttttgacgaaagtgatcccaccactcacagcaggaccatgcaactgatgcgaagcaaaagaaaccttctcctgctcagtgcactgaatcaaatctaacttcttttcaacagcatgcagccaatcacctgcctctactgggttagtggtgcttgagaaggtaggtggtctcacacgtagaaaatctgccaacttgttctgtggaggtggtggttgattgttgttatttgcctgctggttctacgcttgctgcactagtaaattaatcaactgggtttgctgagccaaaacttgggcaagtgtgggacctccttcattgtgaccacttccacttccacttccacttccagtgcgggtgttcaccatctgaagaaaagcacgggcaagaggaaagaacgacagagagatacccttagaacggagaactttaattaatttaaattgtatattgctcttaactgtatatgattacatttgaattgagttaacactatctcaccaactaacttactctctgacaagcaaaagaactaaactcatgtagttacatcccaccaatgatgtaagcaacacgctaaacccacacacacacaagcaaacttaagcaagcaaactaacacagcgaactacggcaacggtccaactaggcaactaatcccgccttgcgttggaacgaagagacggatcttcttcctctggagtagctagctctctttcttctaagtcttcctcttcttcctcatcacttaagacatggatgacaggttcagcacaatcaggcacagcgtctcccaccacacgagtctttgaagctaactggagacgaggtggtggacgggttctcttccttgcggtgaggcgaagcttgggtgctggcggtggtgcttctcccttaagctcagctagttccttctgcaaacggtacaccttgctctccaacttgcaaatcctgccatggttctagttttccctatcatgagctgctttctcccgctccacgcctactgcatccatggcgctaagcatatacacagcatgtgtcagtgtggcgcttccttcgccttcaggacagttgtaagttccatagtcttgaccatgaggcttgtgtggatgatactggaaagctgatgactctaactcctcataaaagcaatgacgtagctctccaatggccaccaaggctgcttcctgacaagcatggctatactttcttcccccagcttcaaactttatcgacggaaggtcttcacgatcactagccaacgtcacgcgaacacgacacttctcctcgttgggatcatggggaatctagcgatactcgggggcaacctcatagcctacttcaaataccatcaatctcagctccctgacgaatcctagcaccttgatcaagtttttcggcggatgggcggcatctaaagaaacatagaaaggaggaattaatgcatatattttttttaagttagctgtacaaactagacttaatttatttgacccaaaaaggaagaaaaataaaagaaaaggaacaaacagaactaaacaaatttttttttttggaaattaaatcagctttggacagagacaaatagctttagacaaatgaataaaataaaactaaaatacttaagatctactataagcacggtacagtgtcaccattaagagggatgagtagtactagtgctatcttgattgaatcgataccataatagatgtacagtgccgaccaaccactgaaattcaaaaaactatttaataccctgaacagtaaaggaaaaagaaaaattagaaaagaacagctttctgttttgtaaagtaggatttagaaaattttgtgcttgaccttgcatgtgctgccaacttaattagtttgtaagagaataaggaagagcagtcctattttttcaaaatattttaaatgctacttaaggtttaccatttggcttgtcctaaggtcaaggtagctctgataccaacttgtcacgcctggaatttctatccaaaattccaaacgcttacatgtgcattaaatcctcgtccaggaatcagccgaggcacacaataacaaattgataatagagtactattaaacaactaattaatattcgcaaaacaatatattattacagaggtggatagttcctctcaaagaataaaattctacacagaaaaaaaaacaaaaatggaacagctatggcgactccactccacaagcaacttgacccgaacaaagcctaatcctccagatcatcaccttcactgaaatactcctcctttgatgaatgaatattgcaagaatgagcatatgtcatactcaacaagccacacagcaaatatgcaagtgcacaagataacaaaggatggcatagtaaagctcatttgcataaacaacatttagtaaacattttaaagaataataaaacagttgaataattaatcagtattaaataaacactatacaacacacctatgttgcataggcccaacctcatctgaacaatcaaccccggttgtacaaatcaaacctccataccaggaatataccattccaaaccaggagtcatattaattatcacaatattatcattaatgaatagtgtgagactaatcacgaaaaacattgtcaaactcacccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatctccccctcaaaaccagaggcaatggactccccagcgacccccacggacttctcgccgcttcacagtctggtgccccgcaatgaatcaggctatacaaaagataaagccgttgtccacgctggcttgtggttggtacggttaatgtctcacaacagtagctcgcgaaccggtccttaattgccatgagcacaaccatcaaaaccatatgctcacaacccaccttaaccaggttttaattatcaattaattaacaccacacaatttaccatcgtgtgcgaccattaaatataaccataattaataataataataatataatttatatttaacccctttagttagcttatgtttctaagcatggctaagcaaaatacatataacatttagctgaaccaatccaatatataaggttctagctaatcgaattataacccataggaaaataaagtcatcttcggccattaattaattaggaaaagcttaccacccgatgtcattcgaaaataatgcataagttgaaataaaacattagctttaaatgggttcaacatgctcaaagggttgtttgggatctgtgtgacttgccttgagcttccgcaaacgcttccgaaccttcctcaacgaaaacgctctcctccggaacgtcggaaactaaagcaaaagaaaaaaatcaacaaaacagtaaaaaaacaagcataaacagtgcatgtggatatttttaacatgtagatctcgattttagatgaatttagcaacttgaaccactcgaatcggagttacgatgatttagttatgaatttatgaagtttaatcgattttcatctaataaagaaactaagaaaaagagatttatgacgtcatcgctgacgtcatcgccagccatggcacggctccacgtgaccaccggtgctagagagctcggtttgcctaaccgaggacacgtacgcgtagaagacggcgacgcgaactcaccggtgcaataaactacgacggaccacgacaaacggcggccggcgacaaggtccaatggcggctcggctcggctcgacggcggtgacggcgctccggtggcttgcgacagcggcgaaggggtggccgaggtactcctcctccgtgcgcacccgacggcggtgacggacggcaacggcgacggcgctagcggcggcgcgacgtgaccggagtgtcgccggcgacggcggcggctagggcaacgtggcggcggcgctacgggcgacggctcggcttgggacttgaagcaaacgaaagaggacgactaggggatgctatttataggcttgaattagagagatcggactccaaccgagaggaatcgagccgggaaaaactagggttaggtggagagataaactcgaaaacgagtttgatttgacttatccgggcaaaattgatctccgaaaccttaggggaaaggaagaggataaggaggagatgatttccccttaagcaatcggactcgggggcgaccggttgaggcggaatcggaggagaggcggcggcgctcgggctcggcttggcccggccggaggtaggggaagaccccgacatgtgggccccacatgtcggcggctaggggagaggaggggcggcggctcggcttgggccgcacggccgcgcgcgaggagggagagatgttgggtcgaaaatggcccattggcttaggagaggattttaaaaacttttccaattaaaataattcgtgaaatgatgtttcatttattaaaatactttccttgctcaaataattcccagaaaaaatctagaaaatagataaacaagcaaagtatttaatgaaattttatctagctcaattttatgctgaaatttttcctaaattattggagtttaacttgtaggcttttaaaataatttctaaaaatgatttaaaagatggattattaatttaggcgattttcatggcgtgacagtgttctagatatctgtaaagataatcttagaaataattatagtcagtatattaaatacatcacgtaaaactcctcgaaaacccagtgggaaaaataaggagagaaccgtgatatattattgactagttttagatcttaatgagtaaagctcatagtatgatccaaaaatagtataatgtctgtagttatcatttagtaaaaatcccagtggggaaaagccaaatgataagacatataacttatgttgatattacctcgttaaaaactttggatgagaaaacctatagggtaaaactcatacaaaggaaaaagagtataatatgacgaaaatatgttattttccagaggaagatactccccctgaatcctgtaaatttttaagtcgtctcatactaattcctttgacacatttaaagaatgtggagtatggcagagattttgtgaataaatcatcaagattatcacatgacttagtttgcaaggtgtttatctctccatgttgctgaagctcatgaggataaaataatttaggagcaatatgcttagttatgttgctcttaatataaacagtttccatctgaacaacacaagcagcattatcttcatagataatggtaggtgattccaatgaaccaataccacaagatgttaatatgtagttaaccattctgcgaagccatacacattcacgtgatgcctcatataatgcaattatttcagaatgatttgtggaagtggctaccagagtctgtttagaagacttccatgaaatagcagttccaccttgtaaaagtacaaatcctatttgtgatctggcattgtggggatcagataaatagccagcatcagtatacccaataaaagtcgaatcatggttctttttaaagaaaagtccaagatctcttgtgccattaagataccgaaagacactttaactccagtccaatggcgtttggtaggagcagcgctgtatcttgctaatagatttaccaagaaagcaatatctggcctcgtactatttgcaaggtacataagtgccccaatagcactaagatatggaaaatcaggaccaagcacatcctcaccatcttcctttggtctaaatggatctttctccacgtctagagatcgaaccaccataggggttttggaaggatatgacttgtccatattaaatttctccaaaattttctgggtatatgcactttggtgcacaaggattccaaaaggtaaatgctcaagttgtagacctaagcaaaatttggtttgacccaaatccttcatctcaaattctgtctttaaatgatgacgtgcttcattaatatcttgtgtattgccaatgatgttgagatcatcgacatataccgagataatacaaaatcctgtgggggaccttttgataaagacgcacgggcaatcatcatttttagtgtatccttttagtgaaaggaattcacttaatcggttgtaccacatcctgcccgattattttaagccataaagtgacttctgcaacttaacacaatacatgttatgatttaccttctgattcgggatatcgattccgtcaggaaccttgatgtaaatatcaaaatcaagtgacccataaagatatgctgtcactacgtccatcaactgcataaatagacgattttgtattgccaatgatattaaatatcgaaagttataccactcataactagagagtaagtttcgttgaaatcaacgccaggtttttgcgtaaaaccttgtgctacaagccttgctttatatctcaccacctcgttgttttcattccgtttccggacgaaaacctatttgtatcccataggaaagataccacgaggagtaggcattacagccgagaatacttctcttttgtaaagcgaggctaattctgcgtcaattgcgtccttccatttgttccagtcagagcacttttggcactcttttatagacctaggttctggatcaacttggaggcaatcagcaatttgttcagaaaaattaatgtcgacaattgtagctcttctatcaaaagattctccagtttcagagtagttgatggcaatttcatcaacccctatagactcatcgtgatctcccgaaacaatgtgtctatggtcttccgaattcctagtctcagcattatgcaccaccgagctaagttgcagactatcacgatctgcttgatatatagtatcaatttggtgtgtaccaactaaagggtggtttgcatttaccgtctttctttgcttattagcaattgtttctcgctgagtggccatacttcttcctctctttttagtgagtggaagttgagttgttttatttggtacctccactctttctggcgcattctgagcaggaatgaaagatttagttacacctttataattagtaaatgcatatggcaggttatttgcaagtctttgcaaatgtataattttctgaacttgaagttcagtttcagtagtacgtgggtttgaggctggaataccctaggcatcccagtcaatttcctggcattctttctggtacttgaagtctccccctaatgctaggaaatgttcctcatcaaagatagagtcagtgaaccgggcagtaaatagatcacctgttaagggttctaaatactttatgatcgagggagatttgaatcccatatagatccacactttcttgtgtgggcccatagcggtatgctgtggtggtgagatcggtatgtatatagcacaaccgaacttacgcaaatgggaaatacttagaggatttccatgtactaactgcattggggaagtttcatgatatgcagttggtcgtagttggacaaggtcagcagcgtgcagaactgcatgaccccaacacgacgaaggtaatttgcaattcatcaataatggtcgagcaataagcttaattcttttgatcaacgattcagccagaccattttgtgtgtggacatatggaacatagtgctgaacctgaattcccaatgccatacaataatcatcaaaagcatgggatgtaaatttggcagcattgtccatacggattgattgaatcctatgttcagggtaatttgccttcagccttataatttgagacattagtttgtcaaaggtatggtttcatgtcgatagaagacacacatgagaccatctagtagatgcgtcaatcaaaaccataaagtacctgaacggtccagatcttggcacaatagggccacagatatctccttgaatgcgttcaaggaatttaggtggttcagctctgattttgagataagatggtctcaaaaatcagttcccagtagcacatgcagtgcatacgaaatcagaggatttgagaaatttatcagtgatcaaatgatgaccaatagagttgccaatatttttttctcatcatcccggtactggggtgcccaagtcgatcatgccaagtgtggaatgcatcaacattttgaaaaattacttagtacgcaacatgtgcaatgggcttaatatatgtatagtacaatcccaatgtgagagatggaattttctcgcaaatgcgtttgccatatctgttttatttggttaagagaagaaattcttctcgattatccatatgggtttcaatgtgaaatccattttgacggatatctccataacttagtagagtacgggttgaatcaggatacaataaagcatcctcgattataatttgtgtacccattgggagtgtaatagttgctcgtcctgagccaactatcacagtatcgcgcccagcgatagtcaaaactttgccttctctctttttgagagtttgaaagtatttgatctccctaagtatagagtttgtggtaccactgtccacaagacataattcctctccaattggggcgatatccttagacatctatagtgaaagaagaattgcttagtgaagaattctttatccacaatatatacatacatataataatgaaaacatcaaatacatagtatgacgtttacataggttaatagtacatactctaatgactagcaggtcttataaccttacaatgtaagggagtttgtacgtatctacttattacaaccaatattgttttgacaaactataggatatcaatataatgtctcaaacacactgagattaaagcagctttatctctaagtgggacgcactgagattacagtaaatctccaagtgggtccgttgagcagtattcgatgagcatgtcatccactacagaaagtgcagcggtatcctctgggaaaagaacgaggttgttctctggttcaataggagccaggtgagaactttcaacctcaggtctttcttttgtaagattgaagtgagcttcaaatctgagttcctcataagactttttctcctttagggatttctgatacaggagaacaagatgttgttgggatgcggcaatttttagcgacatgatagtcagatccacacctgttgcaatgcttgttgctattgccactaggttgtggtgccttacccttcccttttcctttctaatcgaccatttcatttgcgccgttgttgcatttgcgttttccagtcagattcttagggttattcgaggaatttcccttgaatcctttgagtgtgatactgttggttcaatatcatgtcctctggaaacatagttgatagagttttctctattcctctgcttccgttggctctttttcataaaacttcaacttggagcaaatgttatgaacatcatgattgtattctgccacagttttttttaaaatcctttaaaatcctataagcgtaaatgaattcactcataattagcctcaggccaaatgagttccttttgcttatcataacgctcttttagagctttccataggttgagagggctcgactccaacatgtactcatgtttgagatctttatagatgtagagcctcagaaggaaaagggcaatatatagatttctgttctcaactggtggatcccaatcattgggttcctaatttgtatgtgaaatcccactagaagaaaaatttattttgatatcggaagcccaaattgggtagttactcccatcgagggcgagttcgtcgagctctatagttgccatgtccctataatcatgattaacattattaatttacagaggtaaattaataaaaacatgatattgaggttgtaatctcaatgcgtaatgtaagacttcatattttgtaatgtttcgaaaagatgtaggctatagacctgacaatttgagttagaattcaaaattaggtggcacaatgtggataatctccaaataattaaatagtggagtagatatcttaatagtgggcaagtaatacttgctgcctaaaacacggtctccaggcaaatatattctggtgaatataccgcagccgatgtttaggactccactaccttgtgctcaaccaaatttcaaataatctcatttttcaaaacatattctcggaaagtaacacatgtgggtaatcatcgtgagatgttgacctctgtgagatgggcgagatgctcgctgcctaggttatgaccagtgcggccaatttgtaggactccatcgggtaatcatctcaaaatgtagatcacttgatgatgggcgagatactcgctgcctaagttatggtcaatatgaccaaagtataggactccatctacatgtgattaatgtccgagtcaaaatgtgaagtggaacatgcattaaatcctccattaatcatgttgtacataattaagagaatttgctaaatcaaagtacaaaacttatagaattttgtaaattaatgaagcgagaaagtagagtgtgtcttgaaatagtatgcaaaaggcatattattaagacaacaaataaatttagtgaagcagggtatttaaataaacacctatgttaagtaacatataacatcagtggtctacaggaccagtacatagtaatttgtacaactgatgaactgcttgtactaaattatcaaagatataggaactaataagaaaatgctgctaaattagaaaataaaaactaaaaaaaataaacggtaaatgggtggtgagccgaaatcaataggatttggcccaccaccgctactgtgcggctggcccatcgggtccgaggggaaaagggcgcaggggggcgtgggggtgttagggttagaaccctaaccgttcccctcgcggtgtgcaccgccgccgccgccgattggccacgcctcctccacctcttctgcagccgccgccatttcgccgcctcctcctccatcactttagccgccgtttccaccgccacctttctcatccaatgccgatccaatttccgccgccaccttctccccctgaaacgccaccactgttgcctctatttccgccgccgcccaccaccgccgtctctactgcccgccgccgccatccaccgtccgccgccgccgcatcccccatgtcgaccggcggtttgctggctagagttaggccgacggccccaactcctcatcggagtcggagaccggttgagcccttacaccgttccccatcccgccatttgagagcgtgcgggagccatggggaacggcgagccatgtggagcggaggctgggacggcgagcagtggcttcaccggcatgacagtgagacgacgatgggttgaagtaggccggctcccccgtgcgcgctaccatggttccgttccggccggactccggtggcgcgggagtgggggagcagcgttggtgtggcgtcggcgacgtcgtggcgcgggtggtggcggggttggagtagcagcaatggtgatgcggcgccgagggttgtggcggtggccactaaccctaggccggcgcctggcatggtgatggtagcagtggtggcgactcctcgttgtacgatggaggaggtggtgcagatggcgggctcggtcatggcgaggaataccaagaacggtgtcgataagtaattgaaggtagacatctcgtacctttcctgttgattctttcgcttttccttgagatcaaaagcgatgtagtttcttctttcacttcacgatcttcttcgcgagaacggcgtcgataagtaattgaaggtagacatctcgtacctttcctgttgattctttcgcttttcattgagatcaaaagtgatgtagtttcttctttcacttcgcgatctccatcgcgagagcgaaagtgctgataacgtattgattccagcctcagacccacgtactactgaaactgaacttcaagttcagaaaattatacatttgcaaagacttgcaaataacctgccagatgcatttaccaattataaaggtgtgactaaatctttcattcccgctcagaatgcgccagaaagagtggaggtaccaaataaaaccactcaacttccgctcactaaaaagagaggaagaagtatggccactcagcgagaaacaattgctaataagcaaagaaagacggtaaatgcaaaccaacctttagttggtacacaccaaattgatactatatatcaagcagatcgtgatagtctgcaacctagctcggtggtgcacaatgctgataacgtgttgaaagtgtatagaattaactgagcgaaagggattgagcgagagagagaattgcactcaagaatgtcgagaatgaatgagcggatcctttattgataacagtgttacaatatatagggagagagagaggtggcaaccagaagacgtgatggtttgggaaccatcgtgtccgttgctagaatcgccgtgacgtgataagaggtgtggggcacgaccaaccgtcgtgtcccagaattggttgctgctctatccatatagatggatgggatcacccaaatatttcataacattcttgatgtacactcatattcgagtgcgcgtttcgcaattttcctcttgctggtgacctcgagtcgtacgtttcgtaggttgttaattttttttccagtcagcagtttaccaagtttataaaaaagcataacaatacttttaatgaaaacgaacatactaccaaaatatacccaatgcaatatttaataacactaattttttttgccaattaataacactaatttaatgttgtggatgttactaaattctcttataaatttaattaaacttaaaataattaattaaaaaaattatagcatgttataatatgaaatggagaatgtggccaatagtcgtgtagcatccgtagaccatgacatcgtcgtcatggcgttcatattcccatgaccaggcgccacgagggaacacgccacacatgctgaaatttttacattttagtcctttttaaaacttattttatgaatagattattgaaaaacttatttcagaaatagtcttttctggtgcgctagagtggctcgcgccgtcgtcgaacagggtggcaccatcacatctggcgtcgtccccataccattgtggcaccacgtggctggcctgcactgacctgacaggaggacggcgcagtggcatggggacggcaccagattactggcaccgacccacccccctcgacggtgccaacacctgtggcgtgctcctcccaggggtgggtggcacttaacccatacccacatggaccccaccccgctccccctccccacccattcgtcccctcctcccccgcccgagcctgagcagagctcttgctctctctctctctctctctctttctccctcctcacctctcctcttcaaatccactcattgtgaagcagtttttcacgagattttttaggggaatcgaagagcaaggaattctccatcaatgcccctatttttttcgttttaattgataaaatttgtagatggtagggtaacactagaacccaaatttgtgattttgaacattgaaattggggattcgttgattatagtgttacatgtgtgcaatgtgcatattggcgccacaattttttggagtatatatgtggtaatgttgatttttaggtgagacattaatgaatggttggatggaaaaagttgctttaggttagatttgtacttatgtggtatattttggttactttaatatagtgattaacatttttggcattgtgggatgcttaggaaggatcatgtgggctattccctggatcagctgccaacaccgggcgtaatgcgctgtcacgtcctgataaattcatcccaaaataaaaatcattctctaaaaggaataatagaattaattaaaattcgaaaagaattggttaacactaaaatacatacaagaaaaattcgaatgtggcccggagaattttacttggtctaaaaagagccctcaaattttacttgaattttcagagcaccggaaatatttattaagcaacaaaaacaattaacaaagtttatttaaaagaaaaggctaaaaataatccccctcctccctttgggccaagtcaggcccaaagtcccctctctctctctcggcccgctgccaaagtcctctcttcctccctctctttctctccctctccttctctccctccttctcttgggcctcccattcccctcctggcccactccctcctctcctcctccttctgggccgcccctcccctccctccttccctctcggcccagccacccgacccaaaccaggccgagccaagccagccgcgtgcacgcgcgccgcacgcgcgctgacgacgcgcgccccgcgtgggtcccacgcgccgggtcgtcgtcgtcctcccgcccggcctcctctctctctcccagaaacctagcgccattcctccccaaaatccacgcgattcaaaccgggaattccaaaattgattagggggaattaatcccctttccttcctcttcaattccccccaatttcccccttgattcgtgccctctaacgcccggaacagccgcgccattcccggccgccttccatggccgccggccacaaactccaccgccgttccccgctcctcccgttgccggctccctccccgcgcctataaaatggaatccccatcctccgttctatcgttttagcctcatcccgagcctccccgtggtcgtatcacccctccccgccgtcacccttctctttcccccgcgccgaccgcctccagccgcctctaccgcctcgcccgcgcgccagtcggctgtgccgtcgcctccctcggcatcgcagcagcctcctctcccccggcctgccctccgtttcgcgcggagacccccggaggtgcgcccccgccggcaacagtggcgttgtcgccactgttctgcctccggccgcctctgccgcgtctcctgtgcgccgaccgacgtcgccgtctcctccgtcgatgtcgcagcgtcgtcctctcctccggctgctcctctgtttcgccggaacgctgtcgcccgcaccgcctctccctcggtctcgtcgacacccactccggcagccccttccgccgtgccagtccaccggccgacgtcgccgtctccacctccggcatcgcagcggcaaggtcgccctcggcctcacctcccctccacccgaacaccgccggtgtccgtcatcgtcttcaccgttcgtcctcgccgatcgacgtcccatcgttcgcccggctcgtcgtctcacggcgccgcctccgtcgtcggattcacagcagcgtgttccacgccgtcctcgcctctgtgcagctgctgccggctgccatcgtcgtctcctcatcggccccggtcgtcgtcgtcgtcgtcctctcgtcgttcccggtttcgctcgtcgtggcgttcgtccctccgtcaagccgttctcgttcgtcgtcctcgcctccgcgtagtgccgcagccccgtcatcgtcttcgtcctcgcctccgcgtcaccaagcgttgcgccggccgcgtctcgccttcgtgcaaggatcgccgccgaagtcgttccctcgccgttcgcctccgtcgtccccgagccgtctccgccgcgctcgttcgtcgttgtcgttcccacgcctcgtcgcgtggtggtaaggatctctccctcgtcgccctcgtcctcgtccttttggtatcgcccgtgcccgttgtgcggttgtcgaccccagtacccgtgtactggtgtcggtagtcgttcgcttgtgcgtgtggtgaccgtgttagtgtgcccgctcggtagcctcgtggtttccacgtgtgcagcccgtgtggtgtctagtggagtccgtttgtcgaccacttgcctcggttgacacacgggatccgcttccgtcgacccgtggaccatctctgtgtactcggtctaccgtggtcctttaggttgacatgtggggtctgcatgtcaacggcgcagccttcctgtcttttccaggctagcgcttacacatgttttataattgcaaaacctaatcacaataatccgtaaatctccattgtcacgaccggaaataacccaacgggcgttccttacgtgcgtgcattattccttgtcccaggaggcaaggtataccaaaagttgatacaattcagagttcaacaagcggaagcgtaaatagttaatttattacatgggcagcgaaggcccaacacacacaaagacaaacgagaaacagcggaagactagggcgacgaccacaggcgcttgacggcaggcacaagctagacaccaaaaccttcatcttccagagactcctcttctgggtttgggaaaaattgagcaagactgagtacaaccaccgtactcaacaagacacacccacaagtgcataataaatgcaagggagtacaagggagttataatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccaaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgccctggagatgtccatcgacccccgacttcgtccatctctatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacacactagttggggttttgtttatcctagggtgaacaaggtaataataacaatagcaataataatgtcttaacaaaggtaaataggcatggctaaataaaacagtgataacgcgggaatttaaataaagcggtaatgcattaatttaaattaaaataattttataaactgggattcaatatgctcaaggatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatggatttattgcgtcagccgaggggaggggcgcgcggaccgggtccacgggggtggggcccacgcggcagccccacggcccacggtggaccgggcgcacccgggctcgcaccggccggcgccgtgggtcccacgcgtcagccgcacctaagggcgcgggcggctgacagccgggccccacacggcagccgcggggcgcgccagaaggcggccacgccggcgcagcggcgggaggcggcgcgcccgtgcccctatggtcgccggcggcggccataggcacggcggagcggcggccgagagaggggaagggaagggggaaaagaagcggcggtccacggctcaccccgggtcgacggcgacgacagaaacggcgaccagagcggaggggtggacgaggtcgccggggatgcggtgaagccgaaggtggcgacgccgaggcgggaggtggtccggggcgacgacggcggagagagagagcgacggcggagagagagagcgacggcgcgagctcgattccgacggggagagagggcggcgagtggcggaaacggtggagggaggcacggggaaggtttatataggattgggagggggagggagctgccggacgagggggaaacgggcgcggaagatccggtcgccattgatggcgccggcgaagttaggggagaggtttccaaacgaatccgagggagagagggagggaaaaatggggggaaagagggagggaatcacggggaatatttcccccctcttgattgcacgcggggcggacgggggcggcgggattcgcggcggcggcggcgctagggcgcgggcggggcggcgggagcggcgggaggaaggggatgacgggtgggccccacccgtcagcgagggaggcgggcgggcccgcccgtcagcggcacgcgcgcggggtgggggccgaatgggccgcgggaaagaggagagagagggagagagatgggccgagccggcccaagagggggggaaaggactttttagggtttttctttttataaaacctttttaactttgtttatttcttcttaattattatttgtgctccgaaaattccactaaaatttatttacgcattttaggcttttaggaaatatacaaaaatcctccaagccttatttgacttttaactttgcacattttaattgttggaggctttcacacggattttaattattctaggcataatttcgaggatgtattttagagtcgttttgggacgcgacatccatgtaacagcattaaacttcggatgatcatatcttggtcatacgaaccccgaatcgacccgttcaagtctcctaatgtttgttataacctaaagaaccgtgtgctttctttttatgtattgttattgcttctttataggcttgtagctttgcttgtgtgcttcgcgtagcttctgtcgttccgaaggttctcgaagcatggtttgcggtcgtcgccaaaggttcggaaggccgttctctctgagcaaggcaagtcacatcatccttgagcataatgaatcccagtttataaaattattttgatttaaattaatgcattaccgctttatttaaattcccgcgttatcactgttttacttagccatgcctatttacctttgttatgaccttattattattgctattgttattattaccttgttcaccctaggataaacaaaaccccaactagtgggtactctatttatggttccactagtatgaatttaggtagatgcttcgctgattaattaggtaacaataggtggttttataactttagactttaggaattctcatatcacttggatactatggaatggttggcttatggtggaattggacatacccctctcttcctatttcaaaacccctaaaacctgttttctggtggggtttgggtgcatgccagttgtgggaagtagcaccccggacaatataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaagctacatgagctgcggctcggtaatcgagatgtctaggcaaatgaagactacacgggtcggtgcccgttagtcgagatgccatggcactggactagtacgcgggtggtctcatccctatgcgtgtggtgcacccggtctagatcctgttgctaggggctcaatcctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgtgccctcggatatgggcaagcctagcaatgtacccaagttagtggtttaattcttaaaatttgcttaacaactaaaatatggaatggttggcctgggttggcttgggacgagctgggacccaggtcgggttgccagttcggtctgaatcatcgtaggccttgggttaaggcaggttcgtgtgggtccacggcctcgattaataatactgtgtagctctaggatcgtatttataaaatagctttgggcaactaattgacttttaaatgctctttactgcaaaacctaaccctattattattaccccatgtactcccttgcattaatcatgcatctctcggtgtgacttgctgagtactgtggttgtactcattcttgctctatctttcccccccttcagtaagagaagctttggagaagaagtcttaggtggagtcctggcttataccccagttgagcgcctgtgaagatggagccgtaggcccgctagtccgctactgtttatttttgattgtcaggcctgaagtgcctttgtaataatgtaaatattatcgatataataaagatgtgcggtttgtatcatgtttgtgtggtgtaccccggcttttcctgggacggggattaatacactagcggtcgggaaaatgcaaattttctcggtcacgacatgcgccctatgggttggtgcggggatgaatattgttttcagattagtgatgacggagatacctacgtctagaggtattggatgtgccagaactatgcgtatagtccagagaaggctaagcctgtgcctaaggaaagaagggaaaggcgaagaagccagtggaggtaaatttatttattttatatggtaccaccttgaatctatgcaactctgccatcaacatataatgtgttgcaatgtgcaggcaatgaagatcccgcctcctttttgtgacttttgtggaatggattgacaaggagatgaatgagtttcatacgagtttgattcgacattggcgcgagtggaaggaagaacctaagaagcgccaacgcgagtgtgctgcaatacagaaggctgaaagggaaagggagttggcaatagagaactgggagaaggaagagggtgatgttgattgggtgaggaaggtggctagggcgcagcgtgtgaaggaggcggggacggaagtgccaaggaagggcgagtaccctcgtgcacccaatagtgcgatggaagttctaacccaaaattcgattccctaaggcatgtaataccgatactttgaaatgtcttgcattgaactatatgcgtgtatgccatagacctttggaattcatcggaatctttagttcgtcatgtcggtcattggacgtcattggacttcatctcctccgacactgttccaggctcctctcatgcgttcgctgaccggcgccaccttcccttgtttctttggttgcaaccaccctcccttcagcccatgtagtggcagtcacccaccccgacgacatggcgccaatcatcatgtgatgcctgaccgacgctgatgaaccttgagttccactcgacactcaaggttgttgttggctcgatctttcggtgagttatagataactacgatttgggagaagcgttgacgatccgactacaaccgtacaagacgttgcgttgcgccttagtgatcgatacacctctccgtgggttgttgatcttgtcggtgcagatcaaccctattcctgcaagaaaatcgaagaaataagcaaaaaaacaagataaaaacgatatgatattgcaaataaaaattgaatgcaaatgataagttggggtttcgaatacaagcagacagacggtctagccgacacgcgcactacaagaaagtagcaatggctaagctttcatctaaacaaaacccaagaaaccctgaaggggtacctacctatttataggggtgggaggacgaccaagggatgccaagggttgttctccacctggttggggcgcaccccacatgggcccactagggccggggtcccaaacaaagttacaagcccataggcccaagacacgtgatgtagcaccttgtttatgtgattgcagccaaacgacaaggaatttggcaatgaggctagatctgttggaaagagggcttcgagagctttccatcaagtactcatgggccgaaaacggaggtcgtatgcaaattcggcggccgtttgaagtcagcagtgtagctggtggccgaatcggattacagcacttggaggacttgatctttatatcttcttgttcatctatgatgtgagcaatggttgtatccgtagcagccaaggtcacatcatcctccccttcttcatgaaaaatcgttctcggtttttccatatggtgctcattgcgtggtcgatttaaaacaacctgtttcatccaatcaaaacaagagaaactcgaagtaatatgattataaatagcatgtctctctggcttgaaagttttatacacatgtacaggaggttctaaatccgaacatatgtaaactgtatacaccaaatatatttctctatcattatattcaccaaagatatgaaaaatagcattagttggacatggcaaataatatttagcaaataatttctccttcaaactatcgagctcacaaaaatcatcacactgaacatagcccaaagtatttaaagaagatgtcaattcacgttgttgtacttcattagcaaaatgaataacatgcttaaaattatcacataaagaactgacattagaaatagcatgttcattcactagttgtggcattgatataagtgaagcattatcacacaactcttctttatcacaaggaacaacaaacaaatcaacttgtgacaaaggaatctcatcagttggttggttccactaatggttgctctactatagcatgaaaagtgaacaaattcaattcattaacaacacactcaccttgaataatttcagcaccattaagtttacctttaatgccctcttcatatgatggaggtgccttgactttgagtgtgaacaatgggactggtggctctttcatgtctctatcctccatttcatgattatgtacttcctgcaaatggttagtaatagaagacaaaaacatagcatgttgcttcttcatatcctctattttactttcagcattacaagcaagttgtaacaaatgagaaagatatgtatatctttaacaatcaagcatgtcttgaatttctttgttaagcccacgtaaaaagctcaattctatagcttcttcgcattcatctaaatcacaacataataaataagcatgcatatcatgatagtatgaagtaacagttctggtatcttgtttggaacattgccgtttgttgaacagaatgtcagcataatacatgggaacataaacatctctcaaatatcatttcatgtctttccaagattgttgtattttattatgcctacaaagatgtttccaatcatcatatgtaattaaaacactagaggcacacataatcttttgtttctcagacaatccatgctttttaaattcgctatcaaccgctagctcccaattaatgtaagcatgaggatcataatttccttcaaaataaggtagtgcagattcgatcttacctagaacaacatcacttacctcatattggtcatgttgatcacttctcatgtcccgatgaagatatccatgttgagcatgacggtcccctgttcgcttgcttaatcttgtcattgttagtagaaaacaagaaacatacacaagaatatgcacgctcctatcaactactaggtagtggcaactcaaatatcacacacactcaaagcttttaccgagctcttacaagttcttaccaatgcaagcggaaaggtgacatacaccgactcaaccaagcacccaaatggaggttggatgtatcgatgccttggcaaacacttgtcgtacggctgcaatcaaatctgtggagctctggataggcttaagtatgtagcaaatgaatagcaaatgctcaaatcagataatgcaaagttgagcaattgttcaaagtcgagtaccatgctggtcctaggctagaacgtactagagacgcgagcctagacacaaacataacacaaaatagcactagaaacaactcaagcacactctgatatatcaaattcagctcaaaaatacaactgatttttttttctttcttacttcttcttccttcttttcttctttttttctttttttttgatgcggcttttcttttatttttttcttttttatgcaccttcctgcctttttcttactttttttatttatttttttctgcaaaaatgactcaaggacctcaatgcaagattacatggactcaattgtaaatataaaatatacagggactcaagtgtaaaagtccgaatccaaaaaatgaaattataaaaaaaaatggaatgctgaatttatgctggttatgtttttccaaacggatctcgaaaccgacaccaaacaaaaattcaccaagctgtacggcaagtcacggtgtagattgaaatgagggagggagtcggataggtgggaaaccgactatctcggctgaaagtttgggtatctcgcatgaaaggaaacaaaatcaatctcaacagaaaccggtacctcccatgaaaggaaacaaaatccgatcttaacacaaaccgatctgctatcctttctttctccttaactgcgcgcaacagcgatctactatccttcctttctccttaaccgcgcacatcagatcttcttccttgcgtgaagagaacaagcatggtcgaatgcagatggcaaaccctagatgcaactcagcaactccaagaccaaacgataaaaacttctgaaaacttaaaaaatggaaccctgacg

SEQ ID NO: 1607 - DNA, 3931 bp, Oryza sativa
ccactagggcgggggtcgtaaccaaaggttcaagcatataggcccaagacaggtgacgcagcacctctgtttatgtaattgtggccaaacatcatggaatttggcaatgaggatggatcgttggaaagagggctccaagagctttccatcaagtactcaagggccaaaatcggaggtcatatgcaaattcggcagccatttgaagtcagcagtgtagcaggtggccgaatcggattccagcacgtggaagactcgatcatgatatattcttcctcatccatgatgtgagcaatggttgtatctgtagtagccatggtcacatcagatgctgccgcccaccacatccccgccagctcgctcctgcctccatcgtggggctggcactgccctcccccctaccccaccaccacaacgcaacccaggcgccgcccccttccaccccccccccacccggctcgctcctacctcgcgtagctagatagcgacccctcccctctctgaccatagcgccaacaatactggcatcctcccatcccgaacttgtaaagtagcaaattgacgcgcataagccaataatttacacaattcgatattgtatcaaatgcaaacatttcaaccaactcgcaatgagcatattaatcaattattcgcacatgacataattgttaacctccacacatgacccaattccatcgaacaagtccacaagttcaaaaaatgcatatcacacatgacatacaaaagttcattcatcacattggaccatgcatcaccaaagttcatcaaacaagttcacaagcccatacatcaccgaagtccatcaaataagttcacaagtccatatatacatcaccgaagtccatcaaataagttcacaacttcatacataacccaagtccatcacacaagttaaaaaatggtctaaacatgagaagtactagtacgtcatcaaactcacatcttccgttgacatcaaagagcccatgactcgggagtgtaccaacatttcaaaatacaatgtgaggcaataacacatcatggataatagtaagtgcactgtatcattgaagtacggagtacctctttttcccttgctgagtgggacataagttgtatgtagtgggctacgacgcctgaggcgcatcgggcagctgtgacatgccgatctcatcagcatccggtgcgatgtatagtcatcgtcaccggcattgtcatcatcatcattcaatccatcatcatcaaaatcctctagacattatcaatatttgataacaaactaaatatatctacatgtttgttatttttaccaaaaaaaaattgatatagctaaaaatagcccttataatgacaaagctaatggcgccgagctaatataataactcttaaaacattacaacatattatgggacagttggatgggcgtggtgtagttgtcaatgtatttgttgttgcatcttggagagctagctggttcggactcatcttccttgctaggaccagcggaagttttttttttctaaagtaattaagcaaacagttaatacgttaattcatgactgaaaggaatgaagaaaaggaaaggaacaaaagaaagaaaaattgaccgaatttctgacctttgtgccaaatttattttttttagataatggaatgaaatagcatcccggcctttactcgaaagagctacagccaattattacaaactagcactctgtaatagtgaagttcaaatagaagcaaacacaccaaccaaactagacaaaataacattattccagtctattggtaaatctccatccatgattggcaaacagttgcataaccgtcgtttcaaccttacgacatgcaacaattaagaaatctgcatcttcatcacacttttgtaactgtgcccatagacgaagccaatatgttgccttgaaaatgacctgcatataagtaatagtaggtgatttatcaaaaaccctatcattcctactcagccacagtgcccaacacaaggcagaaactccaacaagtatcagtttgctctttttgtttatgactccctgaagccaatcataaaaaatatgagatatgctagtaggaatatataaaccaaaagaaaactgaactgccctccaaataaactttgcaaaatgacaatcaatgaacaatgttggatagtctcatttttcgtacaaaagcaacatcttaaattaccagtccaattccgtcttgctaaattatccttggttaacacaactcccttaagcaaataccacataaagatcttgatcttaagcggcatcttgagtttccaaattaacttatttctgtcaatgtaaccattattaattaaggctaagtacattgatctaactgagaattggccattctgatgatagttccatctaaaataatcagaagtattattcaattgaatatgaacaatagatgcacacaattcatgccaaagtgttaaattctgaccaactaaagctctcctaaaagaaacattgagcggaacagaagtcatcacactagcaacagaagaacttctcctactgacaatagcatataaagatggatacttttctctaaaggccgtatttcctaaccatctatcttcccaaaatcttatgtgttccccattattcacaatccaagaacccatagttaagaaagttttttttgactttcatgagtcctgaccaaaaatgggagtcaccttgtttcctgtcaacttgggttataaacttattataaagatactttctcttcaataagtcttgccaaacaccattttcatttattaacttgaacaaccatttactcaaaagacatctattttgaatctctaaattatgaaccctcaaacccccctattctttgggttggcaaataatatcccatctagtaagtctatactttttcttatggtcatctccttgccaaaagaaacgagatctataataatcaatcttttgaagaacccctttcggaatctcaaagaaagatatcataaacatagctaaacttgaaaggacagaattaatcaaaaccagtctacccccaacagacatatgttttcctttcaactggctaagttttttctctattctttgttcgataactttccaatcattattacacagctttctaaaatgcattggaataccgagatatttaactggaaaagaccctaacttacaaccaaagatattagaatattgctcataacactcctttgcctgaccaaagcaaattaactcacttttgtgaaaattaattttcaagccagataatttctcaaagatagacaaaatcaattttaaattctttgcttgttgtaaatcatgctctaaaaaaatgatggtatcatctgcatattgcaaaatagacaaaccatcatccactaggtgagaaaccaccccatgaagagatccattatctttagctcttttaattagtaaagctagcatatcagcaactaaattaaagagaattggagatagaggatccccttgtctaagccctttatgcgtttgaaaattattaccagtttgatcattaactttaataccaacatgaccaccttgaataaaagaggcaatccactcacaccatttaggagagaagcctttcatcctcaaagtctgttgtacaaatgaccattttaccttatcataagctttctcaaaatcgatcttaaaaattacagcacttttgtttttacgatgtaactcatgcaaagtttcatgcaaaatacccacaccttccataatatttctcccaggaataaaagcagttagagtaggactaattaccttttgggcaacagtcatgactctatttgtaacaactttggtaaagatcttaaaactaacattaagtaagcaaataggccaataatgatggattgtcatagcctcaacacacttaggtaaaa

SEQ ID NO: 1608 - DNA, 33901 bp, Oryza sativa
accaaatgaaaatattttgtgttagaatcaccctctaaaatatccttagatttcgccctctgataccatttaacttcctcttctctcagaattgtagataatctatttctacaaaaccatctaaaatccaattcctcctgactcaaaagcatagtttctgcctttttatctagcaaatccaacttatctaaaatctccttttttttttcttttttgtacaagccactagtatgtttagaccaacccctaagatgctgtcttaaacgacgaattttcgcctgccaccgctccatggcagaattgccttcatcaacactagaccatatctcctttaccatatcaacaaagtcatcacgtaaaagccaaccaagttcaaacttgaaactatgttgagcattactcaaagaagaagtgtttgtatttaaaagtaaaggagtatgatcagaaatatctctattaagagccaccacagaagataaaggaaatttatgttcccactccgtggacattaaaaccctatcaagtttctcatatgttggattcactaaattgtttgcccaagtaaatttcctaccagacatctgtaactcccagagacataacccatcaataatagcattaaaaaggaagggccatatatcatcataattatcattattcttttcatcagagctacgtagaatattaaaatcaccgccaataagaattggtaaggtttcatgactgcacatattaactaattcagcaaggaattgatccttaaattcactttgtgctggcccatacaccagaactaaagcccacttaaacttatcaactttattacataaatgaaacttaatgtagaaatctccctcatcaatcaaaccaatatcaacattaattaaattgatgcccaaaagcaaaccaccggacctacctctaggaggtttgcaatgccacaaaaattctttgccagcacatagatttttaagaacagccggactaaaatctttcttaatagtctctgacaaggcaataaaatcaaggtgatgttcctttgttaaatcagaaataaacttatgttttttcgggtccttaaacccatcacaattccagaacaaccctttcatttaaaaatattcttttttttctttccccttttagtctttttcttactattaggagaggtatctaaagaatttaaagtggtctgagaataattatcatccacagcactaaaatccatcacctcctccattaattcaccacacaaatgttgaagtagagaattatcatccacctgatcatctaatatctcactatcaacatttgaagtatgtacctgattaacagaagaactaacatatttacttaacctcttttcctctatactctttaaatcatttttaacatcatctaagataaaattcgtacccaaagtgatcacaccaagattatcaagagcagcagaaatttgttcatttgtaaattgtaaaaaagaaacattatcatgaaagttaccttttgcctgcaagttgtccaaattcttatcagccttcaatttctcagctctttggagaacaagttgatcactgtcacttgcccttctcttgctcttcctggagggagaaattactgcttcaggaatagcagcgagcttttcccctagactttgctgggtattaaccttcttaaccattacagaatcctcatctaagccatcaaattcctcatcagatacagtcaagccatcagattcaggtatcagactcaaatgagcagccggtatagaaggaccacccctctcactaacctgaccaccagaacctattaaggaatcgttaccaggatcacctccagatcccttccccaaatcctggttcagattcccctcctccttctccaaagtcccatcatccagattctccatatccattggtacaggctcgtcagacccattgtcaggctccactataaaagataactcgtacaagtggtccccaataaccacatcaaccacatctgggatcaaagatggatctaggaccaaaacttgtaaacgagcaacatcataccttctagtaaagttcataaacggtatatcgatctccttctctatctctggtgagttatggtatgtagttccataaacggctgtgttgctaaggtaaagaccttgttgtggcaattaacaggtcgtgagagatcgattaaacccgtacaatcctgtttttttttctatttgttagctaagcagttacataaatcttaaagcaaatctagctaaatagcacgatctaatctagttaaatattagcacaaatcctggagcaactcatgagaccaaaaaatcgtgtgatttcttaacgaaaatcacccctgtgatttatagcaaaaaaaccgttcacattatgtttagttcccaacatagatcattctctcggcttatggggaattattctactctcgcgaggaaacatcctttatcgtttccatgttactcaaacggatatatttttaaaaaaaaatcaataagattaatataaataaaatcatcactccataaacatgcgatgtcaaatttaacatgttgtaataaaaaaacaaattttaatgtgaatatacgttaagtatttatttatttttaatttgtagaagttgaatattaacatgtatgtttatgaggtgatataacacatattaatatatcctctaatttttgttaagatatgatatgcaaataattagaaagtttaaaatccaggctaatagtctcgagttatttagttgtgaccatcatttcgccaacttatacttttcgtctgtccacgtcgaatatggatcagaatctatccactctctgtaggctcacacgccgcgccacgtctatatagagagagagcaaaattaacgtgactccataccaacgaatgctgttttagaatcaagtagtccccacgcacctgatcattgtctaagtacgtagttagggtgcaaatggccggagcaccgacgagcttagggttctccgtcaggcgccgcgagcgcgagctggtggcgccggcgagaccgacgccgtacgagttcaagatgctgtcggacatcgacgaccaggacatcctccgcttcaaccgctccggcatcagcttctaccgccacaaccccaatcaggacggcgtcgatcctgtcacggtgatcagggcggcgctctctgaggcgctcgtacacttctacccgctcgccggccggctccgcgagctgcggcccaccaggaagctcgtggtggagtgcaccggcgagggcgtcgtgttcgtcgaggccgacgccagcttccgcatggatgacctcggggacggcacgtcgacgtcgtcgccgctgcttgcgccgccggtgccgtgctacgacatgctgctgtgcgaggcggagagcccgacggcagatgtcgtcgaccgccccctgctgtttgttcagatgactcggctggcgtgcggcggcttcgtgttcgggatgcacatatgccactgcatggcggacggctccgggatggtgcagttcctgacggcggtgaccgagttcgcccgtggcgtgccgggcgccccgacggtgccgccggtgtgggagcgcgaggcgctcaccacccgatcgtggccgccgaccgtcacgcgcgaccacgtggagtacgcgcccctgcccgtcgacgacgacgacgacgacgtgctgctctccctctccccgtcgaccaacgcgtacgcgcaccacgtcttcttcttcggagatcgggagatcgcggcgctccggtcgcaggtagtggcggcctgctcgcggttcgacctggtgggcgcgttcatgtggcggtgccgcaccgccgcgctgcggcacggccggggcgacgtcgtccgcctgaacatgttcgtgaacgcccgcgtgaggaaccggcccgtgccaaggggctactacggcaacgcgatcgtgttcgccagcgcgtcggcgccggcgggggagctgtgcgggaggccactcggccacgcgctgcggctgctcgtggaggcgaaggcgcgggcgtgggaggacgggtacgtgcagtcggtggccagcttcaacgctgctcgccggaggccggcgttccccaagggcgccaggacctacttcatctcggacatgacgcgggcagggatgacggacatcgacttcggctggggaaagccggtgtacggagggccggcgacgacgatgctggccacgtttcacctccaggggaggaacgaggctggcgaggcaggcatcgtggtgcccataagtttgcccagtccggtgatggagaggctgatccaggaggtggacaaggggctcaatgccggagctgctgccgtgctagacgacgcaaaagcaagggtggtgcctgatgaaggctacgttctagcaaaattgtaggtctcatctcgacggagtacgaaccacggactgcatgtacgccacgaccacagcagctctcaataataataataataataataataataataataataataataataataataataataataattgtattgttgataattgggggcaactatgactagatgcccgatatttgttaaatagcggccggtgttgcatcccatggttataaccgtttcagatgtttcattacttagtacaaaatgtttcagcacttggtaaaatgtatttactttaacaaggagagaatctactccatgccactgaacttgtcagttgtcacagttcaatgatttgtcgctaacattgtctctttctctaatataccagtgattttatcaattgttttacaatatacattgggttggactttttttaaaaaaaatacccaaaatacccttagagacatacaagattaacaattattttttctcattagaagtttcataaaaaatatgaaatttttaatgtagcttccttacaaaacatggaaacttgtatataagtttcaagtttttctaacatatttattttctagaaaaattatttttgtgtggtatatgagagagagtttgcttacacaaatgatgatttatattaaaaacaccaaaaaaatattttatatagcatattacagataagttatatttttgaaaaatgtagaaatacaaacttcatattgtgtaaggaggccatatgaaaattttcatagtttttcgaaacttctaatgagataaatcaattgttaatcttgtatctataagggtatttttgaattttttaaaagaatgtccgatccaatggtgcattgtaaaacaattgataaagtcgtcggtatattataaaaagagataacgtcaatggcaaattattgaactcgaataaactcaatggtatagaatagattctctctttaaaaagttggttgcaacaccgttatatatgttgttgtgcatacatatatagtttcttaattaaaatataatctagtaagatcttgttctaaaatttaattataacaaatatataaccacatcatgtaatagaatctaaaatttctcaaattgatcatcatataaccatatggatacggatttcgtcagaatacaattaatggagtatgggagaatgtgtgtatgctagggtataattggcatgaggttttaatccatgcatgcattgtgggagaatatatgcatggtgtcttgattgatgtaatttaaattgtccttagtcttggtgtataaacttatatgatgatcaatttgggaaggagagagtaatttagaagaaaacaaatcatttcaagccattcaatatttaaaactacactctattggatgctcgcatgtgcatcccttcatatgtgagactgatggctgtttcatacacattgggtaggcaccgtctgattttatttttcggcgtcgtaggggatcgattttcgcaggcgggcatgtaattcggagccaaaaccccgccggcaaaaaaagtacccggggtggagtgggcggtccgcctgcgaagatcgatcttcgcaggcgtcgcttatatggcccgcctgcaaagatgcccctatatagtcttctttctccccgagccctgttcattctccccgacgtttctctctcctaaagtgacttaaatatagggggaggttttgaacttcaaatcttcgggggatttttctacagtacttagatctactcatttccacactaggtatgcaattttttaagcttttagatcttaatttgtgatggatttatgcatccaaaattgtgaaggaagagctccatgttttttaattttatttcttttgatatgttgatgttagatgtatgtgtaatacttgatgcctcttgttgtagtggtttaatgtggtaacataaattctcgattttttttatttttgctatcacatccaccacctagttctagatctagatctagatcttgtcatatatagagagagaataaaattttaaatgtctatttattcggtgcaatcaaaaaatagttatagtattttgtaatatgccgatgatatgattttgttagattttcctaatgtactgatttggcatgtctatgtaaaaaaaattgaaataaactttgatttttttattaatttacacttaaccttaacctttagttaattagttttgaatagcgataatttttttcaataaaccctacaaatttggtattaattgtgcaaatattttacgtgtatttttttagagatatggaaagtcaggaatggatgtatcattggccgaggtttttgtctccatatagaatcgaagtggctaaatttattggtattgccaaggcacacgctgagaagaataatatgaggaagataatttgtccatgtgctgactgtaagaatgaaatagcctgggactttgacgatgcttttaaagtaaaggagcacttagtaactcgtggatttatggacaattacgaaatatagacacgtcatggcgaagaacaagtggacgggccaaaaaatgtagttccgacacaagttgaagacatggtgcatgacgatggttctgttgaggacaaaatcgacctagagtaaatgttacgtcatgcagaacccgacgtgctgatggggtcggctagagggttaaataactttgaagctttacagaaggcagcaaaggaagttttgtacgatgagtcaagggctgtgatagtgagttcacaacactccggtcagttcttgaacttttgaggttaaaggcgagacatggatggtctgataccagtttctacagtctgttgaactactgcagaaaatgctctctaggactaacttactaccattcagcacatatcaagcaaagaaactcatatgccccctttcacttggtgtggaaaagattcatgcgtgcgtaaatcactgcatactgtacaggaaagagtacgcttctttagatgaatgtccaacatgcggtgcaagccggtacaagtcgaatagcaatactggcctagaaccctctaaagcaactgagggacgatagagaaaaatcccgcagcttgagatgtggtaccttcttgtcaaagaccgcattaaacggatatactcaaacccgcgagatgcggaactaatgcgctggcatgaaaaaaggcgcaagaaggatgggatgattcgacacccgacagatgctcgtcagtggataaactttgatactcagtatagagagtttgctaaagacccacagaacattagatttgccctgagtactgatggagttaatccttttggagacatgagcagctcacatagtacttggccagtgcttctcaccatgtataatcttcctacctggctttgtcaaaagcgaaaatacgtactactctgtatcctcatacagggaccccgtcagcctggtattgatattgacgtatttcttgaaccattgttggaagatatggttgatttatggaaagagggattgaaagtgtgggatgagtacttaagggaatacttcacagtaaaggccatcatcttcgtgaccattaacgattatccagcaatgttttcagtttcaggtcaaattaaaggtaaaataggatgtgtgatctgcttgaatggaacgtactataggtatctcctgggttccaacaagcttgtgtacatgcggcaccggcggttcctacgcacaaatcacaagtaccgcaagatgaaggcggagttcgatggtactgaaaagactgatcctgcaccaaaaactacatcgggagaaaaggtgtgtgcaatgacagagaaaattgtttgcgagtttggaaaaatgactaagaaaccatcaaaggggacagcgcaagaaacccgagaagaatacgaagggaggggatagtaagaagcaagatgacagttcgaagccagatgataaactccctaccccattcaagaagcattccatattttttaagtacctctcgtactggaaagatctagaggttcggcatgccatagacgtcatgcatctagagaagaatgtgtttgacaacatagttggaacattgttggacatgccgaagaagactaaagatggtctgcaatcaagaatggacctagtcgagatgggaatcagggaagagttacaccctcaagaaggagaaaagaatggcaaagtatatcttccaccagcctgtttcacactgacacctgaggagaagaagtcattttgcaactcactccgtgatgtcagagtgcccataggtttctcatcaaacatcagtcgactagtttcaatgaaagatttgtcggtatctggttataattcacacgactgccatgtcttgctcaccgtgtttcttgcaattgcaataagggccataaaaccggagcatttaaaggttgctatcacaaggttgtgctactttttcaacgcagtgtcatagaaggtcattagtctcgaagagttaggaaatctccgtatattcgcacatgagacacagtgccaacttgagatgtgtttccctccgtcatttttttgatatgatggagcacctcattgttcacatagtgccacagatggttgcacttggcccattgtacctccatcaaatgtggtcatacgagcgttacatggcggttctgaagtgttacgtctgaaatagtgcacatccagagggatcaatggttgagggttatagtactgaagaggttgtcgagtgttgtatcgattacctcaaatatggatatgcaattggagtacctgtgccccgacacgagggcagattgagtggcaggggaacgataggaaagaagagattcttcacccatgatcacaaatcattccaagaagctcacttcagcgtgcttcatcagtttgctatcgtcgagccgtacatcgatcaacatatcgaactaatacgagctaacaataagggtcgcaccaccaagtggataatgaaataacacaagcgtctcttcatagattggttgcgagacctagacttacctgagggacaaactaccgatgaaataactatgaagcggttggcttgtggtccatcacctacagtaaattcttggcagggatatgacattaatggatactcgtttagcacaagagcccgagataataagacctgtacgcaaaacagcagtgtctgtgtgaaggcaattaatgaagccagggaaaaacaattatacttcgggtttattgaagaaatatgggaaatcgactatgggcacacaatgcaattccccatatttaagtgccagtgggtaaaatacccgaacggggtcaatgttgataagttcggtcttactattgttgacctggcgagtgtgggtcacaaggatgacccttgggtactcgccaatcatgtggcacaagtgttttatgtgaaagacccttcaaatttgaagaaagatatagtgctaccagggaaacaaaagatattgggagtggatggggttgaagatgtcgaagattacaaccaatacgatagtatgccactttatagtcagtttgtacagaagattaagaatgtcgagacatctactcagaagaccatgaagccttacatacgcacggacggtgtgggcaaaaatgttaaagggtaatgattgttgagtggcatgtaagcatctaagaagttagtagttatgtaatggtggtatgtaaggtgatgtgtgatcatatcgcaaattgacgaacaattgtactcaacattttgcatattaattagtttgtactaatttttatgtgcaattaccatttgtagtgtaaaaattttgttaaaaaaattaaaattagtaatatttgaaaagtgtaattatttttatgtgcaattaccatttatacatttgaaaagtaataatactaaggtttgtacattttgtaataatattaagatttgtatattttggaataaatatattcaactctgtacaaattttttcagtcggacggcccgcttgcgaagataggaaaaaagatcttcgcaggcagacggcccgcttgcgaagatagtaaaaaagatcttcgcatcttcccaggcggaccgcccgcctgcgaagatcgttgcccaatataagggcaagcccgcggcgccaaaatttctaagtccaggcgggaaccctagaaattttggcaccgtcaggctgccgaaatttttcgccgccgcacgccttcgccgtcctccgccgccgcccgcctgcgaccttcactctccgaccgtcgtcctccgccgccaccgaccgtcattgtccacgcgctgtcaccgagaccgccgccccttgccgccgctccaccgcgcgcgacctccaccactctgccgccgccgccgccgacccctccaccgcgcgcccgctccaccgccgccagctcctccaccgccaccggcccctccaccgccgtcggccacccctccaccgccgccggccgccacctctccctctatctcgctcgcggccgaacggcttaatcggccgatcgttgtccacgagcgaagtcgtcctcggccgaacgacgtcttcgaccggtcgtcgtccacggccgaacctcgtcttcggccgttcgtcgtccacgaccgaagccggtcgtcgtccacggccgaacctcgtcgccggcccttccttcgtcgtccacgaccgaagctcgtcgtcggccgttcgtcgaacacggacgtgtgtgcatgtgggtgtttctttttatatgtgtgtgcatgtgggtgtgaatgggcatgaggggtggctgatatgtgaatgagggcttatgttgattgtgaatgtgaatttgggaatgtgggtgatatgtgaatgaaattgggagggtacgttcaattttgcaagatatgtgaatttgtcaaattttttaaataacatgttggagggtatgttaacatttttttaaaaaaatgtggaggatatgtttgccttttccattttttttaatcaacatgttgatgaaataaggaagtcaattagtgcactacttgataataacatatcaaattttgtacaaatttgtttgtagtaattaatttagcataatagtaagtagtcattagtttcgcaatttaaatttgtttgtattaattaatttagcataatagtaagtactaattaataatatttcgcaatttaaattagtttgtactaattaatttagtataatagttaaatttggaaatctcagagaatttaaatttgttcatacgacatattgttaatatacagtttatttttgtacaaagttgtttatactaatttgagtaatttaaaatgtggacgataactctttttttttatattagaggtttgaaacgatggccgatagtactaaagggactgaagagaagggtttaggggagcaggagctgtcccttgctgttgtggttgctccggaaccaacggtcccaccgaaaggtagttccaactgcgacgttggtgatgaagacgaggattactcgtcgccaagcgatccttgtccaagcccaagcccgaagagaaggaaaaagggcaacagtgaagaagacgacaaggactacattccccctaaagaaggggtaagtaaacttaatatgtaaaatgttcaccgtgataactattagcccgagctaattcgaaacttccatgtataccttctcgtaggaaacggcgccacggcgatcaaaacggcagccgaagaaaaaagttccgtccaaagacgacgacgtaccagctaacacaaccggcacaaagaaaatcgaacggttagcaatcacgaagaaaaggaagggcgagagaagcgtgaatagaaaggatgaagggttccatgttgttacccatgtttcgcctaaaggagagccgctcgcccctaagacggcacgtgcgaaattcagttcacagtgtggcataatagtaagggaaaagatccccatcacggtcaagtactgggattatgtatcgaatggggataaggaagtcctatggaaagagttgaagaaaatcttccagttcccggatggatcaaaggcagcagtaagaaattgtgcactgcaaacaatggccaagtcttggcgtggttggaaaaccaccttgaacaagaaatttgtgaagactggacgcacaccattttcgacgtatgccaacataacccccaatcagtgggacgactttctgaccttgaagaactccccagaagaaattcaaaggagccaaaagtatgcagagttggccaagaagaacaaatttcctcatcgcttaggctccgcgggatacgcgtggtgagtggaatggtttagaagctttgattcttcaagaatgtccttacggatataatgttcattgtttagcccaccaaaactaggtacgaaatgaaatccactcctaaacttagttgtattggtattggcctgccactggtggagcagtggacaaaagaggaggaggaaatgaggaagaaggggcaaccggtaccaatggaggagtagacacagagatcaaggaactgggtaagagctagaactccaaagatcacggatgaaggaaaagtatcgtttgaaaatccggagctgcagagcgttgccgataaaatagaaaatttatccagttcacaaaagaaaggatatttcaagcttgaaagggagaaagatgtgctaagtacggcgctgggtactcctgagcatgggggaagggttcaaggtgcgtcgagtaagatgagttggaaggaagggttcaaaaatgacccctacaagaagcgtgaagcgtacaaggataaacttagagacgaagggactgcggagtttgaaaggcaaatgatggatttctgcgtcaagcacatgattttgcctcgccccgaaaccaaagaacctgagccagattaccccttcgataacctcaaggagaatacaccctgcagattgcacgttcccattggacgctccgggaaaactcttgaggccgctacagccattgctatccctgggagaacatacaatgaagagttcatacccgctgtgtatgccaaggtgcagccgcaagtggtccacgaagggtttgagtcctacgacattgacttcccgactgcagatggtgtatccgtacttggggatgcagtcgatcttgtaattctctggcacaagaatgacatatcctttggattgggcaccgacgccacgcaaaaacctgtggtgcctaaaccggggttgggaaaacctccgaggcctcctaagaggaaggtgactgataaggcggaggaaccagagatgtaaaaggaaaatccagtgccgaaagtgccaccggagattgcattgccggaggcagccatggagattgcaccgccggaggcagccatggagattgcaccaccggatgtgcccatggagattacagtggcagaaccagaggtgcaatttgtggcatcagtcgggtcagacaaagaagaagtaccaggattggaatgggacggtacagagccagaaatatttgaagacccttctcctgcgaaagaccccgaggtgccacgagtgcttaggagccacgactccaagtccaaagatgagaacaaggagaagttcatggtaaccgtcttcagagggggtaaagaacgtgccaagctcagagatgacgacccccagaaagctgctgaactagccgggccaacatacttcgcaaccgatgattgcccggaaaagtacgaacatgggaaagcactcttgccggaatgggcactgaaagaagcaccatgggagatgagaaggttacataacttctacatggaggccagcaagaaaggcttaggcaatataacagctcgatcaccggcagattgtttcagcgaagaaggttacgtatggctagatttctcatatctccactccatatatcgtcgggataagatggacgtcaactgcgtcggtgtttggtgcatgtgagtatgagttttaattaattagatgaaaaatatgtacaatacaaatccatctgattgttactaacaaacttcttctgtaggatgcaatacatggatgctaagaagaaaaaagaacccatcggcttcttggatccaactcggatctgccaaacacagcatgccgtgacgctagcaccagggtcaaaccagctgaagggcaagaatccaaaagagatagcagaatacaagaagggcttgcataaggagaaattgattactgtcgcacagtacattggacgagccttcttgcactttcaaaataagagagtcgtcatggccacttataattttaagtaagtccaatacatttatcttgtacacatatatcttattttagctagtactaactaactataatgttgttaatatgtagcgatcattatatctgtttactcatccaccctaaagacggaaccgtggtagtcttggaccctctcgattacagtcacaagcaatacaaagaatttctaacaatcttacagtagtaagttattatgactcttgcatttgtatatgaatgtattataaataaatatcctccttactgtgaaacggtacgacatccatacagtgcataccaatactacaagttcaagggtggagaacagacccgaacacgggagaagctgctagtacgtacctattggccggtaatactccactcacttaatgtattccaattgtttcactaattgcaaattttaactacttttttctataatatgtcctgaagtgtcacaagcaaccgcgaggaacggtcctttgcgggtattatgcgtgcgaattccttagggttaatggacggtacaggactaacgcggaggatgtaagtctctatactatgtactagacagctccacatatttatgatactaatatattgattaatttcaatgcatgcagttgccaagattagaatgtcgaacaagctttgacgatacaggtatcacaaatgtccagcgtgatctgtgccacttcatccaccatgagtgctgtcatgtgaaaggagacttcttcgacccagagggtgccctagcggcaagtgacgaatttaaggatcttcgagagtagaacactgctatgccataatgtaactagatgacgttatttgaagtgacaatgtaaaaaaatattgtaatatatatattttggcaacacttttgagttatgcaatatatgtagatttcttagtaccaaatgcttgataatcttccaatatatgtacataaaaatctacctgcaagaatttctattaaataatttaaaagtaatttacgggcaaattattattaaatttcaatattttctacctatcttcgcaggcgaaagtttttttgttttcaagcggacgattcctattttcgcaggcagaccggactagccaacgtccgcctgcgaaaattatctttgcaggtggacggccgccccgcctgcgaagattggagatcttcacagacgttggcttacaggcggacggtcgccccgcctgcgaagaccctttttggccgcttgcgataatgctttttttaagtagtatttcagtcaattcctaattaaaaaattttcactttgactgccttaaaatagaccaaatctaattcgtacccctcacccacataaccggatatgacaactcctcaaactattaaaaccagtgcaatttgactcccttgacggttttgctgatgtggcagtgttgacctggtgtttgtctcacgtggcgcttatgtgacattagaattaaaaaatatatgtgggactcatctgtcattcacataaaaaaatatattgtaggacccactgactgtgggtccacgtgtcatcctctctcccccttgtcccagcgtgtgggaaggagctcgccggccgaccaacgttcgtgctgggaaggatctcgctgggaggccgtgcgctaggaagcgtcgtcagctgggcaagcgggagaggagctcgctggccggacgtgcacggagtaggagtccgcgacaccattgtgagcggggttcatcagccactgcctttttgtgcttgttcagggacagcatgtccacgccgcgcctgctttgcggttccgcgttttcgatccacgggttaggtatatttttgctaaatccccctctatctatacacacacacacacaaattattaaggaaaagaatatatcaaagatctatccggtcgtggttgaacctctgcaagcagttcatctcccaacatttaggatacatacaaactgcatttcgcaccgatgatgaactggcagccttatgatttctgaccagtgagcatatgtattttgcgagatcccgcgaactgcattttcaagttgtttttgggctgtttaaatgtatgcaactcgtctgcatttctggatctctttcgtccatgcaaaggctttagttctttcacaaggataggaaatcagggggctcctaaaggcttgctcgcgcagccgcgcgcggggccctcatgcctagcgctaatagcgttgattagggctaatgacgctaattagtgttaatggtaattttaggagtttttcttaaaaaatacataagtaattcagttaaaagtttttaaaaaatagttcagttcagttttcaaaactttcacgtctaaattttttgaaaactttcaacccgaatttaaaatttttcaacccaaggtttgaaactttcaacttaaatttgaaaactttcatcttaaaattaaaaacgttcaacttaaattttaaaaactttcaaacttaactttgactcaaaattcacgcatattaaaaatatcaacaaaataatcacgcgaaaaatttttaaaaatcgggtaaaaaagctatatacacatatgattaaaaaaatcacccggagaatagcctgtcacacaaggaagccacacgcgcgtgtactgattttcactagcaacgtgggttcacatcctctaccataatggtactatcatggtatctacgtgtgggacaagaaggttgagatccacgtaccggtgatgataatgacattatggtagaagatcctcaccctagttacatgtgggacaagaaggttgagatccacgtaccggtgatgataataacattatggtagaggatcctcaccctaatggcacatacgcgcgaattatcttttccgaagaaatcaaccgtgccaaaaaaactgcattgcaatgtagtgtaccaccctggatctctttcggccgtgcaaagcaagagattgtcttctgggcgcagcacagggctgcaacttactcaggtgaatttttttttaggagtgcgactaaaaatactaaaaataatgatagcattataagggagaaaataaagcatttactgtagttgtaactactataataaaaacggcaataagaatcagtgtcatacaaaatgaatgtcaaacaaaatgctgacgcttaccatttaaacggcaaaactgactaatattgtaccaggaagcagcaaatggttgagttgctgcaaaatttaatcactccataaaacgatgggacccaattccgcttttttttccggaagaaaaagtgacagaccatctcattccattgcttaaatgaaacataaaacctgagttatttctcaaatgaagcgttataaaactgtacaataacatacaagacatgttaacattgcggtctggtactatttactgtttagtaaaaagtacattttatatatggtttcaacattttgacgtatcaaagctttacaggttacaattttaccactgccttccctcgtcttgctaagaagcaaaacttgttcactccagttgcgccggggtacatatacttttgcaaaaattccaaatttttacattatgcaagccaatagcgtggcggggatcacacacaccagggctttgcactaggattgatcattcctccagaaaccgaccaggcccataaagatttgctgcaaatctatgctaacgtcgcaactgaccacagaccagttctctaaactatttctcgaacatatagatgaatcagacatattgcgctcacataatctctgcgaatcttctcactttgacatcagtgcaggggaagacggcatgacatgataaagaaaaaaaggattcacttggattttcataagcaattgcttgtccattgttatatgttagcagtttcccatttggtgtctaaaacaactggaagaaaagacttgtagaaccatcaccaaatgaccgaatatcagcaggctttaccaatgctctacacagggggcaagtccgttctcgctcaaacctaaaacagaaccaggaaaaagctgtcatttcttgatacttgctcaaattaaggggaaaaaaaggaaaagctaagcattgaggcacttcatctgataaggaatttatgttcatgcaactgaattctcattagtcattttaggaatatatcttctgcagcatcaccaaaagcagtagtcatataaaaggcaagactgtgacaagatgccacagaaatatcactccacatcctcttctcatactataaaatctaattgccattcttagattgcttcacgccaatgttaagaataaacatgaatatgttgccatatccaacaagataccttgctcaattcaaaacaaaggcccaaagaaccaaataaagcatgtaaaaaagtataaaataagaaaagaatttaccattcagagacacagtcctcacagaaaatatgtttacagcggaggaggacaggaacatgcatcttttcctggcagatggcacacatatcaccagcagcaattacctgcaccaggttccagcaaaaaacaagttctttaaacaagatagagtgagagttcaagggggtatcctgctaccaagtaccaactagcgaatacgtgttaaatggacagttggctccacaaataagcctgatggctgaaagctgtatggtttatcgataaaatgatagtatcttattgtactattacaaaatcctacaaatgcttacgatttatcaatagttatggcatattgcatttttaagttgagcaacttgccagtagatgaacgtttacctgttctgctgtcgcataagacccataatgcacatctttacgtgacaatgctttcactgcagccaagaatgactgaacctggaacatacagtcaacaatgagaaaataagcatgcatggaatggaaaaaatatatattttataggttcacagcactaattttgtatgtgagctacagtaactagtaaaagtagtaccttttcaactactgaagttaacttgaaggtcaggtacagtccagtggttaaagatgagaaaagactcccatattccttgttcagaaagaaacggtaccaaacaggagttggcaacaaggcacgatataggagcagaaggtattccacaagggttagcatttgaccctagcaaaacagaaagtttgagcctcagaagtcagaaccaactactaagcttgcaactataaaaggatctaaaataagaaataagctagaattcaagataatgagacatgcacctttagaaccaaaataaaataacaaagataaagaaagtaacaatggaaaaactagtcacttcatgcaaaagaccctcataagttttttttccaaaataagttatatcctagtgttacttgcgaacacatggcacatgaagccaacagaactataggaatacatgatgtatacttgactatttggtagtgcatctactaaactatttttcaaactgtttcagaattatggagaaaaaactaccattcttagctaagtatttgggatatagaacccctttctagtggacacatttgaagatgtctaagcattgagctgctacacagactaattcagtagatcaaaacttaaggggataaaaataattgtatagtcatagacatgcagttattaaataaagatagcccagcatagaaatacaatatcattcagcattcagttattatgattagtttctagtcaatatatactcagtattggatatgtggaaataaagataattcagtgtgggagaaagggtgctgtcacaaaagcacccacatatactaagtgttggtacttttgaattttgatggctgcgatcacttcactagtttggctagatctctacaatctctaaccagcatagtaatcactgcattgattatcattagaagttaggtagaaccaacatctaaaggcaagatgctataaacatgatgataaaatcacaaaataaatttatgacaattagaaaaaaatgtcacctgcttacggtagttacgacctctgctattcttatagtacataagtagcatgcacttaatggccattgctgcctggcgaaccattgtatctgcaagtggcatttggttagaaatgccaactgcaacatgaaataaattgtgctaacagataacttaaaatgtttttccctgcaatcctagaaaacatacttctttaagtaaatgaagatagtgccatacagctaatatgaaccttttttggctaaaacaaatctatgttgcctgtgtaattttagcagtttgaaactatgaattgaacaccataaattttgtgccattcaggcattcaaaaatttctagcacatttaatgatctaagtgtacaaataaatttattaaatgattagttttcatcacacatttaactgaagagcatctttaaatttgctgggaattcgaaaggctaatacaaaccgagaaactaatgagttcaacacaaagccttgaattaaaaagcagcagaaagtgaagtaaaaaaaggtcattttgaatgatttttcatgatatgaaaaacgagacaaaattgctcattgtacatacatttacaaagggcaataaattttaatctagcaggtcaataaaggtacttctatgtatatggtcagagttcactatcagataatggagaaatgcatgcgagcaaattcaagaaaccctttaaggaagcatcagtaccattgaccatgatgataaaaatcgcatgccaaaatggcggtatttcttttggcggaagcatgaacagaggtctgagaagatcatcattcctgtaccaccaatagacaccaaacacatgaatcatgaagattactgtaatcccgacaagcacagcaatttttctctcgccctgcaaaaagagttggaaatatgaaaaatttgctattgacaagtattttagcaatttaacaagtagcttcaactagtttcacaacaaatatggtacataggttgacctaactgttactagagataggatgactaacctgctactagattaattaatggtaaatgtgatccaggaaaagctaagagtagataaaaatgttattctctttactactttccaaactgggtaataaagtgctgtgtagttcaggaaattcatcatttcacaatgatgtgatgttcactgcattagtacaatgcatgattatattgttatgtagtcattggcattcaaatttatgacaccagaaggaaaggtctggccagtagtcttctgattctgttatactaaaataatttcattgcaaaattggaaagtgatgcatcaagaaataagaccttcaaagcagtttgcttccgcaatatatcatttgacttgaacattacagcagcaatccaaattgtgacaaagaaacctgcacaacaacccttcctttagtgtgtattgaaatgcttacatggcaatcattgcacaagcaaaaatagatatgcaattgaaagatggatttatatgttaactcaatccattgacctttcttgacaggaaaaaaacaatttggttgtagtggcagaaatgatagagggcatgcactttgaaaagtaaaggatagtatgaatggataaggcaagatgaatataacatccaagattgtgaactgcaagtaattgaagcggtgcataattggatacaactagctgctggaatattaatgtatcatcattaggccttgccaaaaaaatggttggcacataaacacataaattatgagttgattggtgcggcctccaaaggaataaatgttaaaagctaagaacctgatatgatatatgcgtcttaatcatcatttcaagaccactaggagataatcatgtagcagaaaattcatgtcatggtaaacaactaaacgcagatatgtcatctgatccataacttaggagttaggactggtacccaaccacaatatcctccagataatgtagcacaaagagaagttccaacctaatataagaagccgggcttgagcaagtcctgtttaaagttagggcagctaactagcaataccaagctataaatatctccccattaggttcatctaataaagcaggctaaaacccactatatgagataagtcgactataatcaagtgatcatattatcctctaaaccataatgataaaaaaaataacaaacaaaatagtatcccaggaactcaaatggttaacatagatgttaagttaacacataataataatatagaccagcctaatcacaaacattaactcgcctaagtcaaggtgttttactcacaaaatcactttccttttttggttaaacatttgtaataaacaatatatggacatcaacatgaaggaaaatcgattttgttttggacaagtcacaccgcttataatcacacaatggcacgagcacaagagaatgagtattagaccttggagatgctgccgtatgaagacgacgagcagcagcagcgagaatggcagtatctgctcgatccacctcgcgacatggtgcacgtcataccgctggtaggcgcggtccccacccccgttcccggacgcgccgtccgcgcccccaccactcgcctccgcgtcggcgccgccacccctccccgcggcagccgaggccgggtcaacgtccccggcggcggtcgcctcgatcgagtcctcccccgacgaggccgcccccgcgacgcccgccgcgtcggcctccccggggccgccctggatccggatcgagacctccccgtccccagccgcggccgcggagagcagcccatcggcctccgacgacgacgacgaagaagacggcgaggacgacagcgccgagggcggccccgcctgcggggcgccggggccggaggggacgacgccggagtactcgagcagcgcagcgagcggggcctgcaggaggctggaggcggagaatctgaagccgtagcggcggaggcccgacggcgaggcggccccaccggcgcccgcgccggtcccggcaccccggcgatgatcggaggagcctcccgccggtggctccatcgccggcggcagcggcggcggcgaaaccctacaaggcggaggcggaggaggaggagacgaggcccctggaatggggagattcgagagatccccttgcttgggttggtttactttgcctgccttccttttggtttctttggcttttttttttcttgcttctctcgccccggtgccggtggtggcctcggcctgtatttctgttcttaattcttatgctagttttattttgatttagaccctctttgtttaggcttagggttattggtttagttttttaagtcagcttattggcttatatgatttataaggcagtgaatttaatatcctaagtttagtagtagagtcatacatctaactcatataagtcaaaaaagcttctccaacctagcttttggcttaatagtgtaaaagtggcttatggcttcaaaaaggccaaacgaaaacgctgcttatttgtttaggcttagactttttgacttataagttggcttataagcctaaacaaagaggaccttagtgatttagaattagtcttctggttatatacgtaaccgtaacacatatcactactaagacacatcacatgtgcatgtaacatcatgtacatgtaccgtatacggatatttataacctcttaacattttctaaggacgaagatcatcggtaaatcttcggcctcatgtttaacaagtaaaataaagataagtgacataatagctaggatattattaagcaattgcgctatttgcatgctaaatgccattggaaaaaaattcaaacattttcattagacgatatcctcagatcatgactaaagaaattttgaataattatacatttagattgaaatgtgcatttgatctctttttttaactagtatatgataccccctccctcctcatctttcacccttttctaatcatgatttgattattcagagcctatcctttttctcatcacacgtttaacaacaataaataccctactactctctccttccctaaaaaaccaacatagtactggatgtgacacagcctacgtatgtccaaattcgtattattaagatatgtcatattcagttctagattccttttttagagacgaatgaagtatgctagaagagtaaatctcaataaccaactcctaatacctctttagtcttgaatcctaattggtgttgtccccatcccttttttttctcctaaagttatttcacattatgtattattgagaaagtagaatggtattccctatatgcatctaataaagtgtacattaactagcatgaatataaggatattactgttatgaaaatatgacttaggcatccttgtgttttttaaaaaacaataaaaggtgatgatttatattggtatctgcatatgaatgagtatgatataatggagtgaataaatatacgaataaaaactctgtaatttgagtgttatgtttggaaaagaatggacaagaggcaaaattgtatattttttcaccatctatctatgattatattaagagagaatcccttatatgccactcgaaattggccagttcccttatataccacttaaaattggcttcttccttttatgccactggttcaagtttttccacccttttatgccactcccaccactattatgtttgttgactgttagtcaaatgttagttttttcttaaatgaccaatatgccctcccaactaaaaaaagtgtaaacttcaaaaattcataactaatttattttaaatcctttttgagtgaataaaattttgtcagaaccagtgaaaaatgctctttgtattaaaaatattgttgggaagctttatgtttcatgcttatattaaaaattcatttgttatggtgatggctaaaattgcacgtgataaaaaaaataataatcaatttttatatgttgtaccaacttctctatcaaatgaaaaatacctatcattggttgtataccaactctcaaaggcaaatacgtctttttactataaagttaacggtcaactgacggtggagtgacgacaatggcttaaaagggacgacaaacttaaaccggtggcatagaagggaggagccaatttgaagtggcatataaggaaccggttaatttggagtggtatataagggattctctcttatattaatgggtatgcggttgcacattgttttgtctaaacgacctatgatccaaaaataaatccttggtattgattcgcaaataaacaataaagttaaattactaaaacaatatatcacattctatattcatgcaaagtttaaattaacctaaacatttatgaggaaatttagggtataaaggatcaagtccttttgtctagcaataattgtttaattataaaatagttaagtagaagagggttcagggaatgtaatgaaagagtagcatctacttgaccgtgtctgatctctaggttgagatatagagggtagccctagcttggtatgctcaaatgggaaaattttgattaagatgctacagagatgaagataagacataatacattcataattgccttattcttacatgatatcctacttaagttgatggggggctatttgtataaccgtactaattaggaaaagaaaaaaaaacataagttgcatttggagccctaggaagactttgcctcagcttgcctgtcttgatcacctcgtctcgtaaagcgagcttggtgagaaacatacacactcctaataaaacgtctaccatgaatgtgaaatagcatcatagttgctagatgaataaaacgactgctcttttaaagccaatttatccatgcctttaagaaaaattccatgacctctcatcgatacaaattctgagtaggcatattacgccgttgtatggaacatcataaatcacatgaactttataggcataaaaattgtgagcgcttcaagtaggtttttcttgccttacatgcttgacatatctaccacgataaaagcgttcgcttgtatgggttccttgtcaattgtcaacataggtgataacaaagtgcaaacccttttcatataattttctaaaatgctctaggcttaatgaaatattttcctaatgccttcagaaatgaaaagcatcgcctaacattattctctaccattagttgattaagaccttgtcgagcgagcatgccaagatatatcctctcagttaacatgcaagccagagcatgacattactaacatgagagcagagacaatggatgaaaccaaatagagtgggcatgacaatggccaagatcttgaaaggtggtatgatgactagaatattgaaatatggtataatgaccaagagtggaggccgaacgaccttcttgatgaaatattgttatgaaccaaaagactcatttcttggtaaaagccgctctatttgtccgcaattagcaaggttacaaaagtgctcaggaagcaacatggggctaacatgtggctgccatgttttagcagcattagaacccttagatcttaaatcaacatttataatggtaaaaagaaaagttgtgtgtgaaagtccaaataatttcattaaagtctaggtcattgcatcaaaaccaatgcatatggctaaataattatagtatatgtcctaattttcacccagaggttatgggatatcatcctaaacttttatgatatttgtaccttttccttgttaaattctttgtgaaatttcctccattacgctaaacatcaccacattatgttgtgattgtcaaattgtttatttggatcggggtctattaaatactgtgacactgaaataagtctgctatggaaattcaatatactgctgcaacgattcacggtaacactttcatatgcctggtctattttacaattcacattactgtccatcactccatctcatgttctctgtcttcacatcaccataaaaattccaaactttgcttgtcctagtgcagtgtcctgggttctcccttaaaactggaatgaagtatcaagtactatgagttggagaaacttttggaattatgttgcttcagtacatggtccttcatgcaacttttggaggtacgaagaagctgttatttattataaacagtaaaacacgggatatgccataaacacggttgctagatttgagcttgaactagaagaaaagctgatcagttgctacggttaatgagtttaatctcctgcaaactaaatggtttttatccaccagaatgagttcagatgtacagtttgtccattttaccctaaagtagatatccatcaatcaataaagcagatcttacaataactttgccagtaatccagtatagtaccacctggcaccataaaaagttgagtaaaccagaacttgcacaccaccttttttttctttcaaggttggcaacaatccacggtttcaggacgaacaggtgaaaagacaaaaattaaaccggtatatattccatgcctatttccctttgatttgttcatacaagggaattcctcaacctgaacggtaataatttttccattcctgtatcatcattacactgatattacatgttctacaactgtaccagcaaagaaaagaaaggttatgtgactgcttctggagctgagttgcagtagggagtgtgcaagcaaatgaatctggtcgacatcaggcatacagaggcaaaggcgaaacctatcaaaagcccacagatgctcttccgcatgtccaaccttagcgagcgtttgaagactcggccaaagcttggaatcaaagcaccacaggcaatgaccatccagtagtctagtccactgtagtcaatcttcgcgaggattgcactgatggcagcgcttggccctgcaaagccggtcaaagcagcggctgccaaggctgcccgccaactatcagtggcaccatatatgcagctcgcaacagcagcacctcgtggtagaccatgaagggaaactggaagaaccatgtagcgccctagaccataagccttgcgcgcagccacaccaagttgaagaccttcagcatatgcgtgaaggaagacagaaccgcaagcaaggagcgattgcagtgtgaggacactaagtgagaggcctgaggatgatgtaattacattaacagaagatttcttgcggttaactagctgaaggatgtttgatgtggcgacatggtaaatgagagaacctccaattaggaggaataaggtggtaaatagacccatcttcgatgacattagaagttgtaaaggtctccatgctgcgagacggaaggctatgcctgatgctacaccagtcaaaagagggtgtggcatgctgaaagtaagagagaatgcaacaagtacaattcctccaaaaagaggacctagtccaaatacaagtgataccaaaaagcctgctgtatcttctgagctgcagatcagaagaaattaataacatcaatcagaaattcaaagtacccacatagtactccggaattgtatagaggaaacttacttgtggccatcagtaaatccctgaagcactgtacccaatgtttccatgaaagcaacagcaagcgttccggcagaagcaacttgagatggagcagcttcctgcatgaaaaggaaaagatgagcaaaactgcatttacaaatcaatggaacagaagattcagccattaacagatcttctaactaaatgattagagttcaccttaaaagcatcaggaagaacctcagcaattacaatccatatcatgcatccagcagcaaaaccagtacaaaagggaagcaccttttgaaatgcatcggcacaaaggaatgcagggacagcaacaattggctgtattaaccaagaaaaatgaacacatggtcagagtagtgtggaaggcaaaagaatgtcagcaccaaaatgtagcttgaaaccaagttggtatgctgttgcatacaagtagacaaacatttcgctcacaatgaaatactgacaggaagttgcactattggcaagtaaaaggaaaataatagtggcaatccccattaagggcttgttcggttgggccgttctcggccgggatcggagcccaatccccgtggaaaatcccggcgtggaaaggataccggcccacgcaagtataggcgttcggttaagcccaggcgagattttatcccggcccaccccggtgttttcccctcgtcataggccgggaaatattcagcttctctggtggcgaggaaaaaaatcctctcgacgcagcgacacaaagagagggggcgctgcagcggggacagctgcacagcgcagcgcgactccgacgcgacggcgacggcacgctctctcctccggcagttgactcctccggtggccaccttctccccggtgagttccttcacttcctatctcccctagcctcctcttctagtgttagggtttcttgcgcccgtggcctcgtgctactgcggcggcgcacgacggtggcaggcatggcgggggacgccgcagcatcacaccccctcaccatggcgccactgaagctctaagcgctatggcaaggagaagcaggaagacatggatctgttctttgttcctcacaaggtttcttgatttattcttctttctcccttgatttgttctgagtaatattcctaacttagtctgaagctctgatcatgtccttcctggatctgatcctctgtttgtagtgccctagtgagaatatgctgattctcctggtagttgagtagttgaaagaccacgttttctgattcttattgtgagttgttttaaatttgtacataaaggttatgaaaatggtttattctaaaaattagttggcaggtaatagtaatgccacaaaaacatgcagtgcgtaataatattgaggcatcagaagtgaatgctgttcatttttcagaaatactagacaactgttgttcatcagaagtgattccaacaagttgtctgctcttgtaatctcacccatacttgacagtgcccataatacaagtagatcaatgagccattccacatgccatattttctgaacaaagtacaaagttcaaattgaagtagtaagaaaaatgagtcatgtgcagctttagttcaggcctgtaaaaagctcttggcagtcggcagaatacaacttacttaaactgaactattttggtacatggttcaaatggtctaaaaattttcctaggttggtccatttttagtagatcttttttagaaccatctaatgaagaaattctggatgtaaaacatgatttttgcagctattgcttgcttaatctgcagactactgatttttgcttctactgtagctactattgaattcagttttttgcttgctcaatcttatatgtgtcctaatttcattttgatatctgaagcactgctagcagtagtctcatatgcatgtccatgtttctagcactgctagctattaggcaaagcacacaatacagcttacaaacaatcacttgtcaaactgaaaacttggtaaaaatgttgcccaggatcaatagttggctggtttcaggaaatttgagacaattgctcactgcacgaaagcattgcctaaattattgcattttacaactgaaaactgaaggaaacttctttcttctgtacaggctttgggaggaagtctgagaggatggtagttcagatacagagtgaatgagcagacatgtacaagatgatggctttttgcaggagcaacaaatgttgatctctgaaccattgtatattgctgatgtaaccatttggtctaggagtcctggtgtggcagctcacatttatttttatagctcaagtgaatcatgacatagtttcatctttttccttttttattgtcaaatttcacttctatgactgtatttagttgtctctgtattgtcaagtgacctcaagctttgttgggtgatgcctccttgccttaaaccggatacaggccttgatgatactgcaatatttttgttttaatgattaatcaatgtggttttcgcgtaattgatgaggttactgcaatatttttttactgaagtgtaatttcattcatgttgcacttttcacttatacaaaaatatcggtttgcaatatttttttgctattctaaactgccaacctgaaaatcaattttgctattctaaactcaatggacagcgtgcaacgttgaagcaggaaagcaccagtccttctgttgttgctgttgcctattgctgccttgacacgggatttaagcaggcgcaccaagccaaaaccgaacaaacgttttgaagacagggattaggaaaatcaagggaattcatcctacagggattaagtgacatgggagggatccactcaatccctccctggataggttccccttgggggtttaatcccaaggaaccgaacatagcctaagtgattatctatggctttgttattttccacaatatggtcgtgatatttcatttaacacttgagatcctttgtgatgcgccaatattatctctaattttgcttctttgtgatgttactgagctaaatttcctaaaatctacagaagtatgcataacgagctagtgataagtttgatggcttctcacaagtttacaacctcccattttcaattagatgacactttagaatgcgtgcaatcaaatctcaaactcttaattcaatgatatatgcaaaaacattaagatttaatatgttaaaatgacattaatagatttgtcacaaaaaagtactttcatgtagttatttttaaaataattctcatgcatatatgatttgaaaaggcaacaatcagacatgtgtattggagaagtgttgatgccctgaactgcaactgaaaaagaatggaaggagcggtagagaggcattcagcaaaagtttctaagtcttaaatgctgattttactcgaacaaatgttaggaccttggagatggccatgttttcttatttatcaggttagggcgtttaagtcctagcatgtccagcttcacagatggccaccaaacataaatgaggaactaccagatatgcaagcaagataggaaattgtgaagagtatgccaccacaaagaatgctcccttcccttgctaccattattataattgcactaataagtaacgatcatagcaatggaagaattccaatttaaaaaatcagtggacaaagatcatcatatattattcataaaagtaactccatttcacaaatgcgcatgcatgcaccaatgtgctatgctgcacaaaagaaacatgagtaaattacattggtggtacacgaacttgtcaggtgggtgcaaactaatgcataaacttgtacaatgtttgtgttggtgcatgaacttgtctggtgcgtgcaaaccaaggccaaaaggacaccataaggctaatctcatcgatttaagtggtgattaggatgcgatgtaaacatgcaagtgagaagacgcaatatagacatatatatgttcaataaaaggtaaaataaggcatgattgttgttagagaaagacataaaaaacctgagtaatgatgcaagggtgtaaacaaaaagaaggttaatgtaggaaccgagtttataaatatagcatatctcatacccatctcatatgtgcatatcacgtcctaatcaacgtccaacttggtaaaattagccttgctatgttattttggccttggttcacaaccaccaggcaagtccgtacaccaaaacgagcattttacaagtttatgcactagattgcactcacctaacaaattcgtgtaccgccaatgcaatttactgaaagaatagcacatgtacacacagacacaaaagtgaaatagtatagtaactaaatttatagaaaaggaaattcagattgtagcccctttgcaaaaggaaaaaaactgatttcactttttctggctacaaaacatgaaccactataagtctataactaaaaaatagagaactcttcatgttgactcaagaacaaggacatttatcaggtaactcatatttcagttcaaggatagagcaagtgcacctgtggtaaagatgttatgatactccatatcattgccttttgtggggatacacccctggatgatagcaacatgcttacagctaagccttcaggtatgttgtgtacagcaatggctatagtaactaaaagaccttgagagaatccttttgagccagcaaaggaaacacccacaccagagccctccccaaaagaatggagtgtcattattccgacaacaagaataacttt

SEQ ID NO: 1609 - DNA, 1036 bp, Oryza sativa
  unsure (1)..(1036): unsure at all n locations
tcaatttattagaatctgattcttggattcaggagtcaggaataagtaggttaaatgacaacgaaattatgagtatgccaacatatattaggacagaggaaaacccttttgaatgccagtgttctaacatagaagctaccacgaaccacaacaatatgtgtataagtgaattgcaatcttaattatgttaatgtattgatatgtacattgtacatgccatttaaatgaacatatgaactgaatgggtctttatgacatccatgactagctccgtcaagtttaaatacatttgtacatgatttgatatttgtagattagtgaaaatgctaatgtactaaatagtactccataagtgatatcacagaaaactgaagagaatgaaacaggaagtaccttcttgcaaagccagatgaaaaaccctccgctcaaaatcccaaacacaacccagctcccactgccatacatttgcccttcctgcacaagatcaaagctcgccgctaacatcacccctgccgcgagtccattgcaaagtcccgcccactgggcctctagctccaggaaaaagaatggcagagcacccaaaccggtggcagcggccattgcaagcgtcgaccacgcgaccgtagacaccggcaccttcccgctcttgaacccatcctgcccgcctgcgccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1610 - DNA, 765 bp, Oryza sativa
cgagcaacgaaagctctaataccacctaatgaaccctgagttccactcgacactcaaggctgttgctggcctgatcttttggtgagttgtagataactacgatttgggagaaacgttgatgatccgactacaccgtacaagacattgcgttgcaccttagtgatcgatacacctcttcgtgggttgttgatcttgccggtgcagatcaaccctattcttgcaaacaaatcacagaaacaagcaagaacaacataaaagcaatctgatattgcaaatagaaattgaatacaaatgataagttggggtttcgaatacaagtagaacgacggtctagcaggacacgcgcgctgcaaggaagtagcaatggctaaacttttatctaaacaaaacccaagaaaccctgaaggggtatctacctatttataggggtgggaggacgaccaaggggtgccaagggttgttctccacctggttggggcgcactccacatgagccccactagggccggggtcctaaacaaagttacaagcctataggcccaagacaggtgacgcagcaccttgtttatgtgattgtggccaaacatcatggaatttggcaatgaggctggatccgttggaaagagggctccgagagctttccatcaagtactcacgggccaaaatcggaggtcatatgcaaattcggcagccatttgaagtcagcagtgtagcaggtggccgaatcggattccagcacttggaagacttgatcttgatatcttct

SEQ ID NO: 1611 - DNA, 648 bp, Oryza sativa
cgaaaactacaacactccccttcttgcaaaccaatttataactcatttaaacaactagagggactagatagagaattacttatacgcatgcggtcctctagaccacatttcatcatgaaaaggaagtatagtcaaatttgaacaaatatatacttgatgcacattatattgtcatttactatcataattgtcaataatatgaaaaatcacatcagaagggcatggcaattcaaatctagcaaataatttcttctctaaatagttgagtggataaagatcatcaaattgaatatgaccccaagtatttaaagaagatagcaatttaagctcttcattttcgctagcaatgtgaatacatgttaaactcaacacatagtggttctactataaaattaacatgttcattcactagttgtggcatggatataagtgaagcatcgcacaaatcttctttatcactagaaacatcaggcaaaattgttttgtgacaaaagtatttcaacaattgcttccactatgggttgctctaacgtagcataagtagtggacatagttggcacatcataactatgcataccttgagtagtgcagcaccattatcattacctttttcttaagacatgactagatagctactgggaggtggtt

SEQ ID NO: 1612 - DNA, 389 bp, Oryza sativa
ccctaagagagatttgtaactgctggaccttaggaggcgacgtcttcatggcgctgagaaggaccttgcagcttgagaggtcgtgattctttgtcttgtgaataggacaatagacatcacgggttgaagaagtacgctgaatcccacgctctttgcaggcacgaatctcagcttgtacgttgagaaaaacccagcaagcttgcaaggtgtgtttcctggttttgtggataggacactaggaccctgtcacctcggaagttgtccttgtcggctcgtgattcttgtcggaaggacaagattttggccgcactaggatccttctcgggcttggatgttgtcgacgttccgttctctacttcagcgggaggatccttcgacatggagtcgtc

SEQ ID NO: 1613 - DNA, 257 bp, Oryza sativa
agaggcgatgcatgtggtatccccttgaactataaaaggaggaccttgcccaccgagaaaagggacgactctcagtaagcctaaactctagaataagaagagcgagagccctctccggagtttaggggcccttgtagcactcaaccataatcccacacacaggagtagggtgttacgctccatagcgggccaaacctgtataatcttggtgcccgcacgcgaattaatagcattcaaggcggatacgtgatttctaa

SEQ ID NO: 1614 - DNA, 502 bp, Oryza sativa
caaaaacccaaaatcaccaaaatttcagtaattttggattttttttggctgaatttttttaacttttaacatattttgacagaatttaaacaaattttaaccaaatttacaaatgtttggcaaacaccgaaaatttcaggaagattttgaccttgctgttgggggccgaaatttcgaaaattccaaaccatggcgctctatcgccgttaagccgcggctcgacgtgtagtaaaccggcgactgctgggacatcagtgagaagagcttggagaattgaacgagctggtgctgacgcgcgtccgctacgggaacatcgtcaagctccaagtacggcttctgcgccatgagcgggtacatgtacctggtgtacgagctcggcagctcgccgagagaggcattgttagcgaaagtagccattgtactgtagcgaaacctgcaaactgaacgagctaggacgcgagagagaagaacgaacacgacgaagtactccacaacgctgatc

SEQ ID NO: 1615 - DNA, 703 bp, Oryza sativa
tgcagccctaactaatctcttctttgatttgtagacaacagaatcctcccctcctcgtcaaagcaacagtggcagggacatcacctacaccccaggcttaattcctaatggaggtgggccatctcctcctgtcatcggctatgatgcccccaagacttcagctcttcttcaagagctcatcagagaaccagccgatgccggcaagaaaaggaaaaccagatcatcagctgtagatacttcagccctggctccaaagaagaagatcaaaaagaaagcttaaccagctgatgatctgcctgccctagatccatccattgaacaagctctggataaagaagaaatcggagaagatgttgatcaagccgcagccgaagtaagcgatactgaaagaacaccatccgcttcacctaagcagacccctccaactccttttggtccaactccttttaccagagtaagccaccttctctaaccacttttgtaatcatcttactttatagccgattgctcacatacctggtaattgcacaaaaggaaggctgctgtgaagaagaaatcggctccaatggcatctaaaccagctccaccggtacaatagccttaattctttcattagttaatctcagccgattttatataacacttgtctattttcagcctccttcctctccttctcctcccattcaacaatcatcaagcgatc

SEQ ID NO: 1616 - DNA, 731 bp, Oryza sativa
aaacaattctatttgtggtgctgggtccacatgcaagaatacagaaggtagctatcgttgtgactgcaatttcggccaaagacgtgacaatagttctgataacatgggtaattgtgaacccatattttccagagctgccatagcagtcataggtgaggttcaatacatgaatgcaatgttgattgaaatttgcagcatgccatacattccacatataatatataatgctctaattacatgcagttctgcattccatgtatacaccatatttgcattgcactacattcaacttgaagctcaacattgaagtgtgaaaacataattatttccagatagaccatggctgtgcctaaatgttatcttttcgcatgagcatagaccatgtggttgtgcctaaattatcttttcacgtgagcaatatatatggactacgcaattgcatgaatatgtataagttacctttgcagtattgcatgttctatatattaactattttgtttcctatttgtccacagcaacagtttttatcatcgcacttctagtcgtgttactaatgttcattctattggagcgtaagaaaagaaagctgagagcttatttcaaccgaaatggtggacaattgctgaaaagtatcaagatagatatttacacaaaggagaaacttgaccaaattactaaaaattacagtactattattggaaagggtgggtttggtaaggtgtacatgggaa

SEQ ID NO: 1617 - DNA, 703 bp, Oryza sativa
ccaattccacgcggtaggagtccgatctcttcaatccaaggctataaataggaccccctagtcgtcctctttcgtttgcccccttccccgagttctctcgtgctccgtagcctcgccgccgccgccggccaaccgccagccgcgccgcgccgccgcatccgccgtcgccgtcgccctccgtcgccgccattaggtgcgcacgggagtgaggaagcccggccgccacttccccgtcgtcgccgtgcgccgtagcccgccgccgccgtaagtccgagccgccgccgccgcgcctcttgtcgccggccgtcgtcggtcgccgtttgtcgcttcggtaagcaccattgggttcgcgtcgtcgtcctgtacgtgtaggtgtcctccaaaaccccggccgaccaccctagcgccggcgaggtcgttgcccgtgccgtggctgccgtcgatgacgtcatcatgacgtcataatcccctctttttcagttttttttaatagattaaatatattaaaacttcggaaaatcataactaattaaccatagctccgattcaagtggttcaagttgctaaatttttctaaaatcgagatctacatgttaaaaatatccacatgtactggttatgcttgtttttgtactgttttgttgaattttgtttggttgctttagtttctgatgttccggaggagagcgtttcagttgaggaa

SEQ ID NO: 1618 - DNA, 945 bp, Oryza sativa
cggtggaccaagtccacgcgcgcaccgggacggcaccgtggacccggaccacggtggttcacaggcggctacacacggtggcagaggggcggcgacggctcacggccgggcgcggccaccggcgacatgacacggcacggcggcgagcatgggaggtggccgccgaagaggagaaaggggagatggaggggagtgctcaccatgcgccggggcggcgaggggcaacgggcagtggaggcgctccctcgggaagggcggtggcggaggtccgatggcgacccgcgagcacgaagcggcggacggcagccgggattccctggggaagaagatagaagggttagggaggaacataggcgaccggagcggtgagaataccacgccggagaggagaggaatggtggagctcaccggcgaccgagagataccgagcttcggcgggatttcggcggcttggagtggcagccgaggtgcattgggacgtggcgaacgtggtggaggcagtggcgtagcttgcggtggacagggatggcggcagtaggcggccggaggcagcaaaagcgacggcggcctcgggtgtgcggtggggctagtttttcggtggtggttgaaggaagaggagcggttgccggggtggagctcggcatggcgatgccgacggcggcggcggcgcagcgcagcggccgctagggcggaggtggtggccggctgaaggcgatgaacggggcggccggtagggtgatgttggggggagggggttccggcaatggattgagggctcgaaggggaggccggggcgcggcatcgtgcggcaaggtgggcggtggtggcgacgcagtgcggcggtggcgggagcggccgtggcgtgtggctggagatcgccggcgagcggcggcgcataggtttcacggggaggagggggttccgggcatggggcgcttcggggag

SEQ ID NO: 1619 - DNA, 726 bp, Oryza sativa
actttttatttatcacggcgaacttggcaactgacgcggggctgcatgggtcttcgatctccggcgaaggggtaagtccaatgttctgctggcccaggcaattgtactggctacaatagtgtcgttcaaggctgcatcagtacattcgacctctaggattgctctggtttggttgatatatttgcttgcctatttatcatatgtctttgttaatctagtcttagaatctcaatttagctctatcggttgtctctcgctttagggtttctgctgatatcgactaaattgttttactggattagattagctaaggcatctaccaccctaaaaatcagtcaagggcttgatctactaagttgtctagatattatgtttcttttcatacttagtgttgcatcaattaggtttgatctactaagtcgagcttagaaccataatctctagcctgctaattgattgccaataagggtttcatcggggtttcagccgatgagttatctagacgttgcatcagcttataaggattacatacaagttggatttagccgatcgcaacaaagatttcactgtttaatctaatcttgtggattttatgacattgggactccagctgatgtattctttaacattcggatcagtgcttattctatcatatcattggtagctaattgacttctactagattatattattactatattatcatcagctgatcgcctttatacg

SEQ ID NO: 1620 - DNA, 720 bp, Oryza sativa
cttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccatgcctgcggttatgggcgatcaaccagattcaccgtgattagtctcacacttaataaatcgacccaatgcactgtagttcaggtgggttggttgggcctgttcaacgtggtgtagcgttgatcagtggagatttaatattaccttaattactcaactgttttactgttttgcttaataagatgttttacaactgcctttatgcaaatagccacaaaccgtccttgtatccccttgcacgtctgcatcatcggtgtggcttgctgagtacggtggttgtactcagccttgctattattccccttttcagaagtgtagtgcttctgagctgaagacgaagttagaggaccaaggctcagaccccagttgagttttgcctgtggagtggagctgaagccccgctaggatcgcctttttccgctgctgtcgttctctttcggtgtgaggactaagtgcctcttatataagtattttacgctttatttacgtttggaactgtatattacttgtcgttttgtgtaccctggctggtcctggacagggatttaa

SEQ ID NO: 1621 - DNA, 1398 bp, Oryza sativa
taattactatacaaaaaataggtctaatttcatcatatacatgatgaggatgggtggctacattgcgcgtatggattgcacttatctaatactacctctgtacaggttgtttagcaaaatttaaggtttacgaagaataaacataatgccctttattcaataatgtacggatggaagtgagaaggtagttgggggtaggatggagaaaattttgaattggaaattgttgtcgggaagacaaccatgccacgtcgaaaggcgtggcactcttagaggattggatgtgtagtaaagacaatatattaattggtaaaaacttttgggatccctcattacatggtcctagatggctatttatagtctcagtacaggctcaaatcctctagggtttaatatatatacagaggaatttatatggatacctttatgataggggcattagtaagggcatatagtgtctaccctagctatgggcccctatatgggcttcttgggccagcccgctaatggtgaatagccttcctggatcgttccgtcctttgggcttcctggcgaagatgattcctcttcgggcgaatctttcctgcttcgccccatggcttcacccaaagtgaagatccaacgatgagtcccataggctcggtggtgaaccctctagacgctgtccttcgacttcgcctaggtgtttcgcccgagtgctaacccattgggcttcaactggcgcctcgcgggtgtggggttctttgtggtttcggcaggttcggtcgaaagcccttgtgacatgcctccaaatgattgatgttacaaaaggtgctctaaagtgacaagtattttgtaacaaaatttaaaccctaaagcgacagacagagggagtagcttgtggtgactcgggttagagcatccccagcacctcctgtatcacatgctccatcctgaaaatagcgcatgaggagagaaaagggggctccaacagatacgccatagggggctccaaatttggcgtttctctctcctcatgccatccagcaactgcccgtctctggataaactcacgccaccatccggatcgcgtcgctccatgggtgccgtgcaagggtagaggtgaaggcatggaggtagagaggagagacctactggatctggcggtggaggttcggagtagaggcagaggcccgcccgccgccgcctgtcgttcctccgccgcgacaccgcggcccgtgcccgtgaccccgccgcccgcgcctcgtctgtccacccgccaccgcctctgcccggcgaccccgccgcccacgcctcgcccgtccgcccaccgctacctgcacctcgcccatctgcccgccgccgcttgcctccatctgctccccttgcctgccgccgcctgcctccatccgctcccct

SEQ ID NO: 1622 - DNA, 1265 bp, Oryza sativa
ctaaccgtctttatctgtgtttaacaagaagcgcatgcgtgtatatatgcagcgctgctgcaggagcaggcagatcctcaataaggagagagaacaattatgaagagaaagcacaacaggagaggggattatataactgcttgcactgtttgattttattttctgccgttactaattcataatacggattgcttggttcaagtggccacacggtatatttgcgtacacaaatttgaccgataacatgatcttgcttcttgcagccaaaataacagtgatggaaatagaaaagctgctctttgaacatcatgtgccggtaattacaaatatatcattatttttcgtacgtatatattaaatagatctgcagaggtaaccaatcagcaagacaatggcatctgcatcagattcaactgaaagctaattactttgctacttgcaaattactttccagtaaacaatggtacatgcaaatgtttatctttgagttacatattattgtttttagccaagctaattactttgctatgtttcttagagcaaaagtttaatgactataattgttatagctatctttatcatgcatatcatgcagattcatttaaggttagttcttttttttcccacaccttttacgatgtactgctccttttgtatcattccaaaagattggctacgcttcaaccattttgcttggttatttcattactaattttatttgccagacaagatgcaatttaatcgttggaccgacatatatatatggttcacgttcaattttcaagatattattaaatttaactaatctatgttatggggcaatttttaactatgaggatcttatatccattgtgtcatccacaggtaattacgattttacttttcatcaatctttgcccgcagattactcagagacaaagccaataacctactcttcacaacgctggagtacggcatgatggaggccacatcgacctccttcgtcttgcacatgaagatcagcagcgtgccggcgtgtgcatacactgcttaactgacgacgtcaattggatacacacaacctcagactctgtaggttcagactattttctccatccagattttgagttgatctttttttttcatcttggttgttttatttacatgtttctcatctgaaatgagatcagaactcaaccacaccatcataacgtctgatactataaaatttaggtattgatccacaaaatagaacaactttgttgcacatatgatgcaaatataaa

SEQ ID NO: 1623 - DNA, 620 bp, Oryza sativa
tgcttttgctgtttaattgatttagatcctcgatttacactgtgaacttgaattgcagcgctagaagcactatggatagttaaaatccatgactcaaatagttaaaatcttctgactcaaatatctgtttccccaaaatccatgactgtgttgatctatactgtctaatggtagtacaaaataactattcagtttaatttttctatatctgattacttcctaaacggctcggaaaagggctcggaagttctactagagaatatatgcgtgcatgatattggtgttttgtgcttcaacttgataagctaaaatcagccgcagtaccctggtcaagtttttcattgtttgcatattgtcgtccaggaagatgaggtggagaagcgtccagttacaggaattctaaccatcgaaagtgggctgacttcgatctcgaagattgttatggagatgaaatacctgtatgagaaacataagcagtgggattggaaggttaaacaggtggagcagaagaaatatttggtggaatttccatccaaagatgctaggagggagttaacaagactcaagggctttgactttgaattatccaatgctagagctaatgttagggagactgagag

SEQ ID NO: 1624 - DNA, 501 bp, Oryza sativa
cgcgtgacatgaatcggatactgatgacataccatagtttttacaaaaacatcttcaatttttaaatcgagggagagggcgatgcagtcttaatcggacatgcggcagtgaaaaatcacgcgcgcgaggctgttgtgggcccagttgcggcagcgtgcaaaggcgcgtgtggataatggacactgccatcgacgtcgacatcgacaccacctgagtactgtagcttactgccatcgacggtcgttacaccatcgttgtcatccccaacgcccctgacctcattgacatcctcgccaccaacgacgtcgacatctccgtcgtcgagggtgacgccgccggcctgggcgaattcctcgccttcgtaggcaacctcctcttccccttccttgccttcgctagcctcttcttcatcttccgccgcgcccagggtgatcctgacaccagccctggtagcctcggttggcgcttggacttcgaccgctccaagagcaagttcgagca

SEQ ID NO: 1625 - DNA, 442 bp, Oryza sativa
aacattatttggaaagaaaaataaatctaaaattatgttggtggtccctgccattcttccgcagccaagctcaggtgggccccacccggaagcacatagaggaaggacaccagaaccatgcagagaggaaggcgccaccagaagccacatcgcacgcgccgcacatgccgcgatcgccgcccgaaagtgcggcttgcgtggcccgcctagatcccacgccggtggcgccgcactcgattctccccgccgttgagcagcgcgtagcgtaatcgctgtcgatgctcgaggaagctgcttgaagatgcctcgctgccgtcgtggtcgtagaagggaacggtcatgacgcgacaagatagtctcccttggctgcgacggggttgatggtgccccaggaagtgccggcccaactgttgttaggcagggcagcactgccgcagccttg

SEQ ID NO: 1626 - DNA, 1261 bp, Oryza sativa
catcaatcccatattgttgaaatttcaggtctgaaatatgaaaagaaagaaggtcctgctattgatttgaagtgtttattttgaaacagttgccgcaaagaaaaagactcaaaatgaaactcgggatcaggccaatctggatccttcttccaatgatatgttgaacaagcatcggaaagttgtcctctacattgtaagatttcttatcatttgtcatattctatcttctatatatttcatatgttaccactgttgaacagttgtcaataacaatgtcagatttatgatcaattctatgaatatctgaaatcatgctcaattttatgttatatctgctatataatacttcctccgtttcacaatgcaagtcattctagcatttcccacattcatattaatgttaatgtatctagatagatatatatgtctagattcattaacatcaatatgaatatggaaaatgctagaatgacttacattgtgaaacggatggagtatataattagtggtttacaacgatgtgattattatacatgtcgaatattagtcttttgctataaaaagttttttccacccttcacattttgaatacacaacttttaaatcctgggtctgcctctgctcagaccgctcgactagaccatacaaccactcaacccgttggctacccacgcaggccaagccccaatgcagcctcgagagcgcctttcccgccaactcggagagctccacgcccacttcctccgccgcggccaccccttcccgccggcggctcaccccgaccctgacctcgaccgcgcctacatctccgtaatccgcgcggccgccgcgccgcgtctcgcactcgcggccttcgcttgcctccgccgcgtgggcctgcccgcgccaggacgccgcgcgctcccatccctgctccgtgccatcgcgttcgcgcgctcccttggcaccgcaggggccgcgcacggtctcgcgtttagggtcggggcagaggtcgatggcttcgtcgggaccgcgctggtccgggcctacgcggcgtgcgggcgtgtggaggacgcacgcagggtgttcgatgggatgcctgaccgggacctcgtcgcctggggcgtcatgcttgactggtaacgcactgtgaacagctccatttcttcacgcaatcctatggaatcctagttgtttgatctatctcgtaagtatcatgttctgtgtatgcctggctgcctgcaaaatggtttattcagttgcttgtgcttagttgagagtt

SEQ ID NO: 1627 - DNA, 606 bp, Oryza sativa
  unsure (1)..(606): unsure at all n locations
ctccactatcgcaaacacttgctccttatctttttaatttcctcctaccattccacctctttccccctctcccttatcctcttcttcacttgctctcatcttctcctctcaaatattgcagcagctaggagcgagcgtggcgggggggggggggggggaggggcnnangcngtggcccggatgagggcagcggcggctcaacgcggtggtgggctgctggcgcggcgcggggcgaaggcgctggcccgcagcggctgtctgcggcggcagtagcctggcgcggcgcgggggcggaggaggcggcctacgtgggggcagcggcggcccggcgcggggcggagccgacggcccgctcgggggcagcggcagccgtgtgtggcggcagcctgatgcggcgcgggggcggaggcggcgacccgcgtggggataatttttaaatgtgatatggtttttttggatgatttaggagttcaatttttggatgaatttgtgatgttggatctgggatttgtgatatgtgaatgttggatttgtgaatattagaaaaaaaactcgatctgtgatttttggtatgtgaatgttggcaaaaaacgacgaaaaaaatat

SEQ ID NO: 1628 - DNA, 690 bp, Oryza sativa
ttgatgatgtcatcatgtcatcatcggttttttcctttttcccgtttttctaatagattaaatcttctgaaaatcataactaaataaccgtagatccgtttcaggtggttcaagttgctaaatttttctaaaatcaagatctacatgttaaaaatatccacatgtactgtttatgcttgtttttgtactgttttgttgaattttgttttttcgctttagtttccgacgttctggaggagagcgttttcgttgaggaaggttcggaagtgtttgcggaagctcaaggcaagtcacacagatcccaaacaaccctttgagcatgttgaacccatttaaagctaatgttttatttcaacttatgcattattttcgaatgtcatcgggtggtgaacctttcccaattaaataatggccgaagatgactttattttcctatgggttataatttgattagcatgaaccttatatattggattggttcagctaaatgttatatgtattttgcttagccatgcttagaaacataagctaactaaaggggttaaatataaattatattattattattattaattatgggtatatttaatggtcgcacacgatgggaaattgtgtggtgttaattaattgatattaaaacctggttaaggtgggttgtgagcatatgggtttgatggttgtgctcctggc

SEQ ID NO: 1629 - DNA, 4454 bp, Oryza sativa
ttgtggaaacttccattttggtcaccatttatcttctttttgatctcttataagtagtttgtggctatgcactgatggtttacaactatatgcagctaaagtgtggggttgatcttgctgaagtttggaaaatggaagataatggtatcaactcaactccaagtgcaggtaacttaattttgaatgcaactgatcatagagaactatattaggcaaatatattgctctagatatccagaggacaatccattgctcaaacagcgcccagcctagctgcaatggcccagatatttggtgccctcttatgttattagacagaacggaaactctatagattatgctgatatttggatcatactagtcaaaaccatctgcgatttgttccatacagaccatttattttgaaaaatgtaagtgatgttttggtagtttttgtaacatgtggagtctagctcccctgtcatgcccatggcttcattgctatagatatactgctgctaatcatgttgtctgtaattttgcacaattaaaaccatagaggactgacaacaatttggatctcagatttacttctgttgttgctttatgtattgctttgctgctataattgtgcataattgagttccatatgtctcatgcagaagtttcccctgctaccggtggtgtaacagtgcttgggatccagcaagctccagaagaggatgctcctccagggtttccatattatgttgatttggctgacaatgatttgcagagggctgttgaaaatcttccagcttacattaccgaggatcaacacacactgtctgtcaggttcgaagattcgatagatcatgctcttaaagaactgaagagatctcaggaagcagagtacaagctggcagagcagaagctttattcccagaaggatcatgtcctgagtctttatcgtcagcttgattctgaaagatccgtccttgcagaccctatgcccttagctgatgatgatggttcactatatagtacactaatcaccaatgttatgaagcgtgtggatcaagtgaagagtgaagaggagaagctcaaggtcatgctgggaatcgctgatggatttgggaaaacgccatcaggagtcattcaggagcatttcgggctacctgctgatactgccaactgagagtgcctgctttgttgtactgtcgtatgagtttgttaccaacccatctggtttggactaaaccagtaataccgtgaaactcgcggtaatccgtggacatgcctttaggaaccttcgctctccctaataccagttttaccgtttagcagtaccagttttaccgtacttaaagtgatcgttctactgtcagcgtcgtttatccttgtgttcttctgtcgtgtaagtaaatttacattacaggttgcttctgctgcagctgctgtgatcccagagcaatgttggagaggtaagcatttacagattttgactagaatgagcagcagcgcagcacggaggcaattttcctttcagtaattactgcttgtcagttgtaagattaggcgatattcctgttggaatcgcaatactgaagaattcatggagctgaaggaaccccggcgattgatgaaatctgcggtggctgagtaatctgatgaaatagtagatcagctggtgacatcaggtctcgctcgaagcagcagcctgcagcctgaggattgatttgttggttgcggctattaatatactccctccgtaccataatataagggtttttaagtttttgcttgcactgtttgaccacttgtcttattaaaaaaattattcaaatataaaaaacgaaaagttgtacttaaagtactttggataataaagtaagtcaaaaaaaataaataataattctaaattttttttaaataagacgagcggtcaaacagtgtaagtaaaaacttaaaatcacttatattatgggacggagggagtatcacttgatttaggactcctggtcatctggaatctcgatgctgtcagacgaatcttcagcatcatcgtgctgagtcattggctcattgcacctgactccattgttgcgctcgttgagttcagctccatatttgttctctcctgaattgtttcaaggaattgtgaatggattttccccacctttgccagccctcttctcaaacgtgttaaggttggaaaatgtgatagatgtagagatggatgtttgagcagacggcacagtttcattcatgtttcatgaccgaaatttagagttccccaaaccaatcttttttgttcttggttgaaattcgttgaatttatttctcttgaaattcacgaaatctaccatctcgctaaggctgacattttaacaccaaaacaaaggaaccctgggcatgagacgaatgatgggtctgggcgtctggccacacagaggggaggatgaagaacagtactatgtttatgtggcaaggattcgagtttgaaccgtacgtattttctcagaatacactaccaatcgagtttgataacactactgtacgtatgtaccatcgatcaactccctccgtcccaaaataaacataaccatgagttttcgtgttcaactttaatcattcgtctattttttaaaaaaaaataagtcacatataaaatattattcatgtttgataatataataacaataaaatattaattataattttttttaataagacggaaaatcaaagttggacacagaaactcatctctgcgtttattttggaatggagggagtaataatcaagatatgatcttgataatcagaataattcggcagttcttaccccgttcatctgactaaacatcacatcaatacaaccaaaagaacggatacacagtgtgttccaccatcaatctcacaggagatgagacgaacaaagcaaaagctaataaaaaccatcctaaacaccacccttcttcaagccagagtctttgaagtcaggtcgggttcgcctgaatcccgccggcgccgccgtggaaccgtcgcctggccagcctctggcgagcccgcctcgccaccgccgagcacctggacgccaccagctccgccgcggcggggatcagccgcgtcccctcgaacaccacgctcctctggtactccaccacccacgtctcggcctccagcctcaccgccggcgagctccgcccaccgtagctccacgagctgccgttgctcgccctcaccgtcggccacaccctcccgtcggaccactgcaaaaatggcaacaacgacgcggggctcagctagctagctgcaaatgcaagattggttttctgggagtttgtatcggttatgccctgtttacatctcgtcctaaaatttttcaccatatcacaattcacatcgaatttttcaccatatcacaattcatatcaattcatatcgaatgtttgaatatatgtattaagtattaaatatatgctaaaaaaaactaatagcacagattgtgactattttgcgagacgaatcttttaagcctaattgctccatgattgataatgtggtgctacagtaaacatttgctaataacgaattagttaggcttaataaattcgtctcgtggtttactgatggatttttttttagagaagggtattttctacccggcctccatatctaaccggatatatacggccattgagatagggaagttagccccgcaaacaatccaatctgaaattcactccatagaagatttaaactcaggacttttgggtactactcaggtcactgtaaccactatattacatgtcatttcgtaattagtttttttaattagtttttcgtaattacttatggattctgtaattagtatttttattagtaccgaacacctcatgcagtatcctatataatatctgatatgacacgctaaaactttagatcctagtaacacccccttagtttacctcggtgatcttgccggagaggatggtgaggtgccgtgccgggagcgcgcgggggaggaggccggaggtgcggagtgggctcccccacacggtcacctcctccgccgccgacttgtacacggcgcagcgccagtagaacacgcgctgatcattctgcgcgagatcgagatggaaatctctttaacccaaatcaagaattcaacattctcgcaggaaccaaaaagggaaaaaatgttaatacctgctcgaattgccagacggaatcgtgcgagctgcagttggagatccccttctcgccgccgacgagctgcccgagcatccgctccagggcgcggagcttgtggctcaagccgcccggcgcgaggcgcgcctccgtggccagccgtgccacggtctccggcgagagcttggggccgaagcccctcgccgcgatctccgggacgaggcccggagtccacccagaggaggaggaggaacccaagaaccgtggccgtgtagagggcccagtcatgcgatcccccggggg

SEQ ID NO: 1630 - DNA, 789 bp, Oryza sativa
aggtccctggtggcgttgatgctggcgaggcacatctcgcacgcgcagttggcgtccttgcggcatcccgggtagtagcaccctcctcctcccgcaaccccatcccacggcacgactatggtgggcggcggggtccgcgccgccgccgccgacacgctggggttggagttcgaggagcaggaggacgcggtggtggaacagcgcgtgccggtggtcggtggcgtggtgacggcgctcggcgctctcctcgccgccatctccctctcgtccatggcttggctggatggtttctcggagctgtgagttaatgcgagccggcggcttggagaagaagaagaagaagagacgagttgaaaaattttgaaatcgcgtggtggcacaacggcgagcaacggtcgactcctggtcgtggggtgggagatctggtgattgcagtgtggctgacgtgtggggcccacggatgatccgtgggggctttctgactttggagttcggctttccggtaaatgaacctacagtactgaagtgttaatgggccacaccagacaccagtttaggcccccgttcgtttctacacggaataagttcatctaagatctcttaatttatcaacgaatccgattttcgtcattcaaccggaaaaccagatacaacgggtccctcaactatcaaaaccagtgcagatgagctccctcggtggttttgagggtagttttggctgacgtggcgctacgtagcaaatttgacttggtcttcatctgatgtggcattgacgtggcgcatacgtgg

SEQ ID NO: 1631 - DNA, 1167 bp, Oryza sativa
agtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagcacaaagcatccgttaatttatccattcagtatgagataccaaggaaacccactaaaatgatagttggcaacaacctagcaagaagaacctaaggtggttctttttatttaaacatattatgtctgcttttgatttgggtttaatagtttttgttggtgaccatagtattgcgttttcttaaaataagctctcacgttagtaggtggctatgagctaccatgaggtggtcactgttctttgctccttattaaatgcaagtgttgcttgtgcaggtgatggaaaaaagcaacaagtacttagggtttgtcattctctccagcaggtgatatgctattcaatttattatttcctgtgattttacggtgccactaccttcgttctgttctcggaagcaatatagctaattgcctataatagattacataataaaagtttagcgcatctgccaggtagcattttcatacaatgttagatacttacatgctatgcatctattcaagattccttttcttctgtcatgacctattactggcagtacttatttttgggcactcatatggatcttttctaatggttctctgttaaagctacgcattgttcacacatgaagattaagtgaaaaagatgacacacccatcttacctttatttgctggatatgctatattaaaacccaattgtatgtccttagcgtcttaggtcattgtattgcacaacaccgtttgtagatgagctcaatatatatatatatatatatatatatatatatatataggacactcatatggggcaccatgttgcccggccaccatggttttaaaggccaaaatcacttcaaatttttcaaaattttcaaattgtgagtatatacctagttattaagaattcgattcatacctatacctatcaaaaaaaaaactcaaatttaacttttattcccaatccatgattaca

SEQ ID NO: 1632 - DNA, 538 bp, Oryza sativa
catccactgggtgccgagcaccatgtcgtaacctgcaagtggaatgacaaagagatcgacggtgaagagcgagccgtcgatggagagcacggcctgtcggatgacgccaggacatgcgaccttctcgccattggccacagtcgccgtcatgcgtgggcgtggctggaccggcagacccgtgcggcacgctgcctcctcggcaatgaagctgtgggtggagccgctgtcgaggagagcggtgagggtggtggcgccgacggtcacctgtacctgcatggtgtcggcgaccggtacgccggcgatcgcgtggagggagaacaccggggactccaagtcctgcggttcctcagccgcgtcggtgtcgtcgtcgtcatccatagcgcagtccaagaggaacaagtgcttgcagattttgttatggccacggctgtacttctcgtcacagttaatgttgagattatgggtatataatgatttaatttattccataaataaatcatgacattacagatgaaaactagcatgaacgcctcattag

SEQ ID NO: 1633 - DNA, 516 bp, Oryza sativa
ccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcaagagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagcctcggaaaaagatgccgcgtctaagggcgatggtgggcagtccagtgccaatgttgtgcacaaggcccagaacaagagcaaggggaaatacaaagctcagcagaccaccaacttcaagaagcaga

SEQ ID NO: 1634 - DNA, 1737 bp, Oryza sativa
taatttatgtgtgagactgacatgtgggtcccacgaagtttattattttttcggatcaaattgccacgtatgcgccacatcaatgccacatcagatgaagaccaagtcaaatttgccacgtaggcgccacgtcagccaaaaccaccctcaaaaccgtcgagggacctcatctgcactggttttgatagttgaggaacccgttgtatctggttttctggttgaaggacgaaaatcggattcgttgacaagttaagggacctcagatgaacttattcctttctacacatgtgcctgagctgaatgtgtcacgaagggcatgtttgaaggattttctagctgcggcagttttccatataattttcagtttccttaaacggttcaaattatcacctaaattatgagaatatatggtaaaattcagaaaatgaattataaaccataagttcaaaaactgagtttctcccgattctcataaactgactatcaaccagcagaattttagaattttaagctcccctaaatagaacagaagaaagagttgaaacattaccacatgattaataactattataaatttttagaaaatatttgtttgatttttgaaagaaagtttctaataaaatatcccatttagcaacttagaaaacgtagaaaaaggaaatagctaagctaatcagctaaaagaacagggctttacaactaatcccttcattgcttggtgaacaacaatctcttgaatgaaatttcgtaaaaactgaactaattcacaccccatcagttaaaaaatataacaacttctagcatttcaaatttgttcctagatttagcatttttttcacctatttcatcatcttcatctaaactatcatgccattttttttattttagcttcttcatttatttcctcatcctaattgatcacaatcatcatttagtttcacattaatttttagttcccgtgaaaaatttcagaagtgctttaggacggaattagctacctattgtacacaatttacatggaacggtcactgatcatcgctgcatatcgcctgtatgagtttctttatttcgtatcctctgttggtttcttctgggagcacttgtcaagggcgtcaggccctcgggtagccggccctcggctacgtagcacgtagcctcggtctgtcgtcttctccggcgaggttgccccctgccgcaggcttagttgagagagaggagattagattggtaattatttgcttaattcaatttttacccggaatacaagataagtaggccaccggccaacaaacttagaaactactaatttggaaataattaaactaggaaataactctcctaaaatcaaggctagctactatcctcggccctgccttcctgcgcgctgattgagtctgctacggacgctcgggccgcggctctcctgacgtcgtgggctcgacgctgacgcacataggtgcggccccacatgacatctctcccccccctcaagatccagctcgtcctcgagctgaaaatccaggtacacggcacggaactcctccaagtcttcccatgtagcagaagaggccggctcaccacgccagtgcacaagaagctggcggacaccgcgcgccaagcgagcgctctccacccgaatcggctcagggacaacagcaccatggtggatgtcggggagcggcgttggagcggaaagtcgatgcagaaacgtcacgacccgtcagccttcttaatgag

SEQ ID NO: 1635 - DNA, 2297 bp, Oryza sativa
  unsure (1)..(2297): unsure at all n locations
ccggtgcaaggacgtcaaaggcaagaggttccgaagacctgctctcccgatcgctggtgcacgccggcgagcgggatggagtagtctacgagcgacggcgcagtacagagtagaaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcacgccgcctgccatgccatgccatgccatgccatgccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccacaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatatagccaaagcgattcaagatcttctccacataatgggactgcaagagagtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacannnnnnnnnnnnnnnnnnnnnnnnnnnnnnnnnnnnnnnnnnnnnnnnnnnnnnnnnnnnnnnnnnnnnnnn

SEQ ID NO: 1636 - DNA, 1845 bp, Oryza sativa
aagtagcacacgaattgtggtcaatctagcaacaggtgagtaagtgtcaaagaaatcttcgctttctttctgagtatagcccttagcaacaagccgagccttgtccttttcaatagtaccgtcaggcataagcttcttcttgaacacccacttgcaccccacaggtttacacccatagggtcgctctgtcacctcccaagtcccgttagcgataatggaatccatttcactatggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccattatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtggggttcttcctttcagcaatcccattagactcgggagaatagggaggtgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcac

SEQ ID NO: 1637 - DNA, 580 bp, Oryza sativa
  unsure (1)..(580): unsure at all n locations
tatagggcgaattcgagctcggtacccaacagttatctgaagaatgccaaccttaagcatatagatagatcgtcgtgagaacgttacaacgcaatcccctgccttaatgttagagaaagacccgagagtagtcttcagaggaaccaatggagatagcctctcataatattggacctgcatagagacatacagccagcaaatcggaatatttgacgacatgatgcgtgtatcagtactaacaccaaaataaacattagacagctcaacaaattctattgagaagaaacagtttctcgagttcacttggaatattatctgcaaatacaaaacatcagctaatcaccaacaaaagacagatatatatgacatcatgcctgcacattactttctcagatggaggtccagaagtagtgttactatccaggggtgcaatctaaattgttggacgggacctcaaattggtgtggctaaggataagttgagtaacagaggttacaggattgctgatgctatccaccaatgannnnnnnnnnnnnnnnnnnnnnnnnnnnnnnnnnnnnnnnnnnnnnnnnnnnnnnnn

SEQ ID NO: 1638 - DNA, 2063 bp, Oryza sativa
cgagttccttagccatggtttgtatctcttgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaattccttcaggtttgccagtactcacccagaagcatttcatagctgtcagccacagagtgaccctgatctgccatctcttaaaatgcacaccggtgaatttatccggcctcagtgcatcagcaaaaccagccatagtaaaatcacagtgcctataataaggtttttggattgttgagattatgggcatataatgattaaatttattccataaataaatcatgacattacagatgaaaactagcatgaacgcctcattagatctacacatgtaaactacgcagaataacatgaacagatcaaatatgcgcaacatattgaacacgtaccgaggtgacgaaaagaccggctgtttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacttcgtgcacgcgcgccgcctgccctgccaggccaggccaggcgagcgagcgcgcgtttcccctcttctctccaccacacatgcttcaagtggctaggagggcatcctcccttttaaggaggtcctcctctcctagaataagcaaggtggtactaaactccacatgcatgccatcccatgaggtgggcttttgtgattttccaaagaattaatcttcgagtgggctaaggtccattcattaattccaacagttaaagcatagcccgaggcggcgacgctcgtcctgctccgcctgagagagccgcttcaccgggcgaccgtcgatgaggacagggggcgatgcggccctaggcgccggcggctggggcggggcctggcgcggacccagcgtcggcagtatcccgtggccaggggctttggccagggtggcagtgcactgctccatcagctcgaactgccgagccaaactcatggcggtgacgagggactgcggattctgcatctggaccttgagactgagcggaggaagcagaccgccggtgaagagctgaacccgttgtgccttcgtcaggcggccggcgcggggcaagaacgcttggaagtggtcctggtagtcctccacggtggtagtgcggcggcagtcggctaactcgaagaggggagccgaacggagtggcggcccgtaccgtaggacgaggagttcccggaagcgacgccacgacggtttaccctcatccgcctggacttgcatgtaccatagctgtgcaccatcttcaaggttgtaggacgccatccaaaccttctcttcgtccatgatccgttgttggtggaagtacgactcacaccaattgaggaaggtgagcggatcggacttcccatcatagcgcgggaaatccattttctgaaatcgcggcggc

SEQ ID NO: 1639 - DNA, 16116 bp, Oryza sativa
ttgtcaagggcgtcaggccctcgggtagccggccctcggctacgtagctcgtagcctcggtccgtcgtcttctccggcgaggttgccccgtgccgcaggcttagttgagagagaggagattagattggtaattatttgcttaattcaattgttacccggaatacaagataagtaggccaccggccaacaaacttagaaactactaatttggaaataattaaactaggaaataactctcctaaaatcaaggctagctactatcctcggccctgccttcctgcgcgctgattgagtctgctgcggacgctcgggccgcggctctcctgacgtcgcgggctcgacgctgacgcacataggtgcggccccacatgacagcactggacaccgaccagtacatgtcggcacagttttaaatccacaaagtttcatatccctttctccttggcccgatcagcgaccccgtaggttgtttgcaagtgtcagcacatcacatcctcttgggtttcttcttcgatcatctgacatctcggaagcttctgaatttttcaaatcacgtaaagctcaagtgtccatgtcactgatgcaagcagatagattagctcgttctcttttgactgagatcatcattaatgaacaagttattttggagccaaagtgtttaatcaatactccagttgttaattagtagatactcctactttgctgtgaaggaactaggaagccatgatcccggatcagaaaaagggaacgcagtctttagcctgaaaaagtatgttacacgttgcaatcatcgaaaattaagcaaaatgatcatcttagaaacaatgatccaaagcttgagctgcatgcactttcactttctccaggtcacactggatgctaccaatgtccatctgagatgcagcaatgcagtgccttttgtctcaagatcagagaagcttgtaacatacacacatctttgagtgacatgtatcagacaggtgctaatttgatttcacttcaactgtgtcatccctaataatttcagactttgagtggaatggttagaatggttagaagtctgcagatcaagttctaccataaaaggaaggatcattaacagtaatttgtactgttgtagtatactgcagtgccgttctgaagatgatagcactgccatttcctctgggagacagaattcagcaatccatgcaggacaggggcctacggtgtctctactcttaaggatgtcactgtcagctgatcaagtatactcccatcagagtaatctgcagagatgtcctcttggacttcagagagagtattttgttgagaaaatcaggatatctttctctatctagcacctctagccggccaggtgtaggaaagcagctactctcatttttttcaaacatgggaagatggatgaggtgtcattgtggacttgtggtggttgagcaccgtgttgaggataaacttggtgcatttctctgaatttctgactgaaaacatattcaggtttcagggaggtggaaaaggactggatctcgtgaattctgcttgctctcattctctccgatcatttgtcaccatgttaacattgtgcagctacaggaaattcggacgtgactcttctcacttttcttgatttcttcacgtgtggtgatagtgaggattcagaaaacaaccggttgaaaagggcatttttgtcgggagagaattaacgcagtggtgtgagtgggtgccctttttccctgaaaatctttgacaagaatgaacattttatctgcaaaatccaaagaagaaaccaaatgctgaaatgcaacgcctgccctggaaagattcttgagagaaaacaatggagataaagattcacgcaaaatcgagcagcaaaattcagagaaatataccactgtataaactctgcaccattcggttagcaagaatccaaaacaatggagtgagtgatggaggaaaaagaaaagaccactcaaaccgctcgattcctcgagccctatacggcgatggagacggccaccttttcgagttccacgcgcccttaatgcacggccgccgccgtgccgccgtgccggagcaccggcggctgtggcggtggagactggagagagacgggaggaaggggacggcgaggacgacgaaagggtctagatatgtaatatgtaatagtataggggtcttagtgaaaataatctctgttaatctacactgttgaaatctaatccaatggcgtacgggtcgctaccattggttccgaaatagggctataaatgaaataatagattagtatgagggtttattcgggaaatacatcttgctcgcaaatcctttcctttttttttttgcgaaacaatccttttctcaatctgaaccgttaaaaaatgatccaacggtttgtttaaagccaagtgtctttatttgcggataatgttaaaaatagagtattaaaaggggtacttatgcaaagtactcatcgctgattctactcgatcacggccgtagactgccgatcgaatggttcccatgaattctagctcctgggccaagaattaacggcggccggcggccggtgcagatcgccgagctagaacgccggagtccaccggcggcggcgccgccaccgccgtgctgaacaaggactggtgcctccgtaccttcctacatggagtgcagtgaagaaagtgctaatgaagacgacggtcgacgaggcaagcagcaagtagcttccgcgccggcgatgatgatctcgatcggaaagggagaagacgtacggagtagatcaaatcggaagaaataaaacataaagcaaattatctatcggagaggatcatttggtccatatatagcattcgatgatcatgatcgaaggatagctagagctatactcctagaagcgaagctagctaaaggcacgagagtatagtacaagatcatgtgaaatattacttgaaaagaatgtgaaaaatattgaacttgattacacatatgtgcaccctctttcaccgtggttaacaccacctgatcaaaattcaaaattcacatagaaaccttatgtatattactactgctagtctctctactagatgcgagaggaagaagaagacgatggagattgcatgcgtcgtgcgctgcgtgcacctcgtcacaagaaccgcacgccacgccacgccaccgcgcgcgcgcgcgctcgctgtacatgtatggcgatgatcgatcgcccgatcagatgagctggaccgagagcgtcgacggcgcgcggtggtggtggtggcgctcgggcgcggctcgcggcgacggcgacgacgacgacgaggaggatccggaggcgcgccgccgctgcttccaggaggcggtgcgcagcatctggcacatgccctcggcgacgcgctcggcggggccgccgcgcttgagcatgcggcagaaggccatgtgcgcgcgcacggcctcctccacgtcgacgggcgcccgcggcgagctcttcccggcctcgtacttcaccgcctccgagcacagcccgcacagccacctccccccgaagtacgccctcacgccgcccacgtactcccccgtgcactcctcctccagcccgcagcactcgcagctcatcaccaccgccaccatctcctcctccatgcttgcaacaactagtatctgaacaagtttatctcccttctttgatcagagatgacaagtgttcttgcctctgaatttctgaattatattactaggtcgtagcggcagcagcagcagcagtaggtgctctctagctttgagctatttcttcttctttccttgtgttgcttagctgattgattttcttggtgtttgttggtcgtgtgcaatgcgttggtttcctttatattgttttgatatggcacctttcgctgtcgcggcgaccggcaatgaaatgtacagattgtttttttatggagaagaaaaaaaaaggagagattttgctttttggcacatggatagtacccatcagatgatcagatgcatgctactgctatctaggccatctactgctcaacatggtcatggactagtagtagtacactgcttggttattgtttttttttttttttgccctgatgacaagggaaaagaacagcggggagaaagagcatttttgacatagtttagagtgcagagtcttcagttgtgcaggtttgtttactgcttcacgatttcatactctgattgattgattctgaatctctctttagttccatgtatatgattgttttaggcacatggctgacaccatgtcaaagatttcgcgctaatttgatttccaagtcaaaacttccgcggagaatttactgaatctctgccctattttacagggaaagagcaagttctatgtacatatctgtactaggctgagcaccattgtactatttctttgctatttttgtcaaagagagcaagtggggtaatggaatctagaaaatccaccaagtcgtgtacatttaattaatagacatccatgtacaattaaattataaaaacaaattaaccaaccaatttctgactataatcctctatcaaaaacaaaaaaaaaatgaatctgatgataatgctcagctgaaaaccgaacagaatactccctctccatggcatggctgtcgtgatgatccatggaccctaccacgtactcgcggcttacaaagtctctactacggttcacgtcaacacggtataatcgtacagtgccataaacatgccatgtctgcatacgtatgctgattgctgaagctgtaaccatcagtcttatcactatacaccatgactagccaccggtgctaatacagtactaatggtggctaaaatgaacgaagcgactcgagcattatccaatcaatcaaccggctaaacgatctccaggcatctgcatcatccggtgacaagttctgacggagtgacagccggcgatgacaattctagcagctgcacgttcgtcagaggaatgtgctgtcagaaacatgttcagagatcaggaaattcagaatgtggcccaagctgatgaatcttatgtcagttcatgtgtagtatggctgtcagggtgctcgcggcactgcagcgacatctgatggcgagacgatgtttttacgggcttatctgatggattcgctgcatgtcagtatgacagtatgtagtagtatgcgacgacgaacgacgacgaagacggggtgagataggacgttcattcttcgaattctcggtccagaaggcacctgaagattgacatggccatgaacgccttgcccatgtctgcctcctgctcctccgtgtctccctgatgtcttctcccttatcatctcgtacagtcctgggaaagattttgcaatgcatggaccaatcacacggacaggacaggaatttgcatccgcacgatctgtctaagattaaaattcgaattaattggcatccgttagtgataatgataagatgatgatgctaactgcaagtgtttctgtaatctaagatgtggtttgaggagagtgatatctgaacataagaacatttccatcgatatctgaagacttttctcctacgcggttgataagatttcagtaaatatatgatagatttcggtaagacgccggatcacacggacaggacagaggctgcatccctggtatgatgtgtccagtattaaaattctgattaatcggaatccattttagagagaagataacgatactccctcggctcctatttactttgtcaactgtcacctctgaccagggttgtttcaacttcaaccattaacaatttttagatttatcatatttggttgaacaaaaaaaaagtctagttaggttatcatagttcgataatatggtgtatttttcaaagaattacaaaacattgttaaaacgaaaatggtcaaagttttcatttccatcgatccctgaagatatatattctttttcacgcggttaatgagattcgagcaaatcgctgttgggttgaagagattttcttttggttggcgacgattcaaggacaacgttgtcgggacagctgcattgtcttgtgtgatcagagcaagagaggatcgatcaatcgtcttccctgcagaaatgtgtggttgcgcggccaattttagttcaggcttcagggctcctgtcgcctgtcggcagggaatgaatctttggtgccgaatggtgcaaaaatctggtgaatggctgattgctggatgatcatagatagctgcaggagatgcaaatcccaaagaacataagagagagtttcgatcactggtggtcctggtgtttttgcagaaaataaaagaatgagaaaaatattgaaattttctgttgctatcttctctagacaatatagtaatatactgtttttttccttttcttgaaaaaagggtgtcacattggttgggttcagctgataagctgtgacaaaaaaaaaacgagcaacgataaatgatttgagagtagaaccattacatttgtagcctttaaaatccaaggctgaaaaggaaaactcaataatagtataaaatgatttaaaattaggcttaaaaatttaagtttcggttgtgaattataaatcaacaagcaaacgatgaaaaaaggaactctctctaaaaaaaaaagaacaactaattacaaatttgccactgggttaaatctatatattgtaggattgccaccagataattaaaaaatgcaattagaactgttgttcgattggcatccttacaaaattaaaaaaaccagtggcaaaattgtaaatacaaaaaaaaaacaacatatggcatctagatacagcagaggttttggatgttgaaacaatttattaattgagttttgagtggatctaagaaaacttctcgagtttaactaaaggcccaagtattcatgggccgggctgcaatctcaaagccgcctccaaatctccaaccgagacactgaccggtgggcccaacgagagagccactcataaaccctaatcctcgcgaactccccctcctccccgcctccctcccatctcgcgttctcgcgctcgattcgaatcccaccgcaaagcaaaagcccacgcgcgaagcaaaagctcgccgcaaatggaggacgccgcggtcgaggaggccgaggtgagcggcggcgcggcggagttcgcgccggctctcgtcgccgcccacccgctcggccgctccgtcgccgtcgccgtcgggcccgagctccgcgtgttcgatctcaagtaaggaacgcctctcttcgctcgtggctcgccttcctgcctattgtcggatctcaatttactcttatagttaagtagtttgattttgatggagattgggacgtgatgcgtttttttacctgagcctaaattggtctgtcgtattgtactgtagtctaagtgcatagcatatagaaggatgaagcttctgttgatatttattcgtgtaaaatttcactgctgataaaattttcagctcagatgcttagttttgtactgcccagtgaaaatgtctaaatggatgtatgccttattttttccttcatttcacttggtgaatattgaaatgtgcgaataaatgtgtatttttggatccagggccagcagtgcagtttcattgtcagacaattctggcggtggttctcattcggatgctataagagctatctcgtttagtgcaaacggtgctctgttcgcatccgctggtgatgacaagcttgttaaggtctggaagactgattcatggtgctgcattcggaccatgtaagtcaccctgtttgttttattgtgaaagcataatggattaaccaaattagtgtaccattttatttatcatgtattcagtgagtcaatctacaactattcttctgctacttatctacgtgtttatgagaatccacacataattgttggctgacacacttagcagcttggagtattgttagttatgttaaaaacttcatttttgtggttggtaatgtattaagtccttcatgcatgagtttgatttcttttgcaatgtctttacttttgcagaacttctgaaaagagggtcagtgcagttgctattagcaatgatggcacatatgtaacttttgcagataaatttggtgttatttggttagttaccatgggggaaagtggtggagagcaggagccaactgataataaacctgtgtcaatttttggtcactactgcagtattattactagcatggtatgacaaattttgatattttatattagccatagttatttgtatgtcctgctgaaaatatcaaagtaacacattatgcttcaaatttccgatccctgcacacttatattatgtattggaatgcagaaattctcaccggatggacgattcattgctacagctgaccgggactttaaaatccgagtatgaaaccattatactttgctgtactttctgcatttgtgtggatcataattctctttttttttcttctttggtgaaatttgttttgtagattacatcactcccgaaaaagcctttaagaggggctcatgagattcaaagtttttgcctaggacatacagagtatgctcagtatcctgtgccttcgtacttttttattttacacagtgtctacattctttctgtatctctaggaatttgcattattatctattaaacccagtgaaattttagagctaaatgttgcaacgtattagttaatgcattttatatttcctgtggataataatgcagctttgtatcgtgcattgccttcacatgcctttcagaaggtccgagctttcttttgtctggaggcggtgattctactgtgggtacaaaatcattttggaatgctaacgtgttcccagcaagcttttccaatgctcctcgtgatgtttttcattcatttatttaggttcgtctatgggactacataaacggctgcctccttgatacatgtcaagtccgagacaaggtaacatctggaaaatgtttatttgagttttctaaaaaaaaaagtcaataggttgtttattccagttataattgtttgtgttattttgtactagctaacttgctcttaaaacaattcacaggtgggagaactcttagagccaaatgaaactgaagacaacaatctatctgttgcagatatatgcccgactaatgatggtttgttggttgctgtagccattcagaggtaaacttgtgtggttacgcttctccaaaagtaatatgatttgcttggtaaaatggggttcttttttatctgtttgatgcagtttaaatggagtaatgcttttagcatgtgaccttattgcaaagaagttatcttttctaaaggtatgtctctttgaaaatgtatcttttcaaggcaactggtttgggattaatagcatgaccacttgaccaggattttgttttacaacaagatttagcgcatcattactatttagtactgttgatagccttatttcttgaaatgatctttacaaagattggtaccaatgcttgtgacttgctaggctttggcttgagagaaatgttcgtgcgagctctaggtttcttgttgccagttgtgatggggctagttaagatttatctggaaaagtattgttaaatcttggttattggtgactagcaagatatcttgttggctcagctgttcaatagtagtacctttttttttctttttttgtatattgctggaaaaactaataattcctcccctgcactaccaggtggttacaacggaaaagtgctatattcctactagcctgtcttccagcttctcagcagatcttctatggaccgtcatgggcgcatcgaatatgcctaatcaggctacttcccagttatgtacccgtttgaaaatcatcccacacttcaaaaaggatccgctagccggatgtgatcatgttcctacagtcttggaagacagtgaggtgccacatggtgagaagctccttctggcgctgcaaggaagtcttgacattgcaaagcaagaagaggtgttagcttcagttctagctgcactgaaagtatcaatgcacaagatgctggtaaagaagcactactcggaggaaaggagagagcagaggaaaaggggcagaaacgataagaagatcaagaagtagatcggcctacagcctcagcaaaaccagttctttgtttctcattgtaccattagaggcttggaaaacaaaaggcattttgacattcacaactgtaagattaaatctactagcaaacacttttctcattatccataggccacagcataacggcttctgaattctgatgcctgttgtttcagtcgaaatgcccgcagttcttgttgtctgctctacctgtagcagctgttatctgtgatttgaaatgttacttaccctatattaaccatgctgctatccaatgataattgcacgctataatatcatttttgcaatgcatcaaattgctgctgatttaactgcacgctgatcactttttttgtcgtgatcgcaactgatggctgagacgtaaagatcaatcactaaagagcatgaggattccggctgtgttgtctctttctctgaatcgtggtgtacagtatatgacatgatctacgatatgacgacggtaaggacaagctttctgtttctttgcgttgcaaaagctttccatgtatactgatttgaacgtgagtatgtgacgtgcccgatggtttttgcagagctggaaacgagcagctactacctcacatgtaaatgtttttctctggcaggaggaatatttgcagcatctgcgatcactggtttgtcgcctgcatctgatctgccagtggaatttcacagaaaaacaatgcaatttgagctggatttggatgaaattcttttcccaggttccaaaaacaggtacaggtgttgcttgctttctcttctttctgcattactgcttgttagttcattgatgaggaagggtaatgatagggagttagaatttattcccaatcctggtgaggatggctaaacaaagtctaggaatttattctgaccaaaaaaaccttatccattgagcagagatgcaaagatgaacacggttgatcaggaggataagagttctctgtaagaaagttaattcccatggtcaacaacatgatgtctgctttgctgccttttttttccctctcctccagatgcaacttctattaaaactgggaactcactgattcatttttcaaaggtttaaacaatattatcattgatctctcatagtctcatggtgctactagtagagaagctggagtacctctcataagtcagtgcccttgttttcttccttctaattggtttttctaaccatgaaactaatggcacaaacaaacctaagtcagcctcattgataacgattcccatgaaggtatgaagatcttgtatgtcttctagttccagcggcacaaaccacttcaagttcttgacctaatcacctatccaatataatttaatactaaatgttttcaatgaggacaagaagaaatactaaatactactaggtgatagcaagtggaatcctttgtcactagagtatctgaactggaagaaatccagggcgtcggatactgatcggacggtcttgcatgctgttcatcaaattactagtttgtgcggtctgcatcctcagttgttccatgaacatactaaaacaagtactcctatctaccaactgaacagtaacaagagcaattaagataataagaagccaaaatcgatatgatcttaacgttttgacagtccagcgactttgcaattaatggccgccactgcaacaatggctagcaagcagccttggcatgcagtgagaagcttttcttggtctctttacctgaaagctctggatgaagcttcattgcatgatgcaacctgaattttattttactgtgactaacagtgctaagctttgcttcttttcatccacattaagctgatgcttctcactgaaggcgaaagggagacaataagcatgcatcagcaaggcgtccatttcacctgacctaagtgaaagtatacctttctgtcactgcaactgtattttgctgctcacagaatgtcagaaaacggcatgctttgggacatggcccagtttattttaactaattaggatttgcccagttgctttcttcatcatcaccttgtccttttttttaaaaaaaaaatcaagcaaattagggcctgtccaatcactagcactgttgctgcatgtgcaaagagtatttgcaaattgcaaaactcaacagtctggagtctagagttgcatcaccaggagggtcaggtttggtgcccctccctttcaccctttgcccgttgtcaataaaagactgcatttgtgttgtcctccaaggaaaaatggagcaagtttagaacccctcatttacaagcgttgtgacttgtatccaaaagagagagaaaaaaagaacttcagggttaaccatttcttagaattatactacctccgtattttaatatatgacgctgttgactttataaccaacgtttgaccactcgtcttattcaaaatttttatgcaaatataaaaatatttatgtcatgtttaaagaatatttgatgataaatcaagtcacaaaaaaataaattataattgtataaattttttgaataagacgaaatgtcaaacatttatcaaaaaatcaacggcgttatacattaaaaatatggtgggagtactgtatacgagaaaaagagaatcatgtgtgagtgtgatgatgatgccattgttaacttattgatttactacttttctcattctttggaccaagtaccaaaggagaaacaagttctttacacctgccttgctctcacccttccatcgtgcaatggcgccatgatgagcccaccatgtcgcccacaagattatgcccggcggcgtctacttgttcagtcaaaaataatgacagaaaactactgtctactgtcactggcctaaggtcagagtaaccaattggttttactgaaattaaactgccgttaatcacagggctcatatggtagtcataagggcaattctagagtaaatgtctacttcttgaccactgtcatgagattgcaacacgtattgaagtagcaatcactttcttgcttctgggtaggaaaattgctgcaccggagaaatggatatagattgggataatacggtgatctcatgcgtgggtgatttgctagtacattactccctccatattttaatgtatgacaccgttgatttttcgaacaatgtttgaccattcgtcttattcaaattttttatgcaaatataaaaatacttatattatacttaaagaatatttgataataaatcaagtcacaataaaataaatgataattacataaattttttgaataagacgaatggtcaaacgttgattaaaaagtcaacggcgtcatacattaaaatacggagggagtaaatattactgctgcttaattaacatcttgtttagacatggagcccacctattactctctatcagcaaacatctactcctatctaagaaaatggtactcctagcactataaaagtaaggagggtactatcaggtagctcctgggattaaaatcgtgtgccaatccctttctgcaccaatcactcacttgtcacttgtcactatactaaattgatacaccccctctcttttaaaagtataaatcaaaccccccaaatctgtacacatagtatcaaattactaatctaatcttgaattatcaaatcgatgtctcaagtctgagctccaataattggcaagccaacttgccaaggggacaccccaacgggcgaggcgagaagggaatgacgattgacgcggttgccatttgccgcaagccgcgatggaactcgtaattttttttagcccaaacaaatctaattaagcctaagtatttattaaaaaaaatctaatttaaccgttacattaacattaaaattttattacttcattcgtttcaatatgtaacaatttagaatagaattagatcaatgctaagactacgaatatgaatatacctttagttctacatattgagacagagaaaatgtgtttggtcaataagcctaggtagccgctcgaggtcgacggatggtggctttggcacatggttttgatccgattatcggcttgtagagaacaatgttaacgtcaatgtaaaatttcttcgtgcagcaacaatatcgactcgtcgtttgcttgtcagaggaccagctgcgatggagtcaacaaggctacacagggaatagctataattagcgaccgatcttttgtagtaacagtttttttcggtgggttatcttgtagtgccacagagttagtgatgatgttgagcccaaatagcaaaaatcttttactagtaaccgataattgttctatagcggttttcggcggctgatcttgtagtgccatttctatcgtttagcatagttatattcttcgtatggtggattactgcggacacattttcctagcttctaaatggtgcaatatctgcaaaatggctttttcatcagcatttccttgaaaaaaactgttttaaatcaaccttttaaactttctaatgcgtaagtcatttgtttgtgctctcaaataattcttctttcatctatcatccatttttcatatagcactttaggacaggctcttcaaggagacgtgacgagagaagtgtgggggaagcattgcagttaagggcagcgagcgaagagaagcaaacaacaaaagagggtaggggcaggcgggcgcatcgcatacgcttcagtagatgacaaacatgccaagaaaaaagggtacagttagagacaggacataattgcgatcttttgtcatcgtgcagtaatctaattgtactcctaccagtactaattctactaaaaaaacgtttagatgacaaaaataatctggttctttctggcagtaatttctcggaaatactgtaaatacgtgttgttctgaaaaaaaacgatggagattcagctcattgtagtatgaatgtatgatctagttactgactgatttttactgaagcagccactgaatcatctcatctgatcagatgagcagcatgagataccttggtgaatgatttaccgtgtgtttgagagtaggaaacagaagattaagatgatatgtaaaacgagataaattgttaacgcacgattaattgagtaatttctcagagacactgtactactgtaaaagtgtgttgctctgaacaacaatgataattcagctcgttgcatgatctacctgacatttacagttctactactgctataccactgatgaatcatctcaaattatcatctgatcagcgattcagcagcatgagatgaatgatttcattgacgtagagcctcgcatctttccataggtcgacagcaaatctacctgctgtaccaacggaatctaccatttgtgtgcgcgtgcatgggctcaaacggggacagtaacacccagcgcaagaatgcagcacagcacacactacagcagcaagagaagcatggccaggacaggaggagaggaccattgccaatgaaaaagatgtgtaaaaacaaaagagaaaaagaaaaaaaactcaggataaggacctgcccctttggatgcaagcacacacaaaccaacactgacatcatgttcattcactgtgaggagaggagatggcttctttaagatcgccaccctcccaacctccccattgtgctactatatgcttattagtatcatcagttcatcaccaacctctctctcgtcttcttctccctcttcttcttcttcttcttcatcttctacctttgatagtttgattgaggtgttgttcctttgagtgcagcaagaagctgatgattttgatgatagcttaaggatcttgccaaactcttgtgttgggagtagttgcttgcagatcgagctgcaaaggtcccattttgcttctccatctgagcttggttaggttgcgtctgagtacacttctgaggcttctttggtcgttttggcctcgagctccgttcttaaactctgcctcgatcgatcgatctcatctcatctgcgctgttcttgttgctgttgctgttcaattttgagaagaaggtgccgatcgagttgagccgatcgg

SEQ ID NO: 1640 - DNA, 2430 bp, Oryza sativa
  unsure (1)..(2430): unsure at all n locations
cggttcggagcccgagacgccgtactcgatgagcccgacgtccgtgatcgacgcggcggcggccttcgcgcccagcccggacgccggcggaagcaagcgccggccgtggtgcgactggggcgccggcacgcacggcctcgccgacgcgctcgactgcaccggcgacgacgacgacggccacagacagagcgtcctcgccgccgcgtcgcgggcggtcaagctgcaggcgcaaccgcagcagcagcatcccctgctcaggtcgtgctccctcgatcgccgcgtcgagttcggcgtcaagaacaagagctcgtggctgccgcttcgcgtcgccggcggcgaggcggcggcggcggcggcggagtcaccggcggagatgcagatggagccgtcatcggaggactacacctgcgtcatctcccgcgggccgaacccgaggacggtgcacatctacggcgaccgcgtcgtggagggcggcggcggcgccaccaccgccgtagcgctcgccggcgagagctcgccgcggccgatcaatttgccggcgccggcgcgtgaagcgagaggcttcttgagcttgtgatgcagtgatagatggtagcttgattaatgatgcttaggtaaagtttggtgtgaggacaattaaattaaatctgagtcttaatgctgtcattattattattagtatttttattgtattggttgtttgttcgatcttgatgatcagatggtcaagtagtagtagatgctttcttgatcggatcctcaaattttaaatagatgctttcttggtcagatgatcaatcgattcaaacagatgggtttgttcagtatacttcaatttgagctgaatctgtaatacaaattcagaaattctttgcttccacatcctgctgctaccagagcagagtctttacctgcaaatcacttgctgaactattaacccaatgaatttaatctgatctccaaataacaagcttagctgttccacacacacacaaaacaatcttcatataaaccagtttaattccctctaacaaatcagagagaattcagaccaactctgaatttctgacagagagttttcagagcattttcgctcactgaatccaaagatgaggcaagtggtgttctaggcttctgccatactactcctaagctgcagggttcaatcattgacggtttcttgtagcatcacactcacaaccgatggaggagaagaaagaatccaatgattgatgttttcttgtggtgagcccctgctgctgtgcctacgcatccaaaaatcgatcgatcgaatcgaccagtgtgtgtgtgcgcgtgctgggcccacatgaacgggtgccttgtcagtgtcaggggcccaggggttttggcaaacggttgcagctaagctaaccctctgtggataagccaaaagcagtgtgggtctcatgccttttctgcttcagtgaccagcttggccgggttgggttggccgtctgatcggtctggtccaattttgtctctgtgcctctagtgttttaggctttcagtttcttcgctgaagctttcttcttttctgtgatgctgactgaatttgatgcccagtttatttttgaggtttttgtggtttttgagtgtttttgttttgggtgttatgctgtattgctgtcatatgatgtgatgtttgttgaacaggtactgctccagtgtagagttaaaacctctctctttcaggttcaggatggtgagcagcaaggaagggaataaattcttgaggattttagatcagtagtagtacaattcttttaaaatggttagctaccaattgattgctttgttgggggtggtcataatgtacttttagcttaggagtactggggaaacaaaatcttgtcgatagggtgttgtgtacatctgcagttggatgcatgttggaatctgtaaatctgaagttgttagaagaagcagcagcagcagcaaatttttactagctcgtttgaacttcagatgcaagtgcaaaactgagcacttgaactttgaacaccttcaggaatcaggatgatcagccacaaggaaggaattccgaattcatgaggattttaggtttaagcccatcagttgaaaacttgaattgcacaataatcaccattttatcaacagtttgttttcaaagggtgttgtgtagagtgcaactcagcttatgtcagctgtaatttgcaaatctgaaatttgttaattaaaaaaaaatcagactttaacttgctcgtctgagcttcagatgcaattgcaagactcatacagacactgatcttccttctttgaacaggaagaacaagtcaagtctaatttagagctgataaactaaaatcttacaaaagagaaataannnnnnnnnnnnnnnnnnnnnnnnnnnnnnnnnnnnnnnnnnnnnnnnnnnnnnnnnnnnnnnnn

SEQ ID NO: 1641 - DNA, 3728 bp, Oryza sativa
atgcaattgcaagactcatacagacactgatcttccttctttgaacaggaagaacaagtcaagtctaatttagagctgataaactaaaatcttacaaaagagaaataaaaaaggaccgcactaaaatactccaagtccataatccaaatacctaattgcggtccagcttccattgcttcaaatatctgcaagggtacatagggttgctagctatacatcccccctcgcttgcaacttgccgaaggttaattgctcacactgttcatcattttatgatgaactaactttagcaacttggaaaggaaaaaaaagcgcatttcattaaaaattagcaccccctattaatctataggatctaatggaagtagagaactgtacatgacaatgtagggtcatactaaggcaactattatccaaatagaaatattcatacgcacctcgagatgtaaagccaatgttattgcccataaggtttggttgaagctgtgatgaatgattatccatttttcatccaaaaaatagccatatggatcagcaattgcacatactaaaacctagagaaaatttgctgctttaaaagcccagcccagctgagcattgaccaaccattaacagatgtcagagaaaagtaagccaatgaggtttactgtcaatttgcggattaagttattcacaatgcttataaactaagctatttacatgtaaactagcatctttgagaggaaagcgaggtagacatcaatacattggaacaaaactctcaaaaacctggattcaatgaccaaaggaaccaaagatctcaagtccagatatagatatgatgcttgtcagcggtagcaagaggtcctaacccacaccatgaacttgaaactaccgacgaagaatggccctgtaggatcgtcggtaccccatcctttttcaatcttgaccatatgtaaacagacccatcattagcaccagcagctatggagttttcatcagggcttatgcaaggcctgccccagctgctaaccactctgttacccatggccttgaattttccacaaacttccattgttctaggatcaaaaaggttgtgcacgttatcctttccacttgtaagaatgaaatttctattccgtgacacactgacagagcttacgtcaagatgagcgaatgtctgactagtgcattttgcacttcggatgtcccataaccgaaggtgtccatccctatgacccgagcaaagggtgacaccatcaatgaaagctagtgagttggcgttgctccctgacattatggtgcttttgcagaagcctgactgaagatcccaaatcttgatggtatgatcattggatgaactagcaagaacacagctcttcacccagcttgcatcaacggatgaaacattttttgtgtgaccagtcagagtgtgacgtgggcgccccccattaacttcccatacaaacaatttgttagagctacaggcagcaatcacaaacttgttgtcattagtcacagcaagatcattgacagaccccaaacagccttgtagagtggaggttaaagcaccggtatgtgcagaccaaatcttgacagtttgatcctggccaccactgattagcttgtctgtgttatgctggaaaattatagatccacagccaccatcatgagcacggatagtgattctgcatgtagatgggattggtgtttccatgatgtccatgtacccagcttcagaacgacgaatgatgccatcagcttcttgtagtgcattgtgttgtataccaccaacaccagctgacttcagctttagaaccatctcctcatacattgcatttgcctgaacaaaaaatttccccccatttaaactgataaatgcttggtacctactagtactgtgggaccagttatcaatgtaaagcatagtaaaatagatcttcggctactaaaacaatcatcgatatttagttagttcttctactcccacttatgctatagaagcaaaagagtttgaacatgatgtacatatagaattgattcgactgtcgtgactaactgttcggttaaatatcaagggggaagtatttgaaaactgtctaaaaagagccatttccgcagacagcgcacagtagtcaagcaaaattaaagagcaaaaatattctaacatagtaatttgccatccaaatatgatgggaagatggtaaattatagtgcacaaaatctcctgtgttatgtcatggaaagcatgatggtactttaagtatctcaattgtacatccactacaacaatggtagggatccatgcataacatgcaaatttttttcttggccattttagcctaccaggcccttaaaagggaaaatataatcttgatttgcaacaccataaaatagaaagctgcggttttagtaacaagaaaataaggtacctcattaagcctctctgcatccttcatcttctcaagcatccatcgatcaatcagattcctgttttcatcttctgccactttctgttttgttaatgcctgttcaagttcagctttaactgcctggtgctcctgaattataagatctaaagcgcttgttttttcttcaagcgactgcttgagctgcgtattttcttccctacaaaagtgtttgcacaaaatgtcagctgcgtattttcttccctacgaccacaaccaaacattgtattcaatccaatacctggtttgctcgagttcagtctgcatggtagtaatcagtgtttctttctctttaagcagcgcttttgatgctttcccctcttctatctcggtaacgagctgctcggacaaacgtgactgagccttgtagcattgctgcagctccaattcatgcttctcagccttctctttccactccaccgcctacaaggaaacgaaataaataaataaacaagcccaccaaaaaaaaaaaatctatgcacacaataatatctaaatttttgggtttcttgatctccagatgaagcatctatggtacttagcaaaagcatcattatcgaggcacggttttttatacaaaattttccattccattatgcaaagcaagaaaaaaatatatgcaaagatgggaaaaaaaaggagacatgagattggtatttttacttgggcggcgaagggccgggcgagcgcctcgatggccgggcggtgggcgccctcctcgacgagatgcctccgccgcagagaccgcagggctcgccggatcgcctccttgccggcctcggcctccaccatcgtcctgcacccaaattcactccccacttaagcagaacaagaacagaaaagaaatccatggaacggctcctgcttccaagaaaacctcacattgccgggtgcaatccgtcggcgaggaggtccggtggcttccggcggaggaagaggaggtcgcgtgcggcgggcgtgcccggcggcgaggtcgtcggattcggttgggggagcaccggcggcgagaggatcagaggaagacgaaaccggggaggaaagcaaaagcaaagcaagcgaagacggcttccgggccgcgagttggactcggacccgaccggatatggtcccggattgggcctcaacggcatgtgatcttgtggcccattaatggctcgcgtcggcctaattttgtggcccacgtaacataggcccagtaagaatcggatggaatattccggccttggtgtccacgcgagactttgcccttttattttctttcttttttttttcctttttcaa

SEQ ID NO: 1642 - DNA, 12513 bp, Oryza sativa
ctggattgctccgcacgcaatcggccctggtttcttcccggcggcgtggtcgtcgctgttccccacccgccgccggcgccgccgcagccggcgtctgagttgagggaggagggaggaacggcggcgcaatggcggtggctgcggcgctgctgcgccggagggcgctctattcggccctcgcgtcgccctcttggctccatggtttgtgctcgctttctctgatgtggcatgttggagtgtttcctttttcatgtttgttggaggtgtgccttgtgcggcatgtgtatggcgaaatgccaaaatgagcgtgcctcgaggcacgctcattttcgatcatggcaatggtagtatctgcgttgctaggtttctatagatatgctatgagtggtgtagtaggtctatgttgcataattgattagaaaaagaacagtcaaggattatataggtcagatgcaactctttttgggggaaaaggaaacgttttttcccctgtatttacaatttacttgttattctgatgaacggattatatctgttgagagatacttatattttgggaaacataaccttaatatattagtactgttgaacaccgcgaggaaaagttctgctttggatggacatttcgtctttgatagcgtaactaatttcagtggcaaagtccaatgttctgtaggacacatttgctcataacttgtggtttacatggtatatgcttctcatatagataccagttcctgctacatttgctccatttctggtacacattctttggtcaaccatcccaatttgagattacagaggggctaccacaactctgggaagtttgatttgaccgacttgacgtaagaatccatctttctagccttcttttacgtatatcgaagtcgattttcctacagattcctttgagtttatgaattttgtatcgtacattcaatagactccatgttttgacttccaatctagtgtgggatgcacaatattttagtttccttaaatttaccttcacacttgccatagtgaaatataattttcacatttattttacacaccacgatctagtgtagaacagttcatattctcctaaagaatctaaatattttacacaccacgatctagtgtagaacagttcatattctcctaaagaatctaaataaatgctgtgcttcttttgaataatagccatcctcatatatggtatccgaatgcccgagaaaagaagcgcaatgtatttttacatgtcggtcctacaaatagtgggaagacacataatgctctcaagagactagaagcaagttcttcaggtactactttgttctacttagtgataataaattaatatacaattatgatgatttctcagagctattgatgaattctgtaggagtatactgtggacctcttagattgttggcacgggaggtagctcaaagactaaacaaagctaatgtcccttgtaacttaattactggacaagaaagggaggaaattgaaggtgcaaagcatagctcagtgacagttgagatggccgacatgacaactgagtatcaatgtgccgttattgatgaaattcaggtacttcaaccttctttctgtagatatgctaattaaatgtatattcataatacaaacagtaattaagagaattgtcatcccatttttttggactacatcatcaagccagtcatattttttactgtaatattcctcatcattctcatgttatcttcttctgtttagtagatggttggctgtagatcgaggggtttttcattcactcgtgcacttctggggctttgttcagatgagcttcatgtttgtggtgacccagctgtggttcctctcattcagcgaattctcgaacctactggtgatgtggttacggtaatttcgttgaaactcacatagttaaattgaagtgtattaatatgactctgccagaatgatgttagttgcaaagttagatttgttgacattggtgaagacattaggttttgtggataacttagatgatgtaattacctagtttgggatgaaacagtaatactaaatcgcatgttcttgcaagtgtaagtttttttttactgttttcaaagctccatgcttaatatgtttcaactcattccattttaacttaagatacacaatgattttatggattatcattggtggatagcatcagcaatcctgtaacctctgttactcaacttatccttagccacaccaatttgaggtcccgtccaacaatttagattgcacccctggatagtaacactacttctggacctccatctgagaaagtaatgtgcaggcatgatgtcatatatatctgtcttttgttggtgattagctgatgttttgtatttgcagataatattccaagtgaactcgagaaactgtttcttctcaatagaatttgttgagctgtctaatgtttattttggtgttagtactgatacacgcatcatgtcgtcaaatattccgatttgctggctgtatgtctctatgcaggtccaatattatgagaggctatctccattggttcctctgaagactactctcgggtctttctctaacattaaggcaggggattgcgttgtaacgttctcacgacgatctatctatatgcttaaggttggcattcttcagataactgttgcagaatatactgaaataatatctatctgacctgtgtcctgcaattaaaagagtaaccaatagatatcccctgcaaattgttgccagaaaatgtaaataataagctgagaaagtctcattatttttttttggtgaaagagaaatgatccaaatgccatgtttgttaaacctatcatcgtaacttgatctttacctgtaaattttgaaacaacaaactctcaccagcataacaacacacccctctggcctctgcataccctcacgtgtatctggtactccactaactttatcatttcacttttttattctctccttcaaaggggggggggatcactctattgacttaagaaatgggacatatttctcgctatacacttaaactctttgaattttgattcacaacactacagtactatactagtatggttggcagtgaagggtactagatagcccccattacagaaatgatgaaaagacaagggaaaactatgtacgaacctgtaaagctacttaagtaatgcaactatgtacggaagatgtaggcatgtaacagggactagggagagctgtgttgtagtagtcaatatgataattacatcatgttgtgagagcagcgatagctttgtagcatgttttgacaggttggctagtccatcgataatttactttctgttttacataaatgcaagttgaaatctattaagtcatctaatcatgtttctttttgcttttcttctcatggtatttattgaatttaacactccaatcgaaagactggatataaagattgcaaatccatgatatgaaaaatatgaatcaattaagttagcttagccaggggcagatcaaatacacaaggatcagagtgcagtgaccatcatgtctgctgcacaaacccaaaaagattatgctcactgtgacattacaaatcattgttgatttatacccatggtgggaccctgataacttgctgccctagatctgcacttgaattaagcgactgcaaactaagatacataatgtaatgtatcaaagcatcctcatgttgtgattattacgaaaattaatcatctagcatatgaagtaatatatgaaagctcaactacatttcttatatttaaaatgtccgtgcagagaagaattgaaatggggggtaagcatctttgttctgtagtctatggctcattgccaccagaaactcgaacaaaacaggtacttccctcacttggttatctgctactacaccattgtagttgatgccttgttctcacgtctctaggtccttatctaattaaaatttacagctaaagcaccaaacgtttcatttttaatatattaacatgtatatgccatgttttgcttggcttatgctcaatatatttatattttaaaattccatcttgctgattttcttccattaataaagtttatttggtctctcatatctgagtcacatgattgtctggataatgttttgtacaatgattaaagtcagtaaaattagcggtgcagaaggattagaattttctgtttaatgtttgtgagatgaactttcagctagcaatttgttgattaataccccgtaacagtaaagcacaaccaaccacaaattttagcttgaatttcaagaaatcggtagttatggttgtaggaggcaaaacttctcttggcatgttgtgctttattcttgatgatgctgtgatgatttgaaaaagttgataaatctattccctgagcttgcaggcgacaatgttcaatgatcaagatagtaaccttaatgtgttagtggctagtgatgctattggaatgggtcttaatctgaacatttctagaatcattttctctacactggagaagtttgatggcatctgcaacagggaactaactgtggccgaaatcaaacagattgctggtattggatttgtttcttaatagttttgcctctggcagattaagttttccctccccccttgttgcacaggtacttgagcagtgaatttgagatattcttcatattgcaatactttgtcttcattttataggaagggctgggagatatggatctaaattcccagttggtgaagtgacctgtctaaattctgatcatcttccattactacactctgctctgaaatcaccttctcccattatagaggtgctcaccctgtccgatgtctatctctaataggatgagagctgcacgaatcttggtatagataacatgctaatactgcactgtactctctgcagcgcgctggacttttccccacattcgatgtattatctctgtactcacgattgcatggaactgatttttttcaacctatattggtaagctagctaaagcccatccttcttagtactgtatatggcaaattcctaacacaacagagaataacattatatatttatgatttagtgaattgccattgtactacataaacaatacaagggtgttgctcttttggcttttctaatttggatgatacagcaagctattcatgcttttataacactttaactgcaaagtattacttagttcttcaggtggttgatgaagtcatttataacttggcaactttttcagtggcatggattggattgcttctaaaataaaatttagtcatagtattaagatatcctatttgtatttgtttggacttcagcttgactttgcttctcaatagttataaagtggaatttgctcttttttctacttttctctgcctacctctttctcaattacttgtaaatgctgttttcaaccattaaatgtatgccaatgcttcctctggtcaggacatgcatcttacttatcttttcactcttatcacaggagcgtttcttggacaaggctaaactatctccagactatttcattgctgattgtgaagatatgctggtaagattctttccctcaatgagcaccaatttctatatttggtcaaattatctagaagtaagtcagttttccatctctcaactctgtccagagttcaaatttcacgctcaactccaaaaccatctgctttgcactgtcctatcaaaactgatgcaagtcatacttaatgcaagcccctcatccctccctccttccccctatttctcagtgctgtggccaggccaagcttggtagcaccttggtacagcctagatccaatgctgaactagttcaagaggaagctatgaggaataaaaaacctagccagttagcctgcatgcaatacaggaataaggttaatgagtctcatggcaatatagcaactgaaatcgagagatgaaaccaacattttaaacaaaaaacaaaagcaatgatgttatcagattgatttggacatcagtaaaggaggatatttgcttaagattaatttccggttgagctttgactgttgtaactgttggaatctctgattttcctcctacatactccctctatcccataatataaggcgtgcacatatttcaagattcaactttataaacatttgaccaacaattattataatataaattaaatttttatttgctaaaattaatatcattagattgacatttaaatgtactttaagatggttataattttgttgcaataaaccttataatatatgagatattataagttaaagattagttttgaagactatgccaagtttgaccatgccttatattatgggatggagggagtagtatagtaggaagaggcaagaaaaactttctggccatgctgtttcgatgagcttatcaggctaatgtgaagcacacaaccatggatgcatcagccgttgtgatctctttgacatgttcatctttcctcatctcaaatggtatgggaaacagatctggtggtgttttccaatggtgtgtttggtggcttcagcccagcttgatgagaggatctttttgccatgtcatgaaacagttgtgttgtttgccctgcactgttagtgcatgtccaaatagttgccacaccatgatacttttgtagcccagcagtattattctgctaactgactcatgttggtgttgctaaaaggttcaaattaggaaataagatacatacagtttcatatcaaaattatttataaggttaaagaaatcctttgacctagaggagctatggagaaaggaacgagggagtgagaataagagagaggaggagaaagacaagtcttgtcctgcttggcactgctttttctaaaaagccaaaattatgaaatgtgatttttgagaataatttaggtaggtttttttcagttgtcttcttagctatcatgaaaataaggctgggcaatggaagtggtgaagaaaaatcccctaacaataattctaaaatcaaatcctaaacttacaatgagacagctttgctaagaggaataagttggcagcggcagcatgcctcttcatgactcagcattcacatcggcatagtacacatgaatataccacttgagcagttcacccgtttaaggcatgggcattgtttctatgcatagttttttagctagaggtataatttactcagtattaggtttgttttaatgctctataaggacttctatggaatgtcaaaatctgatctcctgggtagaacagcattgacagcctactatcaaaacacaacattttagcaaaatgttaaatttataatgatagtgaactttatcaagcatattttttcctattgagttggaggttcaaacattttgcttaaagtaacctttattcctcatatttttaacagaaagttgctgctattgttgatgagctaccacttggactatatgataaatacctcttctgtctcaggtgatctgtactactatgaacctataatcctatatcgatccatcaatctgtcctttttgaatgctatgctttttggatatctttctccacaactgttgtccaaaatataagctcagttatacacatttgacactttataatttgtatcgcagtcctgtggacattcgtgatgatatatctactaaaggattaattcaggcaaacatttttgtactactatcattcagttatgtgttttgtggaatcaggaaacaatttcactgattttttttgagatgcagtttgcagaaaattatgcaaagaaaggtattgttcgactcaaagagatatttacacctgggacactccaagtgcctaaatcgcacaatcaactgaaggagcttgaatcgattcacaaggttatttacattttctctctccagtataaagcagtactagtacattatcttgtgaaggatttctgctatgcatattatttcattctgtaaaggttgctatccatctgtcccacagtcactttctatttctgtgtaccattgtccccaaacatttgtacaacagcattgatcatgccagtcttccatttgttacaccactgtccctaaacagtctgtagatttatctctgcaaacagtttgtacggttagatcgatcactatgtcaaacggttataaatgcaggtgctagagttgtatgtgtggttgagcttcagattggaggattcctatccagaccgtgaattggcagcttcccaaaagtcaatctgtagcatgtgagttgcatgcagggcttacttttttttttttaatttgttttactgataaattctttggaggtcttattgctggcaatatcaggttgattgaagaatatctggaaaggtccggctggcagcaaaatggacgaaaggactttttgcagaagccaaaaagactacaccaagaatatgatgcatcacaattgtatgaactttttcttttattccaaaatgcacggtattattttcatttaataaagggaatgactatgctagaaacatttaaacttaagtctcaatctaactccactcatgatatatacctgatgtgtctgaactgaatatgcatgtactatagttgctctgctaatttttttccctgcacttttagcattttgcatcagaaaatatacctatgcctatgcaattgattctctattaaatggttatgatgacttgcgttgaatggtactcccacacttgtgggagggcagagaaataagctagattccttataaacttttaaagaagttacaggttgtatatagcattgcaaaggaacatatgaagttctaattatcgaattgcaatatattttcatgccaacctgctggcagagatcattttgctaatttcgtttttcttctcttcatttctttttgatgaaaaattgctagtgggattgctacatttagttttcagtgcctttgtttacttaactctcttaatgaacaggcgcaaatattttcaagaaattgatgtgagatcaaaataagatgcttatgctagaaagtcgcctcacaatatctgcttccggacaacggatttgctcctgtttgcatacgttatggtcgaggagaggcgacaagccgacaatacattttatggatgacaggagtcaaaagaatatcctttgccgacaatacattttatggatgacaggagtcaaaagaatcatcctttgccaaaaccatttaattggcctaagcagtaaatgtggcagcacctgtcctccatccaaacaattttgtagctattctttcattacactttattttaattatttctaacacagatggagctgtacatcacgatgaaacgtctaaatgttcgttaaagttattaacatagacaggacgaagccacctgtaaactttgcggttgtaactctttgtgttatgaaaggtgtaaatatgtcaaaatgacagttgtcaagtgatgtttcttgggcagctaaacacctgatttgtgcatgccaaatcgctttcctgtgatgtgccagcaacatgcctatatgtgccagagcgcaagcaaaacttcatcatgaatcaaccagttgccttctatctcattgtatcagacgtaaaagatgatatcagttgttggtgatgaatgcccttaatgcttcattgaaactgctattatcaatgtactcagtagtttctactcccttataagttgctttgactttttttggtagtcaaacttttaagtttgatcaagtttatgaaaaatttagcaacatttaaaacactaaattagtttcattgaatctaacattgagtatattttggtaatatgtttgttttgtgttgaaaatactactatatttgtaaaaatttagtcaagtttaaagaagtttgactagaaaaaaaaagtcaaaacgttttataatatgatacggagggagtatgcaacatagcagtaactgtaacaattgaaaagtaggatagttactgaatcacagtcgcatttgcataaacattccaatgagcagtacatattaagtttgcataaacattccaatgagcagtatattaagattcatgaccacaggtgttgtacaacacagcacaatgttgtccaccatcagtgacctctcattgaaaggactccatatgcttcagatttgttacctgcgtcctgagaacttgaatctttttgtacactgactgcagattcctcttctcaagcttctccatcacaagatcaaatgtctcctgctttggagcaaaaccctttgacaccatttcctccaagaacaggcaagactgggcaaccttcccatttctgcacagccagcttaccaacaaggtgtaagtgctgaaatcagggctaatgtcctttctaaacatatggcacactaggaacagaagtatctttacccactgtcttttacagcacagcttcagcaatggcgtgtatgtctttatgtctggattgcatgactgctcctccatcttaaccagaagcttcagggcattctctgcctgagagtggtcacaagcagcagaaatcaaggtgttgaaggtagtgacgttaggggcgattccagttgtgcgcatttcttcaaccacagagtatgcatcttccaacctcccagctctgccaagtatgtagatcagggagttgtagaaggaagcatctggagcaacaccatcttccttcaacttgtcaaaggtatccaaagcttctcgcgttctcccagccttccccagtgcatgcatcaaaatggtatatgtaacaacatttgggggacaccgcctcttgcgcatctcgtccaagagagcgtaaacagtctgaaaatctttctccatgcagtatgcttctaccaggctggtataagtcaccactgaaggactgaatccatgctgcttcatctcctccattgtgtctagagcttccttcagcatccttgccttacaccaaccatgcacgagagtattgaagctgttctcgtctggaggtattgttcccctcagctcttggaagacgcctcttgcgcgcttcacgctcctctccttgcacagtgtgtccaggagcacattcatggcctttgtatccttcacaactccaaaccgatccatcttatggaaggcgtcgatggcctcggtccatcgacttgccccagcaagccttctcatcacctttgtcatcgtcatgagcgacatcaagcctccaacctcaaccatctgattgatcaaaccccacatcagatcaaactgcttgaacttccccagtatatctaccatcaagtcatatgaatcggcacaatggcagtaccctccctgagtgccaacccacatgaagaacccgaatgccgccacccaatcattgctgaacctcgtcaggatcttgtcaacaaggcagccagtgacccttacagagcagcagtccatggctatcataatggcctcaggagacgcgaaacgagcactaaggatcctgctgacctcatcgatgtcggcctcgaactcagcatcctcatgggaggcagttgcaggaaagccagggcggatcgacagcgacctggaggtgctgctctggcttcttcgctcatccgagacgttgggttcagtcgggagcacaaaaatgtcgtcctcctcgtcatccaagccggcgcatgagccatcgtccttggggttcctgaaccagtcggggaggtcgaacccggtggtagagaagcgtgtcgcggagagcctgccgccgctatgagacacgaacttgagagacggagggaaaaaaattcggccgcaccggcgcataacctctctctggcttggaggagaccaggtgggcaaatcgtcgaacacctctcgtgcgcggccaaacaacacctctctgaatcctctctctctctctctctctctctgccgccccggcggccggcgcgacctcaagtgcgggcaaagactacagctcgggaggtgatgagatcgagcttactcgatgcgtgtgaatggcagcggcgcgcgcagaaggtggaggtggagattggggagaaacgaagcgggagaggaggggggcgcgaaccgcgaataggcggcgtcttcgcccaaacgcgcccatgtccggatcgtgcggccccgtgggaagcgcataagacgacggcgaaggggcgcgcggtcgccggccgagtagatggatgcacggggacgcgatatgtcgccggacctcaccggcgccgatccgggaaggcgaaggtgggacctcgccggcgcgaagaggcgagggaggaaggagaacttggaggcggcggcgacacggcggtgggatctccgacctcgcctcgccggagctcagctcaccggaggcggacggagcgggagaaagagggaaccaggagaggagacgggatagcgcgagccgcgaggtaatgggctgggctggtatgggctgggtcttaaagccgcaaaaccacatggcccaggtaaaataggcccgaacataaccaaatatgggccaacacgtaagctgcaacgccggtcggacccaactagaatgagcag

SEQ ID NO: 1643 - DNA, 10815 bp, Oryza sativa
taccacctctgcattgtctgtttccaagataacaggcatatgtatccattgcaacgcacaccggataccttcaaggcttgccaatgcctctgcctgttctgcagagctacacggatgcagtgttttgcatgccgctagcaggatgagacctctgcaatctcgtattactattcctgcactcgcttccccagtttccatcctgaacccggcatcaacattaattttcgccgctccatcaggtggcgctatccatccgctgctctgcttttctgccatgtgcttctccttctgaccttcactgtacattggcttctttccttttatgtcatcaggcatttgtcggtttgggagcagtacctcctcataactagtgagaaaactcactgagcctgctatcgagcatctcccatcaccatggatcaggtcatttcgcagataccaagctcgccatagcatgtacataatgtgagttctttgctcttcgtttacaccatctaacagaatcaacaaccaatccggtcctgtccataaaaatttgtcttccccaggcaagtgccaaactgctcgcagggcttctcttaacgctctagctttagtgcattcaacagttgcatggtaactattttctcccttcgttccacagactgggcaggtcccattcatttcaattttccttcttcttttattctcccaagttggcaatttgtcttgggccagcttccagataaagatttttactttggcctgcacctttgcattccatactctgctccaaatcttcctttcacctgatgtagcagtgctagaagaggattgaactacacctttccctgataggttccaagccaacttgtaagcactcttcacagtaaatagacctgacttctcatggtgccatgccgggaagtcatccatttgatggtttggaagtctgattttcagaacctcattcgcatcctcctctttgagaacatgtcggactagtgtctcgttccaacatctgttctcttcattaatgagctcattgacatagataagtctatttcttcccttcttttccaggacattgatatgctccccatgtggaacccatctgtgtcgccatatctttatgttatggccatagccgaccctccatatggtaccttgtttgagcaggtccagaccatgttggattcttttccaaactgacgatgacactgttggagaggcagtgtccacaagatttccattggggtaatatttcgctttgaacactctcgcacacaagctgtccggggaggtgagcagcctccaagcttgtcttagctagcagtgcttgattgaagcacttcatatccctaaaaccaagaccaccatgagatttgggatataagatcttttcccatgctatccagtggaccttcctttccccattatcatgtccccaccagaagttgcgaaccatcctggtataatcatcgcagaatttatctgtcatcttgaagacccccataatataagtaggcaacgcttgtgccacacttttgatcagtacttcttttgcccctgacgacatatatttttcattccaatccgacatccttttagataacttatcatttatcggttggaactgttctgctttcatccttccatctggtgttggcaaccccagatatttctcctcaaaggttgaactatgcacctgcaaggcactctttatctcatcttgacgttcttgtggacagaattcactaaacagcagagagcacttgctaggattgataagttgcccagtgctattttcataagattgagagctttttttattcttctagcttgctcgacctccgctttgaagaatagaagactgtcatccgcgaacaacagatgcgaaattcctggtgttgcccggcaaatcctgataggctggatgaggccatctgttttgtatctttccaagatatttgatagaccatctgcaatcaagaggaataggtatggactcaatggatccccttgccggagtcccctcgttggagcaaaaggatcaagcaattctccattaaaacgcacactgtaacgaactgaggttacacataccatgatccatctcctccatttgtcacaaaagcccagtctctccatcacaccattcaggaattcccaatcaactcggtcatatgcctttgaaaggtctaactttagggcacaaaagttttggttctcccgtttacaattcttaatagaatgaaagcattcaaaagctattagagcattatcagtaatgagtcgccctggaataaaagcactctgagcttccgatattatctcttgtaacataggtctcattctgttaactaggcatttggccaccaccttataaaccacattgcataagctgatcggtctgaaatccttcatatcctccgccaagttcttctttggaatcataactatcactgtatcatttacaccttcttgcattacttcatcctcgaaaaaattcctcacagctgctatcacttcgccctttagcagaccccagtttctttggaggaatctggccggaaatccatccggtcctggggcttttagcggacctatttggaacaaagcatcacttatttcttcatttgtaaagggcttaatcagatccgcgttcatttgctcacttatcttctcatggaacatattgagcaagtttaccgggttcaagttatcatccttggtgtatagctgctgaaaaaaacttcgatttatttcccttcatcttcttcttgtttaatggtggcgatccatcattctttttcagctttttgatcttgtttttcttagctctccaggaagcttttaggtgaaagtaccgtgtatttagatcaccttctttcagccacgtgatccgtgagcgctgtttccaccatatttcctccctgtgtaacatctcttctaactccttcttcacactatggacctcgttatcagtgtccagcagtcctatgtttctcaattctcctagcttctcccgtaaatccttgattttcttccgtacattccctatcttgtctttgctccagctgacaagcttggtcatagtgaccttcatcttatcattaatatcacccaaggtagatgcatcagcacccatcgtccacgcttcctggattacctcaggtagtgatgactctctctcccatacttcttcatatctcataatcttcattggtcttgccaatgttgtttcctctctttcgagaagcaaaggtgcatgatctgaacttggagtagttaaatgtgtaatgacagcctgcggaaagcgcgagctccaggcaggagaagctactcctcgatcaagcctcactttaacattgcggccctccctttgcatattacaaaatgtccatggggcaccctggaaacctatatcatgaagatcgcattccgataagacctctctaaagtctctcatctgtgattcagatcttttcctgtgagatttatgctcagtctgccacattgcttcattaaaatcacctatcatcaaccacgggtctcctgaatttgatctgattctccttaacaagctccacattagatgccggtcctgggctcttggctccccatagacaaatgttgctcgccatgtgcagcaatccagctccgtgatcagaacatctatgtgtcgagaattgtaagatttgagaaccacattcatactttcattccagaataatgcgagcccacctcctttccctactccatttactgtgaaacatcttcgcaacccaatacggttttgcaccatatattggtcttgtctagtttccgcaaggaaaactattttcggacgatgtatctgtaccaaacagactaggtcatgaactgtccgaggtcgtctaagtccccggcagttccaacttaggatacacattaggcccggcggtgctcctccgaggagcccgccgatgttgccaagtcgctattattttccccttcattcttgtcccctcctttctattcatctctctctcccaccgggaatacttgcgttaaccctagcttctcttctatagttggaataaactattctcttattttcagagctttaaccttaatacaagtactccctccgtttaaaaaaaatccaattctaagtataaattaagtatttatacacagatgtttccaggtacatacccaaaattgagtatttttccccatgtcccaagttgatcctaccctgatttgaaacacacaatgttagaaaaaatatatatatatatatatatatgaatagaatgtcacgtcttattgaatctatcatacatgcagttaatcccgatgaattggttaaaaatattagtttggtagcattattaaaaaaacatagatgaattggtaaaaatattagtttggtagcatcatagaaaaaaaaacataggaattccgagaaaaaaaataaaagatgaggtctatcaactttctaaaattcctttaaatttttttatgaaatgaactatcccataagaaactcaaaaggattttgggaaagctattcctttgtttaaaaaaacatgtagaactgttttccagaagatttctttaatcccccaaatttccccatttctcctctgttttaaaggaaactcaatttttgcctttttcttgtatcttatgaacaatgcatatgcttcttatcatattagttcaagttcatggccagattattgccttttttttttaccatgaaacggttaatagttattttagctttacttagttcttccctttttaccgtgcaacgggcagatggagctaagttgattctaaataacatggtgggccgcgtagattacgcggctagcatattttattattaaaacatattaaaataacaacatagttttaaattttgtactaattttatcaaattaccaatgtataatattcgtattaaattttaattatttctaaattgtattcctatatggattctaaactcatttttcaatattttttattttttaattctgaatttttattgtttataaattatattcctatatttctaatttttaaattaaaaattttagttatttctaaattatactcctatatgtacattagactcctatttcaatattccattttttattctaaattttcgttattagtaaattgtatttccatatggactctaggctattcttccaatattcctttttttattctaattttttattattttaaattgtatttctatgtggattctaaactcatattttaatattctttattttatttaatttcgaatttcagttacttctaagttgtatttctatatagactatatactcttctttcaattttttttaaatttagaattttagttatttataaattgtatttctatatggactctatactctacttttaattttactagaaaaatgcccatgtgttgtaacgggtgaaggctattttaatcttattattgttgtacggtataggagccgcaattagggaccaatcgtctcaagttagcatgcaagttgtttaaatagatttcttatatgactcatgtattttcaaaaacgaacaaaattaaaatcgattcaaacacacatatgtatttccatttgtatgtccaaaagcgattaaacttaaaaactgattcaaacacggatgccgtaccaaaagtaccggcaaaaacatcttcaatttttataatagtagagattaattttattccaaattttatttaattctaaatttttatatggactctatactcttcttctaatatttattatttcttttattccgaatttatattatttcttaattgtattcttatatggtctcttatactcttcttctaatattatttattttttaattccaaatttcggttatttttatatggactctatactcttctttttaatttcgaattttagttatttataaattacatttctatatggactctaccctctacttttattttttcatatttttaatttctaatttaattttcattagttctaaattgtatactggtatggactctagtctcccctccaatatttcatattttttaattccaaattccagcttgtatttctatacggactctaatactctatactcttcttttaatattcttttttaacttcgaattttatttatttttaaattgtatttctatatggactctaacctctacttttaattttcttatttttaatttcgaattttattagttctaaattgtatgctggtgcggaccctggtgtcctcttctaatattctatattttttaattctaaatttctgctaattttatattatatttatatatagattatgtttttacattactttaataagttaatagatttttgtttgatttgaatcaggtcggtctagcaagctacaaggtgatgcctcgagttggggatcggacagcgctatcggcagttagagtcggtgccgagctgatatatctttgttgcatcaccgcgggaaaatatcttcacctcgtgagaccacgggggattcgtagagtggcgcgtctagtactgttattcgtaggatcactttgtcacgacattagcttttatcatttagtacttgatacaattaattggcctaatgcacggcctgaccggagggattacgataggttacctctgctttatttgatttttgactaaattaaacaactagtgaagaagaatcttaaagcttatatcttgttatctgattacaactagtgaaaagtaatgcatccatccaacgtcactgaggaaaaaaaaaggtaatggtctgtccaatgttgttccgtcgatcgatggcatgtgttattaccaagggactttttacttaaaaggtttcgttgcgcacagataaaaaaaaaatactaccttcggttttaaattgccgctgattttttaaatacgtttgatcatttgtcttataaaaaatatgtaattattatttattttattgtgattatatttgtacaaaaatttagaacaattcaaatggtaaaaattaataacattaaaaagaaggggaggtagtactttttatgtttacgcttcatatgattcacttgatcgatcagagcgcttgaaaatcctggagcaaaaaacaaacacagcctgaaaagaaactcattacgaaatcgttggattactgtcttatttgcacttcacttgttgaaaatcccaaatcattgagcattaaacaattcattttggtcagatggcatgcttaaaatagttagcaagcgtataataatgcacatgttgacatggcgtcacgtgcacgtcaactaaaagtgatcttggctgttataatgcacgtgttgacatggtgagcagtgagaattttttaaaattttttagacttttttattttttaattttattaatagaccaaactaaaaggtatttttcaaatttgaacattttggtcacgacagctcacctgacatggctaaataactatgtcatgtcaggtgtaactggtgtagtagtgttgtttggccacgccagcctcgacgggacagttggttaagtgattcaactagggacaataaggtatattcaaatcaacagaagggctcaggatgtagagagtggcatggttccaaaattagctgatttataatggcatgtttgcaattcaacaaatagtagtagcatttatcaaaagtggtaaagttttttttttttgggaaaagtggtaaagttataatagcatggatccaattaaccctatctgatattggggatatcatacagattcgatgtaaagttgagggatggtatctgaacttattttttttccgagctaccaaggcgattagggcgcggacagtcggacagatgagacatggcctgggagcctgggaggatcccaagcaagtaaacggaccgcgtagaagagcttggggctgggaggaaaagaaggccgcgcagggcagggcaaggaaagagcaggtacagcgggctaagggtagtcccaaccctccacttaggatggtgtctatggtattaactacattgccacgtaggacttttagcttatgtggcactatattaattaagagagagagtgaagagaggaagaaactgggtctcatacaagacagcttcaacacgagaacctatgcactagacactatcaagttttacattgggagagatagtgttttcataatagatgaagattaaatacgattggtagaagagagatgatatatttattaatggtacactttaagaaaccatgggttgtagagtgtagtttctattgtgatgtcttattgatatggcaccatagacactgcttatggacactatgggttgggactgccctaagagaagacagcctgttcagcacagtatctttttgtattttcgagtgggaattttgggaaaagatcgatctgaacggatttggatttggattaaacaaaatgaataggaatcaaagttaaaatctcattgagtgtttgaatttgaatttttgtagggaagggaaaggatttgaatatctaaactggactcttttttccccttggaacatactcctaaacctatatatacgtatgtacgcacactcattcatatcaatacacatcctaaacctataagctctcccaagaaactgaaccagtataaattagcaaactcatcataggcaattattattattattattattattattattattattattattattattattattattattattattattattattattattattattggagtacggagaagggatttaaatttaaatctttttggtaatcctctaaacagcagttgagcaacgacgaatccttgatcacagtgtaaattcgttgcgcgcgtcaacttcattgagtacgtgcgtgaccgaagtgaaattaatacgtgcgtgccgtgattcagacgtgattaatttatcggaagtaaccaagttggaccgaacatgttttacgttaaaattgtttgttcgagagttcagtaggaatacaagtcgtcacctctcttctttgaggcgttgcgtgtgtttgcatgcagccagagagtcgtcaattgttcacgacatgactacatgtgcactgagtttgttcgtgcgtggtttgcttgccagtggcggagccaggattttaaagttgggtattcccgtctaagcgttgagccgttggccgcttctacccctcgcggctgccggccacccaaccggcctgactgcctgagcttggcggagtggcgggcgccacccgctacccgccgcggcaatagcctccccctccgtggtagcgcggtccagttctcgccgccagttgccgcctcgccgcgccgccgcctagggtttggaaatggggagcggcgcgagggagccgagccagggagggatgggtcatggagggagagcgagagggggccgtctggaagagtggtggctaagtggatcaactgatgtctgatgggtcatataggccggttgggctgtgtttggatcgaagaattgaggatttaggtgcactaatatatgtacatgtgtatagggctatgtttggatcgaataattgaggatttaggtgcactaatatgtgtacatatgtatatattagaaatatacttgtttttcgataaaaaagttgggtattcccgggaatacccgagaatcatggtagctccgcccatgttgcttggacggaggatggcatgtcatttgttatcgtggcctcgatcgtactatcgttagccaacattcgcatttccttttcagatgaataggagtacagaaagcagagacttaaaattcacttctattatccaacgtctccaagtcgcaacttgggtgcgaccgtgcgagtgcgattgcaccggaaaagaatttggtggagaccgcgcgcgcagccaaatcacatgtcctctgctgctccaccacggatttatcgacatgtggataacgtatcaatcggacgggccgacggggtgctccgatgggctccagggctccaggctcagccgagcgagagcgatcgggaataagttcactttgactcctttaaaagtaactcgaatctaatccatgaccctaaaccacaaaaccggatatctcgacccatgaactattgaaatcggtgcaatttgactccctaggcgattttagagagcggttttgctgacgtgacacctacgtggcggtattgaccgggtcttctttacacgtggcattgacgtgacattagaattaaaaaatatacgtggggcccattagtcattcacacaaaaagaaatgtgggccactaacatgtggggcccacgagtcagtcccctgtctccttccttcttcctcctccctctctcccttctctctctttctctccccttcttcttccccttcgggcggtggcgcgtggcagcaagcaagcccgtagcggcggtggcaaaggaagcggtgaaggacggcgggagcaggccgacggcggcaagggagttgggcggcgagtgggggaggaggtaggcggcgcggctcaccgcgaagagcagggcgatgtggtcgcgacggcggggatcccggcgagccgcacagacaaggggtagcggtggcgcaccggtgcgagggcggaggcggagcacacggccggcttgcacgccatggcggtggtggcggccgtcgatccgcccgccgcgccatcctttttggcctccgccgttccggctccccgcacgaacacggggccgccctttttgagctcaaggaaggcgaaggagcccttcccctgctcccactcggtct

SEQ ID NO: 1644 - DNA, 17329 bp, Oryza sativa
  unsure (1)..(17329): unsure at all n locations
catattcacccatgggggagggaagggatggataagatgcgtttgcgggcgatggcgggctctaggtcgtcggagagagagaccgcgaccatggcggctaccgcggcatcttcggctatgggataagcgagggtttgggaggagccggacgtgtcgggcggtcggcggtgctgttcattctggcggtgcggggatgaggcgtgacagctccgccgctctctcgccgcggcgctcagcatggcctggttgtggtggtgttggtggcgctcgttgttgccgctgctcgtcgcgccgcccttcttcgcctccgccgctccggctcccagcacgaaaactgcgtcaggcagctcccgtcgatgctgctgccgcattggtggcggtggtggcggcatggggacgaaacgagtcaccagctccggcggcggcgcctacaggacagcaccggcgcggcggaactcgccgtcgacgacgcattcgggcggcctcttgtcggtgcgtaggtcggcgccgggtagcggggcgaggacgtcctcgagggcagcagcgccgtgggtgggtgggtcgtagacgaaggctagcaacgcgtcagtgaatgacaaatgggtcccttctataatttttaattctaatgctacgtaagcgccccgtcaaacgccacgtgtgatgaagacccggtcaataccgccacgtaggcgccacgtcagcaaaccgctctccaaaaccgtctagggagtcaaattacactggtttgaatagttcgggggttcgagatatccggttttgtggtttaggattatagattagatttaggtcacttttaagagagtcaaagtgaacttattccgagcgatcgatctgtgcgcgtgcggctgttggctctagaggctcgatcttggcccgcgcggctcgatcccgtcaccgccgcgaccgacggaggatggacgcctccgaatccacattcattggcctcctgcggctcgcgggcaccgtccgcgtcgtcgtggcgacgcgctggcgagggaagctcgagctcttgtttcttgtagatgagacgggtgtgcacgcggcgaccgaagtagtagctgctagcctgtgcgtgctgcgtgtcgttgtgcccgtcccgtgtgctgtacctgtactcgtctgaaaatcaaatttcaaaatcacgatcctccagagcccgccagccgcacgggagccgagcggagcgcggcgccccgtccgatcgatacgttatatatccatgcgtcaataatctagcgcgggtctgcagaggacagggtttgcaccgagtctacactctacaccaaattattttcccgattgcacggttgcaaaaagaaaaagcaaagcgtccgcgctcaaaaaccttaacgaagcccctgctcgctgcggaagctgcgcctgcatgccgacaccggctggatcccctgctctcgcttcacctcgtccctgaacgataacccctcgacgcgcaccggtcacgcccactgcagcgcgcgcggggatcgttgctctggctccggtcgccatgggtaccaccaagtgtacatagagtgccactcgccgtggtactctgcgcatgaatgcatggtgcgtgtaaacggagatgggggcggaacacatatatagcagagcacacggtaactggttcgtggcgagagagtgcggaaggagactgccgtggacacggcacgtcgactgaatgacttcatggaaacgacagttttagcctttgacatcaaaatgccatttcatccagcgagctgtgggcaacaccgggatttgtaatggcgggcgaattcgacgcagagatcgcgttgcgacatgactgtgcagtgcttgggcgcggctggtcagtgcaacccgcacaaaatgcaaagacgcgaccgatctcactcagctcgatcgctgaggtcgaacaattcagcagtttaatccaaaaaaaaaatcaccgagaacaccaccaatccggaacggcggatgacataagcagaaacaaaaaacacagagcgtttcaaacgaaaaacatagcagggacaacttccagtagcaaaaatcgcacttcctgcaccgcgacatcacatcacaatgaatcagcatgttttacaactatgctaatagatgatccggacgagtgtcccaagggcctgtgaactttgagcgagataccgatcatggttgctgttgctgaggcggaggagctgcgccagcaaggaaaccggcaaccgggggctgtacgagagctggaggcgggaggttatcgccggcggcgggcgggggtgcgtgcgcgtccagggcggcgtctgctgcctgtatccggtggctcagctgctgcatgaatatgcgctggttaacaatcaaagtctgaacaaattccaaacaaatggaatccatctgaactacctacgaattgaaagggaaattcaaacagcaaatcacggcgaacaaatcccggcgaatagacacggcgaacaaatctcgaaaacacataaccgattcgtggcgaacagacaccaattcgatccaaactcagcaaccacaaaatcaggattcaggaggtgttggagagggagacgggattgcgtaccgatcacagcagcagcctccgggatgtcgtcgaggagctggaggagcccaggtggtggcgcctgcgtcgggggggcacgggtcgacaccacgtactgcggcggctgcgcctgacgaggacgagacactgggcgacgccgcctgtagtggtagtaagcaaccgcacaggcacaggggatgccgagtacagtcgtcgctacggccacaatcaaactccagggaaaggcgcggccaccgcgcctcccgtgccgccggcaaccggatccgccgccgagtccttcctctccccgaattcgtcgtcctccctcttccagagtaagatcataagcctcctcacaagcctgtagaggaaactaacgatatcctgaacttgctctctagtcattttcgacgccggcttcttcaagcgatcgatgactcccatggccatgcgccagaatgcatgaatacgtggaacgtccataaggcagacgccgcgttcgtcgtccggcggcggcgaagaaagggttgcggccaccacgccgatggccgcgtcggggggggggggggggggagcaatcgctgggcgttgcggaggccgaggatcgcgtagtcgatggcgttgccgaaggcgaggaagaccctgccaccgtcgtaggcgccgaagtagcgcgcggcgccacctcgcgcgcggtccaggagcggcctgatctccggctgcggagcgacggcgacgcgccaggagtggcagacctgggccatgtggcgccaatcgacgggggatgggaggagctcgtggatgaggcgcaatgtctcgtggctgagcgtctccattgctgaggtggagaggggggcgaggcgagcggaggagagatggaatgccacgaggaggcgctgcgctggggatattcctctgcttctcgaagcgggaggagaagatggtggtttggtttggaaggaggagaggtggagcaaccgatctgccttgggccttatttattggcacgtaggttcctcgcgaggaatgttaatgggctcgaatttgaaacttatccggcaagatacttggggaattcttataggggattcagttcatttcaggtcccttaacttgactgcgagttcgacttacgtccttcaaccatataacgggtccctagcttcccgcgaggataagaggaatgggctaccgtgagcctccctctccagctgccacccttctcccttctccccactggtcggctacacaactctcctgccacccgccatcgtcaagcccctactcgccgcacacctctcccaccgacctctcctgccgaccgccgcgagcctctctcaccggaatagtcactcgtcgccagtcgcctctcccgctagaacgagcgctcgttgccagctatcaaagtggacacgtggagagagatgaaaagagaagggagagagtgaacttaattgatttatcacgttgactaagcggcgctgacccgattcaaactaccatgtcggataaaaccacccactatactgtgtaaggacctatgttgtacctgttttgacattttaaagatatgttgtatctggttttttagtaggatggaactcgaattcgttgtcaagttaagagagctcacaatgaacttattccatcttatgggcgattagcatcggccttataaggagcccatgaggccatcaacgcgatgaagagcccaagttagagatcgaatgacacgaggaggcactgcacaaactgagagattagaattggataagcctaactaactaattaaccagcttgtcctgcaagacaagcacaagacacgagtacacgactagtagctcctccttttctccctctacataagccggcaaattgagatgggagcgcagcgcaccatttccaattcgcctcgcccgcactgcacgtcgccagttcgccacccgctccaccgccgccgccgccgccgccgccatggactaatatgcacacgcgttgccggcggtgaacgagcatggccaccctcgctgttccggagatcaatttcaagcaaggcgatgccaactcgtttgatcctctatgtacgatcggtgaccgcgaggaccctgtgggtacgtttctctcctcgtccttgccgccgccgccgccggcgaccacgtgggtgatcctggcatgcgtcccgagcgtgtcctcttccgacgacgacttcaacttctaggccggcgaccacctcgcccgccttcgagtggcgcgatccgccgggcggcgggcgcctccctcctttagatctctgtctcccccgcgcctcaggacttctgcctcgaccgcgacgatcaccccttgtcgtctccgtcgactccgcgtctccgccggccgactcctgctccgcagcgcccacgatttcggccccggcggcgtcgcgctcggcttcgaccctgcaccgagctgcgccaacgatggcggctacatcctctgcgacgcttggctccgcacggccttcctctacccgccctgctccgacgactaccggctcctctgcgccgggaacgtcggcatgatccccaggactgcagcggatggcaaacaccggatccgtttggtggccgagctccagcctgacatgcgcttcgtgccgctccctgagggatgcaagctaccgcgtactccagcgatgcgaaccccccaagccaagtaccggtgcgtgaacgtgagcgacggtgagctgacgttcgtgcagatccacgacgacgccgccggcgcgccatcgatgatcatgatcagcatgtggacgctgcagttctgacgcgggggagaagttgatttggtcgatccgccacgcccacggggtgcgcatcaaccagatctgggaccacatgacacatatataccggaagaccatgaatccatgatgccgcggcgcgttctggtgctcgcgctcggtcaccccaaggaatccggcgtggttggtgttcttccagatcacctcgcggaactcgtggatgttcgccgtcgacgcgtggccaccagaagcgtgctcgcgtgcaagaagtagtacacgatgccgcagctgccgacggtgtaccactcctctcgctacgacgctacgtccgcgccacatggagaagatgatgagagtatgaggcagatgtgcgtatgcggcgctgttctttgctccatggcatggctgcatgccagtcacgtcgcattcgccatgcgcgcgctatcctggagcacccctccaccgacagcttggcgtgcccccctcccctcccccggcgacgaggtccgggccgctcggcgccgtttgcacgcccgcggaccgctaatgtcatggcacggcttggcgccgccctcgggtgtgccccccggctggcgaagcaggagccgctcgatggtcgtcaccgcacgcgccaccagctcgctggaccgcctttgccgtcgttccgcttgctcatcgccggagaggaaggggatcgggagagaaggatctgggagctagggttttgcccctctcggcgcttcatccgacacgaggacgatcggggccgtctatcagatcggacggcttagattcaccccgcgtcaggccgccgctaattactcagcccaatgggccacagaagtgcatcgggtcgttgccgcatatgtgggccgcgctcggctgctcggcttgcgggccgtcgaactgactcggctcgcacgaagactggacggcttcaaaagacctgggccgaaagttaagaaataaagttgataaaaaatatattagcctgtaaatgaaattttttctaaaccagacatcggcttcaatggaaggtgattgtttataggctaaaacaacaaaatcttgaaataaaactccaacattgtggtattagagcttaaatttagcctactcaattccttattcacatcatccctgtgattagaagccatcagtgccaatctttgttcgacgtgaacaatttcgagtcaaataagtttaatctaatctgtttagcttcttatctttaatgcttagtgaagattagctcatgttcatgttcaattaaacttaataagatagaattagggttcttgcgtgcccgcttcgttggaccgtcgacgccatgtcttcgcatgacgccaccctcggacacgcctcccagccggtgaagccatagccgcgtgcgtgctccacctcgacggaccgctgtcagcaccgtcgccaccatccactctctcgtgctgccggagtttggatcagagagagtaggggagaaaggggattagggttagggttttcgcacccctcccccctccggccagcgatttcatcggcgcaggaccaatcgaacaactcagatcgaccccgcgtcgggccgccatcattgttgggccatgcagtctttgggtcgcgcttagttcgcctcgggcgggccatcgccggtagatgggccgtgcaccgctcgccgtgcgctcgcgctaaatgggtcgagctgatattttgggcatgtagtttttcccattgcaacgcacgggcactattgctaattttttttcgcagcaccaacgtcattagtgccgtggtctaacatgatgacgtcaatgacgttggcactgtcccatccgagaaagctaagtactaatcaacgagattggtgccaggcattacaatattttgctataaatttgatcaaatttaaaaaagttgactaagagaaaaatcaaatgacttatctatactattataaaatttgaatatgtttttatcggtactttggtacgtcattcatgtatgagtcggtttttaagttcgttcgattttagaaatacatatccgtatttgagtcgggtttaaagttcattcgcttttggaaatacatgaaggagttgtataagatatctctttaaaaaactcgcatgctaacttgatatgatcggactcctgattgcagctgatgattttctagaaaaatatatatccaagtgaattccaacaatgaatttcaccttaactaaaccgtataataataataagattaaaataaccttcacccgtcgtaacgcatgtgcattttttctagtaatataaaacaaggaagtataagctcaagagttatatatgaaatccaaataaaatcgtacatataatgataccttcagactcgtataccacgtaattaactgcgcggccatatattatcaaatttctcatctatctaggtcaagccgtcaactcccgtgtcgtctcccttccttccgagttcgcccaccccctacgccgccgatcgatctatctcgcgagcaggccgggacgtatgccgtcgtcccgctgcgccacatccatcctggtaagcatcctatacgttatgcacatatatcccccctaattcatctctcgacacccacttaaccctagtgtataccaagtcccaagttagactggacccaaggtcgatagatccgcctgctgatatatataattaatcaatctaagaaagacatatggatggtgatgaggagttaatctatttgctgttctacttgaatcagatcggtctagttagctggacacataaatataactagttgatatataccctatgctttgctatggaaaatgtatggatgaatgtatgttatatattataaaaatggtcgatgtatatatttaaaaaatgtgaagataatgatttgacattgtttgcatattgagttttaaaaatataacaaaattgtaaatgatatttaaaatactctagataataattgctagtgggagatgatgatgatgtgacaaatttgtatattgagttttatgagttagtggatatcaactttatagtaaaatatgactgatgtcttaaataggggataggtacgcatactctactggagatagagtcgcaaccaacctggtatatctttcttgtataattggaatgctatcttcaccgggtgataccatgggagatttttacttgtgtagtggcgaccggagcgtacttcgtaggatagctttgtcatcacatcttttttcacctagtacttgataaaatcaatttgcctaacgcacaacctgaccagagggatcacgataggatccccctagcttttttaattttcgattaaactaaatgactagtgaaagaatctagaagcttgtctttttttcttactagctagtaaaaatgcatgtccgttgcaataggtgaagataatttttatgattgataaaaaatcttcccatttaaatgctaaactaaaacaagacaaacaaaacaatggtaaaacaagtcagatatcatatggcattgaatccgattgtgctcgcttcatgcattatcacacaaaaaatcccttatgtgcacctttccatagcctaacaaatcgatcgggtggctattccataaattgatgcataggtatttgctatagattgctaaagagatattatcatcggccaaagattaaaattttgcaattagtggaagttttatttactgtagatggggtgtttgcaaagtaactgttaacaccaaaatttggtccagtgtgtttttcgcatcaacagtaacatcatgcatatcttaaacaacgataattttaaaaagaaaatatatatgaggagagaaattagagaaaaataggaggaaaaaaaaaggagaaaaggagatcggaagaggagggagtggatcagtatgattggaagaaaaagaaagcaaaaaaagtggagaaaaaaaagataccgatcggggaaggggtgtaggacgggccggcgagatggtgtgggtcagctgggttagactgggctaggaggggatgtataatagttattcacattgaattagatacgggtgacatatcaaacggttgacaaaaatattgtcgagggaagttccccgatagcgggaggtcgcgggacccccctttcgtgagttcggccgggggaagaagcttgcctcttatgtgcaccttatgtgcacctttccatggcccggtgaaccatcgtgaggtggcctcgcgccggctgggcgagcagctcgcgaaacgcgaggaggccattgccgggcgcgaggctcggcatctggagagtgctcgcgccgagtgcgcggtgatagcggcgagggcttctaagctggaggcacgggagatggacttggcggcgggcgggcagcccggcagcgtggagttggtgagccagtttgccacggctcagagcaccctcgccaacctagagcgcttggtgcaagatgagcccccccccctcgggcttgttctagcgaaaaggtaaacctgcgctcggtccgtggtagctaaatggtgaagggcaagatcgtcgtcccaagggagccggtcagcgggactggccagaccgaggctacgatgaccgggggtcggggacggccgtgtgtaggcccttccgagcccccggggttcggtgcaacccggggcgcggcccgtgtttgggctccctttcggcgagcccccggggttcggtgcaacccggggcgcggcccgtgtttgggctccctttcggcggtttccaggttgccccacggtacttagggttcggagtgagcgcgaactgtcctttgacccaggacaagccagaggaaagagtgaggataacgggtttcatattaagtagaaaaattcattgcctgtaaagggaaaaggatacacagtggtagcccccgaccaagcccgcacaagccgagaggttgtgcgggggttggcccgagctcctggaaagcaaaaagtctcgatgctatggatagaagcgacggaggtgttcgatattctaggggttaggaaactctgtgccgtcttccgtggtcagtcggacagagcctggccggggaacgccgatcactttgtatggcccttcccacattggcgagagcttgctcagccccagacgcgattgcacgcggcgtaggacgaggtcgccaacttgcagtgatcgggcccggacgtggcgttgatggtagcgccgcaggctttgttggtagcgcgcggcacgcagggccgcacgccttctccactcttcaagatagtcgaggtcgtcgcggcgaagttcgtcctggttggcctcattgtacagcgcgacgcgaggcgatcccagggaaagctccgagggtaggaccgcttctgcgccatacaccaggaaaaagggggtttcccccgtggcgcagcttggagtggtccgatttgcccatagcacggcgagcaattcctcaagccatgaatccccgtgtttcttcaggacgttgttccgccatattccgccatgttgttcgtagctcggaagtcgagccgaacgacgtatttgaggacgtccccgcttgccgaagtcagcgtgactccggcgcctgcaccttgaaggttgagggagccgtcgaaatgcataacccagtgcccgctacgaatgtcggtgtttgggtcctctccatctccggggagggaggggctgttggtcagaataggttcgtccactggggtccattccgcgatgaagtcggccaggacctgacttttgatcgcgtgccgtggttcgaagtgcagatcgaactcagctagctcaatggcttatttcacaacccgtccagtgccctctcggttgtgcaaaatttggccgagagggtaggatgtcaccacggaaacccgatgcgcttggaaatagtggcgcaatttccttgaggccatcaaaaccgcataaagcattttctaggcctgcaggtatcgggtcttcgcatcccgaagcgcctcgctgacaaagtagacgggccgctgcacctttcggctgggccgactcgtgttgtcaggggcggatgatctgggacgcccttgctcgggggcccgggggggcggggtctcgagtcatgtcgggatcgtaggcctcgggaccactcgccaaagcatcccctcctcccacgggggcctcggggtcctcccgggggctgggggcctcgggcactgggcctacggggaaggaagggccatcacgagttaaaggggcctccagttcgctttcttcgcgctcgactattagggcggcactcaccacatggggggtcgcggccaagtagaatagcaacggttcttccggccccggggctaccaagatgggagggggaagtgaggtaagctttcagctggttgagagcttgctcagcttcctccgtccacacgaacggcccagagcgcttgaggagcttaaataggggtagcgccctctctcccagcctcgatctcgatatgaatcgacttagggcggccatgcatccagtgacgcactgtacgtccctaagcttgctggggggggcgcatcctctctatcgcgcgtattttctcaggatttgcttctatgcctcgggaggagactagaaacccgagaagtttgcccgctggcacaccgaacacacacttatcagggttcagtttcacacgtgtggacctaagactatcaaaagtctcggccaaatcctgcagcaacgtgtcctggtggcgagtctttaccaccaggtcatcgacgtacgcctctacattacgccctatctgattactcaaagtaatgcgagtcatgtgctgaaaagtaaggcctgcattctttaagccaaaaggcatagttgtataacagaaggtgcccacaggagtaataaaagctattttttcctcatcttccctagccatgcgaacctggtgatacccagagtaggcatctagaaaacacaaaaggtcgcaccccgcagtggagtcgactatctgatctatgcatggtagagggaagggatctttagggcatgccttattgaggtctgtgtagtcgatgcacatccggagcttgccgttggccttcgggacgaccaccgggtttgccagccattccgggtggataacctcgcggatgaaatcagcctccaggagccgtaccacctcctctcggatgaaggcctgccgctccagggcttgacgccgcactttttgccggacgggtcgcgcgtccggtcgcacggcgaggcggtgctcgatcacctccctgggaaccccgggcatgtccgacggcttccatgcgaagacgtcggaatgtgcccgcaggaagaagacgagcgtgctttcctatttggtgtccagggtcccgccaattttggcggtcttggacggatcatcgccaagggggatctccttgacgggcaccttgtcggccgaggtgaggcgcttcttggaggcgcaagacgcggaggcctccggggcctgtggcttcgtggccaccgcgaggttgtcggcgcgctgctccgcgcaggcaagggcgactttgacatcgcccaaaaccgtgatggaccactaggccccgcatcttcattgagataggcggtatggtggcggccatgaacttcaccacgcangtctgcccaggaccgcgtagtagggcagattgagatccgcacatcgaaacgatccngctcgtgcggaagttggtggagtccccgaaggtancgggagctcgacctgccgaaggccacgtgtgtcccggagtcacgcctatgattggcagcgacggctggagcttcatcgccggggccttgagcgcgtcgaaggcggctggggagatgatgctcagactggcccccccgtcaaccaggacgcgcttcatcctgacattgtgaatggtcggggagaccacaagggccaatttcccgccacgagcgagcactgttggatggtcgctctggtcaaaggtgagcttcacttccaaccagcgcgccttccgagccgcttcgtgggttggaacggcggccagaagctctcgcctcatggccttgaagcctcggcgggaggtgtgagcacatgcccccctccccccgtcaagcgtggcgacggtttcctaaggtatctggaactccagatcctcgctgtcatcgccatcatcggcgggggccttcttcttggcctcccctcgccggtcaccggctgaggtcgcgggggctttgccctctcgtcgaccctgccgcttctcctcatcggcctttcggaaccgctcggccaagttcttgaccgagcggcagtcagcgagactgtgccgataagtgttgtgcaccgagcaccacttgtctgccgaccggccctcgccggatggagcagtggagctcggcttgtcgccggtggcctttcccttgcgtggggcccgtgtaggcccatcagccgcaagcacatggccctcgtcatcggagcgggccggtttccttttacctctcctatctcgccgcttagagcgggggcagactcgtgggtagccgcagccgccgcaccggtgccgggagagttccaggcccacgcctcctccttccgagccaccttgtccgccagctcgaaaagctcggcggtggtcttaggctccttggaggctatcttctctaacatgcggttatgccgcacgccattccgaaacgcataaacaaccgcgtgggccggaatgcatggaatggtgttgcggacctagcagaagcgctatatgtatgaacggagggactcgtcgtacagcgtgcaggtccgcctcttctcccgggcggggatatgtgccctggaagttcgtgacgaactgctggcacaggtcctcccaggagtggatggagtcggggggctgggtcatcaaccagccgcgcgccggacccttcagggccatggggaaataattcgccatgacccggtcgtcacctcccgccgccactatgaccgtggtgtagatctgaaggaactcggagggattgatgctgcaatcatacttctccgtgaggttggggcgaaacttcgggggccaccggacgttccggagactcgccatgaaggccctacaacccgtccctccaggggtgagcgtgggaggagggcctcctcgtgaggaacgtggcactccagatgaggaggcaccttcccccatgcgaagagctcggcgctcgtcccggcgtcgctcgatattgattcgagcgtcctgctccccatagagaccgtcgtgacgcctccggcttcccgaggcccccatcgatgttggagccgtggaccgcctcgaggccatggctgaccgacgggccctcctccttgccgatgaggagagggtaatgggggtacgcgacgtaccggtgacggcgggtcggccgcccgcggccaactgccgctgagctgtggtgaccaagttggccacgtcgtccaaccagcgctggataggggtctccggctccgagttgacggggggatgccgcagaagggcacccgccgcctgaagcgcacctcggggcgagccaccatcaccgtaagtgaggcggcgccgtgccccgacgcgtggtggcctccctccgcccgggagcggggagaggcccgaaccacccgaataggtggggtcccccctccgcgagggttcgcagcggggtggagtggaagagttgcggcgacgatgacgtgggccgcggctctcgctggcatcctcactcccagacggagtgggggtgaacgccaccacctcctcctccaggacctcgaccatgatcgtcgagggcctaaggaaacttggggcggaaggaaacggcttctcttcaaagcgcgcaacttccccctacctggtgcaccagctgtcgagggaagttccccgatagcgggaggtcgcaggaccctccctttcgtgagttcggccgggggaagaagctcgccttttagaaatcgcgtacctgcccctaaggcgtctggctagcttgcgcacaatcggattatacaggttcgggccgctatcgagcgcaacaccctactcctgtgtttgggattatgtatgagttttataagggttcctttactccggagagcactctcgtcttctcctagagtttaggttttctgaccgtcgtcccccttttttatatttttatataaagataaagattggatggtaaacatctattattgtttctctatattttttttttgttgttcatggctttcatctcgttattattcttctctctccgtttcgggttataagacattttgactttagtcaaagtcaaactactttaagtttgactaattttgtagaaaaaagtagtaatatttttaacccaaaactaatatattatgaaaaattattcaattatagatttaatgaaactatgctggtgttgtaaatgttactacttttttctatagagttagttaaacttagagtagtttgactttgaccaaagtcaaaacatcttataatctgaaacaaatgaagtattattgtaaacgcttagcattgtttatttcctttttttttgttgttgttcgcttacttactatggtagcgtctgtatatatgaaatctattctatgagaatagtaatgcaaacatccaacatcaatgtggaaaaaatgcatctgtgcaatgttctatggatgtcatgtgtgttcttaccaagaggaccttttagctatatcaaatattgaagcacactgctaaattattcttttaccatgtattggtgcaaatggccttacacttcataatcatttacttcaacgatcagagcacatacaacttgaaaattgtagaaagtaaatggcattgttggtacacaaacttatcaaaccgctgtaattttgtacataaacttgcaaatggtagttttggtacacgaatttgtctgatgcgtgttgtttaagactccagcatgcccagattattactattgtttttaccatgctgatggagcatgattaattctaattttgtgttcgatttgaatcagattagtctaattgtctggacttatataattgatttgatgcctcgagtttgggaacggacggcgctctcgggagagagagtcaccgccgagctgtcatatctttcttgcgtcgtcgggggatgctatcttcaccgagtaagatcaggggggcttcttacttgtgtagtggcgtgtggactgtcgtaggatcattttgtcatcatattaacttttatcacttagtacttgatactatcaattcgcctgatgcacgacctgaccgaagggattacgacaggttacctctacccttttcgatttttgattaaatgaatgatttgtgaaagaatcttaaagcttattctttttgttgtcgtttaaggcttctgtcttgttattcgattataaacatctaaaatatttgtttctccagtttattttggttgttcgcctacttgcttgtctgtatatatggaatttgttgtctgtaatgcatccatgatccatccaatgccagtgagaaaatatattgtgtatgtccaattactactggaaaaagcatttttcccgacgtaggggtcccattttcgcaggcggacatgactcttaaagccaaatgatcgcctacaaaaatataaatcggggtgaaattgtcagtccgcctgcgaaaatagacttaaatataaatagacttgggtaggggttgattttttctaagtctccacacctcaccctcccttcctcacccacggccggcctctcccctccccatacctcacgggctctcccctcccctcacctctcctctccccggccgtcggagggggagcgacggcggctacggcgcggggtggcgcgacggcgcggcgtacggctggcggcagcctccctcccctcccctcacctctcctcctctccctggccactggagggggagcaacggcggctattgggcggcgcggcgcggcgtccggctggcagcgcgctcccctcccagatctggcggaggagggatgggggaggc

SEQ ID NO: 1645 - DNA, 3990 bp, Oryza sativa
ttttttgttcgtttcatggatttttgcaggagggctgttgtcccgactgtgaaaatcgttgattttcacagttgttgtgctacaagtggtccaacccttcgcttgcaaaattcacttttgtctgtctgcgaaaatactttttctagtagtgaatgttgttctttggatggatatcaccaaggacatattactcgaaaatggaaaggcatttgggcaattgggcttgggatagtcagtgagtgctggcctgctgggtagatcaggggctaagggcatctgcctcaggttattggacgttgttccaagttccaacaacgaccaaagcacgatgttgttattaacagcatccacatctggatgccctgcaacatatacatagcacccatcccatttttccaaattacttcctccataagaaagtatatgatgtacttttataaaaataaaaagtataaatcttgaccaacaattaatatgattacaaacacacttaccaacagttaatcagactattcacatatctctggatgccctcactctgcctcccaccccacctgccatcgaatgctccccctcaagttgcatcgccccacacaaccactcaagccaagtttagttccaatttttttctttaaatttctaacttttccatcacatcaaaacttttctatacataaaaacttttaacttttccgtcacattgtcctaattttaaccaagctttcaattttagcgtgaaccagtccattgatagctccctcctcttggactacctccacaaaacaataaaggccgtggctgccaacatactggcctcgcgccaccccaagtaacattgcttgccttcctcggctcaaatgaggcgagcagaggagaggagcactgctggggtgatagttttgacgatggaatagcaacggtgatatgcgcaggacgcatctcatggtgcggctcacaatggtaggccactcccaatgcagggaacaacggaaaagtggagaacggtgtggcgaagctcgagatccggcattggaaagtacctttacccagtctttttacagcacagctctagcaagcaatggcgtgtatgtcaaccatggaccaaaagtccctgaagtagtcggggatttcgaagccgttggtagagaagagcgcaacggcgagcccgccactgctgtgaaacaacaacttcggagacgtcgggacaagaatcaggcagcagtgcagcaccagggcatcgactggcttggtgttcaggcgatcaaaccgtcgagcacctggcgtgcgtcggtgcgtggcgaaacaacgcctctctccgcggccgctccggcgccatctcgagcgcgcacaaagagtacagctcaggaggcggtaagatccaggttaggagacgcagtgacgtgtatagcaacagctcaggaggcaggcgggagatcgggagcacggaatatagttgaacgacggcgcagagagcgcgcgcaagcgcgaagggccgtgcgatggatttgcattgcacgtgaaccacaaccctgttctggcccaactatattaggcctgcttgttagccacaataccgatccggcccatcgagccgagcagacacagaagttgaatttctacaccgatgtatgcaagtgattgaaattgttgtataaaaaaagtatataatatgagaatatagattctgatgatataatacatcacacaaatatatagtctaaatttaatctacacaggaaaaaataaaaataacaaaatttatctatgttgtatacgtactattaactgtctgattttattatattactttagccttgcatgtttgtttatagacttatctcatttcaattgatactactagtattattttttattttttttccataactattctaagtcgtatgaaaataacggatgcacaccttacccctcgtaccataccacggtccaagtaaaaacatttttttttcaaaatgtagacccaggcaatagagatgaacgaactcctcacaagttcacaacgaggtaacatcctgcataccaaagctaaagctgacaacaacatcactgagatcaggcatagtttcaagccaacaacacacatcaatcccggaagaaaatcaggtaacggatcggatcgacacagctgcaactcctgcacggatggtgttcgacagttcgaggatcgagacggccagccgtcccggccggcgaggtgctagctttgctctagcagtttcgctcacgcgctgccgcgggagaagccgaagcaggagcaaccctgggaggcgtgctccgggacgggggtcatgccgcccttgccgcgcgaggtgtcgatcttctccagcagcgccaccacctccgacatctccggcctgttgtccgggttcgcgtcccagcacctcgccatgatgtccgccatcgccttcgggcagcacctcggtatgtccggcctgatcccctgtcacccatgatccattgatcgacaagaagcaaaatcaatcaatcgacaagaatcttggggaggcgatttatcatggcgagatgtgtctatctaccagcttgtcgacgtggtaggagatgtcagcgaggctgtagttggggtaggccatggcgcagcagtaggtctcccagaggaggacgccgaagctgtagacgtcgcacttgtggtcgtaggcgcggccctggagcacctcgggcgccatgtacccgatggtgcccgtctgcccggtcatgtcgtcgccgtcggcgccggcctccacgcgcgccacgccgaagtcggcgatcttgagcgtcttcttcctgtcgagcagcatgttctccgccttgacgtcgcggtgcacgatcttctccccgtgcaggtagcgcagccccctcgccatgtccagcgccagctgcaccaccttcttgtacggcagcttcttgtcccggtgcttgtacagcagcgtcttcagcgtcccgccgtgctggtactccaccaccaccacgcaacgctgccccccgccgccgccggcgctgccgccgccgacgctgctggaccgcgactccgccttcgccgacgggatcttcagatgcgacgtccccatcgacgcgcccacgaactgcacgcatgtacacagacagatcgatcgatcagacaccgtacacgacggattcaacggcgtggattgattgctgctcaccttggtgacgttggggtgatcaagcttctgccagacggcgacttccttctcgaaggcttcccggtgcttcgccgtcgactcctgcccctcctgcccccagtccagcaccttcactgcattgaacacacattgagcaacaaatgtaaatattagtgcatactccctccgtttcaggttataagacgttttgattttgatcaaagtcaaactgttttaagtttgattaaatttatatacaaatatagtaatgtttataatacaaaattagtttcattaaattaataattgaatatatatatatatatatatatatatatatatatatatatatatatatatatatatatatatatatatcttcataataaatttgtcttgggttaaaaatgatactacttttttctacaaactttatcaaactcttaaagtagtttgactttaaccaaaatcaaaacatcttataatctgaaacggatggagtattttttatattgatgtttgtcatctggatcagtgataacatctagcaacaaattgtttacaggcaataggtcaattaaattacaaacgaccttgtgtaaatctgtaatgtaataatgggtccgttctttgggggaaaatgatatctatttactactagctagaaaaatatgtacccaaaattttactccatcaaggaacttgaatgtatgctagatagaggtgtactcccttgcataaagggtcacatacggctgatgtatatatgggactaatgtttgagtaaaagttactaaataatcttctttgcaaatggatgttatgggac

SEQ ID NO: 1646 - DNA, 3802 bp, Oryza sativa
taaatggtacagtgtgattaagatttttgcctcaatcaagatttgccacttttatacaagggaccttgaaaactcacaaatcaaaatacaataaccgcactacaattaatgtttcacaactattttgtagaagtaaatcttgccaaaattgcattctgaatgttccaaatgacaaaattttaaataaaaagtttcttaggtctatgttagctatcattctatctaatgttgaatacacacatatatattcctaactagggagtatttatccccgagaaacactagaactttatgccataaattgaggtcacgtggatccgaggaattcacccttccgtacataattaatgtactaccacacagcttaccataggttaagaatccccaccgaccgttaccacatagcttgcatcacactatatcattgttgtcttgccctccacaccaattcatatctctactgacacgcggcaccaaaaacatccttagcaaacgacatctcctatcttctccaccacccgcaacagcctctactgacgcacgcacggcatctccaacagcctctactgatgcacacgccaactcacgtgtttactatacctcgctagagccaaaaaggtggtcaacaggagttcctcatcaccaaccttccacccctaccaaccaacgtctactgttcctcttcggcggagcctacaccggcctcgcctccccccctcctcctccttgatccgcttccgtccaccttcacctcccatactaacttccggcggtgcactgaccaccatcaccatcaccatcgtcatcaaccccaccaccgccgctcatcgttctcctctgtttcggttctcgcagctggctggccgacgggaagcaaaacctaatgtccagtaatggtaaggaaaacaacaaaaactaaccatcactacaaaggaaaacacaaagggctattttacaaaatctcttggtgacaaacgagccctcactgctcagacgacgattcaccgtatcaaaaagtgctatggtgcggcgtacgggcgtacggctagcaaagcgcgacatgcacgttcatcacggtgacagtctacgagtctaatactagtaatagcatgtatagaaaagagttgatcgacgcaagagatctgaaggttgatttgattcgattttttaccggcgacgtcatggccgtcgtaggtgccgcggtagacgacgccgaaggtgccgtgggcgacctggttctggatgtcgagcttggcgaggtcgatctcccactccagcagcggcagcggcgacgccgccgacgacgagcggtgctgctcgagccacaccttggaccgcgtcttctcgaactgcacgtccaggttcttgaggtcgatcttgtccgcccgcacgtacatctcgttgtccgccgcccggacgaacacgtcggcgccggcgccggcgccgccggtggccgcggcgctgctgatgccgctgaagctgtggctgcggctgcacccggcgccaccgctgctcgtcatggacttcgttctttgtcgatctcgctcctcggcaaagaacacaacggacgatctgcctgtggttgtgtgtgtgtgaaatggaaaggactgggtttcttctccttatatggcctcttcttcctggatgcgccaaattaaattttgtttctaatgcaggagaagatggatatgaaatcgtttctgccctcttttctgcttcaattaaagcccccaaatcttccaaggaaaccaaccacgcatgcaacgtgcctacaaccagatatcgatggcgaacacacgcaatgcattcatccgaaaatttgagcgaagcgcccccccccccccccctaacaccctcccttttggaacgtaaagggcaaaatcaaatggaaagaacccgaaaagaaaaacaaaatctcagtcagaaatcaaccccgcgccgaaagtgtcaaaaaggaagttaacaagatctctcaaaacaaaatatcaattcggagggaggaatcaagaactgccttaataaacagttaaaaaaattaactaatcaaccaagaaggaggctaatgccggatggaattagccccttcttgatccaacgacccaaacctacgctaagatggagatatttcctcccatgaacacaatctctcctctctcttgagatctaaatcgatagattaaaatgcgttcgaattggggggtgaggctcggaatggatggacgctgttgacacggagagatgcgagggaagggatcggaggaagaaaatattagcgagagaatcaagggaaggagacccattcctggcctcggcctgacagccagccaacgatgcgttacgaaaggaaacgaaacggctcatctctgctgcaggttttcgtcagtaaatggaagacgctgtagaatgtagatgcgactcgcaattcccactgacaagtggggtccactttttgacccagctcggttattgggcctccgcgacccaacggaggacgggccggcccaccccaaaaacgtccccgctaactcacaaacacgaactccacgtggttcatttttaacttatgttcgtggtttttatcccgataaaaacgagacaaatatgttcttaggtgacgtccctcgtagagttcaaaatatcgaacaaaattttctaaatttcggtactatcgcacccccgatatgaatcatatgatatcatttcgttcaaaatttttattcttttttttattttctgtgaattcggtaatattgtgtttagatttgaccaaattttattcgaaaatttcggtaaatcggcatcctccgatgccaacgccgaatactaaagattgaacccactccctacccgcttttaccccgagaaaaacgagacgtggcttcaccgtgtgccacgacacaacagaacagaacagccttcacagccgcaacacgtgccaagcgtgcagtcaaacgaagcagagttaacatcccagcagagcagcaggcgcagagcaaatctatcatttcatcgaaggcaaattacaacacaaacaaaaatcatatcagcgattacttattttacaggttaattagtcaagcgggcacaagcaaagcacaacaacagaaatctctcatccaagaagctttagatacacaagcaatctacgaatcggatgccctgaagagggtgaggagggagaggaagaggttgatgacgtcgaggtagagcgcgacggcggcccagacatactcgtcgtaggagtacctcttgatgaggttatccgtgtcgtacacgatgtagccgcagaacacgagcgcggcgaggccaccgtagatcatcagcgagaccctcccgagcgggaagaagacctggatgagcgcgaacaccatgaggatcatgacggcggcgaagaggaacgggccgaggaagctgaagtcgtggccgcgccgcgccgcccagaacgtgtacgccgtcaggctcaccaccaccgcggccgtcaggatcgccgactcgaggatcacctcgcccttggtgaacgcgcaggtgaggcccacggcgaagctgatcgccgccgtgaagagggccagcaggaggaggttcaccgggtggcgctggtagtagtagtagagcgggcaaagcactgcatcatcatacaatcggaatcgatgaaatgggggatgaaattgatgagaatggaattggggattgattggattggattggattggagagcttaccgatgaaggggaggatgatgaggaagatgtagagggcgaagccggcgggggtggagacgaagaagagggcgacggggcggacg

SEQ ID NO: 1647 - DNA, 19646 bp, Oryza sativa
  unsure (1)..(19646): unsure at all n locations
aggttccggacggttcagcggttggggatccgacgtgccggcgccgtggctggtatgtggggcccaggcgggagatgacggttctagcgccgtttcgttccgtttctggtggcgtctggaggggggcgagagatttgtgcgttgcttttgcttagtgacggggggtatcagtagtatcgttcgtgttggttggttttccgtgtcaagccaagacacattttatatcttgctgctttggggattttgtaagggagaagcaaagcatgaatgttagataagctagcaccaacaggaatggcagatggttctgtttggtagtatcccgttgtgaatgttaaaccaaccataaaaatgtgttggtcatgatctctgcagcactactcttgatggttgacagctctatcatttgtgtttttacttattaaggccgttgtcaaaattttaaattttaagactttcttgatgttaaaatcgtagttaggagttttaaatagttgagaacattgaggttttacagtgggaagtcttaaaataagcgttccgtgggactgtgtttctagcttcctgcttttctagagaacattgagttgcaacaggaattggatggtgtggttaatttgaattgaggtcagttcagtttgatcaagacatggatggtgggtgctgtaaggtcctgagaaatctggtcattgtttttctttttcgaaaaagagaaatctggtcattccgtcattgtatttgtaccgtaaaatattaccactaaaatcttgacttatacagcgagaatactcactcccgggcaaccaacgtgaggcgtcattatcgggcgctccccccggacgccacgtgccccctagcccaccatgtgtcatgctcccacctgtcatgtgtctcaaaaaaaagttttatctagtatactcacaatgtttcactatgcatagatctaatgttacagtgaattgaaaacattcttttgcaacaaatcaaccacatattttagaaaccctctattaaggaattcgtttcattttttgttacaccaaaaatgtttcacctagtgtacttacaatgtttatctaatattgcactaaacgaaacattttttcccaacaaatcatccacatattttagaaaccatctattaagggaatacgttttaattttttgttccaccaaaaatatttcacctagtgtggatcaaatgttgcagtgaactgaaacattctttcgctatttgctgaaacgttgtttttttatataaggtgaaacaacgtccgatttaaacgattgaaatattttcgatctacttagtggaacaattccgatatacctgatagaacatcgtgcaacatttaaaaataatttaataataagctaaaaaaatttcatcggaatatatccatgtatggtcttattttgaagatttaattacaatgaatttaatggtccaatcggatcatgatttggataaataatttaagagaaaaaatagtttaaagtgtttttgcacgcatcgtctgattttaaccccctctcatcgaacggagcgagagtcgcttcccttatacaacgatgagacagccagatatatttctcactcggaacccttctaatccgtttggttgggggagcttttagaggaccgaaagtttagaggatgggggtattacctattctgtttgattggagacatgagatttttctttatgaggctggaaaattgagggataaattcctacttttcaataacttgtaggagtggtatttggaagagaattcctccttgagaaaaaaaaagtgccgtcctgaaaataagcctgtcaaaaagggcgaaaaaaccgttagaaaaaactaaacagtctaaaaaaccggtatataccacgcaagataaaaaaaactacgcaatgcgggaaaaaaaaccagtccgattgcacgcaacgcaagaagaagcccatccgattctacgaataaacttaaaaaaaacacgtaaaaaatcgtttcacgaaatgtaaaaaagagtgattctcgggaaaaaaaccaccatcaaaaaaagttcacgaaaaaaactattttgcagcgttaaaaagaagtctgattctagaggaaaaaaatatcgtcccaaaaaaaacaggtttggcaccacaaaacattatatatatctctatttctttcaaaagcgaaacctgtttttttattcattaatatcttcttcggatcggtttctcgacgacgtactttttggatttttcatacatgcgtcaacgtatttttcgagtactgcgggtatcctcggggcatcaccaaatcagtttagatcaactgcgagtattttgtatgttggtagagatcacgtctattggcaaagatcaaccgcattggtgccgatcaaatacgacaccaacgacgcatcaaatactaacacggaacagaaagcagcagactgccggcacaaggatctctgttattacagtattactgatggactgattgttaagctccaaatagccacagacaacagaattttttttgaaacccgacagacaacagaatgcaacaggctgcgagacactggtctgaagaggcaaagcacttttaacttcagcttccttggcatccgccgaacgctccgcgacaacctttgacatcccaaacatctgagatgcgaaacatgaagcacaagaaatgcttcatcatcaaaatgtccaaaatgcagaaagagcaaagaagtgcagtatctgagtgtttgcacatctgaccttttggatggtgtttgaagcatgtcttgtgctcatccatggaggcatggatgaactcctcgatatggtctttcagatcttcgaggaaagtagcgccatcagtcctcttccggcaacaagtcatggatgggtttttgggaactgaataggcagaatcttgaggttgtgcattgctagattccatcttaagcctgaaaaagaaaagtcaaagggaagttgattagtatgagtctgaagaagacatcaacattgttagaataggtgcaaacacaagaacgcatatagtagtaagtatatagcagaaatgcagagtagcagcggcacaaaattaactgactgcacttcagttatcaaatcatagatgctactaccaaacagatttaaaggttcacatttatttttcaggtagaaacatcagtagctactactcagccaaccgtgtccaaactacgacggcctagaattacaaacaagatgacgcagcaaagaactactcactgatcgataagatctcacagctccaaaaattccaccatcgaatacctaagaggatttacacttgtctcaagttggttatgatcagatgcgagcccccttcactgagattcgactgccaccggagtcacctcccgcccttccctggagctgctgcatccttgaccatgggctcgaccttctttttgccaaacacctgaaacacatcacaggaaacctgcagattatccctcaagatccatcagaggaaacagcatgttataattagctatcaaattacaccataaagagaagattgaattaacttcaatctgaaagaacagagaacactaagtatagcaagaacagagaacaggagtactgccatccgttgnnnnnnnnnnnnnnnnnnnnaattagagtgtgttgctaacttgaattgcaaatgcttgtatacactactgcagttaactaattgtctatgtcaaatactcaggagatctcctcacaagctaatctataatttgccactaattcaacgtgactgctagcaacaaacagatctagatgtacgcacaggttaatagccaccaccaaatgactcgacaacaacaacaacaacaaaagcatcacaaatccacagggaaaaaaccgaatgcctctgctcctctactactcaaatagaacagcactgaaccccaccacaaacgacgattcaaatcgcgaacacaggaacccattcacgcaggccttcccataaacacaacgaaggcactaatcgaactcacattgctgcgttgttggtaaaacatcacacgcttgttaaacctcaagcactagtagagtttctacagaaacagagacttggcggtactaattgcaagcagaacagggtgcacgtagcgaagaaaactccaccaaatttgtagcaaaagagagatcctaatccttatgttcgcatgcgtagacaccgattcaatctaaaagaacatcacgatctaaggcgaattttttttaaaaaaaaaactaaatgcttctccgtttcaaataaatacaacactaaactcgcgaatgattcaaatagcgaaacactaacctattcgcgcagacttttccccctaaacaccgacaaggctttatgcaaaataggaactcgaaaaaaagatcaaatgcttgtcaaaataacaaccgctttggcactagaacctgcatgctaatcatccgttctcagaaaaacaaacggttgcagaagcgatcgatcacactacattccttccgattcaacactccaaccacgcgctacgaatagaacagcacagaacaaaacccccgagaggatgaactagtactacacacagcggccaattacactgagaaactcaaaagcaaaccgaaccgccaagaggaatcacggccaaaacaccaagaggatgaactgtacttactacacgcgcggccaaaatccagacatgaatccaagaggatgaactattaggccaaaacacagggaaactcagaagcgaaacgcgattcatcacaggtcggaaacccagcagcaaagttgtgcaggagggaggagagggggcgtgctcgggtgtaaactgggcttaccgagctgctcttctgtgagacgtagtcgccggcggcgcggaacttgtcctcgatgcagatccagtgctttctcggcggagttctccttgaactggctgtactagtccttgacgcgcgcgctccataaacgtcgccgcccgaacatcatccgctgttgccttgagaggtccggtaaatcaaccgtggtggtcgtcttctgaaaaacctcggcgatgaggactaatccctctgaattccttcctattcaacacggggaccgcgaagaaacgaatcctcctcctgcgcaaaaaagaacacacacacagttaacgacgaatcggagagaaggagcgagagagatgaacagaatggctcaccgctatgtcgaatccgacattgttgggggtggggggggggggggcaggaaaaagttcgaatctgtgggtggatgtggccgatcgagagagagagagagggagagatggagaggagaaggtgtgctctaatttatggaccacgttgcagtgcggtacacgttactgtggcggccccgtgtgagtgtgagcaaatggtgcaacgacgggtggtgctagttgtgtactcaagcgatgtcgaaatgtacaactgcgggtgcggtgaacacacccgtggacctgtgcgtgtgtccggcacgttcgtgcaaattaagaatgtgtttggatggttttgcctgcgtaggagatggccgcccggtttttataggtgtttggttgttgggctggtataggatatggccaccccctaaggaatattcgcagtagatgccgaacagatgcatccggccgaatcgggcgaacggggcgatccagggacgggcgagcgcacgtaaaaggaaaaagtggcatgcgctcacctccttccccctcgttttctcttcctctcctcttcttttctttctttctcaccggtctgagtctctggagctctcaagtctgaaccctagcttttctcccttcctttccccttcatctcccctggtggcgcagccggaggcgccaacggcctcaagcgccggcgcgaagggctgcgtgggaggaggcacagggtcatgggaagaggcgcaggggcgcggcagacgcacgggtgaaggcggtgggtgtcgttcagcggcggcggcggtaggcggcgtccagcggttcaggagcggcaaatggtatttgatgttcttcttgatggtcaaccaagcaatgcacagagacacaacagcaaaactcattggtttgtggatttagattcagattcgtcagttcagtttgttgaaacacaagtatagctgtgctgcttgtgcagtacctcaacaaccatcagaactttccgcaggatttttcattcaacttgaaaaccagtaaaatgattaagctatgagatgaaacaggtgctgataacgaaacttccaaaaataactagaaatggcacaaaatgtcattcacagataggagtgcattgcaatatcggatatgtagtacaagtgcttgtctttgaattgtccgatgaaaatctgctctataacattaataaaacttatttgcttacattatattgtaaaatcagagaaaaaaagatatttaggccatctacaaggagaaggaggtattctcaccatttcatccaaaaggtgatcacaacacccatccatcctaccaaacaaaaaattggctcaccatatccacctcttctccttccaaccaaacataaacttggctcatcctatccgtcgaaccaaacaaaaattggatggccatatccctgaaaatatggatggacatatcctatccatccttgaccaccatccaaacacaccctaaaggagccgatcgagcaagcgttctgacacaagggaggcgtagagcagcctagctaatgtgatccgagttgggtgcgattacatcaaaagttacgtgtcacatacaaaaaataatgggagtattaaaaaactaccataagatttttgagaaaaaactttcagatataactatagaataattgaagtgtaattacactttaattactatattatgagtggatgattttgtgtggatgtgacatccctactatgagtttgtattagttcccttttgcgattctagggttagggtctagggaaattgattttcagattttttttttgttatttttcaatttcgcagtcggatggcttaagtgtccgcatgcaaccgtctacgaaaatcgattttggccgcatgcaaaaaccgattttgtagtagtgtctcttatcaaacatttagtgtgatatgtaaaaatactagaacggtctcgcgcgctaagccgcgcgtgctcgaagcaggcgatttaatatagcgaaaacaaaaggaaatcagttcagtatagatattagtcctgtctatggcaagcagcaagcaatgcatgtttgaatactgaatcacgttatggaaccatgtttttattcgtgaatgtactttggtataatcagatgatgcaggtgtatggaaggggaagccgtttttctgttgtatgcttgtgacttgacctgagtgcactaagcttttgcgttgagtttttgcgttgagttatttttttaatacttgttcgaagtctgtatgcattctaaggacgtgaaattggattatttcaatggatatatgttcagatgctctcatatggacatcatcaaggtagccaacaaatcagcaatcagcaatgatatatttaatctcgccacacaacttgacaagctcatgtactcttagataaaacacggtaaacatataatactttcatatatttatcatttgagatgaccattaaacagtacggtatatacaggctcatatatttgtttgaggaatgtccgcagcgaccttttcaagatgagggaccatgactaacattatcttatatcatatttgctgggcctgtggaaaaacaaaccaagagccaaaaccaaactacagaccaataacaaaatgaattctatatctaaccactgtgagcatagtaacctcatattagtaccaaaaccttattatgcaaacacaatgatataagcaatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttgagtgattttgtgcatttgaaaccatggtgcccgggcaccatggtgccccatatgagtgtcctatatatatatatatatatatatatatatatatatattgagctcatctacaaacggtgttgtgcaatacaatgacctaagacgctaaggacatacaattgggttttaatatagcatatccagcaaataaaggtaagatgggtgtgtcatctttttcacttaatcttcatgtgtgaacaatgcgtagctttaacagagaaccattagaaaagatccatatgagtgcccaaaaataagtactgccagtaataggtcatgacagaagaaaaggaatcttgaatagatgcatagcatgtaagtatctaacattgtatgaaaatgctacctggcagatgcgctaaacttttattatgtaatctattataggcaattagctatattgcttccgagaacagaacgaaggtagtggcaccgtaaaatcacaggaaataataaattgaatagcatatcacctgctggagagaatgacaaaccctaagtacttgttgcttttttccatcacctgcacaagcaacacttgcatttaataaggagcaaagaacagtgaccacctcatggtagctcatagccacctactaacgtgagagcttattttaagaaaacgcaatactatggtcaccaacaaaaactattaaacccaaatcaaaagcagacataatatgtttaaataaaaagaaccaccttaggttcttcttgctaggttgttgccaactatcattttagtgggtttccttggtatctcatactgaatggataaattaacggatgctttgtgcggtctcctttccctgcatggacaaacgaagcaacatgatggaatcgctatggatgcagatgtgttattgaactagcaaccatcttaaacataaaagaggatagtaaaatagtaggtggagcttatgttaagaaggtgttactaatgctatgcatgtcagcccccaaaacaagcaggccaaaaaaaatcagaaatagcttctatgggttgagatgagaaggcagccacacaactcaggttctagcagaacacataaaaaaatagacgggattctcaagcatactcacgagagaatgaacaacagactggtttctcaagcatactcacgagagaatgaacaactctgaactaaaggggcaaaatgcaatcagggcaacaaactcaatggagaaaatcctagatcctttgcattctgagagttttttctggatgatctgtgaggttttccatgtggttctgatgcccaacgtgatcagcaaaaggcccttgatcattcctggcgtttgtttcctgctggaagaagtaggagaagaattagttggattcgatttcagcaatgtgagcagcagattgcttgctcccttttttcaaacaaaaattttactaagaaaaaaaaatcctatctttctgccatgggaggaggactccaaagaacataaattaccatcaaataagctggtagaaggattcattacctaaaagctcgccatatccagattcagcaaaacactgaacaagaactccaggtcagctcaatgattccccagaatttgggttttcgccaacaaatcaagaaccgcgtcttagctgaataggagccaatgcggttgccggcagcatgaccacatgtctgaagcgcacccccaacaatcaaagaaatgaagtctttattggaagcaagacataatgggaggagccatgtaagctatgcaacaggtccaacgagcaagttgcttcatgaccatgaagaaaaaccatgtaaatggaatctgcgggaataaaaacagaaggaactctgtagagctgacccacaacagaatagagttatcttttagaacattattcttttatttagaggcaacaacaaaaattatattgaactatctttctgaatttcgtcacacatcttaccatactcccccatattaagcatctaggatgctcatctagccaatataacaagataatagaatttgcccaaagcattgcatgtggttgttcttaaagaaagtaatagcattgcatagttgtttcactgggggaacaaaagctatcactgctgttgaacagccaagaagattgaatgtaaaaaggaaattttaccgccaacggttgaatatcaaataatcaggttcaattcatacaacaacccaaaggttatgcaagcagagcagtgacgggccaaaggttatgctgaatgacagcataaatcatttcattaagcgccacgttttcttaatactgtaacaatacttatttgtacagaaacatgtccggtggtcttttcacagcttcttactttaacagctattggctttgtttccccaaatctccaaaaatgtaaaatgtaaagtaacaaccatacatttgtaaggcctactgtggcaagcaaatataatcccatggcatgtaagtttctggacattgtatgtttagcaacctcataaaccagtgccgccacccctcaaaaaaaatttagtctagcagttgcaattctctctgctggaagtccagaacactgcaatctcgctctattcagcaagaaataaactcagagaaattggttgtgctgatcaatagcatgttctatacaaaacagttctcttgtttcatgttggacttcatagtgctcagaagtgagaacaatagaacataagaggcagctagctagcatcccatacctttgaggtagcaatctagctcaacataagagaccatatataatgcgtggtcctatgtaagaactatgtgctgcgctacttgatcccctaaaacctacttttattggtagcaaatactcaaatctggatactacacagagtaaattgtggttgaagtacaaaatttataggaaacccatacaacatccacataatttggtcgctagtcgcaataatccttcaccatgtcatccatagtcaactattgaaatttattttctttcgcatcgcactgtaataatccatacatatataaacatgtatcgtataaatcaagcaaatttgactgaaccaaatttagcggataaatgttgtgtatgatacctcataattgtcttgtccagctgcttttcgcaacaactttcgcagaggaaacactggaacctctttgtcaggttagtcccaaatgttattcaaaccgcttacatccctgcaatcctccaaccaaaatatatctttcttcgcctaatcaaccacacttcaatgtcatgttaacagtgcgaatgttgtattgcctccggccgcatcaccaccgagatcctcgtctccacccagaggcctcatcattgttcctgtacacaatcgtcggcagcgagatcagtgagagacagaggacggcgggaggaggataagggcgagggatagaggagttgagtaaggagtgacaaggggggacgctgacctttggtgtcgatgacggtgccgaggacgaggggactgtctggcgctgagacgaagaagaggacgaggtgcctccatatctagcggagtgggtgacacgggagctactgtacatcatcgccgtcatcgatgaagccagcagtgggggattttttgggaggaggatggggaggccaggacaaaggggaggacgttgccgctaccgctgagcaaggagagaccagatccagccatgacgatggccttcccctcctctctccctgaaaacaaacaaacaaaaatacactcaaaccaccagcaacagcagtgaaattaacctccgcgagacccctaatcgatctaccgaacaagccaaccgtgggttccgcctcggcatcgtcgtcgaactcgtcggcgttgaggccgcaccgctctagaaagcgagggcactccgtcgccgacgccgccgcgcccgaaggagccgcggaggacgccacggggagatggcgaacggggaggcggagggagggagacggccttagggtttggtggagaggggcgggagaaaggggggaggaagcaagcggtcagggagtcggggggagcgagcgggcgtgaggatgaggaaggggaagagacgagtgggcgacgtggagggctcggcgccaagcgatcccacgacgcggtaagcacgggcgttaggaaaaaacggatggatagatgtggcccatgcacaggatcgaatggtccacgggaaaggcatctaaaacccaaccatattcaatccatattagcgaggtgtctcaagcggattagtcaacaggagccaaatcgctttgggagcggcaaacgcaggcgctttaagatatctagtatgagtcatgtgctttgcaatgggtgaacttaattttaattgtgccggaaaaaaaccgttcattgcataatgaacattaaaaaataattgttttcattaacttagcacaaactaatcaaattgtaatatgcagtgcatcatagaaataacagtagtggcaacccatgggtgcaccaaaaactgcccaccccattggctcaatcaaaacctaaaaagcaccaatttcatgactccactacattactgcattatcactatataatcacttgtatatcagacatcacataagtgggacccatttataatatcagaattaaaaaatatacatgggacccatttgtcattaaaaagattgtaggacccactgacaggtggggcccacatgtcagtcaatcccttcacccatctctctccatctctcatcttgttcttactgggatgtctctgaagtgcacgtcccacaacacgtccatcatctcaacgtcagtgagcacggtggcgcggttgctgcggaaaccccaccctacacagctcacctcagccactctcttcccatcgatgctgacccgcacctccccctcgccaccgttgtcactgccgcgggtggcgtgcaccgccgcctcgtgctccaccccgccctcccggaacctacactgccggctgaggacaacggcgccgcgtggggctccgtcgctgtctccgaaccggcgagagaggtccaagtagaatgcaggcaatgaggggtagaaaggttatatggtgtgcgtggatgggtcaatagcgactaaggtggacagaaaacgatcgggaattgatggaagtgttcaaaatgtgaacgagtgaactttgagtactattaaagtaaaccgatatctttaagtgctataaaaaaacgtaaactttcgatgctatataaccaattttgcataaatttttagttaggttaagataagataagataattagattgagggagttaaatgcatatggactaggtacgttatgcatgagcctggactacgggcttcggcccatggttctatcgatagattgatcagataactcgttagagatagcatcggtttccaatatctcctagattcgtgccgcgatattattatttttttttctgaaccttccgcgcccttctggccgcgcgccacgcttcaattcgcctttcaagtctcacccgagaacctctccaccctccgccatcgtgccgctgctgcgtgatcagcgtatatatactgtgcgccgtcggaattaacttggtttcgtccttcgtcgaaatcaacttggtttggttagtttgcggtgctttaagcctaaccggtgcgtacgtatactgaagccattaaattttcgtttatttttcactgcacgtagatatatacgcgttgctaaagggcacaaattaagattaacttggttgcgttggattgattttgggaaaagctgatgcttacataagccaaataaaaatctggtatagccattcaactttcatatatatgtcgtatggcgattttaaaattttactcaattagttttctcttaattagtagtatacctacgttcttttaatatatatgatgccgtttactttttaaaatatgtttaaaaatttatcttatttaaaaattatggaattatcatttatttcgttatgatttaatttattattaaaagttattcaagcatgttatatatttttaacatttgtatataaaagttttaaacaagacaaataatcaaacctacgtcaaaagtcaaatgtatcgtatatttaaaaacacacggaatatcgaacatctatgtatatgcatgcaggcggtacatccacactagtaattcaacatgcctcgagatagaggagcgtcatcaaaaaccctcgccgagctcggatacgtggtcggcatggtcatcacgtgctacgtagagcgcgagttcattagggcaagacgtggaggccttctcgcataatacctgacaacattctatttgatgcccatgggattctacttctttgagttgaacagcatgttcttagtttgcgacttaataggagctccaggctggatcaggacccggggccgtttacgagtgctccttttattctgaagtgcacctacagtttgttaatcttattaataaatagatagtgcattttgtattttaatttattatattgtgtttaaatcttcccaacttccttgtcttttctttccgttttgtatttgcatgggttcatgaacccacaagctcatagaatataaatcaattgatgctctgaatttttttcaatatatggtgtatgtgtgttacacaatgaggaagagattgtagggagtcgtcacggccagttgctcgatcgggtgattaagccgatgatgtgggggctaaacggttaagaggaagaagccaaaggtggtgccgacattgaagacgtacagaggtcaacaatatggtgggcgacgcacacccaatctcttagggcttgtttaggttctaacttttttcttcaaacttttaacttttctgtcacatcgaatttttttttgcacacacaaatttcaaacttttccgtcacatcgttttaatttctttaaacttctaattttaacgtggaactaaaaacacccttagaagaaaaacaaacagtagagcagcaatactgtcgcaagcaaatagtagtgcaatacgtctcctagcatgcctcaatgttctatagaccaatgtccagaacaccacgaactctcaagtctcaactctatttatcaatggtccatattcatagcaccacaaattttggcatcttccttacttcctggaaatgtagcttatcttttcttttaaggtctttaaggttaaaggggcaactttattgattacggaaataaggattatattcttggtctaacaagtctatgatttttgcgggagcatacaatcttcacaccgcacaggacgtagagctcatagccatttcagctaaaactatgagcaactatgagctcatagtctatgattttggaggcaccggccgcatcatccctgcgcttcaagaatagtcgcagccaagatgatctcgatgaaccgtgcttatctctttaggtaaattttgatactccctccgtttcaaaatgtttgacaccgttgactttttagtacgtgtttgaccattcgtcttattaaaaaaaattaagtaattatttattcttttcatatcatttgatttattgttaaatatactttcatgtacatatatagttttacatatttcacaaatttttttgaataagatgaacggtcaaacatatgctaaaaagccaacgatgttaaacattttgaaacggatggagtacatgtcattacacatttataatattagaacatcatcgtttctatttgtgaaaccggctatgttccactgaaatttcctaaaatttgagccatgccattctcttcacttttttctatcatcttcccaaactccatccatcctcatcgggggaaccagcatcctgtggtggcagagcgtgtccgcggcggcggcggcaccaacatccggcaatgttgtcgagcacagttcgcaccatgtccttgatcaccacctccttgctgatccggtcgacggcgaggtgctcgcacgcggggcaaagagttgctcgcatattgatattgaggggatttagccagaaaaattaataatcctggtgaagattgagcaggattttgtggtttaattaattacttgcatattgcaatcctgccgaatctccgggacatgcgatgtgtgtcggcacacagctgcacggcgaggttttcgttggagaggccgagtgagtagaggaactcgacaaatgcttgcgcgtgacgtcgacggtggcagggagtttgaggcctggtacgtcgatgccgaacgaggcgaggaatgtggcaacgttggcacggagcagcggtgtggccacgctccatgtcaaggaggctggggacgcaggaagtaggggctattcagattatgatactttcaaccatattatttttttttaaagttgctaaaaaaatatatacgtttagtttgttatcacatttggtaaatacataaaaaattctgctaaaattttgacaatattatcaacttgataaaattttatcattaccaaaatttggtaaagtttattttagctacaatttaaataggtccgtagaggaaagaagaggccgcagaatgggatgtgaccgcgctccatgttcatcgagcagatggagaccgcccgcatgcagctccgccgccggcgacggctgctaggggacgggcagaatccggcgcatccagcacgcaccatgcggacgacgtctacgaccgctgcctggccctcctcgacttctcagatagccgccggcgcactactgcgttatactgctgcctttgcaggattttcgggagcaccagcgaaaacaaaatccgatcgattccagggaaaaactgacaaaaaaaaaccgcgtaaaaaaacgtttcacggaaagtaaaaaaaaagtgtctgattcccgaaaaaactgtcgtccaaagaaaatagttcgtgaaaaaaatattctgattccattgaaaaaacaccataaaaaacccggttcggcatcacacaaacgctttatatatctttatctctatcaaaagcgaaatatgttgttggttcgtcaatttattcttcggatcggtttctcggcgatgtaccttttggatttttcatgcacgcatcgacgtactttccgaatcccgcgggtgtcctccacgcatcactaaatcagtttgggccaggtttttccgcacgtatatatccagttcacgatcccaattagatttatctgtgtagatgcatttcgagatattttttttgtctgttggtagagatcacatccatcgccaacaagatcaaccacgttggtacggatcaaatacggcgcccacggcccacgaaattttccttgagccgagtatgtgccaaataaaaggagcaagcaaaacctcattgggacctaaacacctctcgtcgcctagctccttgttgccaccaagcggccaaagccaatcaccatgagcccatgatgtgctctcgacgatcatccatgtgaaactctcaaggcgagagaaagttttcatacatgtatccatgagatttagattggttcgaccaactacatggtcaaacccgactagctctttgcatcgtcaaaatagtgttaagtctaaggaaagatccaacatatgagagaggtccataaataaattaagaaaaatcaatagctctaactctcgttttggatcaattatcgatattgatttgactatggataaaaattaagaaaaatcaatagctctgtcattgcttttggggtgtaaattattctattgtgcagtgcacttatagtctaacataataaaactatttaattgatactttgacaggttatggacaggtaacatatttatttttatgtttttacatgttaattgaatataaatttttagttgaaaattaagatgtttctgacttcttttcaggtttaattgtaggctattaactatcgataaaattgagattggcagctttaaagccaaggatatatttttcatagattgatcgtagagaaaattgcattggtggtatacaaacttattaggatgatgcgatttagtacataaacttgtaaaatacctgtttcagtacacgaacttgtctagttcgtgagaacgaggaccaaaatatcattgcttggtttttttcaccttttttctactatcactgtatcgtattctattttttattagagaggtgtatatctaatagtaaccttctcaaatatacataatattctaatcagcccctgaatcaataagattagccatgaagtgtccttttcgccttcctccgcacgcatcagttaagttcatgcaccaaaatgagcattttacaagttcgtgcactagattgcactcacctgacaagttcgtgtaccggcgatgcaatttactcttgatcgtatgtattctttttatgtttccctttgcggtttatgtttatcttatattttggtaagctcttttacttcctaatcaatgacttggtgttaatagctatctataaatagtcaaatactaattagttagagcgattgccttcatctatatagtaaaatatagtaaagtaatgcaccacgctcacgctcaatatgcatggttccagctccgccactaatgcccatgacgccatcttaataaattcttaacttcacctcaagcttttacttgcaccgtgcgtactgcgtccgtgccactgtttgaaattcttcttgaggttaagaaggacctgttttagacttcctataaggagagcagaagttctggaacaaaacaaaagaaaaggtaatttcgaattggtaccaaaaattacattaccaattttttttagtaagttaaacagtaagagttcctttgaaacacctcactgaaaaaaaagtacggatagaaaaaggaaacacacgatttttatctattccataataatttcaaagataaggatagggtttcctataaattttcccctataataaattgaaagtatctcaaattctttttttttttacaaatcaatgggtgttaaatgtggtaggcttggatgaaggttaaacaggcgtaattggtagtgcctacgtttaatttggtcatattctagaagttcagtaccaattcaaacaataaccagataacattaccaaacaattgatgaggtagagaaccaaacttaatcgatctcaactaggagagttacttctctatctctacttctctactattataaaaattgaatatgtttttgccggtattttggtacgtcatccgtgtatgaatcggtttttaagttcgtttgcttttggagatacatatatgtatttgatttggtttttaagatcgttcacttttggtaatacagaaggaatcatataagaattctgtttaaaaaaactcgtatagtaacttgagacgattagacgtctaactgcagctcatgagggtaccgagctcgaattcgccctata

SEQ ID NO: 1648 - DNA, 8525 bp, Oryza sativa
atatatatatatatatatatatatatatatatatatatatatatatatatatatagatatatatatatatatatatatatatatatatatatatatatatatatatatatatatatatatatatatatatatatatatatatatatatatatatatatatagtaaatttgtttggtgctccatggtgcccgggcaccatgattgaaatttactatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtaattttgtgcattagataccatggtgcccgggcaccatggtgccccatatgagtgtcctctatatatatatatatatatatatatatatatatatatatatatatatacactagaaaaaatatccgtgtgttaaaagctatcttaatcttattattgttatatatttttgggtttgctaattaactgttgacagttttcagcgctggcggtgcgtgcagagatggaaaaaatttgcaagccctgttcgtgctaacggtgcaggaggataggaaaaatttatcaagcgcgccatggggatcgaacccaaaacctgcaacatacacacttgctccattaaccagttactcctttgcacttttgtgggagttacatccgagttacatattaattatattatagttacataatagttacaatgtaattacactatagttacatactagttacatttgaaagtttttcatctaaaaaactgtcgagtgttgtatagctactcccatatattttagttaacgagaaatctattgagggaacttgtttggatatatattttttaaaaaaaatcatgagctgcaattaggaatccaatcgtctcaagttagcaggcgagtttttttaaagagatttcttatacgatttcttctatatttctaaaagcgaacgaacttaaaaaccgactcaaacatggatctgtatttccaaaaacgaataaacttaaaaatcaactcatgcacagatttttaatttttataatagtagagataaatgaactccaacagtaaatttcatcttaactgaaccatataacaataataagattaaaatagacttcacccgttgcaatgcacgggcattttttctagtacttaaaaaaataataggtgctttcgtcgtccgtcaaaaaaaccggccaaaaaaagggcgaaaaaaagaaaataaacaaattgtccgatccaaaaagagggcgaaaaaaccggcttaaaacaaatcgtgcgaagaaaccaggcgaaaaaaggaaaagaaaaattaaatccgtccgatcaaaaaaggggcgaaaaaaaggaaaagaaaaacgaatccaactccgtcaacgcagtaaaaaagggcgaaaaaaaataaaaaagaatctgtctgattccaaagaaaaagaaattatatatgacgcggttaaaaaaatatcaaatcctattatattatctctatctctactacttaaaaaaaatctctatctctaactctaactctacttatatgatatgagctgtttccgtcctctgtgaaaaaaaatcgggcgaaaaaaaaacggacgaaaaaaagctaatcctattccgtctaaagaaaagggcgaaaaaaaaccaataatcatgaaaaaaaacgggcgaaaaaattcgggtgaaaaaaaaccgtgcaaaaaacaacaacgattccgtgtaaaataggaatcggtaaaaaaaaccgggtgaaaaaaccagacaaaaaaacgaatctgattccgtggacgcggtaaaaagaggggaaaaaaaacgaattatgtctgattaaaaaaagaattatatgtgatgccgtaaaaaaaatttgaatcctattatatgtgacacggtactatatatctctatcttctctatctctatctctactactttaaaaattaaaacgtttccgtcgtccgtaataacgaaaaaagagcaaaaaaaaaacattaagaaaaaaaaaagtccgattcaatttacttccgtcgtccgtgaaaatcttatcttatcttaaaggtccaggccgctcggcgctcatcgccatttgcgagcccgcctagccagaccaccgacgctgtagcacggctttgcaccgccctcgagtgcgcccgctagctggcgaagcaggagccgcttggcggtcgtcaccgcacgcgcgcaccagctcaccaaactgccatcaccaccttcggcgtcgttctgctcgcttgtcgctggagagaaataggatcgggagagagggatgtgggagcttgggttttgcccctctctcccggtcgtcacttcatccagcacggggacgatcggagccatccattagatcggacggctcagatttgcccagcgtcgggccaccgccgccgttgattacgctgcgcccaacgggccgcgaaagtgcatcggaccgtccccacatatgtgtgctgcgtcagctgcttggcctgcgagccgtcgaattgactcaactaaccaaagatgggccagcccaagtttggcccggttgggaagacctgggccaatagcaaatttgatcaaacaatgtggctcagattttttaaattaaagtccgtcagataaactcataagtagattcgaaaaataaatctaaaactaaatcctaaatcctatgctaatttatcaaattagactcggtcctacctatttgttaatatatcaaattagacttgatttttaccgttttgaggttttcaaggtttcccactatcgaacggtgtttttcccgttgcaatgtacgggcactattgctagtaaaaaaaaaaagctgaagcccatgacgccatcttaatcctctgctcgtactgtccaccaactaacaggcacttgacctccgccagtccaatcatacacagccacgtgtcctggcacttcaaaagttagttaatgtgttcaaccaccagcagctaaaccccgccaacctttgcttcccgccattaatttctcctccctatttatgctcccccatcctccgcccaattcttcccccaaaacgcacaccccaatccgatccagaattcctccgtcgcgaatcctcccttgtaccctgttcgatctcgtgcgcggcgcggagcggcggacgacgacgatgccaacggcggcggcgatggccggagggatggcgacggggccaggcagccgcgtgacgcggtacgccaagtcgacggcggcgtcggtgacgccggtccgccccggcaagacgcacgcgctgtcggcgctggacaacgccatggagcgccacgcggtgtacctggtgctctactaccgcgccgcgccggggctcgacagggagccgctcaaggagtcgctgtccgacgtgctgtcgcagtacccggccatgaccggccgcctcacgcgccccgccgccgccgccgccggcggcggtgaaaagggcgggaagggcggcggcgccacggcggctgtgcaccacgggtggatcgtcaagtgcaacgacgccggcgtgcgcacggtggacgccacggcggcggccacgctcgacgagtggctcgcgacggcgtccggcgaggaggagatggacctcgcctacttcgagcccatgggccccgacccctacatctggtctcccttctacgtacaggtgaccactactctttactcaaatcaaatctaacgacagtaattacctcacttcgtgtgtttggtcagagtaggtgagctaattagcaaaaattaaagatgctaatggaccagtagatcatcttatctatttgttcgtcagttgtttcaattaacattgctaccagcaatcatgtcgcgaacctacgatttccggaatttaatgcgtctctctagtctggttagttggttgcttggaggctagaatcgtacgtactgttacatctcgccggccagcatggccattttctgtcaattgaatgcgtcacatggagttgccgttcatgaataatccgatcaattttcaagttgatatttgctcaaatcagcagcgtttagtacaaatttacagtgagtttttactagttttttacggctatggagtgatcgattctgaacttgtgtgagccccgtgcagctgacggagttcgcggacaaatcgtacgcgctggggctgagctgcacccacctgcacaacgaccccaccgccgccgtgctcttcctcaacgcctgggccgccgcccaccgccgggatagcccctaccctccgttcctccactcgccggcgctcgccgccaagtccgccgcgccgccgccggagcacccgctgctcgccgccaagtccaggggctccccggacaccggcggcgagatgtcatccgccacgttccgcttcagcgcagccgcgatgcgcgcgctgctgtccgccgtcgagccgggcaccaccccgttcgccgcgctggccgcgctcttctggctccgcgtcgagggcgacgccgccgacgccgccgccggcgggggcgcggccgaagagagggagctgacgctcgcgctggacttcccgaagcggatgcaggcgccgctgccgacggggtactacggcaccgcggtgcacttcgcgacggcgcgcgccgacctgtcgtccgggctggcgagcgtggcggccgcggtggagcggcgcgcggccgccgtgccggaggaggagctgtggcccgccatcgagtggctgcacacgcgccaggccgccggcggcgagccgttccagatgtacgggccggagctgacgtgcatggcgctcgaccacgtgcccctttacggcgcggagttcgcggccggggcggcgccggcgcgcgccgcgtgccgcgtcggcggggcgagcggcgagggtctcgtgatcgtcctgccttcggccgagggcgagtccgcgagggacgtggcggtgacgctgccggcggcggtgacggccaggatctgccgcgacggcgaggtgctccggtacggcgccgacgtggtgttcggcccaaaggtggacacgcaggcctcgtaggatgtcgggctgtcggcccacagaaaaactcatctgggtttctttgtgctttacttaatttgttgtgatgtggccttcaaaagttcaaatgattgatgtaccctgctttgatgtgtttttttttttggtcttctgttgtaatgcatttcctagttacaagttacaaccagtcataagttttatttatttattggtaataaaaaatgttgaactgaattcatttatgagagtatcactctatgctatttcggattatttgctccacacctttaaaaattgttgtatattttcatctattgtattgcttgaatcacttattctgagcatttgttaaatttacttttaaagatatttaatttttccttagtaaatactccctacatcccaaaatataaggcataaccgcttttctcttatgtctcataatatgaggcagacgtgcatgcatgcatacattaactagtatctcttggtccaatagaattgatttgttttaaatcctataccatcaagcctcccagttacattgcttgcatgcatcaagatgatttaaccaaggtgattaaatgttttcttggtctttgtgttatgagtggttgagccttatattttgatatggagggagtaatctatatcaataattcggtgcataatttcattccaaggggccagagtgccgggccctccctcataaaggaattgtcttgttatgtagttagaaatagcaatgtccaagaccgaagatgcagatatgcaacgtgtgaatatggaatcttctgcctttgtagctttagccaaaataggcgaatgagttgctacagacagaagtgtaaactgtaaagttgtcgaactgaatttcctttttttaataaaaattgttcatttgaatccatttctgattgtatcactatgttgagatgcacttgatagtgcaatgacaaagggtgtgtgatttcaacaccaagatcccgtgttcaattcccaacacactcatagtttcctcttaaaaaatgtttggagggacgtctcctactccaaatctcctttttttcccctattgtatcactctgttttaatatttgaagcagagaaatgcctctattatattcctctctcataaagaattgctttattgtgtagttagaaaaagcaatgcccaaaaacagctctttttttatcgctctgttttaatatttgaagcagagaaatacctctattatattcctctatcataaaggaattgcttgattgtgtagttagaaaagcaatgcccaaaaacagcagcagcagatatgcagcttttgaatatcgattcttttgaatgatttgctactgaagcgtagagtgcgatacttctagtggtaaaaatcttcagggctttcagaggccaaaagcgtgctaggcaccaaggagatattccacggcaggttcagtgctctttcttccgccggctactcgaaataaacgtgatttgtttggccactaatgacaatatgacatgtgccacaattggacttgttgtctctggttgctatcaatgtccttcaaagttcaaacatgatgaaactaatgtatcttagctgtgcaatcatgtttccttcgttttgcatcttttgcatcaatatatatatcatgcgccttacgaccaacatggtaacttataagcataacatttagtttttaaaatatagtttaaaggtttttcactatgatttattttccagtatttactttttttaaatagttaggaacaattatataaaagttttagcaataaattatttttttaattgttgataagttattttgcttataataagtataagaaaaaaatgttgagtcccttggtattacagcagtgagtttatcaataattcacataaagaatcttctttttttttcccgttatcagactagaggcaaatattcgatcttacttaatttccatctaaagcacacttacatatgcgtatcattcttggttatgggcaagaaggttgggtttacttcatcaacgaaacccgatcgattttttgcgattttcaatgttttcgacgtggctcaaaatcaatatctgggagggatttcgaatggtctttgataaattcaaatttgaaacagtagtttgatccaagttttggccttgtttagttttaaactttttcttcaaacttccaatttttccctcgcatcaaaacttttctacacacgtaaactttcaacttttccatcacatcgttataattttaaccaaattttcaatttcaacgtgaactaaacacatgtcgaaatgcaatcaaaataccaccacatggcgcgggatcgggtagtcagtcggaaacgtaaacaacaccgttgtttgtttgtggaaaaatatggtttgagatttgagaaccgtacaagagtttgccgagaacttgaaaaaagtacaagccaacgatgtgatactatcagaaaggtcaagagatacgcaccgtgtttagttttaaatttttttaagagatacgcaccgtgttttcatttttttttaaacttacaactttttcatcatattaaaacttttctacacacataaacttttaacttttttatcacatcgttttaatttcaaccaaactttcaattttagtgtgaataacacaccagatcatacgagacgctatttgagatgcgtaccgccctaacaacatctcgcgttgcgccgcgcgcttctctcccactccactccactcgtgcatcggccatggctgacgcgatcggcggtggcgggaggcggcgccggctgagggtgttcttcctccccttcttcgcgaagggacacctgattcccatgaccgatctcgcgtgccgcatggcggcggcggggcccgaggagatggacgccaccatggtggtcacgccgggcaacgccgcgctcatcgccaccgcggtcacgcgcgccgccgcgaggggccaccccgtcggcgtgctctgctatcctttccccgacgtctggatggagagaggggtggagtgcctcggcgtggccgccgcgcacgacgcctggcgggtgtaccgcgccgtcgacctgtcgcagcccattcacgaggcgctccttcttgagcaccgcccgacgccatcgtcgccgacgtgcccttttggtgggccaccgacatcgccgccgagctcggcgttccgcgcctcacgttcagacccgtcggcgtcttcccgcagctcgccatgaacaacctcgtcacggtgcgcgccgagatcatccgggccggcgacgccgccccaccggtgccccgtgccgggcatgcc

SEQ ID NO: 1649 - DNA, 2004 bp, Oryza sativa
agggcgcgcgtgctggcgaagcgcgcgcgcgccgcggtgggcgaggccgggtcgtcgtggcgcgacatccaccgcctgatcgacgatctgacggaggccacggcctccccggagccgcagttgcagtagatccgaagatctcatctgagacagattaataagataggatttgtagcttccctttacttgtcgctaattcgtatgcactctgtaatggtctttatgaatacatttcttaatagttgcttgaatatctatctgtgtttttaacacaagagatcaaagtttgctcggtgaattttcagctggcaaaccaacaaaccatttcaatcttcaactacgggcaaaactgtgttggtattttttgggacagcggagcttttgtcctgactgggagagacataggaagcaatatctgcacatttctgtcgaagtcgaagttgccactgccaaatcctacctctcttccaaatgcgaagatctcatctgattgacaaggtagaatttgtagctttccttttacgtcttgcaatatatgtccacccaacagagtgataatcttcaggaatgaatattgacttgaatatctgtattttaaacagaaaataattcaagtttggtcggtgaagtttcagctggcaaaccaataaaccatatgtttattttcctctggatcatttggcaagctttcaatcttcaactacgtgcaataataaagcttttccaggaccttttttattgtactaaaaaagaaaagaaaaaggatgcttcagggtctgcagactacttcacaatattattgagcccagaagaggcctgcagctctatagcccatacaagcaatgaaccatttcgtcgaaggcccaaagggtaaaaaacaaaactttacttcgtctttattaagttacatgcaccagccagttgcacctaaaagcctaaactgatagggaaaggcgggcaattcactttatacactccaacactccccctcacgcgagaccccctcaagtctcaagcgtggaatattggagtgggctacaattattttatttaattgcgcgccagccaggattcgaaattattttatttaattgcgcgccagccaggattcgaactcgagacatttggctctgataccatattaagttgcatgcaccagccagttgcacctaaaagcctaagctgataaggaaaggcgggcaattcactttatacactccaaccgtcttccccaattgcggtatgggagcctcgcccattctaattatttgatgttaggtcattccctaatattcatatcttttttcaattgcggtatgaggggtcgctcgactggttgcttgttagggcaagtattacaagcatccaagtaaaatctcctaaatgtcacataaggttaagtagtgaggtggaagagaaaagagatgagagagatatgaagtcacccctcatacaagaggcaacccctacataaaattcaagacaaaagaagagagatgaagagtagattgggcaaataaacattagagctagtgtattagaattagtatatatgtgatataatgtacatattatctatatttattagttgatgatatgattaagattagatgtagcactatctcttttataaaacttgcccttagtgatctcggtaggtgctcctctagtgtccaggtccatgctcagggaaagttctcacgcttcgtttcatgcggcttgtcgtgaacacggcctgtggcaacgagttcatatcttccaaccaagtccaccggcagcggcagcggtgcagaggcgatgagcttcacacggcacctcattggcaaactcatgcatcccatgatgtggagcggtagcagacttgccgaggactatagccgcctccaccatcaactccttcaaatgacaatgccgcccgacggtggtcgtgaggccatccacctccgcgaatcttcgctgtcactactgctcagtcttggccgctgcttggcttcctcgaaccaa

SEQ ID NO: 1650 - DNA, 7264 bp, Oryza sativa
gggcccatctcccccagttctcctctccgatttctcgccgcccttcacgtggctcacccccctccctctcacggcccaactgtcagcctcacatgccaaccacgcggcggggtggccaaccagcatcctccaggtatacaaaaagaaggggtcaatcgggtggggccatctgggcccgcgcggttgggcgaaaagcgggggagcccgcagctgcagctgcaactggcaaaaagaaaaaaaagataagctgggatgggtgtgagtgggaaggggaagaagcttccagaactctcgccccgggccttcccgaacgttcgccgccacgtcaccgcactaggcagcacaccatcccggggggaaggaatgaaggctccgcttccagaactgtctggaaacttccgcccccacatcccaacccacccgacccgacgggtatatatataggccggggtgggggcgcgaatgctggtcctggtttcgacgagctccatcatccaagtacgaaggggataaagggactcatcactccacccagctggagagaaaaaaaatctcagctgtacttgctcgtgttctttcctctcccttttcttctccgccatcattttctctgtactttggggtgtacttcatccttctgtattttcggttctttttgctctgatttgtcatcttttttttgcgagcgagctcgttcgctcgccaacgaacactcctgctgtagctgttcttggcgttaatgaaagccctgcattctcgcatttgcaatcgccatttattcagctgtgatctttgtagagtgttgtgttgattaagaatcgcatgatttgggttccattggtttgtttttgcaagagtttttgtgtttttctctgatcccctttcagctgattgaatgatcatcttctcccctaattctccatctgtctttggtggtgattgatcacttaaactctacacaatttgatattttttgcaaacttttcagaggcaagatcgttccagattgaattcgttcggtggagggcgatatattttttttcggcaaggatcgccattctcaccggtcgttcaaattcttctcctgcgttaagtggctgtgtgtgctctgttcgtcatcttcctctgctactcaattgcattggttggttggttagacatgaatccattgcgcgtcatcgtgaaagaggaggagctcgacttcgccgccgcggcggcggcggcggcggcgggtgagggctcgccgtcgtcgtgggcggtcggcgtgatggacctgcctcgtccaatggagggcctcggcgaggccgggccgccgccgttcttgtgcaagacgtacgaggtcgtggacgaccccggcacggacaccgtcatctcgtgggggttcgccggcaacagcttcgtcgtctgggacgccaatgcgttcgccgccgtgctcctcccgcgctacttcaagcacagcaacttctccagcttcgtccgccagctcaacacctacgtaagtccatcaatggcggaatgcgatgcgcggttcgtgttttggcgtgatcaatggcggggttcttgattttcttttcaggggttcaggaaggtcgatccggatagatgggagttcgcgaacgaggggttcttgcgggggaagaaggagctcctgaagacgatcaagcgacgccggccgccgccgtcgagccccccgtcgtcttcgtcgtcgtcgtcgtcgtcgcagcaccagcagcagccggcggcggcgtgcctggaggtggggcagttcgggcgcgacggcgtggtgaaccggctgcagcgcgacaagagcgtcctgatcgcggaggtggtgaagctgcggcaggagcagcagacgacgcgcgcgcagatgcaggcgatggaggagcgcatctcggcggcggagcagaagcagcagcagatgacggtgttcctggcgcgcgccatgaagaacccgggcttcctccagatgctcgtcgaccggcaggccggccagcacggcgcccggaacagggtgctcgaggacgccctctccaagaagcgccgccgcccatcgagtaccttctcacccgcaacggcgagacctgcgccgccggcgagtcggcagctatgctggcggcggacggcgtggcggaacccgacggcgacaccaccccgcgccgcgacggcggcggcggcggcggcggcgacaccgagagcttctggatgcagctgctcagcctcggcctggaggagaagcagcgagaggacggcgtcgccggcggcgtccaggagagtaacagcggcggcgctgacgtggacaacgacgaggaggatgacgacgatgacgtggacgtgctcgtgcagagcatatatcacctcagccccaagtgaaaggtcgagaaggttccacggcgaaaacgaagggtacgtttcgtttcgtagggtgacgtaatcgcaacagtagcgagtagtaggaatgtaggggtagcactgcacttgtctttctttccatttttttatagtttcggacatcttgtcgccgccctgcaagttgccaaaaaaagcagccaagccccactgccacaggcgacggaaggttcaagaagtcgagaagcttctcccgcgggggaagcttctagaggtgtccagtaagacagcacagtagctgcgggtgttcaagaagctgggaagcttctagatgtcctctaggacggtggcttcgaatgttcttcttctggaatttgcacctagtatcagctaattatgtgcgctgtattttgcccatgctactgccatatgcaactggtgcctcttatcccccaacagctactgctgcccttttaaaatttgaaagttacggagtaatttcagctgatttttaagtttcttcattagtagtttactttctgtattggttgtcaaatcttaaataaagttctacttataaatatcttggctatactagttcattttccccttgtcttttgtcatggaaggctgcctgttttgtcgtgtggtgacagttctgaacttttcatctatactggagtgctacgtggagtatatacatacaaagtgctccattttgtttgagccgtgccgtgagcgcgtgtccttgaccagggaaaaaaaatgttttgctttcaggttgcagaggacaagaggatgtcggtgccaaagatattttcaaacatactaaccgaaaagggcaccaaaatatcatcatctgaagatcttaacagtatcaagaaagtggttcccagctcatcaaatctaggagtactacgtggtaggagtatcaggctccacctgtacctggtgtcttaattaaggaaaaaagaacagagaaacgctcggagagatgattcagaagcttgacagcgagtatttcaggagtacgggtgtcgcttgctgcgagatttcacaacaggagactgtctgtcacggcgttgctgtaccacctctttaaaatggatcgtgggacaggacagttgacacgtagagtaacactcgtactacccgtttccgctaaatgtcaaaatcttgtacggagtactatctggattaaaattaaagtttatctatgaaaagaaaagatcatctcaaagcatagaaccactacaggtgtacagtacaaaagaaattttactgggcctctcacacataaaaaggagaaggaacaagtccaattaccgtcccttatctttacttcacgtttaattgacatccctaaattacaattggcttgttcggcagaactagccgttgcagcgctgcagcgcaactacagcagccaatcagcaactactcctataggtttgcaacaggacaagcatattaccgcattgctacaatggccatccgctgcaatgcttcagccgttcgactatgactatgctgtacagacgtaaaagcgcaggttggcttgccgaacaggcaaatcttcacccttcatcttagcaaagccgtctaagttaggtccatagcagtatgaagggctggttttgacttatgtggtattctagtcaggaaaagttaataaaaaacgtgtggccccacatgtcagcatccacatgtcgttcgtggggtggtggcgagcgagctcgtccgggcaccgtgtgaggaaggtagaggcgagagagggaggcggaggcggctgacgagcttgtccgaggagaggagagaggcaagtgggcggctagaagaggaggggggtgaccgggtaaggggtcatcgagctcgcattcctcacggcggtgtgcaagctcaacctcggtgacattgggagcctatgcgagagaccgtcttggatggtgcggaggtggaagcggcctcggcctccgcgagaaggtggagacaaaggcgactgtgggtgggcctgccgcgccaccagccaccgccaccacagatagccgcgatgccgaagaagatggtcgtcaactcccatgccaaggcaacccgcgagcgtcactatattgtggaggccgagagatgtcgggactgcctggagagcgccaaggaggagtattgggcgcgaggccgagagctccaagtcccgcgttccgcgccacaaggaggaggatgccgaggagcacatcaaggctgccgcctgcaatgccggcaagcccctccaagatcaagcttgcccagcctccatgcgagggaggcggagatgggaaatatgggggagggcggggacggctccaagcactggggtagggacgattataccatgcgaactcgtcgcgcgtcctccatgtcaacgtagtcgtggttgcctggccttgagcttgaggaaaccgagagcaggccatgcttaggcattgccgctgtcgttgttgactcgtctattgcgtttccccctcccatagctcccaccatcagtcgcgagcatggccgccggcagctcctcgaggcagatggccgtggatctcctgcaaccgctctcctcaatgtcgtctcccctaagctatggcagtcgcgcttgttgtctcccaaagctacgacggttgttctcctcgacaccggctcactctctgtctcccttgccctgtgctcgccgccacctttacggcggctctagaacatgagaaaggaacgagaggggagaagagaaagaggcacttgcacgtgtgtcccacatggtatttttattttcttttgctgactatgacgccacgtcagcgaaaccatctatccatattactagaggacctgagttaaacggttttgtcaagatggaggttgaagatttcgggtattacggttcaattttgctacatatttatcgacaaattttctcccaaaaatttgacagatgtaattacagtacaatcgtactgtaattacactgtaacttgtatataattatactgtaactataatgtaacttatctgtaactttcaaaaatctctccgtaacatgttatttcggtaaaatggaggtcgtgggaatcctttcacatatgtgtagggatgaaaatggttcggatagtttccgtccgtcctgaccaattttcggattcggaaaaattcggtcggaactatccggaatttctcggattcagaaacgaatttggattttttttctcggatacgaaaatgaatacagtaagggtgatattcgacgaaatcgaaaaacggtccgaaactaacccggatttttcatccgatatccagtaggttacatgcgagcaaaagggaaaattttcagcaaaaaaaaacccgaaaccctagccggccgcgccagctttgcgccacccaccgccagccgccgaatggccggcgctagatccatgccactgcagccgcccgccgctggccgttgtgggcccgaccgccgaacacctccctagggcggcggatccggcccctcacgagggcgccgccgccggatccgccgccctcgccgcctgccgctgccgcccaccgacgccatcgccggctcgccgcccaccgaagccgtcgtggcaatcgagcccgctgccgccgcccgccgcgcgagcccgcccgtcgccgctcgtcgcgtgtcgcgccgctctcggccggccgccgcccgctcggccccgcgtagtgagatagaaagagtaaaaagtgtgtgtctgtgagagagagacgagagaaagagtcaagagaagataaggttgggaaaaaatggtagattttttttcaatgtaaaaatcgattttttttacatgtggctctttaaaacgaattttaaggaactaaatcaactcatataaaaaagttgtcaaaaacaaagttgtataacttattgagatttaccatttttcttttggtcatttccccatccgagttttattgaactatataaattttgaattttaaaatataaaaatttaaataattttttgggtagtaaatgatttcaaatgaaaaaattgtcaaaaacaaagttgtataacacatcaatatctacaacttttgttttggtcatttttctatatgactttgtttgaaccgtttgaatttaaatttcaaaatatgacaacttcaaacaacattttgaaatactaaatgatttcaactgaaaaagttatcaacaacaaagtttcataactcatcaagatctataaattttatttgggtcattttttcatccgacaaagtgatagtaactttgttcacaaaatttacatctatctcatctggttctatagactataagagagatatgtaaactttgtgaacaatgttactatcactttctcggatgaagaaatgaccaaaataaaagttctatgtcttgatgagatctacaattcaaaatataaatgtagttttatgttcatgacttttttagctgaaattaattacagcttcaaaatataatttgaagtttttgaaattcaaatttttaattgataaaacaaagtcacacgaaaaaaaagtccaaaataatagcggtaagaatacaataacatgatagagcatgattttggaaacatttaggaaaaagaatcatccaatttggagttcatatgagtgagataaactagttttaaagtttatttttgcatacggcttcttaagacacccttatggaaaaattgatttttccatgcgggtccttaagtggtccacatacaaacaaatgaaaaaaattcaattattaaaaataaccactcaaatttttaaaaactttcatgttcaacccaaaatttaaaatattcaaccaattttcaaaaatttcaatgtgcatgcgaaaatttcagtgatgcacattaatttatttgatttatgataacataaatttgtatggaaa

SEQ ID NO: 1651 - DNA, 18530 bp, Oryza sativa
  unsure (1)..(18530): unsure at all n locations
nnnnnnnnnnnnnnnnnnnnnnnnnnnnnnnnnnnnnnnnnnnnnnnnnnnnnnnnnncatgattttggaaacatttaggaaaaagaatcatccaatttggagttcatatgagtgagataaactagttttaaagtttatttttgcatacggcttcttaagacacccttatggaaaaattgatttttccatgcgggtccttaagtggtccacatacaaacaaatgaaaaaaattcaattattaaaaataaccactcaaatttttaaaaactttcatgttcaacccaaaatttaaaatattcaaccaattttcaaaaatttcaatgtgcatgcgaaaatttcagtgatgcacattaatttatttgttttatgataacataaatttgtatggaaagtaaacacaacattttctatctcccccttgcccttataaatagagataaaatttgaaaatggtgatgttttgtttttgaaaactaatggctacagctcttccttgatttaagaagcttattttgaggggtcttaatattttgataattattcgttagcgtattcgtttcaattcgtattcgctccatacctgtattcgataatattcgattccgttttcgtatccaggttttcgattccgagaaaaaaatatgaaaacaaatatgatagagcttgtttccgaccgtattcgattcgttttcattcctacatatgtgtgtactgcgattttttttcttcctcaccagaacaaatcttgtaatagatctaatgattcaaaattgcgtgaaacttacatacaagttacactgtagtacatgcaagttacagtgtaattacatgcaagttatagtgtaattacactatgattgtattataattatatctgtcaaatttttaggagaaaatttgtctgacaaatgtataggtggtcccttgcggttttaggggtgtgaattaaactcaacgtaaagacgagagacgtcaagtggacttatttccaaaggagaaatttcatacgggacgtgtttctcggcccagcccaaatatctagagtacgtcttctactcatgattacgtaaataatgagagacgctatttactccgctagatcagccaccttctcctcgccacgtacgacacaagcagccactcgcgcgcacatggccacgtcacgcaaaacccgcagaattacgcgattcgctgagcccttttctgcaaaaacacgcagcctccctcttctccccaatctagcccgtgacctcctcgccggggctacttctccatcgccatcgacctcgacctcgccgcctcctcctcctcctcctccccgtgcgaactccgggctcgtgccgagggggtggacgcgccggtggtgagagcggacgcggtgcggtgggccatggcggtggggtggcggccggcgatgctggtggtggtggtggcggtggcggcgtggcgcggggaggcgctgtcggtgacggtgaccgacacggagtgcatccacgagttcgtgccctacgagggggacaccgtgtcggggaacttcgtcgtcgtcgaccacgacatcttctggagctccgaccaccccggcatcgacctcacggtgcccgcccccgatcctcctcgtcttcgttgtgcttttgattttcgatgcaaggatctataactagatgggtttatgggtttgttttttcgtgatctggggcacgctggattggggatcaggtggaatcgtggtcctctttttgcgatctgcgatttcgcggtgcaaaagtttggggaaatttggtgatatgaagatatttcatgaataggtttcgatttgattttagtttatgaactaaattaacttggcgcggtggctgttcttagtcaattcgttggagcgtggtgcaaacttacgaacttttcgatgatgtttcgatggattggcatgctggtctgtagattttgctgcgtgacagggtcataggttcaactacgtgatagtgtgtttggtggctttccactgatctgcttataaaagtcactacttttagtttgggtggttagttttggccagtggcaaggtgttccagatgattttaccttgtcctgtagaaaatttaagcaaggttcttctctattttcttgatcgggtgtagagtcctgtctcttatgttttggtgatcttgttttaaagttcacactttaggcgttttggggaggctgaacatttttcacctccattgatgccagaatcgaattgttcgctgtgaatgcccctttagtttcttattaataccctgatatagaaaggtagatgaacttgatatttcttcccaataactgtagtttaattgaattatggctatctataaatcctcatcagaattcatttataagcaaactttggagaatacttgtgatgcagtgtttcttggagccacttcatttgaaagaaaagataatgtgccaatttttgcaaatgtgttcaaagcgcattctgcactggagtgtgttctgatcatcacacataactaagtatcattgtgttgcactatagcgttattccactaataaccttgtctcacttcctttcgtgatattttgtgctctcgtggaatgtaggtaacttcaccaggtggcaacactgtgtatacattgaaggggaagtctggtgacaaatttgaatttaaagctccaaggggtggaatgtacaagttctgcttccataatccatatggagcacctgaaaccgtttctttctacattcatgttgggcacatacccaacgagcacaatctggcaaaagatggttagtgttctggtcttttaccttgaccttttcgcttgtcacagtctcatatctgcttatcacgtcaatttatttgttttgagcattgaatcacaatcagtttaatatgcgatcataggtttatatttggtatgttcattttatatttgcgtacataagctatatttggttgcttttgcagagcacttggaccctatcaatgtgaaaatagcggagctgaaggaagcattagaatctgtcactgctgagcagaaataccttaaagcccgtgaagctcgtcaccgacacagtaagcttaacaatccttttgcaaatggtcactgaagctttggcagtttcctataatcctgcgtgtgatatgagaatgcataaatttgtatgaattttctgttggtccactcaccaccctttccacatgaagcaagaaaaaactgatccgttattacattttaaacactacaacattatcaccatcagaaagaagagcaaatagggatagaatggctaatatatgtgactggaaattggatattatttaatttggtttgtgtttaacgactttagcctgtccctttcttagagcacaataaagccacagtttgagtgagacaaatttctgtctggtctcccacttttgggctgttcttccattctgtctttgttcatctctgagctacctaactttcctcctttgttcttccatactactttctcaaattctgatcatcaattcttagctatacattttttagggcaaatcttgatattggtaagtgttaagttagaacctagtcaggtgggtcgatgtgttctcagtcaggaaaaggaacttgtcacctgttgctccaaaaagggagaatatcctctttaactaatatatgttcacatttatggtaattgatgtttcacttagcttctttgtaggggaatatatctaaagttgttttctctttggcttaacatatattcccctttatggtaattgatgtgctatatatagctttttcttgctcttgtagcatgacgtttttatgtattctatttttcttatcattatgtgatcgtggagagcttattttgtgttaataaatccagcaaatgagagcacaagaaggcgtgtcatgttctacacaatagcggagtacctagctttcatgggtgcaagcgctttgcaagttgtttacatccgtcgcctattcagcaaaaacgtggcatacaacagggtgtagaacagagtctacttcaaggcagcagaaaatggttggagcaggaaaaaaatatttccaacatattgtgttagcttttgcagccattttttttgggtttagtctaaaacgtggcacttttaaatttattgccttgtactttagaacttcagtgagatatgaagcacatttgttgctgaacaagtgaacacagatccgtaactaatcttcaaagggttgatgtctcaaagcaccacttgtgttattgtgttaatatgacttatgagggtcttcgttctgatataaattgatcaaattttatcctggtctatgcaattcattcaaagcacaacgtttcctcgttatggaatgaaaaggaagtgttctatgtcaccgttccagacatctataacaggttggtccttgtattctgaacatgtaaaactgcattagcagtatgtaaagttgtctggaaatcatgttaaacattaccgacctaccatgctcttaactaagttactatactggaaaactgatttaagcttattttctagatgaactcataaagtttgaatccgaagtaaacagcaagaaggtggttaaacacacagagtagcaactagcaaacactaaaacatgaacaattaccatatcaatcacttgttgcacggcagcagaagagggaaacataagcaacagaaaaggcatataaaaagtaaattgtacatgtattgatcaatatctcagtatataaggagatctgtttgtagtatacatttgcacatctggacattttacttcaaattggaaggaaaaaaaatgattcgttcctgatgccattttttcctctttgccagacatgagcatgtagtaaaactgcacacgtgctttcagtttcagttcatcacactcttggccattgaggactaactacctgcagagttgaagttaaaaaccggtcagcaattagaatttttcattctgcttagtgtttgtcgattgagaatgcaatagggtacgaacctctaatgtactgaaaactaattgcatgcgactagctactactgatggctcctctgaactgcccgtgacagccatttgttccagctgcaaagttttcactggtaacctgcaacaacagttttgaccccatgcatatgatcataatcataaaacttgtaaataaaaagagaaacattgctaatttcaaattgtctcaccatgccattcctttggtatagtaagcgttcgctattaaggcacaaaatcctttccactgatgcaaaacgtcagctgacactggtggggtagtagaccatctgatgatcgttggttgtggtgtgcacaggattgtaatgaatactatactgagccacaggatgcattcacggacctaccaaaaaaaggggaaattctcgctaagacgaagaaatgaaagcacaggtcttatcaagtgtgtttgcatggtaaatgtgttctccagcagactacatgataccttacataaagcttcatatcttgccaatgcgacttagtggacttcatctatcgataatcattaacaaattaaaagaaaaagtaaagacatgatgatggaaaatgcacaccaaaactcttccacttgtgtataaagactaaagagcatattgtcaatgaaattagagtataaagcaaaggtaactgtaaactgagcactttatgttgtgctaacctcaaaggagtgaactttgaaggtcaagctggttcctcctccattggaccgcagagcttcaatctcaaggccagaatcttcaatatccataagttccttcctgagcccctcttcagtacagcctagagcatatgcattcaccccagcactaacaaactcctggcaggattgaaagcaccatattgaagaaaagttatgtccagaagagaggagaagaatttcagcgagaaacagtaccttcaggttatctccacctcctcggtcaatgacatttttatatcgcttgaataggctgattgctatattgcgtgatgagcggaagtcctcatccgacgaagcgttaacatgaaaccgatgctacacacagcacaatgattcagagaaaaaccaagagcagccgaattcatcaaaaggaaggactttgggacaaaatctgtaccagccaatgccttgtagttctttcacttaaacttctatagagataatggctcgccctggtaaagttaactttgcagctaggaacgatgtgcggcttctgcacatgatgcccttccactggattataaaacgcactgcaacctaataggttgttatgaggaactatggcatgctttggtgatgacttgacctcttggtaagcactcggcctaatgaacagagcggttccatgtagcgtcagcatgtctggatgctcatcagcctgcaagccgtccacacatttctccaataactggagagtccttcagaacttgccaacagttcaatctgcaacaaataaagctttcatgagtcattcgcaactattagttactccacagatcacacaacctcatattcagcccccgaagcatgtgtatatgtgtatacaagtgtgcaaaatgatcaataacagtgtttctttagggggtcaaaacggcaatgtttcccacacatggtatcaagatgtaaatagacacccaaaaaaaaaagaaaaagggtatgcaaagtgtatgttgcctcagtctgtatggtaccgaacaggccaaaattatgggaattttttttaggaaaaatagtgtagtacttgctatctacagttggtaacataagcaagatatgctaccaacaaatgcatcgcatggtatcagttgatcaaaattatgctctcgaaaccaaaaaaaaaaaaaaaagtgcacagaacaacccacaaggccaccatctcaggaagccaaaaccacacccatcttcctgtactgcctgaaggattgctacctgtatcattccactaattaattaatcgcagcttgttcatctcccataaactatgcggcatcatacatcatgaaatcagtactacctaattctgaaactatcgcttttcccccttccaagattatcggaaccggagaatctacctacaagatcgcgaccaaaacacgcaagaactcacatagcaccacgcggaatcaagaaaccgatcagaaacagcttgcagatgaggagcgggaggggaatacgagcggatctttacccgggaggggagaacagcagcagcagcagcggccggaatccggaggaggaagaaggggatgaagcggttgaagtggaaaatataaatacgtggaggggttccgtgcttaaaaaatataaccccactgtgtgagtgacggagggagaaatgtaattcgccggaaattcaggggccacaataaaaaacgactggatgagtggcgacgggggaacgcgaggagaggaaacgccggcccatcgctctcgctgaatctttgtgttaaatgggccggatgttggggctcgttagaatatgctgtttgggcttctttcttagttgggcctggcccatacacaaaatattatcatttttttggtttgtttatattaacaaaatggcggtgagtggatctagcattgaagccaattctcgacttcatttcggtgaaaagaacatgatttcgggttaaaatctcagccatgacagaaaattgtaagctcaagggtctttagaagaagggggacacttagaacacgtgaattctacaagatttttattgatctttagttcagaattcagatcctttaaaattcctctgtatcaaaggtggcctaagcatagaatcggaacttttccctatggaacgaagtttttgaatgaatcaatgcatctaacgaaaccaaaaaaaaaaaaaggaaacctaaccctccttttatgcctgcattttgacccccatcttgaccaaatccctgcaggcgtgtgcaatgctaactcatccgcaaataattaatacaaatgtatcatccttgtacattcctatgatttagtcaaacgtgttaaggagcagaattggtctactggccaagctagattcagatatgaattaagctcaaaaacaaacactccatgacaattccataatcccactgctcctcttgattcccctggtgatatccataccttacaattcctccactactcccttcacacctcaccaatgctgcaatgcatgaaaatgccatgattgagctgtaccattgaatcattgttcttgttcattaggattgtgtttttttctagagaaattagaatgatggtggagtatttatcacctaggtctaatggcatgcatgtcatgtcatgtcatgtcatgtcatctttattttaactcaaaatatcatactccctttaagaaaaatattcacggaatgatgctattaaatgaattagtgaatgagctgattattgagaaatgcatctagtagttgtagatgagaaaagatgtcctgatgggattaattaggaggcttttatgacgccatcacaacaataacaacactgcaacgcccaaaatgcaaaaacatgggagaattgctagcaaacgtgtcaaccaggagattcatctctctcgcgtcgtactcatcaatcatcattcaccaaccagataatccacacagcacacgcacaatgtagaagctaccaacaacttccacctgtgtgatgttgcttgcattggagatgcatgtgcctgatcactgtgatcttacatccctgatgattaccctatctatatgaaggctccgtttggtcttaatttgttttcacctgatgttgtcttgatcattgaaagataaacttagtccaaagctatcttcaaagcaaccgattaagttactctagtttcataccaccatttcatgattaaccatcataatctgcaaaaaagaattcctcaaaaatcttatatttttaaacggataaagtagtgttctctcatcctttggttattagcggtagctgaaatttaaaattttaaaattaatttagaggatctatcgtcataatttatattttagcattaactttaaaccactaactaatggagtaccattttacctataaattgtttcatgatcatacaccctttatctccaaataagtttatttccaatctatctcacacatatcaatacaaaacaaataagccataatactctcgttttctcaaattccaatacaacttttttagaaacacaatacaaatcgtaatttaattttattttattttcaatgtatttttaaaaattttataagctataatctaataattaaaatgttgagaaaaaagaccagggtgtagcctcatagcgcttctgtcagggtaatcccaacccataaactattaattagttttcataatttctatgtcatatagacactatatatataaattatatacccaatggaaggtatctttaattaaattcttatctaatcaccgcttttctctctttttatctacatatcctttgttttaattcctgattcctgtatagagatagtttcttgtataagaaatagtttcatttatctttttacctctctttttattaattctcttataacatcaaatttttatttatgtggcagtggatttaatgctattcatactagctaagacggagggttgagattggccagagggacaccgtctcacaggcggtgctggttttggattgctaaatatgatgttgacttaatcctttgccatttagctgtctcgctttacgctccgcgactcccgctcttgtcctaagactttcccaccttctcccactgaagctgcatttctacatggttgatcgatgctagctagtgtaaaggagttcatcatcctagatggcttagctaatgatttattccacttgcattagttgtgggaccctgcaagcacaaagggatggtggattcaaccaccgttaacgtgtcttaactaaaaatagggactggtttatatgtactaacttatatattccctaaagaaaaactatatatttatgtatttatatatagcaggacatgcaggaaagctagatgctcatctacttgtttagagttgggactttggattctgatgggaacagttacaatattagattcaggtggttaatttaagatcatgtgtatggaggattgggattcggtgacattgccccgtgacattctcggtgacattgagtcactgacatgtgggtccagtcacatgtgggtcccatatgtcaatgactcaatgtcatcgagaatgtcacagggaatgtcactgaatctgtgttcgtgtatggataattttgtgttgattagtacaagagatggatgtcatccatggttttcatctgagattttttttcggttttaattgccgtgttaagccaacgaaagatgattcccgtcttgttttaaaaaaaaaaaaatctcgtttcttcttttgtctctgtcatatgaggtgtgcatagtaatgggaagcgggtacaaacaaaacttgcactgcgtagattggtgaaagaaaaatcatcatcgttgaaaattgttagttttcgtgaacacgaatgaatacaagtaattaagctgtttatttcaaaagttcgctatttcgagaggtttggggttaactcccagtcaaaatagtagtaggcactcaataatatagtaagacttggcctggtttgatttaagattgttgagcgggttattgtcatgtattatccacttaattactacctctgtttcagattatcggactttttagcattgtccacatctattatattatcttctattatattattaaaggaatagaaaaaggagcctccacattcgctctcatgccctagaaattctcacattaatcgaagaaaaagaaaaagcatagtccatatagatatacaatttagaaatagctgaaattcggaattaaaaaaaaggaatattagaagagaagactagagtccatatagaaatacaattaggaaataactgaaattcggaattaaaaataaggaatattagaagtagagtatagagtccatatagaaatacaattaggaaataactgaaattcggaattaaaaataaggaatattagaagtaaagtatagagttcatatagaaatacaattaggaaataatagaaatttggaattaaaaataaggaatattagaagtagagtatagagcccatatagaaatacaattaagaaaaaaaataaattcggaattaaaaaataaggaatattagaagtagagtatagagtccatataggaatttaaaactaactaaaatttggaaataaaattaaaagtagagtttagagtccatataaaaatataatttacgaataactaaaatttgaaattaagaaaaacatgggaagaagagtttaaagtcaatataggaatacaatttagaagtaactgaaattcaaaattaaaaattaaagaatattaaaagatgagtttagagtccacatagaaatgcaattagaaataataaaaattcagaaataaaaataaataatattggaagaagaacatagagtctatatagaaatacaatttatagaaaattcggaattaaacaaagaaatattaaaagatgagtctagagtccatataggaatatatataatttacaaataactaaaatttgatattaaaaataattaataactaacacgtatataaaatacaatatgaatattacacattagtagttttgcaaagttatttaaaaatttaaaattatgttatcattttaatatatttgaataatataatgagaaaacatatatgctattatatgagagaaaatataatgatgctacccgctcaatctgcgcgggctactatgctatttcatataaatgttaataaatctaggcacacatatatatctatatttattaagatatatatatgaatgtgggcaatgctagaaagtcttataatataaaatggaggaagtataaaaaatagattgataaataacatttttatgacggttgataaataaacttaataaatagcttcaaacaatgctctttttttttacaatgcaataaaaaatttttataaaaaatgtattgtcttaagtgtgaattgtgtaaagtaatgttaataatactgtctagtgaaaaaattaaaaataacatgagtcgatcatggaagggtaatttttgctcggcctcctctacatacaaccggatatatacaatatttttaattagaaacttagcgctttaaacagagaacttagctctcaaataacctagtctgaaactcactcctacagagatttgaaatcaggatattagggtgcttctcgggctagaaaaaatcattgggagcctaatgctgcgttattttcagctattgcaatttagctactactcgactttcgttagcacacttttcaaatggttaaacaatgtattttatgtaaaaactttatatatataaactgttttaaaaattctaataaatttattcatcaattttttatatattagtacttaatcaatcacatactaatctcgtttctcattttgcgtgtggctaattagctgtttcaaaccttcgaaaagaacgcagccttatatctcatattctcattgtacaatatatattgtggcttttccagcgttttggtcgtggctccgttataggaatactacttagggcttgtttggtacagctccaactcctaaatttagcttcagaaattaggtctagagtggagttatagagctgcctaaacccagctccacaactctagttcattttgtgagagagctccacccagctccactcccagttttggtagagctgaaactgtttagctgggtagagctaaagttggagctgtgctaaacagacctttaattatctggttcatgtgcgtttttatggtggctatgtcatgacattagcaccgttcaaattattgtgaggatacaagtccttgtgtgttgcgacctctgtaaagggaatgacatatcagttcataacctcgtgacagcttaactacaagctgcaggaattggtctatctatcctgcattccgctctctctgcccacatgggttgtgtgcatactcttcctcttttctctctgttttttttttttgacaggttctctccaaacgtgccaattactacaaggaattaatcgcggttggttcgatcgtatcgattctctcttcctttccctttcccctgattggatcaacccattgaccgatcgatcgacctcaaaaaaaaaaaaaaaaaaaacggtcgcacccacgcacgcgcccgcgcaagaaaatctcccggcgtccggcgacggtgacgaccgccacgagtatgatgggtctatttagaagtttaacattcggagtgtttatttgaggagcaattttacaatacctggtatcataagaataagtataaagataaagatcggtatggtctctacgttaattagaggctatcacgttacaatagttaagacaatattgtctttaaactaaaatactttcttactagtcatcttttctttattagactcaatgcaacgaaaaatttcctaataaatactaagagtcgactctatgccgttgtcatgcgtagcaactatctttctatttccttcttcctttctcttccacgtcaccaaatatacttgcatgataataaagagagaccactaataaagaccattatacatgccctaaggtaacactttttctattataaatttagtatctcttggtacctaagtactatgaagaactaaattttacactaattttttattatcttatggtatctcttcaaggaccgtagaattgctcttatttgagagtttaagattaaagcagctgttgatattccaaacaaactggtaaacccaggttctggctttttattcgttttatggattctacgattacataatctcaaaatcagggtagaaactacagccgctataatataggagaaactacagccgctataatctcttaaaaagggttttgagaaacagctgattagtagttaacttctaataacctgaagatattgagtttttagtctctggtttctaattcgttttctagattttacaattatagctttttaaaatctggatgaaataattgtgagagaaactgcagccgtgggaaactccacaaacaaacccgatgtcgagcggtgccgtgaggcgaacctcccaatcgcgcatgcgagatctcaccatctcgtcgccgtatcagcccgacgaaccggtccgtgcggcgcggtgtctctcgcgtgcttccgtggacgtcgtggtctcgcaagactatcgatttatttctacgtacacggtgctaccaatccatcgatgctgactgctcatcagcgtacatcgaaaattcgaacatatatactcccactactgacgacacagcatgttcttcgccgctgtgagcgcattttcatataggtcggtctgaaattgggattaagctaatcaagcgagcaatcgagacggatatcagcacatagtacagctttcagacagattaattatcaaatattagtataactggttttttattagtccatgatgacaattaatcagactagttcgtgtatatatatatggccatgcatgatcgatcagttgcttgattttctaggccggtttaatttggtcgagatggaacatggcatgcatgcattcgcgcctgacggagctagacacgctccgtgcatgcacgtactgcacgaaagctgcctttgctaaatccccttctgattaactaagattccatctcccattttttttcttgaagaaaatattcccaaacctaccaatcaaactaaggcacttaataagttcatccacattcgtcgacatttttatatatccttttggttccatcaccaatatattatatatgcgattcttgatttcgaccaacaaggtagaaatcttattggtccttcattgctcaatccctgtttaagagctactcccccctatcaaaatataagtatttttagaatagtgccaagtcaaattttttaaattttgcctattaatagtaaaaaagttaaaaatattaatcatgtaaatttgatcttactatatttatcattaaacgaaatatcataatatgcaactatttttatttaaaacattctacttttaaaaatatttttagtaaaagtagtatctcgaagaccatgtcaagataaaaaaatacttacattttgggacggagaatgtaccttattattattttctattttctgggtcaagtcatgacctgatcctgcaacctgcatgcatacataagcgtagaccatgtcaagagaactcgataaacgtagaccatgtacatgtaacttgatgagttgtttaatcatcgtgtgattaattatctttatatacactgtcacaatcgtcgacgataatgtcaatactccacctgcagccgcctgcatcaccgttcgctaagctgcgtgcactgcacaacgtgatttcacacggccattttcactttttggtccaagcttagttaggccccgtatagttcacaattttttttcctaaaaacatcacatcgaatctttggacacatacataaagtattaaatataaataaaaacaaaaactaattacgcaattagggagaaaatcgcgaaacgaatcttttaagcctaattagtccatgattagccataaatgctacaataacccacatatgctaatgacggattaattaggctcaaaaaattcgtctcacagttttcaggtgagttatgaaattagttttctcattcttgtccaaaaaccacttccgacattcggtcaaacgtccgatgtgacacccaaaaattttcttttcccaaactaaacagacccttagcttacggcttgaaattaattaactagctctcgtgatataggttttcaaatattttgtttagtactttcactagtccacgatcaattggccacacctaaaaaggttaaactgcgtggtaacttctccggcactgctaattatagccaccatgtgctcggtttaacattcgctaacttactctattaattctaacggacatcgagagtgggtatgtgtcaactgtgaaaagtacacacctcgaaaattagttagaaaataagctgtcaagtactgtaagctctcacgtcatgcctatgccgaaatggaaaaaaaaataaatcgtaaatcccataagcacaaaatactttagagttacatgctaatcacacatctgcttgagatttttgtttagacaagcaaatttgaatttacaagttggtgttatcgactggaatatattccaacgggacgtcaaacatctccatctccatttccctatctaatcccatagcctaaccggtttcggtttagtttaagtttaatttgaaaatttagcagcgcctttgtccctacgcctgctacgtcatcggggcggggatccgcatccgcatccgctgcgcggcgcagagcagcgaacgctcgcgcaccgaccgtcggatagccgcccgcgtgtgcatcgagattcgggctgaggcgctggttcgcggtggatcaggatttggtggggcccggccggccgaggcgcgggggcgtggggcccacctgtccgtgtccggaggcgcgaggcccgcacgtctgcccgggagctgccacgtaggagagagaaagtctgacgtggctcgggcctcatttgcggggaagccctcgtcagtcgtcaaaattgctcgttgtttgtaagcagacacgaaggttagtactaggagccaaagattaataaagaatacatttattagcattcgaagatgacagcaagatttttaataatttggttaattcaaagaatctgctggagttgtccaaatccggataataaatttgaccctatgtattgtacatctccttagttaatcttcatctaattcaggctcgaatgggaccattgttgctttaaaacttgttcggtatctcttaggcagtggtttttgttttacctaaactacacaattttatcctttgcttcctcttacgataaatatgattctttgctagtatatattcagtatgatagcatttcgataactttctttatgaatgaaattccaacgtatatacattttataaaagcctttcgatccctcttatagggacaaagatctaaccatttgattacaaatctaacgcctaatgatgctctcccgtcgtatttactctaaaaacgtcataccccatctatgtttattcggttatagcatcgtcttatcatttcttcaacctcaacatatccccatctcctcctaccttgtaatgctactcagatctacgtgtttagatctgctcattgattttatccacatctccttctcttctcttggtatttgtatcagccgccaccactagtataatcttgcttcactcatattctcatgtgccaaaaacaactttagggtttcgcctcgaagcaaatagagtcatcaaaagcttacttcatcaatatccatcggtgacgaatatagatgagtaggagttgattatgtcatcggattctctaacactcttgttttatccctacatccatcgagggcgcttctcttgattggccaaatggtatgtgtttggtgtttttgccaaataaaatattatacattttctctattaagttatattcctcactctaaatttattattattcctttaactgaatattcaccgaacatatatataaagtatcatactatttatattctctctctgtaacatgttaatttcctgataagtcttacattaaaaagtactccctctgtcttataaaaaaccaacctagtaataaatataacacatcctattacagaatctggatatacatctgtccaaattcattatactagaatatgtcatatccaatcctagatttttttttggacggatggaataggcaccatgctctctagaattttattttttaaaatctatttcaaatacacacatcaagcttgccactttcacaaaggaaaacaaaagataggtgagtcggaacaggcaaaacatttttctcccaattacggtagtgcgaagacgtcaagcaaaagtcacaaaagattttaaagtaaaacgcacacaaagtcagacgaggttagtaaagcctagttaacgatgttacccacaaggccattttcttttcacaataaaagaaaaaaacacaaaaatggacaaggaagctaagcaaccaaatcacccaccaaatcgcacagtacacacacaaattacaaaccaaacagagagagaaagacagaggggaaggaagagcgcgtcgtcgaggaagacgagatagcgaggaggcgcgtgggagaaaaggaggaaacaaaagggagagaaaaaggaaaaaaaataattattacaagcgagggagagaaaaaacacaagcaaaaataggggcaggaggaggaagaaggaggcgaccagagga

SEQ ID NO: 1652 - DNA, 7620 bp, Oryza sativa
  unsure (1)..(7620): unsure at all n locations
cggcgtcgcgacggcgtccgggagctcgccctccgccgtctccgcgtcccctgccaggtaggccacgccacgccacgccacgccacgccacgccgtggagtcaaatactgtccctcgcctgaatccgtcgtggtgtaggcagctccgatgcgatcctgtcgcgtgcgttttttcggattgagcaatggcaatcggatttggatttcgagagcgttcgatcgtagatgctttaccttttttttttcctcgttctctgcgtgctttttttccccgtgtttggagatttgataggtagatgcgggattaggcgtttgatatacgctttgacctttgctggttgatacacctgatattgtttttagctcaagcttcccagtaagttccaaatttttttggttttactcatacggttccggggagaaatgatgttggaataagacggtggttggagatgcgttagctgtgtggtcagctcatggatttcaattcgtctgtacgctgcctattgcctgtttcttttggttttgttatgcgtttgcattagaagcgaaatttgtatgagctcttctagagatggtgggagttttacttgtcacggttgatgccaaattggtggagaacttgatgaatctgttgattcagcattcatgtttgcattggctgtgctttagtaataagattggtgcatgccattttaagacactgtttaactttgatagtgttcctgtattgttgcctctgagaagttgcttgctaaatttgtatatccacttagtgaaatttgattgtattactaggattatattcatgtccctattggaaacaagtaagtagtagtaattttatgtgttggaaattttgacatatttaaattcaaatggcattattgtttatgttatacatctgagcacaatgtctataataaatgctaattgagcacgcatgttattgttctttatattgataccatgacgtgcctagagtgattaccagtgttagcattctctgtgtcctcttctgttccatggtaataatattgactgtacaaccgttgtaattaaggttcctattgtaatcgatgccatatatgaagaatacgttctatattttactgtagaatggagatttatgagctgttttcatttgtatatgcttgatacctggttctttattcagatgttctcttgtcatttcttcagcattcaataaatatcattaacctaccaagaaagaatagtgacttttgcaattgcattactaatgagatatcgtgagtctcatcctttattcctttgtggctttgtctggactctggactaccactagatattatgttgttaaagttggtaacttcgttgtgtgcgttgtttcaaggtgttctgtaacttaaacttgtattgtatggtaactggcactgggaaagggataatattagagcctgtataatgttatagttctctctcgtacttgttagttggctagttgcccttccaatccttgcatggcagttcatgtatttgtaggtgtcatgtcaggcattcacattatatatgcatcacatggttctgatgcatggattgtactaagaatgacaaaacgaggcatttgatccctttgcttcaattattctccagaattttatctgctgtttcaagtgaatttcctgcaaaaatttctcagtttgtactcccattgttaaataaatgttcttaaccttgtatttgcaggggaaaaaatgagttggagttggacttcaggaggttctgggaagaattccgttcttccagctctgaaaaggtaccatcgcacttggttcaccttgtcaccatggaacatagcacttgcatgtccgttcttatcctaacactgtgccttttattttccctgcacaggagaaagaaagggccttaaatttggcagtagatgtcttctgtaggctagtgaaggagcactctagtgtagctgaattagttacaaagtatgccttgttaactttcatacattcgctacattgttttagtttattctaaaatcatatctgtttatcatgacataaatctttatccaggtcgagttttgttaacattcttgtgattactacaggttagtagaagcacatgtttttgcttttgttattggaagagctttcgttacagatgtggaaaaactaagaattcacagtaagggaagatctttgcgtgttgctgatgttattggtttcttttcggagatcacagaggtcagcctttataataatgcctataatgcagtttccaaatttcatgtgaccatacattctctgctaacttctattccattatccagcttggcatatgtccaggttcaaatttgttatatgcagttgaagttcttgtgacacaggttcgtgcagtttctcttgttaatatcaaatcattctgttttctgttatatttaatctcccttattatcttatcaggtgttaaatatatataatcgtaaagtcaacaaaactgtggtattcaagttttttgtgattgtgtttgtgtaaatttttactaattataatatgatgaggagggcacatcattgtgataaaagctatacataggccatatatatactccaggtgttatttgaaattccttttgccttcaaagctattatgaacattggactagtgtgttatatttacctctgtaatactgttttcatctttatatttatatccaccttgtcctctctgtaagtatacagtatgagccatctggaggacaaaaatgattctaaacatctgaacaagagcagtatttctactacaaaccttgtcaaaacaatgttagttcttagtgtactatatataatcttgcatatttgtgaatagatgatgattgtcaatgaatgttgcaaagagaatctgtatatcgaagcaattagccattaagtgtttggtgttaattttgggctggttttgcaaccgctaagtcaagttatggtatgaaaaccaattttagttccctgttctttcctttgcaacctttttgcattgacaatgacacatgtaataagacaaaaaaagagaggcatctgctttctgataaaaaaacaaagcttagatatagtaaggaatgtgcaactgacatatggtgtttcaaatcggctaaaacaacatttgccaaatgctcagagtaacatgcttttcatgtttaatttcttggttacagactatcgataagcagcctctgttggattctggtattttgtgctgccttatatatatcctcaattccctattgagtcctgatgaatcctcccaaaaatcctctcctgttggtcaagaagtttcaaccagtgagaagagtaaagattggggtcctatgctatcacggcgccttgaggtaataccagtctcgtggttcttatataaagaggatttcctttgcattattttttaaagaactcgacgcaaggggagagaatcccgaaggcattgcatttaaggtcgagaaaaggccctgaaagctggcacttacctgtatgggaacattgttgtcacaggctgtcttaacacttacttttggggaatacacagagaggtaccttttttttgggtgagaaccaggttttgagccctggttggtagcctcacaactggaggacttaccaccgtccactgtgcataagcacgttctcacctttgcaatatcatatactacctccttttttaataaatagcgccgttgatttttggcatatcgtttgaccattcgtctcatttaaaaattgagtataaatatgcagaaatacaagtcatgcttaagttttctttaatgataaaacaggtcataacaaaataaatgacattgaataagatgaaaggttgaatgtcatgccaaaagtcaatggcatcatctactgaaaaacagagggaggagttgttaacttattctgatgcaaaatcacaacttgttaatactttatccgctgaacttcacatagtgccatgctggagtatccatctgaactaatacaaggcattcgttttatgccaaacctgcattatgtgatatgttaaaccttcttaatttctttgcctggttaatttgagttttgatttttttccccttgttttttgctctatggagatcgaggcaagtgtagtacatacaatgaaggcactagcgagccatccatctgctgcaccaagcctaattgaagatgatgctctacaagttctattccacatggttgcaaatggttccctgaccgtgttctctcaatttagggagggtcttgttccaattcacacaattcagcttcatcgccacgcaatgcaggtaagttgatatgatgcaacattttttgtggatacctgacttcctgccacaccgtaagttcctaatatatttattccttaactgagcaggttcttggtctccttcttgcgaatgacaatgggacttcagcaaactatataaggaagcatcagttggtacattctttatctcttcttcattgtgggttgaaatattttgatcttgttcttctgtttttagcaattgtatcttagtagttattagggctccttgacaccatactcaatgtaaaaatgtgtctgtactgagctttcttggcaaataatagaactcctgtagagcaattaatacctttttattgaattatctagagtatttcattttggtatagttatctctctctctctctctctctctctctctctctctctctctcttttgtgtgtttggaacatctactcttttgcactattgctaataagtcctatgccttttagattaaagttctccttatggccgtgaaagatttcaatccgcagaatggtgatgctgcttacaccatgggcattgtggatctcttacttgaatgtgttgagctatcttacaggcctggtaaacatggacagacttttgccattcagatacatttcatcttgatattttttcaatgtgtacataattcatggtcagctactcagctatagcgtttgctaatatttcaatatatggttaatattgcagaagctggatccgttaggctcagggaagatatacataatgctcatggctatcagttccttgttcagtttgctcttacactatgtagcttacataagaaccaggttctccaatcttcgcccaagttagcatctgaggatggagtgaatcctcctcacagatcagaacaagatacattcacatccgatctttcaccacagctatcaagattgcttgatgttcttgtaaatttgtcgcaaactggactgtctgaaaattatgttggtaaaagtatgaaatcttctcatgggaagggaacaggccacaacagaagccggactccatctgttgacaagttcgcagatgagattttggagattaacagtcccaaagtaaaagatcttgaggccattcagatgctacaggatatatttctgaaggcagacaacttggaagtgcaagctgaagttttaaatagaatgttcaagattttctcaagtcatcttgagaattacaagctatgtcaacaactgcgaactgtgcctctttttatcctaaacatgggtggcttccctccagcacttcaagaggtcatcttaaaaattttagaatatgcggtcactgttgtaaactgcatcccagagcaggagttgttatcactctgttgcttactgcagcaaccaatttctaccagtcttaagcatacaatactctctttctttgtgaagctcctttcctttgatcagcagtacaaaaaggttctcagggaagtaggtgtacttggagcgttgttagatgacctgaaacagaacaagcttttttttggagaggagccacaaaacaggacccctaagtctgcacagaggatgtccagtgcaagtagttttcgaaaaaccatggataacaaagatgcgattctttctccgaagctaatggcttctggttccaccaaatttcccatgtttgaagatgaagggacaataactgttgcttgggattgtcttttttatctgctgaagagagctgagcctaatcaacaaactttcagatcttctaatggcgttaatacgattcttcctttcttggtatctgaaagccacagatctggggtattacggctattgtcttgcctgataatcgaagattctcttcaggtttgtgttagaacctgactcccatgaaatacatagtcatttttaatcacgaatcatcttagtttagggcataaaatgccaagttcatgggagtgaatgacttgtaaaaaccttaagggtctatttcccctatgatttgttaattttaatgatgcttaaaaattgaatttcacgagcaccatgtgagctatgactcctttgacattgttttcaggctcatccagaggaaatagggtccctgatagaaatcttgaagagtgggatggtatcaacttcgtcaggttctcaacagaaacttgacaatgatgcgaagtgtgacacttttggcgctttgtggcgtattcttggggcaaacagttcagctcaaagaatttttggagaagccactgggttttccctgctactaacaacgcttcacagtttccagaatgacagtgaaaacgaggagactgaatcatctttgcttactcatatgaagatctttggttttctaatgcgagctatgacagctgcagtatacagcaatcctgttaataggataagactgcatacaatcctgtcttccaacactttctatgatcttctgtctgaatctgggttgctctgtgtggattgtgagaagcatgttatcttgcttttgcttgagcttgcacttgaggttgttcttcctcccactagtaacctgcaggtagagagcatttcatctgaaaacccagaggatgaatcaggtttcttgtctgcaacctcatttggactatcaaggcttgacaaggagcgtatatataatgctagtgctgtagttgttttgatccgctctttgctagtatttacacctaaagttcaactcgagctgctgagattcattgagaagctagcaaatgctggtcccttcaaccaggagaatttaacttctgtaggtatggacagcaattgttttgtcacctctgtttcctttactttagctggcgagtttgccttatgttattcttgccctttttgttatacaggatgtgttggtcttctacttgagacaatcaacccatttttggagggctcatctcctatccttaatcacgctttgagaattgttgaagttctgggtgcttataggttagttatatttgatggttaattttatatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtaccgagctcgaattcgccctatagtagt

SEQ ID NO: 1653 - DNA, 305 bp, Oryza sativa
ggcccacttctcccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgcattccccgcgcccgttcccctccctctcccgctcgcgcccgcgcccgagatggccgggattcgaaaaccg

SEQ ID NO: 1654 - DNA, 646 bp, Oryza sativa
cgggatggggggcggcggctgctggagatatgctactcctagatctctgccctagagccgcctcccggacctcgcgccgcctccaaaccctagcgccatgggagtcgaggaagacgagcgctgtctctgctcggggaaaaaaaaatcgtctcggagatgatttttctttacccgggggtttggcgtggatcgggcggagaattgcccccaccccggcccaggcgaacgcgtatatggcccacggaagaaaattacacccggccgggatggcacacggggatttcaggccattcccccccaaacccagcctaaaagaacaaggccttaagggacaagatctcggtccttggctgtgacaggcacgcagggggggagggatgaggaggaggagtaaatacctgaccccctttggctcctccgtttgcagcaacaaaagatcgccgattcgccgcgcgtacagcgcgatcgcggcacgtgtgcgccgttccgtatccaaatcccgtggattcgatcaatcgatcgatctctgcactgcacagctgcgcctgcagaatctcgcgacaccttgtacttccatttttttttcctctcctaaactgcatggtgacctcaccggcaactacagccacctgtgtatatatataga

SEQ ID NO: 1655 - DNA, 809 bp, Oryza sativa
aaaaaaaactgaagagttaattgcagatattgatgaatgcttactgccaaactactgcaatgggacatgtcaaaatcttcctggaaattttacatgcactagttgcccccgcagaaaggagtttaatccaattacaagacagtgtgttgcatcagctaagcaacacaatcttattataggtaagtcatagctgacagattagtcaatcttattgcattaagataatgcaaagtggcttcacggcacaaaaataatgaatggctgtaggtattacaactggtattactgtggcattggtttcataattattgcattaggtgcaattattctagccaataagtggaagaaaagcatccaaaagagaattagaagagcatactccaagaaaaatcagggcctactcttggaacagctaatctcagatgaaagcgccacaaattaaacaaggatattttccttggaggaactagaagaggcaaccaacacctttgatgctactcgtgttcttggtcgtgaaggacatggcacagtttataaagggattctatctgaccagagtgtggtggccattaaaaaatcaaaaattgtggaacaaactgagatagatcagtttatcaatgaggttgctattttatctcaaattatccatcgcaatgtggtgaagctttttggttgctgtctcgaatctgaggtgcccttactggtatatgagttcataccaaatggtacattgcatgatcgtcttcatactgatgttagtgttaaatcctcattatcatgggatgatcgaattaggattgcttcagaag

SEQ ID NO: 1656 - DNA, 697 bp, Oryza sativa
cacaaaagaagagggaattccgtgcgctccatcagggcaacaggactgtgacagagtacctccatgagttcaatcgcctcgcgcgatatgcaccagaggatgtccgcaccgacgccgagaagcaggagaagttcatggcgggtctggatgatgagctgaccaaccaactgatatctggggactacgccgactttgagaggctggttgacaaggcaatccgccaggaggatcagcgcaacaaaatggacaggaaaagaaaggcggcgcagttccggtccaaccaaggcagtcagcaccgaccgcgcttcactcccggacagcagggtggacctaccaccatgatcgtccgccagcaccgcccgttcaactccagcaacttccaccagggcactagtggcagtcagaaccaccagggaggccagcccaaccgcggtgcagctccacgcccaccaatggcaccggcacagtcagcccagcccgcgcaagccaagaaggagacgggagcaaaaccagggtcctgcttcaactgtggcgagcttggccacttcgctgacaaatgcccgaagcccaggcgtgccgggccaaggtttatccaggctcgtgtcaaccacgcgtctgcggaggaggcacaagcagcaccagaggtcgtactgggtacgttccctgttaactcaatccctgcaacagtactttttga

SEQ ID NO: 1657 - DNA, 453 bp, Oryza sativa
ctccactggcagctcttaagggaaataatgcttaaacactatatagcaggaaacaaagtgataaatacaatatagccaagaaacataataatagtatctcatatctagttgcaatgttagccttattttcatcatcttagttgcaacattgttatggctgattttgtttactcttgctatcgtttcaactctgtttttatgttcggggccctttatgtttctgttatgtacatggtttctatccagtaacactgactggatggactgatttatgtaggtgctctgtgtatcgtcctctcagaatagacagcttcatggacagcccaccgtccctgctgcaagaaaacggcgaaaagttaattcaggatcaacctctaaaaaaaggaaaaggtctgctgatgagattaccctgaaatttatcaaacggaatgttgaaaccattgaatccactga

SEQ ID NO: 1658 - DNA, 688 bp, Oryza sativa
tcgtaaaattgaagtacatagaagccaaagccatgtcatattccattgctgttatctgggttgtactattggcaacaagaggtttgggagttttggtggcggtgttgcaggtaagctcgaagccgtcccgaaagcagcctcccccaatcccgaaggggtaggagatgccatcgacttccccgcagctagaggggcagtgagcgagggagtcattagaagggacaatcaagagccctccaccaactccatagactgaagccaatactcgtggcgtagctgccgagcacaccagcacaaaagaagtggcacaaactgccagaaagctcgagctcatctttgcgccagccggcttgcccttcctggtgtacgtaggccggtgcctgttaactaccgatcaatttatattcagaggcagccatctctttgtgctcacgctttcgtggactttataagtatagatgccagattaataccagccactccccaagcgctatgtataaaacatatatggaggaattgattggcttatactcgatcggcagaaaacaattttatcgcaataatttgccattgatcgacgaagtccaggggcactagtcgcatcagatatcccggtcgttgctggagccaacgactcgtccaactgccggtcgctgctcgcttctacgtccgattttctcctcgcgtc

SEQ ID NO: 1659 - DNA, 1797 bp, Oryza sativa
actgaagataattgatagaacatgaatgaattgcatacttaacaattaacccttggtatttcaactctaaaacttgcataattgatcaatggctggccggaaaccacaagcttttgtagtgtgatccatatgcaacgaagtgtcgagtaatgcaggctgcaacaaccctcaagttcttttttgcttcaaatagtttctattgctaattttgatagtattaacttcatgtatgaatggaagatttagagctccctgttttcttgattctgatgaccttctgtttgttgtgccatcattaattactgtaaatgatctatgcagtatgtcgacaagcttcttattgccaaagataccaatcaaattaccattgatatattggaggctgtaaggacgaatgatgtgagggcagcatatcgcattcttgtgttggctgatgtgagccctaacatgatatatgatgagttaaacaatgatgttcatcatgatccttcagtaacagatgggaagttatttgatccagcatcttgtgatgtaaaggatgattctgggaaaccagaaggttgtctacaaggctgttccctgttgcacattgcttgccaatatggccattctataatggcagagcttctgcttctttttggtgcggatattaataagcaagacttccatggacggacaccgttgcaccattgtgtccgaaggaaaaatgatgcacttaccaagcatctgctaaagaggtaggattgaatttctagcagtatggaatatagataattacagctatccttccactgttgccaagctgaagtatcgaactctttacataaaggctattttttttttgtttcattcagcataaaagtacagaatgagacactgaggcatatatgatatgttctggggtcctgacaatgtctttagtatcttatcaatatacccaaaattgtataaaatcaattggatgacttgttcgccaaacacttggattcatactagtcatctcatcccatgtctaaggtccactggtctatggaggtttgtctcattttcagtctcatcatacctatagcgcctatcaggtggcattcagttggttggcataccacttgtgctgtgagttgtgccttttcgagatcatcaatgatgcatttcaacagtttagtaggaacagagagggaaacagcaacaaaaaagcattttcctttcctcaggctattattacaatccctttaatcctgtgtttgtcctcccattttcctcaggacaacaaaaaaaaccaattagtcactgttaatttttgtttgactacatggataatgttaaatggatttctgttccataggggtgcaagaacaaccattaaagatggtggagggttgactgctttagagagaagaatggaacttggagcaataactgatgaagatttgttcattttatttgtaaggtatgatcaagattagtaaaattgcttttcacaatattatcttggcaattactagcaaatgccagtttttcatttccttttcaacgcttgaaaccttctcttgttttcaaaatatgatattgtcttcatgtctgagaaataaaagtacatctcatatgctaaatatttgatcaagcataccctaagtaaaactttttaggagatatcgatctttgcagtttcctgaaatttcatgaagtagcttgtttatgcctgtttcttgaagccttatgttatttctagtcatgaagaattttgttacttagtggtgtaataggaatacttgttaagaaaaagggtctcatttgggg

SEQ ID NO: 1660 - DNA, 1271 bp, Oryza sativa
ccacccaagagggagattgaattccggattgacttggcaccgggaaccgctccaatttacaagagaccatacaggatggcggccaacgaattagcagaggtcaagaagcaagttgatgagcagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcccttaccgcgaatcgacgatttatttgatcaactgaaaggagctaaagtgttctctaagatagacctgcgatcaggctaccaccagctgagaatccgggaagaggatattccgaagacggccttcaccactcggtacgggctatatgagtgcacggttatgtctttcggacttaccaacgcacccgcattcttcatgaatctgatgaacaaagtgttcatgaaatttctggacaagtttgttgtggtattcatcgacgacattcttatctattcaaagtccgaggaagaacatgaacaacatctccgtctggtactcgagaagttgaaggagcaccagctatacgccaagttcagcaagtgtgacttctggttgacggaagtcaaatttctgggccatgtcattacagcccagggtgtagcagttgatccatcgaacgtggagtcagttacaaaatggaccccaccaaagaccgtgtcgcagattcggagttttctaggactggcaggttattaccgccgattcatcgaaaacttctccagaatcgcccgacccatgactcagttgcttaagaaggatgagaagtttaaatggacagctgagtgcgataagagctttgaggagctcaaaaagaaattagtatccgcaccagtattgattctgcccgacccgacgaaagacttccaagtctattgtaatgcatcccgtcacggacttggatgtgtcctaatgcaagagggcagagtggttgcgtatgcctcgcggcagttgcgtccacacgaaggaaattatccaactcatgacttggaattggcagcagtggttcatgctttgaagatctggaggcattatctgattggaaaccgctgcgaagtatatacggaccataagagtctgaaatacatcttcacccaaccggatctaaaccttcgacaacgaagatggttggaactaatcaaagactatgacatgagtattcactaccacccgggtaaagccaatgtggtggcaga

SEQ ID NO: 1661 - DNA, 647 bp, Oryza sativa
  unsure (1)..(647): unsure at all n locations
ccatgtgtcccaattaaagaagtgtttaagggtacctgaagaacaggctaattcggaacacattgatatccaagaggacctaacatatgtggagaagccggttcgcatacttgacactagcgaaaggagaaccagaaacaaggtcaccaggttttgccgtgttcagtggagtcatcattcagaagaggaagcaacctgggaaagggaagatgagttgaaggccgcccatccgtacctcttcaccagctccaccgaatctcggggccgagattccgtttaaggggggtaggtttgtcacaccccgaagttttcctcccaagtcaaaattgtaatttataattgaccctaagaaaatgctggtgaaatcaggagaaaaccctaagaaagtaatgcaaataataatcggatctgacatgtggaatttttcttgaattctacatgtcgaaattcattaacaggatttttagtggaattttcagagctctagaaataattttaaccaattaaaaatcactaaagtgcaattgttaattccagggaaaatcctttttccttttctttttctttttcctctctttttnnnnnnnnnnnnnnnnnnnnnnnnnnnnnnnnnnnnnnnnnnnnnnnnnnnnnnnnnnnnnnnnnnn

SEQ ID NO: 1662 - DNA, 948 bp, Oryza sativa
  unsure (1)..(948): unsure at all n locations
ccgtttagcagtttgaaaagcgtgcgcgcggaatacgatggagaagggttgggaacccttgggtccgaacacaccctaaaagtgttccaattacctgtaaagtgtatgctttcatgggagagattactctgaagcaaaatcttaggtcattttcttctgcatcaatcttaattgttgaagttcttagatcaattttgtggcacgaaagtgcattgtcaccctgagttggagccttttggttcaagaatctgaaacgactaaaaacaccagtcccttcaccagctgtttgctgtgatgccgctccttgcttnnnnnnnnnnnnnnnnnnnnnnnnnnnnnnnnnnnncaaagagtataatatagaatacagaacaaacaacatgcaattgttcaatatttcaggtatattatgtaacacaattaaggtataaattcccaaataatacattttaaacaatccatgacagcccacaaatcgctaacttttattgcataccgattgtcctttattcccgtagtagaaaagagtcccgtgactgtcgagaacaaagaaccttctcttccattctcgtgaattttcagaacgcttaaagagataaccttgtttgattatttgaacctgccagaaaaataaattagtgaaagaaagcaacaaagcttaactaaaaaaaaggttgcatgttatatataattaaaatgtagtctggtgaattataaatgggaataacagggcattataatactagaatttgaaccaaagggataacaccatcgatctctttgcctagatacctaatttaggaatacatgaagaagcaatcaccatcttagaaataaaaggtgcttcgctcttaaacatcatcaatccctctgaagcagaacattgaacagtgatgcagcaagcttagccgtccaggtatcctagcctattatttatgattgtttact

SEQ ID NO: 1663 - DNA, 628 bp, Oryza sativa
tcacacaactcacttgatggccccataccggacgcccgcacacacgccgtcgctgctatagcacctgccgccacccctccggcccccgctcgccgccgccacgaccgatttggcccccgttccccgcgtacatccgtaggggaatagaaaggaggatagaaagggagggaagggagataaagggaggaggaagaagggaaggagagaggatgacatgtgggcttcacatataagtgggtcctacaatattttttttggatgaaaaatgggtcccacatattttttttaattctactgccacataagtgccacatcaacgccacgtggaacgaagcccaagtcaacaccgccacgtacgcatcacgtcagcgaaaccgtccttcaaaaccatcgagggaatcaattgcaccggttttaatagtcgggggttgagatatccggtattgtggtttagggatagggatggcagttttgcccatgggttcgggtatccgcggatacccgacccaatgggcacgggcatgggtgtaaaattttacccgtgggcttgtccgcccaagacccgtagacatcgtgggcaacagccgggcttcattttttacctgtgggtaacccatgcctgacccga

SEQ ID NO: 1664 - DNA, 653 bp, Oryza sativa
taagatcggtatgaaggtggtcatgcagtgtgccattcgatatgaattcataaaccagcagtggcacctcagattcaagacaacatccaaaaatctttaccacattgcgggggataatttgtgataagataacaaccttgttgatgaattgatctatctcagtttgctcaacgatttttgattttttaatggccaccacacgctggtcagatagaatgcctttgtaaactgtgccatgtgctccacgtccaagaacacgagttccatcaaagttgttggttgcctcctctagttcttccaaggaaaatatcttcgttttgtttgtggcgctttcatttgagattagttgctccaagagtaggccttgatttttcttgaaatatgctctccgtattctcttttggatgcctttcctccacttattggcaagtatcattgcccccaacacgataactatggagccaagaccacaaccaattccaattgcaatacctgcatcaattcattttgtcataataaaatcattttgcatgttggctattacttcttacggtcttacctaaaagaagattgcgttgctttgctgatgtaacacacttctttttgattggatcaaactcttttctatgcgggcagcttgtgcatgtataatt

SEQ ID NO: 1665 - DNA, 496 bp, Oryza sativa
tgaggggaaatatttcccttatcctcctcttccgttttccccaagaatcggaccttatcccggagaaattaacgcggaatcgagctcggttcgagcttatctctccaaatagaaccctagtttttgtgaacaaagctgaaggcgacggtgacggacgaaaaacgtgggttaaggatgtgacgaccggaaaaatatgaatatttatattagttatagatatagatatatctcccatgctgattttattatttgtgtggccgtgagtcaacctatgtgatttgtatcagtctggattagagtccgatcgatttgctgacatatcgatgcttcgatcttttttccggctggtgcgtgcgaacgactcgtgagggaggatgtgaacacgcgcaggtattaggggagaagtcggacactaacacggacccgattctgatgcgcacgaggtctggattagagtccgatcgatttgctgacatatcgatgcttcgatcttttt

SEQ ID NO: 1666 - DNA, 729 bp, Oryza sativa
  unsure (1)..(729): unsure at all n locations
gtggatcaagtcagagccgctcaagtaaatgatccggaaatagcagaattgaaaaagaacatgagagtcggaaaggctcgggatttccttgaggatgagcatggcacaatctggatggaagaaagattgtgcgtaccggacgacaaggaattgaaggatctgatactcaccgaagctcatcagacccagtactccattcatccaggcagcactaaaatgtatcaagacctcaaagaaaagttttggtgggtcagcatgaggagagaaatagctgaattcgtcgcactctgcgatgtttgccaacgagtgaaagcagagcaccaaagaccagcaggtttactccaacctctccaaatcccggaatggaaatgggaggagattggaatggactttatcacaggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagtctccgaccgaggtagtcagttcacctcaaagttctggcagaagctgcaggaagaaatggggacccgtttaaatttcagcacggcctatcacccgcaaactgatggtcannnnnnnnnnnnnnnnnnnnnnnnnnnnnnnnnnnnnnnnnnnnnnnnnnnnnnn

SEQ ID NO: 1667 - DNA, 537 bp, Oryza sativa
tcgaattatagagtgaccatgcctgcttgaaatatctcaaatgggcatccatcactgcacttattgattccaagaactcatacttcttctttgcttcaatatttgaaagtgcgtgcacctgaattccttacaaccaaggagaattattggcttggcaaaatcaataaaattagcaacactatataaaaaaatgttcatacatactaggttaaagcggcatcgttcgaaagctgacttggcattgtgtagatcctgcaaatttggaattagagatgttgtatagaaattaaataaatgatcacttacggaaaaaaaaacaagttgtccctgttcacctcctcaagtcctgtcactacttctgctctagtccctttccgtactgatacaaatttttcacgtgcctgacaagcaagatagcaacatatattcttatagggcaccacatgccaaaatgaagaaatatgcaaattgaaaactaggtaatcacatagctagagtgcaagatatcacctgatcataccccactgtagccctatc

SEQ ID NO: 1668 - DNA, 297 bp, Oryza sativa
cgcgctcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggagaaggcatgatcgactttgtggcagagctggcacgcatgacactggtagtgggctaccccgacgcgccggagtacacgaccattccaccgctcagtggcgagcttccttaccgtgtccgcttggaggtccatggctacgtg

SEQ ID NO: 1669 - DNA, 677 bp, Oryza sativa
tcggtaccccttattatttacatttctggcaacaatttgcaggggatatctattggttactcttttaattgcagaacacatgtcagatagatattatttcagtatattctgcaacagttatctgaagaatgccaaccttaagcatatagatagatcgtcgtgagaacgttacaacgcaatcccctgccttaatgttagagaaagacccgagagtagtcttcagaggaaccaatggagatagcctctcataatattggacctgcatagagacatacagccagcaaatcggaatatttgacgacatgatgcgtgtatcagtactaacaccaaaataaacattagacagctcaacaaattctattgagaagaaacagtttctcgagttcacttggaatattatctgcaaatacaaaacatcagctaatcacccacaaaagacagatatatatgacatcatgcctgcacattactttctcagatggaggtccagaagtagtgttactatccaggggtgcaatctaaattgttggacgggacctcaaattggtgtggttaagataagttgagtaacagaggttacaggattgctgatgctatccaccaatgataatccataaaatcatggtgtatcttaagttaaaatggaatgaggtgaaacatattaagcatggagcttt

SEQ ID NO: 1670 - DNA, 667 bp, Oryza sativa
aaagctgcctttgctaaatccccttctgattaactaagattccatctcccatttggtttcttgaagaaaatattcccaaacctaccaatcaaactaaggcacttaataagttcatccacattcgtcgacatttttatatatccttttggttccatcaccaatatattatatatgcgattcttgatttcgaccaacaaggtagaaatcttattggtccttcattgctcaatccctgtttaagagctactcccccctatcaaaatataagtatttttagaatagtgccaagtcaaattttttaaattttgcctattaatagtaaaaaagttaaaaatattaatcatgtaaatttgatcttactatatttatcattaaacgaaatatcataatatgcaactatttttatttaaaacattctacttttaaaaatatttttagtaaaagtagtatctcgaagaccatgtcaagataaaaaaatacttacattttgggacggagaatgtaccttattattattttctattttctgggtcaagtcatgacctgatcctgcaacctgcatgcatacataagcgtagaccatgtcaagagaactcgataaacgtagaccatgtacatgtaacttgatgagttgtttaatcatcgtgtcattaattatctttatata

SEQ ID NO: 1671 - DNA, 699 bp, Oryza sativa
tgcacaaaaataaatgacatttacatagatttttttaataaaatgaaaggccagatatccgataagggagtttattaaatatgtgatgcgaatatcgacataaaatatattaggattagtcttcgtttagtccttttctattatgactctaagctttttccttttttacctatatccttgtaaccggcatgggaagaataccatggctagatgtatactatgtgttcgtaatcaactcctcagtattacctattggcaattggcgtctgtggtttttttccgtaatgatttttcatgtaaaaagttaagtctcatctataatgtaaatagcttcatatatttaagaacagagagagtggcaagttaaattaaccaccattaatcaataatgtctctgtttggaacagtacaaaaattggctaagctaagctaattaaaatagcatctgtgtgctgtcgttggaacaggctgctgacctacttactaccttaaagccaatcagtcagcttcacacactgacaccaaaggaagcatctttcttccttctcttcctcctcctcttcccggcagccatgccaccgccctcccttctcctccctcctctcctcctcctcctcggcctccatgccgccgccgccgccgtctccgaggtgtcggccctcatggccttcaagaacgccctcaccatccctcccaccg

SEQ ID NO: 1672 - DNA, 337 bp, Oryza sativa
ctcttcctcggcttcgattgctccacgcagtaaccaatttactcccaaccaaatctaatcctaatcctgtgcttgctaatgctaattctagttctaatgctaatggtggtaggtcgctgaaagccacggtgctggacgccggcctcaccgccgtcgcccacgacgccgtccacttcgactccgacctgccgcactacgccacccatggcggcgtcctccgggacccatccggcggcgacccgggccgcgtcgtgtcgccgccgctcatgtgggccgaggcgctggacctgctgctcgccaggctcgcgcccagggtggactacgcccgcgtcgccgc

SEQ ID NO: 1673 - DNA, 582 bp, Oryza sativa
  unsure (1)..(582): unsure at all n locations
ggcgaattcgagctcggtaccccaatcctttttgtgtggcagtgggtccatttgaggaatccatagtggataagcaggtatgttatgtgtgccatggtgtcatggtaaggtggatgaacacacatagatgctcactcaaaagggagcatttgtgattagataaaaaaactcaccattgtggggaggtggaaaaggagattttgacatgccaaaaaaatccccattttttcacatacacactcatgtgttcttgcttcaattgattgctattgacattagttagttaggtccagaaccacatcaggccactaattctctgttaaacatagataagcaacacggttcgccacatatggaaaaaagttggctagtttgttaatcttgatgatgactgactgacctctaaacaaggttactattaatctattatatatgaatacaggagctaattgcatgcccaaattaatgcagtgtttttgtggatgctgacaaggcatgttgtacaagtgatgaagtggtgagaagnnnnnnnnnnnnnnnnnnnnnnnnnnnnnnnnnnnnnnnnnnnnnnnnnnnnnnnnn

SEQ ID NO: 1674 - DNA, 520 bp, Oryza sativa
tacatttgtgcgctgtattacaagatagttatgttgggatacgtataggctacgatagtataaaaattaaaattttctatcacgtaaaccaggaaccatgcaagtattagatcatagattgttaccactcgacacgctgcgcagcggaagaagacgctgagaagtcgaaggaactctcgcgaagtagcgcgcgtcgatgtagaggaagtagtcgatcgcaccggctcgaccttctcctcctcgtgcgttctcctcaccgtactcccacgccgatcagcaccgcaaaccagcggcgcctttaccggtatccgcacgtacgtacagggacagaacgccacgcgcagatgtgctagcacccgcgcgcagctagggttttgctcggggaggaaagtgacggctagggtttctcacgtgatgcaatgctccgccagtcagacccctcacgaatatataggatccatcactcgggccttcaaggcccgtaggactcctattcggatccctatccgattaagctcat

SEQ ID NO: 1675 - DNA, 865 bp, Oryza sativa
  unsure (1)..(865): unsure at all n locations
nnnnnnnnnnnnnnnnnnnnnnnnnnnnnnnnnnnnnnnnnnnnnnnnnnnnnnnnnttcatgcatggcgtgcaaagtctgaggacttctctcattttgctcagagagaattaatccattttgtgcagagtatgaggacttctcaagcaaatgattttaaccaaacattgcaaatgattttgtgcagagcctgccgccggctcatgtaagggcgggagagagagagaaataagggagagaggaggaagaagaagggtagtgagagagaggatgagatgtgggacctacatgttagtggatcccacaattttttttaatgacaaatgggcccacatattttttttcttttaatgtcacctaagcgccacgtcaatgtcacgtgggataaagaccaggtcaacattgccacgtgcgcggccacgtcagcgaaaccgccctccaaaaccaccaaaggagtcaaattgcaccggttttgtaagtttaggggtcaagatttctggtattgcggttgagggatacgatttagattcggtggtaaattgagggagtcaaagtgatcttattcctttaaactccgaactcctatggctatttcgtgcgctatctgtaggcttagatgggcctgagtgggaatgcgactctctcttctggttgggccagaacagtatcaatgacatacatgcggcccatatttattgggccggaacgggattgctacttcgtgcggtctgtatattatggagtcccccagtttatctcttctctacaattataaaaatcgaagatatttttgccggtactttgatacgttatttgagttggtttttaagttcgtttgcttttagaaatacagaaggagtcaaat

SEQ ID NO: 1676 - DNA, 652 bp, Oryza sativa
gtgagcgacgtcatgttcccgagccacgccgggacgcccccgtgcatgcacgtcgtcgacaggatgagcacgcggaggcgccgcagcgccatcagcgactccggcggccaccagatgtcgaacccggggttctcgttgaagttggccacctcgagcgtggtgacgttggcgatcgacgtcgggaacgcgccggagaagtagttgttggacacgttgagcacccgcagcgccggcatccgcgacaggtccggcacggcgcccgacacgccggagcagctgaggttgagcacctccagcgacgtgcagttcaccagcccgccggggaacccgccgcggatgtcgttgtacccgagccggacctcccggagcgccgggagcgcctcgcacacgccgccggggagcctaccgctcagcctccacgacgtgacgtcgatggccgtcacgttgccggaggcgtcgcacccgacaccctggaacttgcagtagtccacggccggcgccgagaagtcccacctcgccatggccggcccggcgaactcctgcttcatctgggacaggtacgccgcctgagcatccaatgccgcctccgccaccaccgcgccgccatcgccggccacgaagaagacgacaacacaccacaagaagaacaaca

SEQ ID NO: 1677 - DNA, 344 bp, Oryza sativa
taccttacctccctgtgattttggatgggccgattctcctccccggcccatctccccctcccagcccatcatccccccctcgcacgtgcgttgcacgcatgcgagccgagagagagagagtcgtcgctcgctctctctgtctctctcgctctcgctgtttctctctctctctctcgatgtctctctcccgcgccgacgccggtttccgccgtcgccgcccaaaacccgccaccgccttcgccttttcccgcgctcgcgcgtggccgaccggccggtcgttgccgccgtcagccctgccgcgcctgcgccgcgcagacacccggccccgctccatgccaaaccga

SEQ ID NO: 1678 - DNA, 1338 bp, Oryza sativa
caaggctgcaaatagaggaatccaagctgtctgaacaggttgggtttagattcgatggttggaaccggtgtttgcgtgtgagcatccgcatcaccacaacaccacgcgacagaaagcggattgcctgcaaactgcaactcaacctgaccctgcaggcttagtatagaaaccaagcagaaaattactactacatcgcattaaccgcgactcctcccccattaacagattaaccgcaaccgcagcaagagaaggaacagaatccaactccgaaatcgatggacaaagaacggggattaacaactgaaatttctgtctaaaccaacgcgtagtaaatccgacgaactaaaacgaacaagtagagaagacgaaggaggaggcgagattaacttgcctccaagtcgaccgcccgctcgccggcgcaacacagcaaccgccgccgcctcggtggagccctgcgccgccattaagtgaaaccccaatagaatgagaaggaaatcaaccaacgaagcagcacaaagcagcaaaaaaaaaaaaggcagcaggagagcagattaccacggcgacgaggagtgggagtgggttaaattaagcgcggccgcggcggcggcaatggcggggagatgcggactggattggagcagacgagacgaggcgaggcgagaggaggaagaagaagaaggggatgatgaatccaaactttttcctctctctctctctcgctttttcgatttggtttcgattttggtttggttttgatttgggtttggagagagtacgagacgagagtggaagggaagaagcccccaggagttattgcaaaatcaaatacggagtactacagtgtcctttaagttttctttttcttttttttcctccgaggaataaaggattggtgcattttactactcctatcaattttttttaaaaaaaattaaaattgagatgagaaaaaggagatgccacgtaaggtgggcagtggagaacgtggtgggggtggattggtcccaacagtggggcccacacgcacgccgtgatgacacgtggttctcaccgggccattggaatcagaggccaagcagtgtcttgtcatgcttggttaccaacaagtaaagcacacaattcatcacatcgatcgatcttgacatcaaattaatcaaagagcatgatttgattttttgtttatccagatcgtggccaaaaagtcccttgtaagttactcctatgcaattagcatctttatttgtgtttggatttgagttcggggagccttacggcatgcaccattcatccatttattcgtactaacattataagatttataaaaaaaaaagtcccttg

SEQ ID NO: 1679 - DNA, 451 bp, Oryza sativa
  unsure (1)..(451): unsure at all n locations
gtgctccagatgtacaccaacaagctcaccggcgccatcccggccgtgctcggcaactccacgcagctccgcatcctgtccgtctaccgcaaccagctcaccggcgagctccccgccgacctcggccgctactccggcttcaacgtgctggaggtgtcggagaaccagctcaccggcccgctgccgccgtacgcctgcgccaacggccagctccagtacatcctcgtgctcagcaacctnctcaccggcgccatcccggcgtcgtacgccgcgtgccggccgctgctccgctttcgcgtcagcaacaaccacctcgacggcgacgtccccgcgggcattttcgcgcttccgcacgcctccatcatcgacctctcctacaaccacctcaccgggccagtgtcggccaccatcgccggcgccaccaacctgacgtcgctgttcgcgtcgaaca

SEQ ID NO: 1680 - DNA, 1438 bp, Oryza sativa
aaaaataactcaaagaacaattgagaaaggctttgtttcaaatttctcattttgttatatcttccaatgggagccgccgccttggagatcatcgggaaagagagaaaaggggagaggtggagacagataggggaatagagtagagagaagggtggaggagaaagacgatagccactggtaaataggacccacgtgggctctatcttttttctttcctttactataagtgccaagtagatgttatatgggatgaaaaatctagaaaacttgcctatgggtgtaacgtaggacggaaccgttgttcaaaccatcgagggattcaatttacacaaattttagtagttgggagacgttctatacctagttttattatagttaagaaatgcaaatgtaactcgatctatagttgagagggacacaaattggattttgttttcttttcgttttccttatgtcgatcaattttttgttgacgggttgttactggcccgacatttgatatgccgttttgggatgcaaattttgtaagaataagttcattttgtccctcaatttatcgtcgaatttgaacttcatccctaaaccgaaatattagttggtccctcaatttatataaccggatcacccaaggtcctaggcaagaagagggaagatagagaggagaagaaagtgctagtcactgacatgtggggtctgcatgggtctcacgttgactaagcttgtcatgtcagctaaaattgagcataatacggttttgtaaattgaggaagtcattatatctgctatttcggtttagggacaaatttaggactcggcaccaaattgagtgaccaaaagtgaacttattccaatttcgtatgttagaccgtttatgggctggcattttgacctgaggtcgtctgtgcgtggaatatttcttttgctgggcctttagtgggctgcgcttgccagtaactctctgtggatgggctgttagaattttggaaacttttcttacgctccgggccgttcatcagcaaacgatttctttaggtgagctgttaatgggctattcaatgtgcgttgttaacgggcttttctttccactgacgaaggcttcaggcaatacagcacacacttccaatggagtataaaacagtaccacaatagactatgccttgtggaaaatctggacacaatatactaatactatgcaggcgctttttcaggccttgtggctgatctgtaccaaattcgaaattcatgaatatttaggccaaaggtttataatcacggaatatcaggtgaacgattaacatatattcatgatatcccaaggttaatagtcatgaaatttttagccaagtctaacattcaagcattttttagccatggtctaagagcctatttgggggagcttccattaactgcagcttctccgaatctggaaaatgaacta

SEQ ID NO: 1681 - DNA, 7238 bp, Oryza sativa
  unsure (1)..(7238): unsure at all n locations
aaagggcaaattttccatcagaaaatgactatactagttaatcatgtccggaaatctttctagagatggttttggtttgcagccgccccctatcctagtactacgtttctaaatctctgaattagtcagagtaatgtgattcatatgtcattctacagaaacttacaaagttacggttgcatctagcgtgtgtctttttgtttagttgctgctactggcttgtaagcatttcaaatggctaatcagcagaaaggaacacatgaatctttttttgcccattctgccgctgtttagacgttttaatacatgctgattaagcaggtaagcaagattcgtcagtccaattgtgcaagtaataactaatgtattctcagagcaatcgaattctgttataacctgggtacgcttaagtcagattaccaaccctagctacctgcagatagacatagactgaatcttgatagttccagcctccaggagtaggttttttttttttccttcagaaaacaaaactagttgtatactgccagtagattgtaccgtaaaaatcttcatctgaatggagaaaacttagctgaagctacatgatagtattatataagcttggagcatatgctgggctttgtctctggaattctggattgaagcttgaagacacaagagcactgtttcagaaagcagagcccaaaaccaaaacaatgggcctaaagtaaaacaagagactaaactgaattttcagtgaagagaagcagagcgtttatacttaatttggcgatcgaaatcatgctacacagacggtgaaaagaaatcctaaataaacaagcatatacacacaacgaaatggatcgagcatgcatgaacggcaacgaaaacgattaattccaagcggaagacgccatgagcagccgcatatccctcctgcatattccttggtgacggaaaccccaatcacaatgttgcaattataattacgtgcattgcattgccgcactaataatccatggcgccgcctaatgacgccggagatggcgacgacgacaagcccgagatgccggtggtgctcatcaccggctgcgccaacggcggcatcggctacgagtactgcaaggccttcgcctccctcggctgccgcgtcgtcgccaccgacgtccccgaccgcgtgcccgacctcgccggcctcgacgccgaccacctcccgctcgacgtcacctccgacgagagcgtcgagggcgccgtggcgcgcgtcctcgccgagcacgggcgcgtcgacgtgctggtgaacaacgccggcatcgggtgcaccggcccgctcgccgagctccgcggcgaggccgtgcgtcgcgccatggacgtcaacttcctcggccagctccggatggtgcgcgccgtggcgccgcacatggcgtcgcggcgttccgggcgcgtggtgaacgtgggcagcgtggtgggcacggcggcgacgccgtgggccggcccctactgcgcgtcgaaggcggcggtgcacgcggcgacggacgcgctgcgggtggagctgcggccgttcggcgtgcacgtggtgaaagtggtgcccggcgcggtgaggtccggcttgggcaacgccaacacggcgcagctcgccgaaggcaagncggagtgncggctgtacgggaagttcgcgcggcngatcncgaagagggcgcgggcgtcgcagccggggggcgcgacgnacgncggcgtgttcgcggcgcacgtggctcggcgggtgatgagcgcgcggccgccgcgggagatcgtgtacgggaacatgacgttgctgttctcggcgctggcggcggcgccgctgtgggcgcgcgacgccttcttcgccaagcgcttcggcctcgacaagatgctaccaccgcgctagagaagaagaagaagccatcatgactggtgtattcaacttgcgtagtgggctgggctcactgggccttttattttatgccaacatatctaggaataagttcatgttatgttactcatcttgataccgagttcgaattatatcttaaatcgcaaaatatcataaatattaaaccccggtcctcatctttttaaactaggtgaaaccccgcgcgttgcggcgggcacattagaaaagatgaaatatgcatgtaagaatgaacaattagattgtattatttgaatctgaaaacaaattgataggtaaaataggcactgaagtaagaaatacttgaaatgatatcaagctcataagctaacaatgtggagctttgttttactgcttgcaacacataatgacttatagtatagtgcaacttaatatgaggaggaatataatgttgaatgaaaggttgccaattgagacatacatgattgtttgaactatcttatagcaaataatgtactctgtaataacataagcattccttgacatgatatgagcacacagatatagagactctctactgctcaaattaagtttattgcaattgcttacctggttaacgatgagcgaggtggaatctctttcatagtagtcattcctatccatgtgcaacaccttcaaatacatgacaaatacatcgttctgttagctgaactcccccaaaatcactatgccgctactcttttaagtgggatagggaagtcgtaagctcaggcacgcactcacaattcctccccaaacgcaagcaaccaccacaaccatggcgcaccacctacccagccacgatgtatgaacaatttaccatcccgctacgcttgaataggtaagtaaagcagcgatcaaatggcgaggtataaaaaaaaaaaagcaaccagcagcagctcatccgagtgccgagtgcggctgcgtcaagcccaaataagatgaagggggcaggggccgatctacggatcgggcttcaaggactggatttgactgcagacataaaaagaatatgtagcaaaaattcaattggaatataactaatttaataatacaatggccttccaaaaataagaactcgattcattacttcgagaacttgttgctctactattcttccctcggtagcagctcggccacccaaataggcaagatatctcataagcattttgttgtttctgttttacccacgccgctctcaccactcacaagaatagagttgcttttcccttcatgaatcattgctctgtttcatgtaaaaagacagcaggatgatccacgatttataggagtagaaagttagaaacactgatgactcaaataccacctatcatatttactttacctgtatgcaacatctgccatagcgaaacatgtggacttaactctccaaatggtgctcccttgtactgttgcatcatatgtggatcatacaaatatggcaatctttggaaaggattgacggcaatgagaatgtttcccgtatatgtctgtcaaaatgttaaagttataggtcatacagtacgactgaaacaatggcatatttacagtaaatggccatgcagaataacatatatatatttcattaagttcatatctggttgccaaattctgcagaactcctggttcatggaggtatgatagctttgtcatatcatcaactccaccagcagctgcaatgatctaaaagaattgacagcacaaacataagtagcagtacatcaaactgaaggccaaaaacgaattagcagcttaccttctttccattggttgcttggatcttggcctcttcgcctttgatcttaacaacttctccatcgacccaggcaagttcagggtcttcagcccaaacatgagaacctactataatattaactttcgccccagcaatagaagaaaaaattggatatattctcatgattccattcgtcattgggaaatttacaatggtgtttaaatgcattcatgttttacctatatatgcagaaacattgtaatcctctataaactacaaaataaaaatctctctaaaatgatgtttcggtttgaactctaaaacgaattaacatgggaaaaaaatattaaatcacttcgatttgaaaccgcattaaacgaattgctacaatcaggaagcttcacgcaaagcatgccaatgatcaaacatgagcaacacatgttcagcgactgcatccctcaggcggacgcaagaggtaggcggctttaccattccgccgggttttggaggatgatcagcaggtggacgctgtgagggaaggcgcagatgaactcatatcatatctcgtggtcggtcgctcgtcgaagctaaccctccgtcgttgccggtctccgggcgggggatgcggtggtgggtgcaaaagcgggggagtggagagggaggagccgatgtgtagaaggcagtggagggcggagagggggcgggagtacgttgagcggccatggcaggccctcccttcgatctctgtgcagcgatcaaatggcgaggtaaaaaaaaaaaagcaaccagcagcagctcatccgagtgcggctgcgtcaagcccagatgagatgaagggggcggaaggccgttctacggatcaagcaccgatccgagcacgggaggcggcggatcaatcggattgggtaggagagaggtaccttgaggccgtcgacggagaggaggccgctgaggatgcactccatgaggcccgtccccagcacgatcacgtcgtactcctcatccatggcgggcgggcgggcgggcggcgagcggcggcggcggggaaggagaagtgggggttgacgaaaggcaacagcgtcgtttgggagtccaaaagcgtgggatggtgagatgagaatgagatgggaggaggaaggtgacatgggcctcacgtgctgtgaaccctgagcctttccatccgacggctaaaatgggatgtaatctaccgatccaacggctgtaaattaatgatgacgtggaacattgaggtttgagctttaggagattaattgcacttagtgggggataactttataggaagaagggattgggttactttgtcaatttcaaaatataccggaccagtcttccggatatacaatcaaacaaataaatcactctttgttacaaatgataaacgagtgaaaaagctatagggcaatcaaactccgctccgtccaacgtgggcatatatccataaatatacattaaaatcaaccgtagtgcattccaggcaaatcacgtatccagcaaggtgtatatggaaatgagcttaccactctatctgtattatggtataggaacatcatacccaagtcttgaacctttgccttgttgtagtcatatgcaacaactcttaaatttgtatcgtgcaagaagacgatgtctttaaaaggatgaaatccgagtacagcggagatgtattctccattatggtggatgctttcattggcaccactaataatgtcatcagagtccttatcgatagcccattcaaattcctccatatcatttacagctggtaattccctggttttgtcttgtttagtgtcagcattatgccatatccattgctgacgaccatggttgcaggggtagctttgtattattggccctaggtcaacaccatgcttgagcacccactcgttgtcgtcgtatgaagaagaagaagaagaagaagaagaagtttcgttgaggagccaaatttggagtcgacttagaccggtgaccaatacgtagcacactctgtcttttgattttcctaggaaagggtccctagtctttctgtttgatgcagagtcgccaggcaatctgatgacccgatacttgtggtcgttaagtgtgatcttgatgacgcaatcattctggcaatgcatgtagagcgctccccggaggtagacggagtgagtcttgcagtggtaaggtacccttgccaaggatacatcagccatggtgcccatggtggcgtcgccttcccggagaaacgacttctcctcccatcgccccgtcgtggaggagaagacgtgcaggatgaacggcgacggcggccactgatccgacagagacgcagcagggagtcgatgaagaatcaggtagggcatccagaggacgtcgtagtgtggtgacgctgctgggtcgaagacgaggccccgatcaccgtacattatgttgggcagtgaggcgtacggggggacaggaggtagacgcatccactggcgtgtggccgggttgacgatgtggcgatcgagcaagaggaggccgttgcagtggacttcgatggtggcatcgtcgtccaggtcgtagtcgaggtcgatgccggggatggtggccggcggcgagggacgggcgaagaagccatggaggcacgattcattgaggcagacgaagaggccgcggagatggtttgggaggagcgcgaccgcctgcgtggtgagggaatgttcgtcgacgatggcacgccaggcgtggcaaacggcgcgcgcggcggcgaggctgcgtagcggcaggcggcggaggatgtcgcggcgacaaggtcgcccggcagctgggagcagcagtccatgcgtagctagcttagcttaattgcgttgctggcttgggaaatttaattgagttaaaatatgagattcgctagctactgcatgcattctatttgaggaggatatggattgcatgaattaggacggattaatggagacggaatcggatatggacggaggaaatttcaccgttcggcttgcacgtgggtgaaggcggtaaagaaaatttcaccgttcttcttcttcaattcttcttcttcttatataaaaaaaatatccgtgcgttttaacaggtgaaaactattttaatcttattattgttatgtttatttaaggtgaaattgactataggaattcgcttagatatgtatatttttagaaaatcataataagttgcagttagcaggctgttcatctcaaattaacatgcgagttttttttaaaaaaaatagatttcttatttgactccttctgtatttctaaaagcaaacgaacttaaaaaccaactcaaataacgtatcaaagtaccggcaaaaatatcttcgatttttataattgtagagaagagataaactgggggactccataatatacagaccgcacgaagtagcaatcccgttccggcccaataaatatgggccgcatgtatgtcattgatactgttctggcccaaccagaagagagagtcgcattcccactcaggcccatcccagcctacagatagcgcacgaaatagcaataggagttcggagtttaaaggaataagatcactttgactccctcaatttaccac

SEQ ID NO: 1682 - DNA, 2267 bp, Oryza sativa
gtacttgcaggattgatttgatttgctttaacgatctcttcctgcaggtgctgagcctctgggtaccaaggatgaaatttgggcttgtatttggatgacataagcgcgccacgcacttgctatgaaggaatgaaaatcaggcggacttctgacctctgctggcatcaatatcgctctttctgtgctggttatatcgctctattctgttctgaggaagcagccagccaatgtcagggtctactttgggaggaggattgccgaggagcataatcggctccgagaagcttttatcttggagagatttgtaccatctactggctggatagtaaaagccctgcagtgtaccgaggaagagatcttggctgctgctgggctagatgctgttgttttcaatagaattctagtattcaggtatttttacttccctgtattgtttatatattattagaaggtggtatctgattgctgagtttttaaacttcaatatgggcatgaatcagaaggagaagaaaatttgtagctgtataaagcataagttcctgacttgttgtaatgcacagtagcacatcccctgtcttttatttaaagatttatattccttattttttacctctatccaaatttacatgctaatacatttgtttttcaacagcttacgcatcttctctctagctgccattctgtgtgtgtttggaattctaccactgaactactttgggcaagatatacatcatgttcggattccttcagaatcattggatatctttacaattgggaatgtgaaagtgagatcaagatggtgagatgagaaacttcttgtagttttactacagggtagtttaaccaatgttctacatgacatttacgcctcttgagtgctggcatttagagaactccctccgctctcaaatagacgacattttagaatgtgtgcaatcaaatcactaataaatgcaaaaaaaaaaagacatgtgaaaatagatttgtcatcaaaagtactttcatagaatcaataatttcttctttttttttttttttttgagaaagatatgatttatatgccggttgcattgcaggctttgggtccattgtgtagccttgtacataatatcaggagtagcttgcattctcctatatcttgtaaggcctttttctcttaggagtaattgaaacattctcattcctcatattgaggagtagatttgatataacattatttgtctgataatttaggagtacaagcacattgctaggctgaggctccgtcatcttacttgtgcaatgcccaatccaagccattttactgtccttgttcgtggaataccaaaggaaaccaaagaatcatgcagtaatgctattgatgatttcttcaccaagtaccatggatcaagctacctgttccatcaagttgtttacaaagttggaaaagttcagaagataatggtaaaatctgcactcgaagggatgagctgcatataaatttgaacatattgtaataaagaatattgctgattgtttattgggaattttaaaagacggccttgatagttgttgtcatttgatattaattttgggtctactatcttgtagttgggtaatcactgggggaaacaagcaaaacctatcacattcttcccactaatttgattctcagctctgtgcttttatatagagtagtgttcattaatctccggttccttgaattgaatttatggctttgcatatttttatttcactttcttcttattgtgtaacaattctagtcatattctggcagactggtgctaagaaggcatacaggaaattcaaacattttacagacagcactattgatcagaggtgtcgagcaatttcataccggtgctgtctgtgcggagcctcatctaattctttccagctgttggcaactgggcttgagcagaatcaggggaaatctgaccttcaagattccagcttgaaactagatgatcaggttgaacttgtaatctcacaaatattagctcttttactggtagttcgtcaattagtcagtataaaaccagtaactttaactgttgaattgtaccaggaatgtgcagctgcttttgtatatttcagaactcggtatgctgctcttgttgcctcagaaatactccaaacatctaaccctatgaaatgggttactgatctagctccagaaccagatgatgtgtattggtcaaatctttggctaccttataagcagctttggattcgccgaatagctacgctccttggttcaattgttt

SEQ ID NO: 1683 - DNA, 8786 bp, Oryza sativa
aggccctattcttgtgattagaccaattaatttaacatgttctgcagttagtcaattcaaatgtgtaaaggaacacagtttgatgtttccttttctcttgtgttgctgaggcaatatttaatgtagaaatacgggcttctattcatttctatgcagcatctactgagtactctttcgtgtgcaggaaatacatgagccagcttgtaactgggtaccttcccagtgtcatactgcaaatatttttatatgccgttgcaccgataatgatattattttctacattagaggggcctatatctcacagtgaaaggaagaggagtgcttgctgtaaagtgctgtacttcactgtttggaacatattctttggaaatgtactatctggtactgtcataagccaattgaatgtgttatcaagcccaaaggacatccctgtccagcttgctagagctatacctgtccaggtaaatattgtccaaacacctttttgtctttgtgcttcagaagatatgaatagtttggagtacatgatgaaaggtttctccaaaaagatactgtttttgtcccttagtttttttcttaacttctctctgctattctgtaaatattttcaggctaccttctttatcacctatgttctgacatcaggatgggccagtttatcatctgaacttatgcaattatttggtttaatatggaactttgtgaggaaatatattctacgtatgccagaagacacagagtttgttccctcattcccatatcacacagaagtgccaaaagttttgctgttcggactactgggcttcacatgctctgtactggcacctttgatcttaccttttctgttagtgtacttcttccttggttacatcgtgtaccgcaatcaggtgaggaacctcttcatttctacttggagtattatatgttcataacatatttttattctcaaatatgaatatcttcatcaatgaatattttattatgttgcaaattgtaaccgtggtggtgaacattttttacatgaaccttactgcaccattatatttgttgagtagctcgcactgtttcatgcaattaaatttggaaagaaaattgcatgttcttgtaaaaaatgtttactgaaatagtatttcttatttcttagcttcattcttcaaccctattatttccccatgctaatgatattctattcgtggtgttttcagttgctcaatgtttaccgcacaagatatgacacagggggtttgtactggccaatcgcacacaacgcagtgatattctctctcgtgctcacacagattatctgccttggtgtatttggcctgaaagaatcaccagtagctgcaggcttcaccatacctcttatcatcctcactctgttattcaatcagtattgcagaaatcgacttctcccattattcagaactaccccagcacaggttcgtattagttccatcatagtgtatagtgatggacttaagtggacaacaaattaaaaaataaccccatggtctccacattctatcattgtggtgactggtagagatttttgctcgtgggtgattgactactgcattttgattgtacaggatttaattgacatggacagggaagacgaacggtcaggaagaatggatgaaattcaccaccggcttcattctgcctattgtcagttccacgacactgaagatatacccttggagaaaattcagactgtcgggagcgatgaggaacaagggtgtagctctgataagtcgaatggaaaagaaagcttcgaggaacccagagcggagttgtctcacccaacactgaatggactcccagttagccgtcttcggcatgctgtgaagtcgattactttccttgtcagattgcagaaaagaggtttgtcagaatagaataggatatctaactactaaccccttcatcagcctgttcagcgatgaaaatgtacagccacatacatcatacaacatacattgagagagcatcaggatacctgaaaagcaattttgttgttttgatccgtttgatttccaagctagtgactctaggacatgctagttaatcagtatattcaagcctttgccatgcagatattgttgtagtgctaggtcattctgttacatgaaatttaaacttgtttctttggtaacctcagctactctgcaactcaattaccctcctcttctaacttcaactcatctgagaatgtaaaactgaaatttccatgcctgttagcttagagcttgtcctggactgcacatttttttaatttaatccatatttgtcaaaaagcatgtgccatcattttgtatttggtggcagttcttgagatttagcgttgggctgcaatctatacatatctgtagctgttgggaggcatattccccatcaaactttacagccaccatcagtctttgtcatcaaaagagctcaggggattatcctttgtgctgtgcatcacaaatctggtgcatgctgatttcagtgaatattttcttttgtccttggtggtgtttccttcctctttgtatggagtactccatctctttaggctctactgtttcttgaaaagattaaaagaagagtaaattgcattggtggtacacaaacttgttaggtgggtgcaatttagtatataaacttataaaatgctcgtttcagtatatgaacttgcctagttcgtgcgaacgagaaccaaaataatttggcaatgttaattttataaagttgatgttgattaggatgtgacgtgcatacgtgcagtgattattataaaacatgcaatatttataaatttagtctctactttatccttcatcattgaaatgatgaatttcatatgtttctaacccttatatcagtgctcgatttttttaatctttttctacattcactaaatcctattctatattttattgaataggtgtatgtctaatggcatcctcctcatatatatgttaacatagtatcctaatcagcctctaagtcaataacattagtcatgtcctttttgacttctcccgcacgcaccacacaaattcgtgcatcaaaatgaatattttacaagtttgtgcactagattgcacccacctgataagttcgtgtaccgacgatgcaatttactcttaaaagaaatctgatttttgactgctgccagtgctttgaacagggaaattaagcaagaactttttgttgcctccctcaaagcatatgcttttaagagttgatctgtaacataagcagaacattttcagagtgcttgtacacagtttgggtggtgtttttgctgctgcaacttatggtctgggcactgtattattccacacattacttgtgatgatcaggtcagggcagttagcctgcagctttggtttttctcaccaggctgctcccgcggtatttgaaccttgcggaaaactggtttgtgtttgaatttgacataagtgtagtacagtttgaagttttgaaccacaagggcagagtcattgacgtcagcagattagtgatgctgcgaccagtcatcaaaatctgttccaattttcaatcgatcgatcgacttcaactttccaagtgtaaaggatgactgatcttgttgatgtcagcggtgatctgtacactagaatttctggacagagcagctagcttccaggtcttcagtatcatatttcgtcacagataggtactttacttgttgcctgcatgaattcttagagctaatctgggatctcaataatcatagagtctaacgaagaaatgatcagttaactgttgggtctctaatctattgatggtttgatctctcaacataccgtacgttcgtacgaataaacttgaggttgcaacgaagtgaaccaccgcagctagcgagacactttgacaatgacctttacttcagtagttacccttatcctgaactacccaataaataaatttcagagaaatgaaccaaccatcaaaagagaacagcagagtataatcatgcatggtccagggggttcatttcatctcatcactatatataggacacatatataaaagtattatgtagtattaaacacctacattaattaacagtttattaactagtgcatatgcataaaacatacaatgcgtatgcatgccaggtggtttaagaaaattaacaagagaaaacttaatcaaaacatctcaactgtaaatcaatgtacgattacattaattatcaccagtaaggcatgccaaatacaagttgctgctgctgcacaccagtttgtaatttgccttgcaaatattgtagctggttttggtggttgtgccaattcatcatcatcatcagcgcgtcgtccgtgctccgattctgagctgatgatgaacaatcgccgccgctcgtgccggtggaacggaagatctcgtcgagctccgttgcgccgccgctcgtagctgccgtcgactacaacgaatgaccggcggcgaagacgtcgtcgtagccgcgtccttcttctccgactccgacgtgcatgccgccgctactggtgctagcaacgtgcagctggtgggcggcgaggaggaggaccggcctggtgccgacggcggcgtggagggcgaggatgaggcggtcgtcgtggtcggagaaggccccgtggcggatgccggggcggaggtagttgagccagcggaggcggcagctcttgccgcagcggcggaggccatccagttgccgccggtgccgtgctgctggatgtacgaccgcagccgctcgtcgtcctccgccgtccatgccccgcgcttcggcttcaccgccgccttgtcgcagcacgccgacgacctccccatcgctcgctcgctcgatcgaaagggagatgcgagagtggccaggtataaataagctagctagagatcgatcgagttgttgttaatttgatggcgtgtctgcttaattgtgtgttcgtcgttgcttggactgcatgagtatggttttcatgcatgcgactaatcgctcgttctgcccacctgctcaattgattatatactataaacaacatatgtggcttagttttctgatttttttagcaataatattattttaatgaaaaattataaaaatagaagttgaaaatcacaagtttagcatcctgtcgaacaaccgcagtttaacgggggcccatatcaaacaaactgcggttgttcaacaggtgatatttttttaaaaaaaaggagaacaagcactgtgcaatattgttcatgcgggacatatcgaacttgtaagttcgatatgcccctgccgaacaatgcgtagcactgttcatgtactttttttttatggaccaactaccctatcgaacctgtcgaactgcggttgttcgacaggatattaaacttgcgattttagctgatcagctcctatttttataatttttttattaaaataatattatttctaaaaaaattctagttttctcccctatccgtgatcttcctatgtactatctctatttctctctgttaggataatataaggttttgaaccgccattactctgttgtaatattatttacgcgatgcaaaattgtgttcataaaatgtacttttaattcatttttttaacaggtggtgtgttgtctataagtataccgctgcgaaattacttaaacggtactgtctccattttaaagtcttaatatattttattttgtgatttttccaaatgagatgatcgtatttatagaggtgtttggttgccattcacaatctgccacttctaaggttagttaagtttgatcaccttgacaaccatttggttgtagctatagatgtgacaagattttcttccaataaaccagatcccacacgtcaatgactaaaaaaaagtgtccctgcaaaaaaaaaattactcaaaaagtatatatagcaagatttccttaagcttgtgaagatgtacatcgcctcaacttagataagtatgataatatttattggtaaatggtgataaaatatagctaggaacctaacacattcttcacacattcaacacttaaataaagagattgtcgttttgttttgtggtgctcgattgaattgtttaccggaacccgagtaaccatctttaatacacgttgcatgcatgcatacagtttttaactgcatgcatatgggatgagtttgttacacgtggaatgagttaaacaaatttagtcttcgtgacaaattgaaaggagggagtatgaattaaaacaaaaggacgctacaattcattctcgatggatgcacgtagttgttgaggtgatggcattaatagctaggtatactgtatactccctctgtattttaatctatgacgccgttgactttttaactaacgtttgaccactcgtcttattcaaaatttttgtgcaaatgtaaaaatacctatgtcatgcttaaagaaaatttgatgataaatcaaatcacaataaaataaattataattacataaattttttgaataaattttttgaataagatgaatggtcaaacgtttatcaaaaagttaatggcgtcatacattaaaataaggagggagtaagttaaatcaggatgtctgtatggttagttgattcattgcttggactaatcaaatcactataaacataatggggcggccggtttcaaggtaataactcaatctcgcccgtttgatgatcagtcggaaatcatagttgttaagtacatcctagtagctaattgactcgatcgatccataaatagcgacgaattgggagtatatggccaagcatgcatgcaccgatttccgaacaaatgaataatttatgtggatcaaacctcatcgcaaagtgtttagcttagaccaatagacctgcatgcgcatcctctacaaatagtactgtagtagtggtgaagttaattagggggaagctacatggatggagacttcagtagtgaccggatgatgatcttcaaacacatttcaataatcaggatatgaatatttcacatccgcacgtttcctcggtgagcctcacacactgatcaggcactcaactgcctcaagatcagaaaccggccggttaagctaggattattgtgtaatatacattggtggcagctgtcatacaacacactacaaatataagcattgatatcttttttaagcagagattaagtgaaagaattaaagatcgaaagagttttttttacgacaatgtccataattaaatgcactttagaaagtgaaacagtgggaagaaagggtccactattactgaggggtacccattatctaaaaaaaattactgaggggtactgaaaggacaaaacagtaaaagcgtcacataaatgcttatataacaaattactagatgatgccccacgttttgctgcgggatataataagttagatattggagaaatgatttagattgaaatattataaaaatgatttgagaatgataatttagcatgtgtatgtttagttttagaataaaataaattgtagactatatacttacatgttgagttttgtgtgcttaatgggttgatgtggcatgtttgcacataggttttataagtgctaataaatactatgcttgcatactaaaagatatttcctctgtttcaggttataagactttctagcaagaggtagtaagaattatcttaggggacgataatgctttcgccgaaataacaataactgggccagaatatttgggtcggacactgtgtgggctggatactgtcaagcttacctgagtttgtttttaagagaactagaaaaaatgcccgtacgtttcaacgggggtaaaaacgttttatttatcctatacattttactcccttggttttggaccgaatgcttccttggttttggatcgaacgctcattccttcctttccagcttcagtcctagccatgtccgctacctccctctgctcagcctacctctcttcggctcagcccacaagtgaaactgtaggcccagctcgaacaataccgtgcctgtaccataacggagccgatcctcccattaaatccggtccaatctttctcgatctccaaaatttaatccggtcgagcttgcatagtccagtgtccatacaatgatggagccgatcctctccatcaaatccggtcgaatctttctcaatctccaaaattgttgagggattttgatctactcgatctccgtcttcctttttaatcaaaatccccaaaattgttaagggaaaatgacaaatccggtcgaatctttcttgatctccaaaattgttgagagattttgatccactcgatctccctattcctttttaatcaaaatctccaaaattgttaagggaaaatgatgagagagtagtcgggaatcttcttgatcttcaaaatttaatccggggtcgagctcgcatagtccagtgtctgtacgatgatggagccgatcctctcctgaatctttcttgatctccaaaatttagagggattttgatccccttgatctcctttttccattttttttatcgaaatccctaaaattgttgagagaaaaatgatgagagagtagtagagaatcggtttttgcaatcaattggagaagaaaacacatgggaaagcaaatcaacgtgaccgcggtgcagggttcggcacgagaaaaactgcaaaaaaacgacaaaagaaagaaaaacggcgaaaagaaaataaaacggaaaaaaaacgaaaaagaagagaaacggaaaaaaaaaagaggaaacggaaacgggaaaaaaaggaacggacagcgaaaagaaaataaaacggaaaaaaataaaaaaaaa

SEQ ID NO: 1684 - DNA, 2132 bp, Oryza sativa
cggcggtccaaaaggacaattgggtcccgcggcggggcccaagccagctgttccggggacgccgtcgacgtctcctccttggaataaggagtatgctccggcggcgccaggcgtggtgccggtgaaccagccttcttccccggcggcgccagcaggcgtggtgccggcgccggtgcagcctttttccccggcggcgccagcaggcgtggtgccggcgccggtgcagcctttttccccggcgacggcggtgccaaagcctccttccaatgacccgtacgccccggcgaccagcaacactccggcggcggaggagcagaaggacgggctgaacgagaaggcgatcagcgacatcgtgagggagcacaacatgttccgcacgagggagcacgtgccacccatagtgtaagcatcatgcacgcacgcaagctgttcgatggaatgccaatggcaatggcgatgatcgacaatggcatatataataatggcaggtggaacgcgacgctggcgaagtacgcgcaggagtacgcggatttgaggagaggggattgccagctggagcactctcatggcccctacggggagaacatgatgttcgggacggggaagcagtggacgtggaagaagacggtggacgagtggagcgacgagaaaaagagctacgactacaaatccaacagctgcaaggccggcgccatgtgcacccactacaccgccatcgtctggaagaacaccaccgccgtcggctgcggccgcgtcgtctgcacctccggcgaccccatcatggtctgcagctactggccgcccggcaactacgtcggcgtcaagccctactaattcattcttcatcatatcgatcgatccaccacccctgctgctgccctccatctctcacccatcatcgatcgatcgtcatccatgcatccaccatcgtcgtcgtctcatcttattaataatatatatatgcatcagattcttaattattataactaattaattaatgttatcttaacttgttagtgatatgccctagaggctatcatagagatgattatatcacacactatgtttacatatttatccgactttgttccttgaaatagataaacttattattggttaatgaatgtgtgattctttcataagactctttatgttatgtgttgctatttctaaaggatcactgatcaaatatcatatgtggaacaaatatgtatagatgatcagcacatgtattaattgataatgtgggcacatgttggatcatggtatagagataccaaattaataatgtgggcacatgttagtgaacatattgttcgatagacccaacatgagacactgtaagaaccatatatgttgtgtcatcagtgatctcatttagtgttggtgttgaatccttagacttgagattatcatgattcccaacatgtgtagtagcttacttagagactgctaaacgctactccgtaattgggtagttataaaagtagttttcgggtatgctatgaaacatgtagtgggatatgaataatcaacatgggatttgcccctcctatgaagagatatctctgggcccctcgatgttgtagattatggaagtgcatggccatgccaaaggtgattgaggagtcaatcacaagttatataatctatcgacaggttcgagtgaatgattgagctattagaggatggcatatatctagccttgaacttaatcgatatcgtgaggcaaaggggttcatacaagtatacactagaggttcagccgatatgatctttatgtatgcccggtgagtcaatacgttctgctaggggccgctgttgacgcgtggaccgaaaatgagttttcgggttacagctgagtatatatgaaactacagggtcgcacgcttaatgggccggaataagaggattggatggaggtaacgccccgattttcggtcgggattaaaaaatcatttaataatgcattttctagaaattaaataaaagttaaagcaatttaataaagtgaaataatgagggaatttaaaatttcctttaaaaatcatggccgggaatattttgtaatattctttgtgccctaatgtactatccggaattttccgtgaattttcggagctcaagaaata

SEQ ID NO: 1685 - DNA, 2262 bp, Oryza sativa
tttcaccacgccgtgctgcacccctgcatccacttttcctccccaaaccgccaccgaaattcccattccaccaccaaaccgagccaccacctttactcgcggcctccagccaccaatcgttgccgctcccgtccatcccgcgctacgccgtcgcctccttcggcttcgcaaggacggggagagcctcggccaccacttcccgtcaccggagcgccgcctcgcctccatcccagggagcacgccgccgacggccatcggccgtcgccatgccccatggcggccgcccctcgtcggcgccagctcggtgagcaccctcctccctccttctctccctccttcgccgctccccgcgccgcccgccggtagccgtcgctggtagccgcgcgcgtcgtcgctccaaggctcggccgagccggctcctcgtcgcgcccgtgctttggccgcccgtggaccactcccgtggtccgggtccatggtgccgcccaggccgcggtggaccgagtccaccgtgcgccctcccctgtgccgttaacgtgcggggcccacctgtcggcgcgcccctttctcttgatgacgtcagccgtctcttttcctttggaaaaataaataataattgcgtcataattcgatgataattctagaaattcatttaaatggctcaaaacttctaaaattcatatctaattcattcgaactctgaattgtgccgttcaacttgcaaaattcatctaaaattgagctctacatgtttgtttactttttatgtactattttcttggtttttattagagtttttcctcgttttgcgtgccagcgtgtagaatccgttgtttcggaagtccgcggtcgcgaggaaaagagttcggaagatttttttgaagaagcaaggcaagtcacacattccccttgaacatgttgatcccaatttataaatgttttaccgtttacaaataaacatgcatgtcttgctaattacatgggattcgggtattacctatctgcttgcgtgtgccatgtttacttgatatctgtcctttgtcacccttgggtaataaatcgactagctcatgttacttatgtgacctagctagaactgtatgcttagccatgcttaattaccactagctcagttgatgggataattacagtattagacctttttagtatcagaatgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtgcttaccacaagccagcgtgggcaacggctgggcttgtagtgtagctttcctctagctgacgcatccaggcaagggtgggcgtgatggagtttggatgggccctgcgacggcctatgcggcttccggattcacctaggcacgagaggggactgcccgctgccttgcgaggagtgggggtgaaacctgaggtgtgtaacgctccgcttttcgtgaggcgttaaaaactaattcggcaaaaatcctaattgcgaaaatttcgttctttgagtgttgagtctaagttgtgccaatgatctcaatttaatcccgttgttccctctcatcgaaaccaaaatcctctacctccaaattccttttccgattcgagtctctgaaatcaaattctgaaattcaaatccttcctttgaatcctcgccaaatacttctacgaatccagaattattcaaatcccgcctcgaatcctttccttgactccaccctatgatcccgagaacaaatacccaagtattccttttgaatctttcccatgacttctccttgaattccccttgatacatccctaaaccctcgagttcgaatatcaaatttgaattcgaatccaaaccctaaatctctccaattctatccaaatcaattttctctgcaaaagtctaccttacctccctgtgattttggatgggccgattctcctcccccggcccatctccccctcccagcccatcatccccccctcgcacgtgcgttgcacgcatgcgagccgagagagagagagtcgtcgctcgctctctctgtctctctcgctctcgctgtttctctctctctctctcgaagtctctcttccgcgccgacgccgctttccgccgtcgccgaccaaaacccagcaacgtctttgccttttcccgcgctcgcgcgtggccgaccggccggtcgttgcc

SEQ ID NO: 1686 - DNA, 6141 bp, Oryza sativa
tataggcgaagtcgagctcggtacccttcagtctccaccgctgtagcgccattaccaccgaaccaccatcgccgccttgttgccgcttgtcccgctctcgtcgtcgtcgtccgtcgccgagcaccggaggagccggtgcgagcgtgaacgcgtgacgaggagctccgggcgccacctctccctctcttcttccccggcgcactcgcctcgacgccgcgccgcctcggcgtcatccgccgtgcgccgccgctcggtcgcgtgccgccatcggccttccacccctttccatccccaaatcgccgccgataccgttcccgcacgccggtgagctcctcgcccaaattctcgccatctgcatcatcttggataagccccgagccattcggttgctcgctcgtccccttaaacgtgccgccccgccgttgctctgcttcgccgccgccgcacccgcctgtgagccgccgtgggccctctcgccaatacctcgcgccaccaccgtccttgagctccctaggacctccccaaaccattccctagcgccgtcgccgcccagcacagcctcgccgccattgccgtccgctcccgaaggccgctgctcgtcgccagccctcctcagtgattctccgccccatccgacaccggaaacggattccttgaaccccggagatgctccaccccctttgaatcgaaccctcatcgtctcgtcgtgattcccctctttgctcgccggcgattgccgccgccacaatccgccggattccggccatcctccggcgaatccgagccgtcggctcgcttcgtctcgtctctccccttcccccggggtgcttcctttttccattgaggtcgcgccttgctcctgcgaacgccaccgccgtccgccgtccatcccgaccggcttagtcttcgtccttccgccgacccgcgtggctgccgccacgtcggcgccacctcggcacgaccgagtcaacagacccggtcggcccctcccttccgtttccccctccgtgcgcgcggaccccggtgtgccatgcggctgcacgtgggcccgccgcgcctcgatccatccggtgcacccaaaaccctagcgcccgccccgcgtcgccgcttccaccgtgcaccgtctcgccgacatatgggccccacccgggaccccgcgtggtgggctcggtccaccggaccgctccctcccccttccgcgcgccctaatgggccacctttcccgcgaccgcgccggcccaaatggcttggccgagcctccttcaacccttgggccgcgcccttgccgcccgaaaaagtctaatatacatccctccatccttttctttttcccggaatgtaataatcctttttcactttgtcccataatcaattccttattccaaaattccatgaatcattttccttggtcagtgactgtcaataatattcttgagaatattatttctataaaattccataaaccatttctcctattccagaaactccaattaaacttccaaaattcatatcttctcaaccgctcatccgattgactccgttccacttccagtaattccgtaaaattgatatctatttaatggcactaataattagtctaaataggatctttcttttggtcttttgtttaggttttcgattgtttgcgtatagttgcggttatcggattttcgtcgatcgcgggttttctcgaagattcgtgaagcttcgtgaagactttgagcaaggcaagtcaccctttgatcaattgctcctataattgaaaagtcattattatttcgtttgcaacttgcattattagaatcacacacttaacttgcttggcctcggtttgcatgccaaatcgacggacctacccagtagtcgcactaattttcgtaggtcatactaccctgattccttgtcgctccacccttgtggtacctcggtattcgtgctctctgagcgcgtataccaaatatcccacatacaccgttgtttgtcgaaaacttgggaaatgggtttgtgaagccatcaaaacccgacatgtggtgtcggtgtgtttgaaaataaaatgaattgtgaaaactcgcgatgcggaggttgtgcctatgtggcactgtcccgtattcgcatataaggaccgattcctatgggaaactcatcgaacataatcaaagtgcaaccacaaggtggaatgggacaccctggctaagtaactagtcggttcagggaaacctcgcatgccaatagttggggaacgccggggcggggtcgattggagccaacccgggttcctggtaaggcaagaatgcgaagcttgccaggttaccgatcgaggtggttggagtttgatttgtgaaaactgaaatggcctatatttatgtgaggatttgatccttctatgtggcatgaggtaaccctgggtcggcttgggaaaggctttgttgcgaacctccgataccgacgggtgttcgaaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacaaatctgtgtgattcgggatgtctgcgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattactaaatgagctgttgaaaaacatctcttaatgtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaatatatatatatatagttccccggccctgaagagaagataaagtgaagtgaagattagggtttcgtcctggttcccagccgtcgcctgtggtgttgggtgttagaccgttggttccgctgctgctgctgttgttggtgttcgcctcgtccgtgtcgtcggttgtattctcgggctgtctgagctataacctaagttaaggtaaataagtcctctatttatcttaaggattgctatgattcatatttgtcaccgtgggtaccagcactatgtcctgggactggtaccgagatcgcggtttcgtaggaagcggttcgcgccgttttccctacgacacgctcctgtcaggtgccgttgtacggcggtatcagattggggtgtgacaaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcaacctaatgcactgtagttcaggtgggttggttgggcctgttcaacgtggtgtagcgttgatcagtggagatttaaggttactttaattactcaactgttttactgttttgcttaataaaatgctttacaaccgcttttatgcaaatagccacaaaccgtccttgtgttccccttgcacgtctgcatcattggtgtggcttgctgagtacggtggttgtactcagccttgctattgttcccccttttcagaagtgtaatacttctgagtgaagacgaagttagaagaccaaggctcagaccccagttgagtcttgcctgtggagtggagctgaagccccgctaagatcgcctttttccgctgctgtcgttctgtttcggtgtgaggactaagtgcctcttctgtaagtattttacgctgtatttacgtttggaactgtatattacttgtcgttttgtgtaccctggctggtcctggacagggatttaatacgcaaaatagtctggaaatttgggctaaatttctgggcgtgacaatggagatccaatatgagcttaattcggatagggatccgaataggagtcctacgggccttgaaggcccgagtgatggatcctatatattcgtgaggggtctgactgccggagcattgcatcacgtgagaaaccctagccgtcactttcctccccgagcaaaaccctagctgcgcgcgggtgctagcacatctgcgcgtggcgttctgtccctgtacgtacgtgcggataccggtaaaggcgccgctggtttgcggtgctgatcggcgtgggagtacggtgaggagaacgcacgaggaggagaaggtcgagccggtgcgatcgactacttcctctacatcgacgcgcgctacttcgcgagagttccttcgacttctcagcgtcttcttccgctgcgcagcgtgtcgagtggtaacaatctatgatctaatacttgcatggttcctggtttacgtgatagaaaattttaatttttatactatcgtagcctatacgtatcccaacataactatcttgtaatacagcgcacaaatgtaactgttgcctgaatgtgctgtaaaattaaacaaagaaaaataatcgagaggattcttatgctccattgatattttacacttttattacctctctgagatttccgttataaacagaaaaatgactggctagctattggtcaccgtcattctcgtcatctcccattctcccgcaccttctcctatttattttccttcctcttttggttgagttaaggtcaatagtactttagggctaattataaactaattaggcttaaataatttatctcacgatttccatacaaactgtgcaattagttttttattttatctatatttaatgctctatgtatgtgtccaaagatataatgtgatgttttcagaaaaaaaaattagaaactaaacaaggccgaattgcaagagatggattttcatatacttctactggagtgtacgtacgtattgcaagctttcagccttcatgcattactcagcggactgcggtcagtgctcacaagcggctgaagccaaaatgttgagaggcctgcacaactagctagctactcaatccaacaagtttttttatccatccgtccaaaaaaactaatcactcctggaactacgaatctcgactattcatcgtcggtcacgtctccttctagtttaaggttttttttttatggaggaagtaggtgctctgctgatcaaggctgccgcttgcattgctaaagactgcagcgacgactcatctgaaagttgaaagtaccatcaaacgattttgtaaacagactactccttgcactgatcgatgtgctagcttcaccattcgatcgatgcgctctactattagcaggcagcaggtgttgtctactcaccctgtgaaaataaaaacaaatagactatggctgtgtttattttccttcgaacttccaaaaatttcgtcacatcaaatgtttgaacacatgcatgaaacattaaatgtggatgaaaaaaaacaaattgcacagtttatatgcaaattgcgagatgaattttttgagtctaattacatcatgatttgacaatgtggtgctacagtaaatatttgctaataacggattaattaggcttaatagatttgtctcgcagtttacagacggaatctgtaatttgttttattattagtctatgtttaatattttaattgtatgtccgtatactgctaggactgactactgttactgccagtctctcactcaagtgagatcagatcaggtgtttgcatggtccactccacgcacacatcgacgatctctccttgttttttactcctcctcagataatgttgcacatctatagtggagtggtatatgatcatctatctgcagcacctgcatatgtttgcacgtctcgacgtgcgtaaactcatctatggtc

SEQ ID NO: 1687 - DNA, 1061 bp, Oryza sativa
aaaaaaagagatagaattaatactactcagccgtcgagcttgtccccgctggccgccgcctttctccccacccattgtcagctcccttgaaggtttgggttgagatgggaagaaaggagagaggtgaaagaagattgtgggctgacatgtggggccgtactaactcagccactatgtcaccaaaatcggagagcaatattgctttgggatcaaaaggtgactcagtttataccagattaatgatccattacctctggtattccggttcagggatggttttaaaactcgacgacaagataagggaccttaggtgaactttacttttttcgtagaagaaatatttccagcctgatgggcctgtgcgtatgacccataggccataggcagccggccgcagagcgacctcctccatacatcccgtctgccgccggcgccgatctccatcctgcgagcagagcagaggtggcgccgtcgccgcagaggagcgggagcatggccggaggcggaaggatgccgttgttgggatggtggctgatgctggtcggctccctccgcctcgcctccgtctggttcggcttcttcaacatctgggcgctccgtgttgccgtcttctcccaaactgacagtacgtgtgcttctcctctctctctctctctctatatatatatatatatatttacatccacctccctcctcccgccatatgcgtggggcgagtcagtcatccaagcggagcgggtggattttgcttgtaccagatcgaaacctgagagcccgtggatttggtttgggatcgtaccatgtagtgtgacacggtcgttaaatgcaaacttttacctcaaggctgacacctgagagcgtttttgaaacacatgagctgcaataggtctcaaaagtgcatttctttttttttgtcctgtaaaaatttggttgggtttgtgagcttggaaatttgctcccctgctggataaatttgtctactaccttcagcttcagggccaagaggatggctttgctgccgttctgtcttggaaatcggagtttgattacagaactgaacc

SEQ ID NO: 1688 - DNA, 652 bp, Oryza sativa
atttaaattgtcatggcaacccactatttcttttcgattataagtttcatgttctctttaagacagtcagcaacaggctcatatttaagttaatctgttgagttaacttgaggaaaccattttccaataatacatagctaatacaacaacgtttgccttctttacatgcagtgactgaaatacatggtcgcacttttggggtctggacacttttgacctgtactctgtgctttctgtgtgcattcaacctggaaaacagacctctctatctggccactttcctgtccttcatctatgctcttggtcatttcctcaccgagtacctgatataccatactatggctgtggcaaatctgagcactgttggcttcttcgcaggtaatgaatttagttttgactgtgttgtttgctcagttcagccttctacttagttatcatgcaactataatgtcaactgatgatatcagctcaaacattcaatagtcaataataacagtcaaacaccatgcttgtacatacaccaaataggttgatgtctctggtgcttaagtagtggaagatttgttcagtacagctagcggtttcttgtgcatgcttactctttaaaatcacttagcattcacctttataacagttatcttgccatctcttc

SEQ ID NO: 1689 - DNA, 4617 bp, Oryza sativa
ctgccatcccagctgctgtttcttattttgtcatgttcgttctgtaaatgtgaatactagggtgtcgctgcagaaagtcagatgtattactacagtgtatgctcttgcttaagtatttctcgacactgaaacagagtaaagcaaagtctagtcagattcgttttgtttgcttcaattcagatcatgcagtgagcttgctttttacattctaattgtgctagtatgtgcaattcagaccacattcacccatttgtaccttttcgtcagaaaaatggaaaaatatgatcagattttgtagttacccttttacacaaggaatgtggtaaagatacacgcatcaactgaacaattgctgatgtagcttatccaattcaacatcaagaagttctgaaaccatcccaagcatgtgtggctcacaagaaaaacaagcatatacacgcttagggaattaacaaaaaataaataaaatcagtgatggcaactccttttgcttatgcaccaaaccaggaaaaaagggagtacaagaggaaaagctcatgaaggtatagaaccatctcacttttcctgtattgattttcaagaggggcatggaaacatattattccaaatgaaattcatcagtatgtgccattcttttttttcttaatgctatctatgttgttttcactggatgtaatcttcattgtagctgtcactgatcaccgaaacgaaccgctcgagccatggcagctggtgaaggtccttcatggtgtcaatgatatatgaatcggcgcagcggggcggcgactggcttggaggctcacccaggttgaaaccccctgagaggaacctctgaatgagagccagctgagctctctcctgctccgagtacccttcgatggcggttggcatgcagtcgaacgtgtcccatgcccatatctcggatgcttgggtggaatgcgctgccgaggcagcctcgatgctctcttcgtcccagaaaacacattggcatgtctgtataccattggtgtactcggcgccacaggagtagcagaactcgtgcccgcaccttcagaagtgacaaaccaacatttagcatatcgataagaatcaaaaggtgcattcatgaattagtaatccttgatgggagcgagcatttgcaatgcaatagctatctaggtgggcgagcaacacagagcacatctagttggatctgaatctacctagtgtgaaattactatgaagagtatgcccatataaacaaaaccctaatgcggactgtagaagaaaattctcttattgacaccagtaatgcaccttaggccccaactaagaattatatgaagttatctcttgtatgatatgataaattaaataactaatttgggaatccgggattctgaggccataataaggaacaccttggaatttgtactgaaaactaccaagttctttaattcagagtgtggtcagagacagagtgggccaacataatatagctagcttacagtctacaacatttctatctggttggtaactttcaaatattacagattgggggagaggcagaaatcagcgcactacttaaaagttgcactaagaaagcttcatcaaacataataaacattcgttcataacctgtgaaaatgtgaaatgattcttctctctcatttagaaattttaactactagcatgacaacagatctttactcttataataaacagtgtttaatgctttcaagtttcagttgaagcccaatgaaaccggccaaaaagagtgcttctctatgtagaattataaagcttagttctgtgtgtacttgtttatttttttaaaaaagaaattcctctttttagtctacgagattccataccagcaagtgtgccaaactgaaaaaaggaacataccagcaattcatatggaagcagccttgtgtgagttcaatcattcgtcggcatctctgacaacgcctccacctattgttttgtgctagccgatgcaaagacaggtctcctgcatctctttcatcaacaggcaagctctggtactcatcacagcccatcatgacatgccatggcactccacagttgatacagatatctctatggcattctgggcactcaacacaattgagatctgactgacttgatgtacttgctctagagaagtgctgactaagatctagtagaactgaacagtttggaaagggacaataaaatctttccatgtctgaggtgccagcttctgcaaaagctctctccagagaatcgtagcagctaactggaaggaatgacttacactcactagcagaaatatgatatttacaccttaactgtgggcatcttataggaaccttgttggtttgcagcttctcttgagtatatgaagtcaagcagctatagcaaaatgtatgagcacaacccactttgatcatctgagcgcctcgtttttcctcacagcaaattgaacaggtgccaacctcgtatggagatagatacatgatgcctatggcttctttggccaactgcagtggcctctcaagctcaaagctaggaagcaatattatatcaaagtcttccagcttttccaccagttcaagaattctgtgtcctaaagctaccaagagctggtcttctagaatttcagcttctgcgatctgtcagtgcaaaagaacaagaaatgacacatcatgtctaagtatgatataatacaggaaggcagtaagataactctattgaaataggtaattatgtaagaattctacagctttcggacaacataaattgaacaaactactgcatagaactgcaagtgatgaatacgatctatatactgcagctgcactgcagtagcagaatttggaatgtgcagctgtcataactgcacattccctaccttttcatcctttcgttcctctcagtttagttctgtttacaacagtcagctattaataggtagctgttaaaatctcaaataggaaagacggtttcttcattgactgattgttgaattgattagttcgactaacttggaaccaagcaagatggcatgaagtcaagtatagttatcgtggtgcggtccatttttttgtcattcggattaccagccaaacatgtggtatcctcaaaacatgaattacattattttggtagcgtatatcacaatgccaaactgcaacatacagtttagttaactaaaccttaagcgcccattaggtgatgcccaatagcagaaatatcagggtgattgaaagcgatactagcgattctgtgtaacattcataagggcaaaccatatattagagaaaatcggaaactcttgcctgaaagtacagcttctccgaattggtgaaagcaaagatcttccgtatcccattctgcaacgccaccaacaggccatccatcagcgccaagtgatcggccactagctcatccacatagaagtccagtttcttctgcacctgaagcataggcaccccaggtgacctctccatcaccaccccaatcccggacagcttcttcccctccgcctcggggctcgacacgcccttgaagaacagcctcaccgagctctcatcaagctctcccttggcgacgccggccgtgaatgactcctcggtgtcctcccactcatcctcatccccacagcagctcctgaagtcatcctcccctctcgaattgcaggcgaaactgccctccacgtcggctaacctctcctccattgctgaaatcccaatccaattggtgaaatccaatcaaatcaaatcaaatcaagacgacactctctgactcagttagaaagctgagcaatccccaatttgagcaatctccattcagctagatgggtcagcaagaagctgagcacactgacaggcaaccaaaaccaaaaaggtttccaccaaacgagcccttttgagctcgagactgcacctaatcccaactccaagaaggtgccttgttcctttttgccacaaccactatggtggtggtggtgatggtgccagtgacctatcgctccgacgaccccacagattcgtgggggggcctcggaatcgcacgagatttggctcagaaattggcggagaggatggccatgaagcaccagaagagctccacatcgcgaattccagggccgcgagggcgaaattgaacggggcagcgaccaaattcacccaaatgttggagctttcgtcgattctcgaattattcctcatgcgagagagacgctcagtagtaattagcaattcagaccccgaggacagtgcaaatcaccgccgcgacgtgagctccaatcacctgcctgcaaggtgagaatttaccaacaattcagatcaaaatcagcaattgcgagaacgaaacgactgctcctgaaattgacaaaagaaaaaaaaatctagctcaaatgttggaaaggcccaagaaaaaaaaggaagaaaataccgaggcaacctgcctcgcaatcgaatctaacagcaaattctgcagaaaactcgtagaaacagatctagagaaggcgagcatttaggcccaaaagtagatattccagctcaagaaaaattactagaaaacagcaagagaaaactccgcccaacaagcacaaaaagaacccaacaaaattcgcagaaaaaaaaaaagatg

SEQ ID NO: 1690 - DNA, 3197 bp, Oryza sativa
ctgaggaagaagaagaagaaaaagagagaggagtggcgttaaagcaaagacagaggagccctaattattccttctcgaccacgaggagcaggagcagcactgcaattgcaaactctcctcttctccttcttcttcctctccagatttgcactgctgtccctcaacaagcacaaatattgcacctttcaaacttagcactactacctctcttctaaaatgttcagttatttcatcatggaacgtgttttaaaatgaagggtgggtttagttcacgtcaagggcccctttgatttgaagaaaaaatataggaattttggaggatttcaatcctatagaaaaaattcctatgaagccctttgaaacaaaggattaaatcatatccaatcctttgaaattcctatggaatgcacaattctatagatattttggaggaaatttagcaagagctccaacctcttagaaaatttcctttgagtctatctctctcatccgtttcctgcgtttttcctgcgctccaatcaaacgaccattcctgtgttttgcgatcctatgttttacacttacattcctatcataatcatgtgtttttcctattcctatattttctcagccctgcgattcaaaggagccctaaaattgaaagtttggttgaaattggaacgatgtgatggaaaagttggaagtttgaagaaatagtttggaactaaacacggccgaagttcttttcatctacattatcttcttagccaatcataaccattctctatttaatttctttatatattttcttttatcaacaatgacaacttttttaatgatttttgtatattttattaatatttgctttgatcttaaaaacaagatagtggagaactaaggcatgtttgatttagattattagatggattatttagggataaattacttttaaagtaggcttaaaagatactactagcttagaccaaacggtcaatacagtgaaaataatttaaattattgaatggattatcgatttagttgtagaaataaaattatatatattgagaaataaacttgacaaataacttgaaacaagcaaaaatgcataaattattttagaaaaatgtagttttagaagtgtgaaacaaataatttattttatatttcgatgaataagaaaaaaaaatatggcaccatcaatccttaaacaagtcattattactcgttcataacgtgtccaattgcctacgtttgcttgtgccatatcataagacgactccgcattttataaacgagtcaatgacatcgatgttgcgagtgtttataatgggttttattgctccttgaaaccatcaaggataagttaaccaaaaaaactttaaagttttattgttaggtgtatgtttgtttatactttaccctcgtcaaagaaacaaacatgtatctaccgtagagaacaaatcaatcaatgcattctagtagtgctaggtggtacttggattcagggactaaacctgtcatatcggatgaatttggagtattaaacatgaactatttactaattacataaataagagctaattcgcgtcacaattttttaagcctaattaatccatataattagcatatgtttactgtagcatcacataggctaatcatggattaattaggctcaatagatttgtctcgcaaattagtccagggttataaaatgagttttattaatagtctacgtttaatatttataattagtgtccaaacatccgatgtgatggagacttaaaaagttttaatcccttttaaacggggtcttaatcaagcatgtatttattactactccctaaagtagtggaaaattaatataccctccttttctaaatacagtaactaatcttaaattctgctctttggaattatgaccacaatctactcttaaatgttaggtaaagtgaacgaaatttcgttcttacatttactccatccattcctaattaattttttcctaatcatctttcacaatcaattttcagcatcatgagattaatgttttaaaattcattgtgtaatatttatataatgtactccctccatctacttttgatagtcatattccatcttggcacacagaccaaggataagtaattctacttatcatctatttaaacatgctaccaaggataatatgataggttgttgaattgaaatatgcctatcaaagataaatttttcagatttagaaatatgactatcaaaagtagatggagggagtatatttcacatgatattgaactataggaatttctaaaattttattattgttaaagatagatatgttaacttacgataaagctaaatcaacaagtaatatgaaatgggaagtatatgacatattacacttaaataacatataacattttttatggtttgtaaatacttaaaagaacaaatgatcaaaattttaaaggtggatagtgtgcctaacgttggttattttgtaaaaaggtgacgaacacactgacagccgccaagaagtaattcatccggttttataattttaaagttttgaataataacacgatctacaaaacgcatctttaactatgattttctcttgtaatgcatataataaataaatatttaattttgttacagtatttttaataataatctatttatattttttaagtgcattcaaacttgtaaatattttagaagatactaattgttaaagaaattttaatagtttgactccagctgaattaaggaatcggatggagtaattagcagaagagaggaggtgcggattgcaaaagaggcatggaagtggttggtcgattgattgatgtcgagtttaatggcggtcggggcccacactcacactctttctgcatctgcatgcgaacggaacggaagaagaaatcctccgttccgtttggactcgccaagttggggcggtggagtgggcccacgctgtcggcgagagcagccaactcggaccagcgacgtggcaaccaccaccgtccagtgtcagcgtcagcaactgagcatattctaccaaaatcatcttcctcctctcatcaattattattatgcttattaaggatcaggaacgactacgtgcacaggattctaatcttctaatccgattgaaaacatgcagagattcttccctgcattctgaatttctgatgagagaatcaaggatatgagcatgaacg

SEQ ID NO: 1691 - DNA, 1429 bp, Oryza sativa
cagagatttttccctgcattctgaatttctgatgagagaatcaaggatatgagcatgaacgtgcggataacataaaaacaataacaatttttagaaacattaattctctctaatactccctctggttctatattaattgacgttttgggcaagcttgaggttaaacttttataactttgaccatcaataactttaaaaatatttagtttaaagaaactaaaaaaacatatatagatttgtcttttaaaacactataataaaagtaaacatgcattcatttattgtatatattataacagaaaaataaggtcaaaggtatatcttgtagagcgtgtcattatccaaagcgtcaattaaaatgaaaccggagggagtaactaatgtatgcatgtgtgtttccttgcaatcgtatctttttctccttttatttttccttttcctttttactgacgacagcacctgattcaagattctaatgctcgcatcttcaggcttttactaatttttttttcttttcatcagtcttttttgaactcgattcttttctcttttcttcaagagcaaaactcagctttaatctactttctgcctgggccgggattcacacactgattaggcaaggagggtaggcgatagattatactactgtatactgttgctgattcagctagttgtgttgtgtcattaataggaaattaaccacagcttgggagagctctagctaaagaactcttgttcatctactctcgcgtcgtcctcccctggggcggcacgggaggcgacgacccagccacccatctccctccccttcttcccctccgcctcgccgccgctcgagcggccaccggcaaagccggccggccgcaaggacggcggcggcggggcccctcaccgacctttcaccgggcaggcaggggagccgccaggcgggacggcggtgaccgccagatccaggccgctccggccggatctggcggcggggaggacggcggccacggcggcggggatggcgacggcgaaagcaggggcgcgcggcgctaggcggcggcggctgaaggcaacgggaatggcgatggcggcggggatggcgatggtagcggggaaggaaccggccgcgggcgcgaagatggtggtggtggtcccgtgtgagcttgtggtggcaacggcgcggtgctccccggcggcggcggcggcagtgtcccccagatccgcgcctctcggccggatctggagggtggccggcggcaacttgcggcggctgtgcggcgacgacggcggcggtgcggcgacggcagcggcggcggtgccgcgacgtcagcaacggcggtgtggcgacggcagttggcgacggcgacggcggtcgcggtagttggcagttgcggtgttggctggcgatggcggcagtggcgcacatggcatggggcggcag

SEQ ID NO: 1692 - DNA, 3774 bp, Oryza sativa
ctagctgagggcgtggaaggcgactacatctggccggcgcggcatcgtttggtgaaggggtcgaagaccggcttggcgcagagaagcgcagccgatgacagcggaggccggctcggcgcgagaggcgcgagcgacggagatggaggccggcttggcgcgggaggcgcggccgatggagggagaccgcattggcgcgaggcgcgtccggtggaggagaccggcttggcgcagagtggcgcggccggcggtggaggaggcgacctaggggtgagggagagctgccggtgggtgtagcgcggtcttcagcgctcgaagactggcggcgggggacgccggtgcaggggtcccacatgtcggcaaagcttgtgtggtggtggagcatcggtgcgtcaggcgtggtttcgcaagtggcgagcggtgggtgaaaacccagtccggccttggtcggaccgacaacgatggttatcccccctcctgagagcgttgtcgtgctgtctcacccctctggtgaccttgtctgtgtccctttgttagcctagtgggggtcggtcacgcttagcggcggccggtccggtgttagccttctcctgggcttgtgtgatggcgttgtcgccgtgtgggtggtggtttattttttcctttttcctggttacgaccctccagggttgtaaccttgtaattttttcctactctatcaatagaacttcgcaccgtctcgtgcgagtcgttcagaaaaaaaaaaaaaccacagcttgatacaataatccagggtaataattgcctgaactgacagttcattcatagagcgactaaaatacttgcatatatatatatatatggtatccccatattgatcctttgcaatcagctggctttcatgtgcctaggcacattggtttaaagaaaaaacatataaagaataactgagacgataagataatgcaacaggtggctaaggttagataatgcagcacgttctgcaagaattagcaacagtaatcttgcctgcctgccatctttcggcgtttagcccagtaatcagttttaggttttgagggtgtactcttctgcttggaccagtcagctagcagtgctgacctactactaataataagatacttgtactaattattaaaagatacagtacttactactaattggagtactggtagtatggaatatgtttagcacctgttcattacaacaagtactactgtactaatagctgttctgtcgtctaatggtaactgtacctatcatatagcaggtggcttggagcttagcaagggaacagtactagtgttagctgtattaatactacgactatcttacactggagagagaacagctagtgacacactaaccaatcaagctgtagtagttcagtagtactagtagcttggatcattttgccatgaagttagctagatgccaatcggctcagccattcattatatactcctacatctactaaaagattaattagagtggaacagataatctcagcattcttcaaggttagtatagtattaacagtgtcagagatatggcactgattagatcatactgtcgagatgattcaataatactgacctatagctctttgacactgtatacatgcatgttatgatcaatgtgtatgcagtaggttttgcaaaaccatacgattatcatgcgtttattattagtctccttagtttttaaaaccacaataaatcttacgataattatacgattaccccgataaccgtaacccattcaaaaactatttgatgaacgcacacgatgctttacgagagaaccttttcagatacagatccctgcttccactgcattgcattgttctgatgatcggtcagaaattcagaatgaatgactctgaagcagcattgcagttgagttgatggaactttacatggcagagcagggcagctaatgacaaggcatgtgaacggcactttgcagctttctgtctcccccttgattagcacagagatcagcaacctttggattttttttccctattaatttattgatatactcgagcctgacagccgggacattagtattagtaggagtatataatgagtatttaatctactcaaagcagggcatgtatatataagtagtaaaagaaaaagaaaagtgtactatatataggcaacagtaattacagtatgaaatttggagtaatacactaatactccctctaacccataatataagacgtgatcaaagttggcacggtctccaaaacaaatctttagcttacaatttctcatatactataaaatttgtagcaacaaaattatagccatatgaaagtaaatttaaatctccatctaatgatataatttttactcctttcattccaaaatataaggcacaaccacccttaacccaaaaaccaagaaataattattatcatcttgtagtttgaatcatcctaataaatataatgcatgcatccaataggattagataacatgagagtagaggatttaaaaaagtaataatttaatggagaagatgccatagttaattgcatgcttgcatgcatgccttatattatggaacatctaagaaaaatggttgtgtcttatattatggaatggagggagtaacaaataaaatttattttatattatactaagtgttggtcaaatgtttttgttttaaaggttgaatcttgaaatacgtgcacgccttatattatggaatagagggggtactcattaattacattacatggtgaaattggtttatcttcttgcatgtactccatacaacaatgaccaagagtattaattagtacaaccttgaaattaaactcgaacaagaccataaaaaggcccaggtttgactgcttggccctttcggatcacacaaggaggcccaccacgatctggcccatgtatattacgggctgcacgtaggtgacaatccccaagggcccctatttaacacgatttccgtttcatgggcctcacgacaggctgagactgcacagagaagcccactctcgcgtgcgcatttctcacgggcagcaccctttgggcctttggcatcccctgtgagcaagggtctattttaatgtaaaattattcccctcaatcccctccaatactttttaatccattctaaatcgaacaagacctaaatgtttcggcttcgttggttgggagctccggatttatggtctatgcttttcgactccaaatgatcgcatgtatttctcgtagtcttagaggatgtttggatgggactaaaaatttttagtctctttcacatcgtatgtttgacactaattagaagtattaaacgtaaactattgataaaatccatttcataaccatagactaattcgcgagatgatctattgagcctaatcaatccatgattagcctatgtgatgctatagtaaacatgtgctaattatagattaattaggcttaaaaaatttatcacgcgaattagctctcatttatgtaattaattttgtaagtagttttatgaatatatataatgatattagtgtcataaaatatgttgttttactcgggagggtatgtttcgggttttcattggtttttatcctgagttgaacatggaggagggcctgtaggaggcaagagcttgggccaaagaccggggaagctaaggagagatagggaaacccaactgctgccggtcggaacggacaagaaagaggtggggataagctatataagagataaggccgattcaattggaaaaacaatatactcacaatcc

SEQ ID NO: 1693 - DNA, 7336 bp, Oryza sativa
  unsure (1)..(7336): unsure at all n locations
ccacatttatattgatctatatctagattcattgacatcagtatgaatatgtgaaatgctagaatgacttatattgtgaaatgaaggaagtagaaaagttcttccggcatatatagatccaatcccgcagtggagaaaatggatcactcactgagacatatctgaaatgcattttccctccatttgcatcactaatttttaaagttgtttcataatataaggcttgcatgcaaacatgtcattaactagcacatctttttcattgaaatattattatttaaatcctccatcattaagatctctaattttattaggtgcatgtattctattaaaatattattatttaaatctttcatcataaagatctctaattttattgggtgcatgcattctatttatcagggcaatctaaactatgagaagataataattattttttggtctttgagttaatgatggatgtgccttatattattttggaatggagggagtaattcattagcagtattactaggagcactgctacacgtattatatttcttttacaaaactcttacaaacaattatttcaaccatttgatttaaatagatggaagttatagaaaatttagatgtcctcaccgcgtgacacatagtgttagtaagagtttagtgtgacaaaatttagtatgtatagacttttcttattagtagcttccccgtcatatacagccacatgccgtcggtccatttccaccaattaatggacgagtctgcgggtcgggcgcccgatcggtgtggagaaaaatcgggcgctgacgttagcatgacgtcaacacccgatttacttgcaaaactactttaaaatgattttttttctcaaattaattatccaaattataatccgattgcaccattaaattcgttgcaattaaatcttcaaaacaagaccacacatatatatatatatatatatatatatatatttcgatgaaaatttttttagcttattattgaattatttttaaatgttgcacgatgttccaccgggtatatcggaattgtttcactaagtagatcgaaaatgtttcactcgtttaaatcgtgttttgtttcaccttatataaaaacaatgtttcagcaaatagcgaaagaatgtttcagaatgtttcactcgtttaaatcgggtgttgtttcattaagtagatcgaaaatgtttcactcgtttaaatcgggtgttgtttcaccttatataaaaacaatgtttcagcaaataacgaaagaatgtttcagttcactgcaatatttgatccatacatagtaaaacattataagaacgctaggtgaaacatttttcagtggaacaaaaaataaaacgaattcccttaatatgggtttctaaaatatgtgggttttttgttgcaatggaatatttcagttcactgcaacgttagatctatacatagtgaaacattatgagtacactaggtaaaacattgttggtggaaaaaaaaaccaaattcccttaactaaaggtttctaaaatatacgagtgatttgttgcaatggagttgtgtgtgtggataagtggcaggtggacagggaacatgtggtgggggccaggtacgcacgtgatgggaggagggggaagctatcgactttttcccctccccgcgcgaccgagaaggagcattctcggcaatcaatccccaatttaatttgtgttgttgaacatttcctcctcgatatcctgtggacctgtactctcgtatcggaaccaaaacaattatggagtgataacacgcacgtgattgaattatttgcagtccgttaatgcgtgtttatccgaagaaaataagacatacagaaattttttaaaaaaagaagaaaatactatattgaaaccaagttaattaattaatcaattaatcggaatagctaaaaatatatcgggaataataattaattaactaatttacagaaacaagcgggacactcacgctctatatataccaagcccacgcgcgcggccgccacgtgccacggtaaaagctgagccgaccgccgccgccgccgccgccgccgccggcatcgacgacgacgacgcaagcttcccacagtggtagtgtactccggccacgtacgccatggccgtccccaggagatcagagatggtggccggcgataaaggcgccgtcgaaagctgcaggaaccaccaccacggagaatgcgccgtcgacctcgcctcgtcctgctgcacgtgtgcgccgcccgccacgacggcggcttcgtcgaggaagaagagaccgcgcgtcgtcgtcgccgatgagacgacgacgacgaacaccgtcgtcgacgacgacgatgaggatgacgacccgtncgccttgctgcggcggcgggcgaggtggaagcaggggctggaggcggtaaagacgcccgtggcgtggcgtctggcggcgaaggacgacgagatcaggcgggcgcgccgggagatggcggagcgcctccggtgcgcgtgggcggtgtcgcgggcgtggcagagcatcgccgtggcgcgggagggggagaaggccgcgttgcagggcgagaacgccgcgctgcgcgtcgagctcgaccatgtgctccgggcgaagccgcggtggcaccacgacgacgacgacgccgagtcctgctgctacggtgacaacttcaccgacgacaccggcggcaaggaggaggacgagggcggcggcgacgcgagcacggcggcgaggtgcttcgggtgcggcgagagagcgtgctgctggcagtggcacctgtgcgccgcgtgcgcggcggtggcggcggcgtgggcgtgcccggcgtgcggctactccaacatggacatggacgacacatgcatggtgtaggaggagaattgaaggagatcgcatcacatatcatatacatagctagcttcaattcttcttcagttgtagtgctagatttggttattcaatttgtgaacacaaatcttgtcattcgtaatagtttggagtattgatggatttattcttaatttgttaatcgcaaccccttggatagtgatacatgtccctcttaattaatactccgtttcatattataaagagtaaatttcagaaaactactactatagtgataaaactatcagtttgctgcaacattagcgatctatttcagtttgctacaacaacagcgtgggaaattattacaaaactgcaacttttacgtgatatgctgctacagttgtaagctacagttttgtgataatttccaacgctattgtcacctacatatactgtagcagcatataacataaaagtttgcagttttgtgataatttcccactctattattccagcaaacgactaaaatagatcgctaatgtggcagcaaactgatagttttgtcactataattgtagttttctaaaatttactctattataaatgtttgggtagtgatatgcttgccacttaattaatacctcctatgtttcatattaatatttcctccgtttcatattataaatgttttggtagtgaaatacttgccacttaattaatacctccattgtttcatattataagttgttttaattattttatagtcaatcttatttaggtttaacgtaagtttataaaaatatttaacaacattgtcgacgggtgatacccgtagaccggatatagagggtattggggtacgttggtataaggatctacgtaatacgacatcaagcaaacaaaagacgaagattatactggttcaggccccttgacaggtaatagtcctaatccagttgatatgggattatatggtggaaaacacaggttacaaaggggacaatggaacttgtagtcgagtcggatccggcgagatcgtagtcgagttggttcgactagatcccgatgacttggctccttgcaggctccggcttcgtaggctgtatgagttgtgttggctctgagagtcgatgccttaggccctccctgaggggtcccttttatatcgcagatctggaggtttacaagtagaactcggagatatcagaccctgtacgatacattaacgactcaatcttgtccgagtaggattcttcccatccatagattctgtgagggatttccttagagtacgcaggaagtatccgtatgcgcgtgggtataccataccgatatgtaacgtatatcgaagggtaaagggtatgcctaacccgtaaccctgacaaacatctgttatcaaatgcttcgtttgtatgaaaaagtttattttatcctcctcaactatgagacatgcgcacgcatttttaaaatacagatgggacgaagaacaaaaatgttcactcgataaaagcaatcaaacataacatatatcgtatttatagttcaatcatataactgcctcaatcattgattatggcataactaatctgttggacgttcccacctacctaagtgacattaaaaaaataatataaaatataagtggaagccacatataagccccacaaacacgaaaatcaaccagctagcccctctctcttcctcgatggccacctactagaaacaaagtaatactgttttcagtcttgtgttacataacacatgcagttgaccatccaaatatttagtcaagcgacttaattaaatgaaattcacatgctctgtatgcgtacgtacacacaactgatcatccacatcaaccacacatgatcaatcaattaatccatgaatccatggatatactacctccgatctcttggagttaattaattaattaatggacctgattattgagtgagtggagtaaactaattatgctccttagctaaccgtagtttggtcgttattatctttcaattaattgccacatgccgatggacacggtccacacggataatgctacgtatatatatggttaagatatgcgtgaccaggccaatgtttgtccttggaatatactcccgtatgtcgtcgttgactttttttaacaagtttgactattcgttttattcaaattttttgtgtaaatataaaaatatttatgtcatacttaaagaacatttgatgataaatcaagtcacaataaaataaataataatacataaattttctaaataaaacaaatagtcaaacgttggacaaaaagtcaacggcgtcatacattaaaatggaggtagtataatttaattgtactatgacattttaatatagtttaataactatagttgcttcaattcctgatcgaagtgaaaagtcaaaaaggaaacttgacaaagtggactgcaagtctgcaagtgtcaccgcgtaccattagacgtactcactgctacgtgtttcttgacggacccgtaacaaatgaaccattaaacaaactaaaactgtcaattgaaatataaaaacaaattaaggggaaaacgtgtttctatcgacagggagcactcgatctcgtcatttgaccaaaagttagatcggcgcggttaaaaaaatgctaatgaggtcgaattattttaatctaagataaaatttactccctccgtcccataatataagggattttgagtttttcttgcaacgtttgaccactcgtcttattcaaaattttttgaaattattatttattttatttgtgacttactttattatctaccgtactttaagtataacttttcgttttttatatttgcaaaaataattggaataaaatgagtggtcaaacgttacaaacagaaactcaaaatcccttatattgtgggacggagggagtaccaattaacgttaattgataagaaaattaattttgtcctaataatattgtggttcagtttaatttcacatcgtatgaccacagtgataaaatctactagtgtcttaatagagtagagtagtacatatttatctattgcaatatatgcttattggtggacttggaccatcgctctaataatttaaactagtgatagagcttagcctgatcatacaaccacacctcaaacttcaccaccaccggcgtgtgggagtctcttttagcgtgtgaatggcttttgttgagtgttgagctcggtcgtcctgttcttgacttctcgtctacttacttggtagcttagattagttggtggaatgtatgagtatgatagttgtgtggtttttaccccgttttcgctaattaattctgtatttatggcatgatcatgttatctccttaaaatggaacactcgttctttatataaaatgtcagcaacagtctgaccgttcggaaaaaaaaaacaccaccacgtactggtgatatagttagcgctatatttttattatgaaatagtattgcccgtaatcaataaaaacacttgttaattttgtaggctcgaaaatactatttttatgggcttgatgatgacactggctctgcaacaaaagtaacactgcgactagtgttatccatgtcgtcaaaagctagctggtgcaggatgcctcgtgtgatcttctcccataccttgccagtgagcaaagatggcttccctgcagtgttttttgtttttatttttacgcgtgctcgcaaacaaaaagaagattccgtgaaatctatcgcaattttccctcccctttcattcaccgtactaactttatcttctctacagaaatttaaaagaaaagtatttcttttctacatacaaatcaatatttcttcgtcgagcgtgtcaggaaggaaggaatgttccgtgctgcctaaggaaccgctcccacctttcccactgacgcgcggggcccgcatcgccatcgccgcgtggtggcgcaccattcgcgtcaccacaactaacctcctcccctctcccctcgccgcgccgccgccgcctcggctcgatccgcccatatatttcccacgcattcatcgcgtcgtcttcccatctctcccagatcgcaacgaatccaatcgaatccaatccgaattcccccccatctctcctctcctcctccaaaaccctaacccccactccccatcggagagagatcgagaggtggttgtcatggcggagtgctcctcctccgacgactgggtcatgctcgacttcgacaaccccgccgactcctcctccgacgacgactacgtcctcgcgctcttttcctcctgcaacactcccgcctgctccgacgaagaggaggaggacgacgaggtggggagcgacgctgacggggacgacctctacggcggagaactcgaggaggaggactgggcgcgccggccgcggcagaggcggctcctcgggcctcttctaccacacggcttcgacaaccagcccgggtacctcgccttggacgccatccgcagcgccaagcacctcatccccgacccgcg

SEQ ID NO: 1694 - DNA, 21112 bp, Oryza sativa
  unsure (1)..(21112): unsure at all n locations
ttctggcgcacctccatcggcttcgtctactacgacccggagaagggctacccccacgagttcgccgcgccgcccgaggtggaggcccggccgttctgggagatcggcgagatggagggcaacctctgcgtcacctgcatggaccagcgcgtcaccgaggtggcggtgctcaacctcgacatggacgtcctcgccgccgatggggtcgggtcgtggtcgtgggccggccagttcgagggcagcagcctcaggaaccgcgagggcgtcgagctgctccgctcgcagggcatggcggaggtcgtcatgtgggacccctcggaggagcgcgtcgtcgccatggacctcgaaggccgcaccacccgcaacatcggcccgctcacaggcgaggactactcgagaggtttcatcccctacgttgcctcaatcgccgaaatctccaggtacctagctactggctactgcattcgattcgaatttgccgctcctacttgtgaattaattctgtgatgtgttgttaatcttctgcatccgattcgttttgatttgccactcctagctacttgtgaattccgtgatgtgttgttaaacttctgcatccgattctatttagcagcgctactcctgatgtgttagatcgatgcgatcgacgagtcaattggagtttcgtaccaattcgtcaattcgtgtattgctatcgagttggtttggatctgtagcccattcctgattaattggcgattagttaggatttctgtaactgctacgtacgcgtcgtttttagctgagtttttgcagtgccagtacgttttttgagttcgttatagtcagatccagacaatactcgcaggatagcttgtgtatcgaggctgatatcagcctactacattcccaaacgaaacgtgttgttgacgctttaaatcgaattgggatcagttgtctgtaactgctacgcgcgcgtcattggtcagtcgttgtctatgtctagatgatgcttgtggagttgtgatgtactgaaatgtggacatggatgcatgttactgtggagtggagttgagtggagctgatagacaatagataagatctctgtttgaccattccaatggcttagctggtttgattttgtcagtcttcaatagactcccaaagtcggtctccttacccgagtttaattaatcaaccgatgataagatttaatggaatgagacccggcaaaaaagataagatttaatggaatacattgtttatgttacttccatatatgatttgttattaatataagagcacaacacactggaatcatgcattgcaatttagtttagttaatgatccaaattcttactgtattaaattgtccgatgtcttgtttcccatatgtgtatcctgtacatatatatcctggcattaccgcattagactgagaatgagtagagatcgatagctcgtcctgctttgtcatctgcttaggtgtagacattttaccattaattgctgtctgtttcattgattacttgaaaaggtgcacaattttgtgataatagtcatatctatttcgttacattataattaaatttctatacccatttgtatgcaataaatcatgcatgggcaaaatctgtactgtactgaatgacaatggtttgcacttgtgcttttgagttaccagaatttggatagttcaccattgcatagtctgagtaaatattcagagcaacaacttctaatgctgctgcaacagagtaacaagtactctttagctgaacttttctgcatttgtgtgatacatgattagttggtcacggactgtcaagcgcatgcagctttgcattcgttgatgttgatgtgttatccactaacagttgtgtgctctgcttatgtttatgttgtcagcgatcaaataagttcaaagtgctctgctagtgctgctgatgccaacacgcccaatcttggagcagcagatgcgaccacgctcaacaacctcgccgcacctgctgcgcaagttcactgaagcttcaactaatctgtaagtcgtatcgtatctcgtcaattccaattcagacaaataacataacctgattgattgattgataatataatctatctgtgagatatgatgatactctgtttgcattgcaatttatttatcggtggcatgcatggcttggcaggtaccaatagctagcaggcagacaggaagattcgttgacgatgaccaggaataaacgaggctagctttcagattgatttgtccagcataaaaaggaaagcgaaaaggcatccttgattgagtggcaactggactactactgccataagcattctttttgcagctactccgtatcggatatgaacactaagtatctttcttgttaggttttgcgtctgccttgtaaatattagcagtagcaggctcccttttgtgtccgtccgtcgaactatcattgagtccttcttgagttgcattcagtcagtcagtcagtcagtcaggtccaaactagttgatcgagtgggtaaactttgaaactaccaccgtctctggtgttcctgatatgtcattctggctgggctatgcaattatttcttttgcttaacccattcattcatttttagtatttcctttttgttattccggttgtttctttgctgtttggaatcaaccacccagcaatttttgctttcctgggttatgacttcttttcactaggaataggaattaccattttgttgtacagcgctttgttccatcttccatggactgttgtttgctttgttccatgtactgattgctgctatacaggagaatgagcttcatatgcaccctgtaattgactggtgcaaagcttgttgacgctgcaaccccaataattgtttgagatgtgtagatggacaatgctaatatatgtactatgcttggtgcttttgatttggttttaccaatcctaggatgtattgcggacattgcctcctcctgttgttgttgttagttcttagttatataatgtgaagcgagtaaaagtcagtcagtcaatttcaggaaactgaaatcaggagatttagtgaagaaggcctgattctacaaagcactgttgaaatctacaaagctgctttgctcaaatgcaaagcagatttgattgatttgagatattgaggtctacggagtagtggcttgcacttgcagcggaataagctgcctacattctggaatctggagattcagatacctcaggtacatctccaccgcgcagaccacaacgtaccacatgacacagtgccatatcaatcgtgacaacggaaagcccttgcaactatctaaaatatgttgttcgatgatagtttcatcaaaatttacatctatgaaagttattctagcaaattaacatggaattttttttttttgccacagtcaacaatagacataatatcaagcacaataactaaagcttgcgcataagaggctacaacttgaaaagatgatctaaggtacgtttatacctaggtagtgtttagcaaatgggaaagggaaatgatttcccagccatctttaaatcctaacaattcattcttcctcttccatttaatcctaacccttcattcatttcccaatcccaatcccacccccatttcccattatccaaacacacccctacagtatggagaggttgcaataaggttgcggcaatggagacgacgtcttttgtgtgggctcctaaatgagtaggtgccatcagaggtggagcattgccgatgtcacgaggagatgacgacgatggtagtggaccacgagacgatgcagacgataagagaaggctaaatattagtactactataaggaagatgactaataagagggaaggaaagaactaggaagggattacgtcaacgattcaacgcctctacacggtctttttctctttcctctcttttttttaaggcaatgtgcaacttgctagggaatcaaggaatccaagcgcttgcaatggttagagttggctatgagctctataaaagagtaagaaaatatgtcctaccacttcctcaccggaggtgtgttgggaaggaatactatttaatacaagaaaaaccaattcttcgcaactaaaaaatatcccaaatcctccatggtaaggtgtgaactaaaaggagaaaagtgctcctacgtcctctacgttacacacgacatgcagccttacaaggaagagtaatgcactgttcatagaaaaaaaaacaaagcaaagaagcaaaaacttgcactgttgatagaaaaaaacagggagagaaatggacagtaaaaagagcaaagaagagaacttgcattgttcatagtaaaatattcatagcaaaaatatggcaggaagaagagagaaaacttgcagtcttgcactgttgatagaaagaaaaaaaagaaaggaaaggacagtaaaaaaagcacagaagaaaaaacttgcagtgttcatacaaaaacagggcagagaaggaaaatgttcattgcaaaacagggttaaaaaggaaaggaaaatgttcatgcaaaacagggcaaataaaaaaaattactacgcgccaggtaggggtcgaacctacggccttctgcttaggaaacagacgctctatccactgagctacaggcgctgttgtttacttgagagcaaacaattattgtgacaaatactcttttctccaaaagaatcaaaagttatgtaccgagctaaatctcctcgcatattgtatcggttgcttttgcaatggaaaatgtcgtctaaattcgtttttcagatatatggcggcagaaagaaatggcactgtggagattggtcacagatagcactgtgttcttttctatggaaaatgtcgtagacattcattttccagagatatagcggcacaaagaaatggcactgtagagattgatcacaaatattagtatgttattttcagctctttttagctacctcaccatacggatatgcatagaccacttgttccaagatatttgataattgttaaaaaaatatttaatttatcctacaatcaagtagataatccgatgaataatatatttcagacaggctgcaaatagaagagaacaaatgcaaaatatcttcatactgggaaatagggtcaggtggcaaagaatgttcccctctctaaactagaaagtcggccaattaattcagaaaatgtgcctctcctcaagaaatgtttgtccatttccttaatatgtgagctcacatggcacaggtgtttatacctgatgtctgatgaggtgcttttcattctgatggaattcggttgcttttgcagtgcagtgcttgaacgagacccagcctggtgtcaatcaccgtttccatgtttcctcgggtcaccatctattttgtcctgagatcttccaaaacaacggaggcagcgttacggcccggagcgcccattaccccacctcctgggtgtgcaccactgccacagaggtacaatcccttcactggagttctgtaatctgacctgaagaagtggtgacgacatgttcacggtcatgacagatgaaccttgacaggcctaagattcgccgagtagaagggtgaaggaatatgcatgttagaggtatagacataccatcccttggcaggcctcatgaggaaaagtgaatccaagcccattgcgccatgaaagatgttaccacctgtgaaaatgtgaatcaaatgctcgtttaacaaggttttcggatgaaaacagcaacggtcagcactccgcaagaagggaggtacactatgtataccacgcaaacagattacctgttaggccaaactccctttcaagatcaggtggagtcagcatatcatagcctaccactgatgagctaaaacccggtgcatattcatcaatcaaggaaaagcatctttcagcaaaggatttctgaaaattggtttcaattaaaatgtcaggggtgcctctctgtggatagtaactggtgacaaacaataatgcataagggcatcatcatcatccactctgttcgattaaggagaaaggcatatgtgggaaaacatacacagcaaaatctgtgcagccatgaaagcataaattaaacgaagtgcatcatgacatcaaacttcaagaaggaactacttactctaacattagaatcctgccagctgccttctgaaagtttgtatggtgtgtactgaacaaaaaggttaataacatgctggcctatcaaaggataaagcaaaggatgaacattgattcagattatataaagcataagaagaaggtgaggtttcacagccacatatccaaattaaacttggattttttggggggtgaggaaaattaatcttggatatatgaactgtagggcacaattatagcttatacaaatcagacaccacacttttatgcaactgcaatgctgggaacaagaaattggcatacctggtggggagatggtcttatccaacacagaaggaatcgtcatttctataacaggtcttgtggatgagacgccatttgcagcttccctgtacgctagatcgatttcctccatgctggagttccagtaaagttcaatatgaaaagataaggataaagttcaataacatgaaaatataaggatttgcatagagaatccaacaaaacgctacatcatccagtagtttccaatcaccaaaataatgagaaactagcagtaggctgcatgatcccagtcaaatgtatttgacgttgggagaactgagattagtttttccaatgtcaaatgtttttgactagatgtagtagtatattaccgttaacatgttcagattacactcagtactgtcctaaggtactaatggagacatgatatttctatatacacgtgcaggtcatcgatttggtacatagaattgagacaccaagtgtatagtatttccaaagtagaagaatatgttaacggaaagatgacatcatggaattaagagattatttcacttgcctactcattactcatgttggcaaccaatctatactacacaggaacgggaggcaatataaaagctggtgtctcaaagattttcaattgtgtacagctacaacagaacaaagattaacacaactgaatgcaataacatgccgcagatcatcatagttgaagtagaaaaggttccataacttcagtaacctacctttcagatccaatgtgtatggtgcccatgtgttctggaccgccttcaggattaaagtctttgcaacaggaaaactgtggcagcctgtcaacagccacattaattttcgttgttgcctgctctccacagaatcatattacattgttatcaatcaatattataacacttatttattatgttatgcttcaaagtacgttcttacagagctataatctgcagttttgatagcagagaggaagttgtctggaagaacattggcaggcactaggtcctgaaaaggaaaccagatatcagtgtacaaatatttgtttcattgtgtctacaaaattggaacaggtattatatcttcacgttgttatatattctgagtagctcttaccacaaatgttctatatggagttgcatttgataaaacaactgatgtcagcacctctgttccatcagccaaaactacctacaagttcccataatttcaagaggttcaaagaaatgaaataggagtaccatttatcggttagtcaaagaacttaccccctgtaccttcccagaagtgtgatgaacagatatctgggaaacctatataaaaccactagagtgaggcatgttgcttaaacagaaatctgggtgcaggataataattcaccactaaataaaatttgaccttttcttgtagaaaaagccagcattttacagctgtcaataaatagttactcattttttctattcaaatttgaatgctgctccaccatacgtaatcaaagaggtaatatcatggcataagaagagaaaatgcacctctgcatttgttaaaatttccacacctgcttcaagagctgctttgcttatagctgacgatactgaacccataccaccttcaacatacctgaagcgaatgtttttgttttaccacataagtttttcaacaagcaaaataagaagaatcaggaaaccaactactaatgaaccaacaatgctaaaactagcatatttggctagaaaccatatgaccattatatggcatttgccctgtttgactagacagtggagatatgcgccagcaaaacaattcctgatgctagggccacaaaggcttggacatggtttcaggcctagaacaatgaaggacctattatttttctgcgggaacagaataacagagagaagctcaggttaagagtcatacgcccatactccacgttggccaccagtttcccccataacatgatgcagaagaacataaccagatcctggagtgtggacaccagcctgtagaaagtccatgcagcatcaaatgctaaaccattaccattggccacaacacatttcttggttcatccaaagcacccttaccatagaacctatcacagcatcagtcgcaagagttgccttcaacacatcaccctgcagttaaaaaaaaacacaattgtccatggttacaagaaaaacatgtgaatattgtcaattcaatagtgaaactccacgttgcttcatatgaacaatgtgataagaagtatttcagagaacgggtaaacaagatatcaacctcaaaccagttgttcaagatcttggatgctggtgaaaggagaaggtcaaagaaatccctgtgaataacatatttccaaggaaacagaaaaggaagattaaagttacacatagcactgtcgagtcatggtgttgatggtggcatttgcaaagggtcagtatttatactcacaccatgtccttctgcccctgctgcatcacaatcccaagaagtttgctccagaacacagacttgtcaaccttatccttcatcctgtccaccatggagaggtggtattcatgcctcatctcagggggaggcgagtctatgacaaagtccatgagtttgcagaacttctccagcttctcctcgtacctacatttacatgtacactacccaactaagatcatcataagataaaaaaaaacatgcacggtcatttagtcacatgaccgattctacctaaatttcacaatgaaaacagagttcatataatcaagcactactccaagattttataactgaaaacaagagtcaaaatatcagtgagtctatcacctcgggtatgcaccggcatcattctcggagaacttgctgatctccgagtggttcagctcagcgtcggggccgagaaggagatacctgccgtctaggcatggcgtgaatgacgacgggctccgcggcaagagcttcagcccatgcctctccagctccagctccctatcaagaaaagaacccacatcaaagctagcagcatcagaattcagttagtacagtgcaatattataacccgcatttgcagaatgattacagaaatgcatatgaacacagagctgtgggaattccgattgacaaatagtatttgggtgggtagggggggttttactggatcaggcggggcggaggaggctgagaaggtagcttgcagcgggagaaagcgaaagcccgggacgaagtcggactcggagacggcggcgccgccgatgacgccacggcgctcgagcacggcgacggaacggccggcgcggcagaggtagncgncggcggcgagcccgttgtggccgccgccgatcaccaccgcgtcccaccgcttccccttggggaggagctgctgctgcggagtcgacgacggggcctccgtcgagaagcggcggcgttgacggcgggcggccgatagcaggaggctcctcgccgccggcgacattgggtttaggggttcagccgccgccgccgcctgcagccggtggcgaatatttctctttctctccgacggcttgtttcgattacgtctacgctactagggaggcggatttctggattacgtgtctccagtctctgcctctattggctcatagtttgaaaaaggttattccgaccatatcgtttttggctatttatattttttgttttttaatttctttatgtattgtattaatattgacattgaatagtttaaatgataaatatagtcaattaccgaccgatcgagtatcgtttttaaagagatgctactaattccgaccgttttcactcaagtgatgtgctttggtagcaagtacaaggtattatttgtaaaagaggggggggggggtttctcgtcgtttgccctatgacttataaaccgataccaaaatatgcactaaaacataattttgatgttttttcaacgtagttttcttagtttggatttaagtcgctaaaatacatgtgcaaaagttttacctataaatcatttttagtcgctaatcagtcgtaagtaaccaatcgatgtggattgtgatgcgctggttaaagttgatcattcatttgctattgataaagttatggtacacacgacatgattatattcaaagttaattggtgtgattttgcatcaatgggatattcaaacttattacggaaaaattcagccattcttgacctttttgtatttatttatttgtttgtttgttttccaaggctgggaggaaaagaaattgcattgtacaggcatgctatgttgaagaactccaaggacataatgtgcaatcaaacgaggtgaatgagtgtgaaactgtgaatagctttagcttaggattccagtggttgaaaccagggttcaccgtaccgccggtaaccgcgcggttaccgcggttaccgggcttaccacgggggtacggtaatgtaaataccgcggtaacctcattaaattcaaataaatttaaaaaataatttgaatttttgatgaattttgtacggtttttcacggttaccgcggttaccgcgcggtaaccgtgcttaccgttggggcacagtaaccccggccccgacggtttgggaaaccctggttgaaaccaatccacagaattttagtaagacttagcacgggtactcatatttaaaagcaaataaattatacttttaaaaacaaaaacttgacgataatattgtaaacaggtgccgccactgtcatctactactctatcttctagtaatatttaacgttgattagtaagaaagaaaattaaaaacgaaggagcatttttcttttaagaagcaaactaaaccaaaaaaaaacttagagaagtaaccaaccacagcacaatacactcacataaacagccttggtcaagtaaaaatggtcgcttattactgttggtcatttagcagtttttacactaaataaaaaaccatattgccattcttcagaaaaggtcccatggtctagcggttaggacattagaccctgaatctagtaacccgagttcaaatctcggtgggaccttcttttttcccctttttattttttattttttatttttttcccattaaaccttaatgaccttttttactgcaatcattaaccgaggctgttttaatcaacgggcaagattttccaggatctgatcagacgtgacagcaagactttgactgtgcgagtcaacttttgatctgatcggtcggttcaggcagccgcgtcgcgtcggctttgccttcgcgttcgggtcggaccggaggccgacccgtgggtacaaccgtcatttcgcccgtaagatatttttaggacactgtcaggacacgccgacgtcagctgggccccacgtgccgacctatgcacattttttgctccgtgtcccaatatcacccaaatcctggtgctcaatcatcatattgccgaaagcaacctctcctagtgtactatatatatatatatatatatatatatatatatatatatatatatatatatatatatattctcttgtaataaatctatcatttagttattatgcttttaatataaaagttgtttggaaaagaatcttgcaataatgtcactactctagtcatgagttatagaatatatatggatggatatgaatatatattcttctacaaattttagatatgattttgtggatctggtgcgtgcaatgatagatggtgatacaaaattccactttgtttaatctaaaaggaggttccactttattttctataaaagcccctaacaaagaaaacaacaatgattatcttgactgaaatgatatggattaccatgtttaaagtggatcctttttctatacaaagtattattgatatctaaacaagaacatatatacttaaaaactcaaaagctaggctatccacaaatatttttatgagtagagtctatccacatatttttttcgctaaaaggaaatggaaaatgccataacagattttaagaaaactagcaataaaatgtgaatttttcccattaaatagtaaatacaacataaattccatcgctagccaaaacgatacaataagatttgctcatttacttggaaaaaatcctctccaccaaagtgaaaggtgaataaaacctttcaagtatgtggttgtggttagcattgctaaagaaagaaacacatagtcatcaaaattgatcccccatccacataaaaagtgcacaagaaagggatgctcatgagctaaagtgaaaatacacacgagtgcgtgctttacaaagaatatgaacattgcgtgcaagaaacgttacaaatgaaatggtgagacaaaatgtgctccgtgcatacgtggtggtgactcacattcgtatgaatacggacaaacaaattcatgcttcgtgtatatatactagttgcaaacgtatcggcatgtaagtaaattaagtgtacgtgcttagcctaacttagtaagttaaccacactaaaaaaaaatgtatacgctataagcgtgcgtgacacattgctacgcacgcaaaaccaaaagaaaaggaaaaaaaacactactccacgtcatgtagcaaaagggcggaattctttccattatctttagaaaaggaaaatatcatgtacagtatactactagtggtgtagatacttggcgtgagcgtagcaaaaacacaaagacaacttgaccccccgtatattccaaaggcacccacctcatatccttatcctgcgcccctcaccccccaccgtcggatgcgatctggacggccacggattcccctgagccggctataaatcccacctgaggtgcagccttcttccccgtggtctctcagaggtgggttggcttctcctccccctcccggttcggttcggttcgggtccggttcgatttcgtttttttttcttcttcgtggggttggtgggaaagcatggcggcgccggatgttgagtaccgctgcttcgtcggcggcctcgcctgggccaccgacgaccgctccctcgaagccggcttctccaccttcggcgagatcctcgagtccaaggtccgatggattgattccctcttctctgtgtttttttggatgtgatttggtggtggtgttcttcagatctggttgcgtagatctgactatgggggttgtggtatgcggtgcagatcatcaacgatcgggagacggggaggtcgcgcgggttcgggttcgtgacgttctcgagcgagcaggccatgcgcgacgccatcgaggggatgaacggcaaggagctcgacggccgcaacatcaccgtcaacgaggcccagtcgcgccgctccggaggcggaggcggaggcggctacggccagcgcggcggaggcggaggctacggtggcggcggcggctacggtggtggcggcggcggtggctacggccagcgccgtgaaggcggctacggcggtggcggcggctacggtggcggccgtggcggcggcgccggctacgccggtggctacggcagccgcggcggcggcaactccgacgggaactggaggaactgagcggtggggccctcatggccaagttatctatctatctaatcgagctaccatcatcatcatccgatcgttatcatcgttagttttgtgtggaactactatctagtttgtgttactgtgtggttgcccatctgtgtttttgatcgcaagaagaaagctcgtctcgtgtttgctttgatcaaatgaaatgaatgaatgaatcttagtgtgctccgctctcgtcaaatccatcgaattatttaatttgtcatggttgtgaatcatgggggttgatactatttgttgttgatgctagtgcaaatgatcatcatcatcacgatttgatgatttgctaagcataagcagcatcattagctaccactcacactgactgtgatgaagctgtgaactcacactgatgctactactgaagcgtttgtctgatttccttacgattggatttgttgctaaacagcatcgttagctagcagcggtgacagtgatgagcagtgatgctgctggactagagatctgctgatctgtgtacaaatagattggagcaaagcttttgcaatacagatttttcttcagtcgatgagaatgccggcagcgatcgatggcctccagcttgagcacttgcaaacaaaaaccacagctccatctatccagtttccccatatttaacaacacttgaaacagtctttgcaattgctaatcttagaagccatgattgccacaaactatgttttctttgctctaattttagcagagttacagctgaccaggtgacgcttgttgtgcccggtcataatacaattcagagaacatgaccatgagatgtctctgcgacagaagctcggcctagcagtgtgaatgtgtgatggtaagatttgtactgtgttctactcctatgttaatcccggggatgtatcggtacaacgtgtatgtccaaatacaccgccttggcgatttctgccggcttcaatgcaccttgattgtcttgcttattcgccaaaacgaaaaacgatgcgccggccaatctctgacatcaaagctccaaggattactaactttcagaagaaagattcagcaaggggaaaacatgctctgagaattaaaactttgcagtcttcacagtttcctggtgcagaataaacacaaaccatttggaaactgggtgccattaacaattagagttagtggctaaaatcacttgcaactcttctttcaacagactctggagctcagcattcggatatcagaactatcaatcacccaaaccaggcagttagcctgctcaaatacgatcggattgtcttctgtccacccacatcccatatgttcaaagagaacctgccacaatcaccatatgtaaatctgaatttggtgacctgaacatgtcacaatatataaccctgtaacaatcctagatttctagtttcttttctgtgtttgccactcaaaagcattaaaggcaaggtgcactctcatgcttctgaagcaatcatcaaattttgaaagtaggtactgatcagtgtcatgtcttaacataataatagcatgttaactgaataataactagagaacttcgcgaccaccttatgctgtccacccaaaaaaaaaaattgaaagcagtcaagcctactaaagtactatctattttttttcgaaaggtgctaattctacctattatattgccagaccatgtgaggtgaatttcctacaaaaaatgttgatctatgtgaatcactaggcactccatggcataatctcacattggaaaatgtttgttaaaattgatcttatggaactaaataagctagggtgctatgaagataacatattctagagcatgtttgagcatattctggagcatacttcaataccttatacttgtagaggttaagagaagacacttgatatcatcaagcagataaaaaatcaatatagatcagtaaactcacactctattgactaaaatgatgaatccacttccaccattccacatgcttcagtcttatgttacatgcacttaaattgatacgaaaattttcagaacactacagccagtatgctctcggagacttccttttttagataatggtatgatcccggagatactatagcatttaaatgataaatcatatcatcatcctggaatttccttgtgatgccatatttataacttgataattgacagaaggagaggttgcaatgcaatgcatacttgtggtacttgatggtcttgatcctgaagccaaagtgtagggctaatgacgctggtgtcatcaccattttttcttagcacaattgttgtcttaccctagttgtggaggccactgtaaaattcttcacatcagtgatgtctccaagaaaatgaaaggaacaacaagagcaaccaaaccaatggtacaaagtacatataaaccctggtaaatcaagaaacatactacaacccaggaatcaagaaaagcatcagcattggaagctggaagaggaggggaggatcagcttacaccatgagaatcctcatcaccttcttctcctttcgcttgatctttctgattatgctgaggagacccattctagagccggcacattcacacagcagaaatgactctgagccacactctagctggacaaacaaggattagaattcctcctatctgtaaaccaaatcttgcgcgctgcaatcagtagtatctgaactaggaatcctgacaagcgagagatgacagaatcggtgcaggaaacaaagaaacggaggcgaagagggagagggcactgaacctatcggagggaaaggggtcggatcgccggcggcggcggcggcggcggggggagacatgagagatggaggaggaggaaggcgatggatacatgggctgatgttagaggcccggacggttcattgggccgtcgaatttagtgggcttaatgggctttgcctgtgcctttaaggctgttttattttgaacaattttccaacttctattctctggttttgacacgtacataactgctaaacggtgtattttttttaaaaaaaatctctataaaaagttattttaaaaaattatgttaacttttttaaaaaaattatatctaatacttaactaatctcgtgctaattcgtcgttccgttttgtatactgagaaggaagtgttcccaacaccaatgaacgaacagaaccttattacttgcatggtaaaattgacttaattattagtcagagcattttaggagcaagaatatatttagtttttcatataatctttgttggtaaatcattggtaacatctaaatactgatattccgattgattctcttcatcgcatttctttatttttatctatggacatacacatacttactggaaaaatgtaagtttatatataaaaaagcctattagcttgacatacaagcgtgtagacatatccatgtactatgggtcttcaaacgtatacaacgattgtaattaagcttgctcaggcttcgtaaaattattgtctctgccactgattcaaatacatgcatatattaataataaggctagggaaaaaaaaaggactgatagatattggggaaagttcttcgcgttctacactacgaggcagttcaaggcgtcgactatcacatcttttggtctccctcatccagaccatgcttctgcatgctgcacaaccatgtgtcagttatttatttttaaaaggaaaaagtcaagtaccccctaaattttagatagaaatccgtgtggagataatggataccccatacccacatggcatgtatatccgactagatatgggggtaccatatatggatacaatatctttagtaaagaactcggttgttttcctaacttgtgtatgaaatatccgaggattctagtcggttacgattgcaatttttatttacttgcatattctgttaggaacatgtgttgtatcttgtaatacggactcctccccctatataaggaggggttcgggtgcctcttggggcataacctttctctcatatcatacgatcaataatacactcggtggatcaatccccgaacagaagtagggtattacttctcattgagagggcctgaacctgtataaaccttttgtctcctaacccatccacttttcctgcttgatagccaccccctttaagtattgccgaaatattgtttcgacagtccatctagcaccctaaattttaaaaccggacgtccaaccccttaaactttgcaaaaccgttcatgttaacccctaagatggttttggatggtggctttgtatattttaaaatcttaaatgaacaactttaaataactaatataacatatttgaatatcatcagttgtaagtcattaatttatacttatacagtgatatcatacgattattatgttggtacttgtttgtaagtaagagctaacaactggtaaaatgaaagatttaagtggagattataataatatatcccctctgtcccaaaaaaaaaaagaccaatcctacctacgaacctagacacatatgtgtgtccaggtttgtagctaggaattcgtttttttttacagagtagtatatgtccaatgtgcatggcacatgatcaaactcatccaatttatacaaattagataaaaaaatcactatacaaaaccatcttatgaggtaatatgaacggttttgtaaagtttagggggttgaatgtccggttttcaagtttagagtgctagatggacttctatctaaagtttaggggaggggggggggtggtatttggactcctttttaaaatgaaagatgttgaggcatagtttgagagcatttatagatcgagataagtttaattggtgaccttttgtcatagtgttcacatccaaatatgcttaaatcattttctcacagttgataaccatttttgtaatcttttcttcgcttcacatatattttagatctatgataccgctttattagtaattttcataacctcatatttcacttaaatatcattctataaaatcccgcaacattgcacgaggtatcatgtaaataattagcaactcatgactagtcgatggatcggttgggggcgttggttgtggcgtaagcttccgatttatcgcgctagctagctacggggatagtggcttcaaaaagaagtgcatgtgaaggaaatggaaagaaaccgccctatcaatacagtgtatatgtatcacagacccagggttcgacttaccgtcggtaaccgcgcggttaccggccttaccgcggggtacggtaatataaataccgcggtaacctccttaaattcaaataaatttaaaaaataatttgaatttttgataaattttgcacggtttcgtacggtttttcgcggtaaccgtgcttaccgccggggcacggtaaccccacccccgcggtttaggaaaccctgcacagaccaaccaacaaatgctacaactccctctgtctcattttaagtgcagttgtggatttccgtgtccaacgtttgatcgcccgtcttatttgaaaaatttatgaaaaaaattaaaaaaataagttacgcgtcaaatactattaatgttttattatctaataataataaaagtaatgataaaaaaattcaaataagacggacggtcaaatgttggacatggaaatctataactacacttaaattgggagggacggagggagtacaactctatgtgagagtgagatcagaaatatattagtgaaagcaacaataacacatccatgtcaccccttctgaggcatcaaaaggaaaggggaccagttgatgtgtttgaatgtaagcttttgtgaaagagatcattgtgcagcgatacgacaactaatctatgaagaatagtattgacagagaaacaaaatgtacgcattaatcgccttaattttcactcccactattcaggaaatctgaaagatgctttcaggatcaccatttatctgttgttctagtactacaaagtacaaaaccctcagtaacataggcattcagcatgccatttcgatactttttttttccttaagatataatgcaagcttttaatcaagctgatacaaccacacatactgttgttatgtacaacaaattcagcctatgtagaacaacaggtataagaaaaaaaaatcaactaaaagagttaatttagttgtacaaaaagtgtagcagaaaatattagttatacagaaatcaaatattatgtgctcgaatcctaccagtagagagattcttattgttgcctgagtatttactctctttgagacaattttgtaataaatggttatagcttctttgaagcaaagaccgaaatttttattccattatagaaaaaaaaaaaaaaccagcggacatatgagattaagatggatccgcatccgggtggtcctgactcctgaccctgaaagacaaccgctgggacagtgtctgcatcctactccaggatcaagagttgtatacactaattgtacactaatccaaattaggacaatgtgagcatgcagtgggcacacctaactacacatggcattgacttgagttgaagtacttcaaatatttttagtaataaaaagactactcacaacaaaataaatgaaaattacatattttttaaataagatgaatggtcaaacgtgtaaaaaaaaaatcaacggtgtcatctaataaaaaacggaggtagtatgttctaatgttcacaaaatcacagttaaggtaaaaaatatatctagatagaatgtatgaaaagcaagcacatcggtagatttgctttttcataatttttgtttttctcataatatttagataggatatatgaacagcaagcacataggtatatttgagtcgaaataacttttagattatgggtttgacgggcctttattattattattattattattattattattattattattattattattattattattattattattattattattattattattattattattatatgaagggaaaattttcttatttttttaatcaatttataattttataattcccacttatttacccgcaaactctactataataattgactaaagctttgttgaaataaaaaacaaaatttatttatcgaaaaagataatgattggatggatggagatacatgcgtggtcctgcgcagccagcactgtacgtacctactccctccgtttcgaaatg

SEQ ID NO: 1695 - DNA, 7039 bp, Oryza sativa
ggcacggcagcacggtggtggatggcagcacggcaccggcgacggttgtgcccgcgttcgctccccgggcccctccggacctcttcgtcgacttcctctctgcaccgatgcagccatcgtcgttgaccatctccgcgggggaccagccgccgtcgacctcatctgcgcgggagagctcgggagccgccgccgacgttgctgtcctcgtcgtggtcgtcgacgagccgcaccgcctcgcccagatctggcgaggagggctgctcgtcgttgctgccgatggaggaggcgtcgagcctcgaactccgccgccgttggccccaagctttgtcactggtgctgccgacgcccatcccctctctccacatgaccatcctcggcagcagttgcgccccctccgcgacctccccgggagcgtcctcgtcggcggcggcggcggcctcgctcgcgaccgtcctcgccggtagcggctatgcccgcgtccgcctccacggctgtcctcggcagcagctatgccccctccccgacctccccgcgagcgtcctcgccggcggcggctacgcccacgcccgcctccgtgaccttcctcggcggctgccatgcccctccgcgaccgtgctcgtcggtggcggcaaagatcgatggttatatgttgattggtttagttagctagctagctagcctcgcgcgctgcatctgtagcagctagctagctactacctgagcttgttgggtgtttctgcctgagctccgttccgccgaaccccgtcagacccggccgcgaccgcgccgggctgtcctccgcccgtgccagccgtcgcgccagctccccatcctcttctccgttttgtcgcgtgaagccgatgcgtttttgtcgcgtgcgcctcatcggcttcgactccggtggtcgagctgctcacacgcgtctgggggcagcacacgtgagagagagagaggaggatgacggcgtgagagagaggacggaaattgtgatggagtggcatggttctcattttaaaaatttgcagtggcatccagcgtataacgcgaatatgtgtggcattgttttgatttgccacatttgcagtggcatggatccaattaaccaaaaaaaacttgcacgaaagttaaagctaatcagcggctgtgattagaagcgagattagcacttaattatcattagcgaggggtaatttcgtccaaagattttcgagcccatatccagcccagtccatctgaagcgatccccacccccaccggtttaccacggcgccgctcttaaaccgcaccgcttccattccttcttcccttcgcctggccgccgttgttccgttaaacgccgccttgccgccccggcgctccgttctttttttcccctagcccttaaagcgcgcactgcagccgcgggtcgaaccggcccagccgcgcctccagctccgcgagcggtcgatccacgcctccagctccgtcgtcgccgcgggcatcctccgcgccgtcgtcgccggggccgtcctccgcgccgtcgtcgccgcggcctcctccgcgccgtcgtctccggggaccgcctccgcgccgtcgtcgccggggccgtcctccgcgccgtcgtcgccggggaccgcctccgcgccgtcgtcgccggggccgtcctccgcgccgttgtaatcgcggcctcttccgagccgtcgtctcgggggaccgcatccgcgccgtcgtcgccggggccgtcctatgcgccgtcgtcgccgcggcctcctccgcacggtggtctccggggaccgcctccacgccgtcgtcgccggggaccgcccccacgccgtcgtcgccgtggaccgcaagccgtcgtcgccggggccctcctccgcaccatcgtcgccggggaccgcctccacgccgtcgtcgccgcggtcctccgtgctgtcgtcgctcgatttgggaggacattacaggatgtatgtcatttaaaggcattttgtggagggcatttttttaaaactgcctcaaatcatctctttcaaaggcaattttcataaaatgccacaaaaagtatttctatacatggcaaatttaattaatgccttcaatacttttatcattagaaggcgttttaaagaaaaacgcctcaaaaactctgtgctttcaaggcaatttcattagcgccttagaaaatctcctatttcagacgtaatcacggaacgccataaattttatattatttgggggcattttgcaaaatcgccagggtaacagatagaaggcacttttgagagaaatgcctcctaatctataccatatatgcaaaaagaatcctgaaagaatttaaggtataaaaattagtccttccaccacacgtatgctaccttatcagatccgaatcagaatagatcgatcagatcagatcgaaaaaaaaaaatctcacgcggctagcgagcgcgcgtgatcgactcccggccgccgcccggtgactcgccgccggcgaccgcccggcaccccgcgcgcccgcccatcgcccgtcgcgccatgccgccgtcgacggtcgaacgtcgcccattgcggcgtcgcccatctccgcatcggcgcatcgcgccgtagcgccgcccgttgacctagctcatagggagattcgccgccggtgagcgccctgcgtcccgcccgcctgctgcccatcgcggtgccgccatcgacgctcgaccgtcacccgttgcgccggctcgctgcctccaccctacagcccacggcttcacgcgccccgagcccacgacgccccgcgccagaggttcccagcttccacctacagacgaagccacgcgtgaattggtaactcttcccctcatccactgcctaaatgctaaatccagggatggttaggaacatttttggtttggaacttaggatttagttaatagttgaatttaggctctctcgatctattggtgatatgatttaaggtgtgtgaaatgagaattttagtagacatgttagtctccatctctacccatcacactactgtttgagcacgatgatatcttgaggtttgtgcttttccagttgggttgaatttacctcagtttttcatgcattgaaggtgtttgtagtaatgcctaagcgagtttttatggttcataactggttcggtacatatcattcatacagtgagctatagggaagcaatttcttacactgaaatagtgttccaattcattgtactgaaattgcagtgttcataacaagcttatgttctactacgtatttgcaactagtagtgaacttcagtgttctgcatgtcaaagtgttaggtgcagtaactctagcatccaaaattccaaacgagatgtttgttttatgtttctcagagactgttctgcacagttcaataatcttggtatggaagtaacgcacgagcgtaatactctattttctataaaattagagttagttttgttgtgaagcatagcatgattgaataggaactctattggcagttttatcacaagaaatcttggtggttataaccttataggaacaaaaatatactatggtttgtgatgtgatctgaacttagtgattcattatgtatgcgtgcttagttgcaggggtgccttttgaatagttgggactggatttattagtatattaattagtatatgactcagaaatgttaattaggcaacataactggtagtatattggatctgactggttagctgaatatatagttctttgcattatgagaggctcaacgactaattggatcatgtattttggatgaagccaccatattggatctgctcttttgttttctaaaacagtaacaatataaatccattggaaatgctactagaacctttatgttcactttaatcttgatccaaagattagaatgctagttttctgtgggatattctacacaagtttttcccccataaaatttatgcacagttataatttgggttataattttctgcatatgcctcactagatttctgtggtttgatgatatgtttgaactttgaagagttgagctgctatctgtcggactgtcacaagtgcaaattaacttcgattgattgatcatggataaagggtggatgaaaggagaacaatacatgatctaacatgcaaggataacataggacatgaagatgtacattctaggacaagtactcttggaaaagccagcgctggttccttaagtgctatcaagttcactaatagccaagtgctaacaacttcacggttctagcttatgaaagtaagtctcctatcccaagttcgaatgtcttttctcaagaccatggcaataactctgctgttacatgataagaaatagaactattggtctggatatattgtttcttactagtatttaagtggatttgcattgtaaaatgtagcaactcattttatggacaattataatttctgcagatacctcatttgacttgtattacagttattttcccctagatactttcatggtgcattccccaacaattatactatatatgtttaaatcttacggattcaggatatttttcatggtgcattccctaataattcaaaatattttgggcacctactaatgattatatttacttcagtgctggcctaagaatagtaatcctgagagcaatataggatagtatgttatggttggttagctgaggaacactgagacagtaagtatcatctctttgtgtctctttgtttgtttgcattatgttctgtttaaaagagtatgtagtcatgtagaatgcaatctgactcaaatcgatcaacaatttgttactttgattatgtgcactgtatatattgtgaatctaattcatgtaattctagacttattcaacttgcagcttgagagttaaatgttttgaactgatagaaaattggaacaccattatactgccacatcattatactgcaacatcatcaaaattggaacatcttgatgggacactaaaatctgtagttttgcaataaatgcattgctaaatcttgtattgatggaacattaaaatatgtagtcttaatgtatatttataatacattgctaaatttgtagtttttgcaatactgtgacttgcagctttttgataaatctagtgttataagcttggatttgttgttgtatgaatttttgttttgtcctaatacttgcagtttcatgtaaagtacactaaatcaaatcttttttttttaaaaaaaaaactagttttactggaaactggctttggttatccattattttgtctgttaaccaaacagaccagcaattttccaagaccctgctagacctggtctctacaaaattcataacccaaacaacctaaatctttcctactgatttcatatgtgttgttgctatgcattatatcaaggcaaagcctctttttaggctggttgcctgattgtaatggtttgataatcttgtatactagacgtttctttttctttatacttttgtattctttaacagagcacaaaatataattggaacatcatttactatttttaccaccacccaccttctcaggttgtcatgggagcacaaaatatctaacttttgctgtccatatcatacttcatcattttggttcttttagaaagaactttgctcaagttgtcccgtgtttattacagcatcatatagcataataaagcatatgtatcatcagatgtttgaggtatgagttatgaattatgtatctgcactgggaatcaaatcaatagttgatcatcattaatcttttaacaacattgatcattacgatgattaaagtgcaaaaatatttcatactctgcaggcaattattggatttcatttttggattaaagacatgtacgaagattatcgttatctggcaagtgttctgatgccatcagaaacaattagaagctatcacgtcaagatattcaacaactgcacatggccctttattgatttgtttgtcttttcctctcacttgtagccagtatataacttcagtgtaacagaatgttatttttttagttgtaaactgtgatgtgagaaatagttggaaagatatctaaaaaagatagcaaattgcaaatttttggtgttgaatgagcactaatattggtttgattgtaccaatatatcagtatgtaattggatgattcattggccacaatttaggtttttttattagatgtttttttcattggaggcattataaaaaatgccacaaagcaaagatgaaggcattttgaataatgccacagatacctaaaatggcattctggaaactgccctagtaagctctaacggcattcttgaaaacgccaggctagacactttttaaggcgtttgtaaaaattgccctggattgcttttcccgtcgggagtaaatgtggcatttttcaaactgcctctaaagaccattcaaggcgtttttttgactattcaaggcattccaaatcgcctcctaaagtgtgtcatcctgtagtgggagggggaaggcgtgggacccacgattggataggcgatcctggctggccaaagttggccagcgtgaggccgagtttagccagccaagccatccggctggccagtctgttggagtacatttttggcctaaaattactaaaatttagcttggagagtgagataagtagactgttggagatgctcttagcaggttggctgacaaattagtgacagtggtttcactatagcttggtacgcctttaatggtgcggccacgtgacaatgtcctcgtcagctggcccgtacatacataaattgtgatccactgcatcatcatcgatcgcctctgtatttggaccgacgcaacgtcagactagcgtgataaaacaacactgttatatgaggttagcaccgttgtttttatctcgcgtggcaaagaccgggcttaatttgtcacatactcctattaggttgacatacacggctagaaaaagcatttttcctaacgtaggggtctcatttttgcagacggacataccccttagaaccaaacgaccgcctaaaaaatatatatcgggatgaatgtgccggtcc

SEQ ID NO: 1696 - DNA, 4023 bp, Oryza sativa
cagggttaagcgtgcttggcctggaccaatttgggatgggtgaccgaccgggaaattattctcgggtgcgcacgagtgagcacaaagtgtgcagaaaagacatgtgttggtctgtgagggtagtctatgacctataaaagctatcagatggaagcgggcccggcttgggagaggcaggacgctacatggatctggccggaggagggggggaggctggcggagtccacgacggcgcggggccgcgggggcggcggcggtggcgacgacgacgacggcgatgcccggcgtggcttccctcccctcccctcttgcccggcgcggcgacgccggaggaggacggcggcggcgacccccgcccgtgattttttttttgtttttttgaatgtattttcgcaagcgggttgttgccccgactgcgaaaatggatgattttcgctgtcgttgacctaccctccgcctgcaaaaatcactttttgccgcctggaaagatagtttttctagcagtgatattagtgatattaggttgatatggtaaaacaataccggcgtactcaccgtaggcagtttcgtagtattgtttcgccacgttatagttgatgtagctaaaaggtttatattagagatagtttatttttaaagttaaaatattaagaggtttaaaaaatttgcattcttgcttgccttaatttggactgacaaatgagctagagagatgatatatactatttaatttggctggctaattcgtttgtatttactttaacttcttaaaaaaagaattcgtttgggtttaattcttttatttaatctttagataagggtattttttttacccaatctctacatccaaccggatgtatgtggcctttttaaattgggaactagccactcaaacaatacaatgatctgaagctcgctcttatatagatttgaacacaggaccttagagtgctgctttaatatgtgtataaatacatatatgactactgttctttccaacaattaacagtcaaccccttaattatgtttgacgagtgtgattagcacgaatagctagctagatattggcagctaacaacagaacgttgatgtacatgtcactagacagttaatctccggtggcgttagtttctacacatgcagggttcccatgcacacacatctctcgattaattctccctccgtattttaatgtatgacgctattgactttttaacaaacgttcgactttccgtcttattcaaaaaatttattcaaaaaatttatgtaattatcatttattttattgtgatttgatttatcatgaaatgttctttaagcatgacataagcatttttgtatttgcataaaaattttaaataagacaaatggtcaaacgttggttaaaaaatcaatagcgtcatacattaaaatacggagggagtattatatagtagcatattgtttgcatagtacagtagggagcacgtttctaatttgttaagcacgatcaactcgatcgattagccttttcttttttgacagccgcaatttgtacagctcgatgtgcacgtttacgttacgtacgtgtagcacgtgctgaatttgttggtgccatagctttttctattcaccaacttctgcatccatatgcttgccttttagtcaatttggtgaaaaatattttaggattcgtgcaagcatcaacaaggaaacactgttaatccgtacgctccaacgacttaaaattaagttttaaaatgcaaatctatactttctatataattagtacccactaacaattattataaactaactaaacctcaacatgcaagcatgccacaccatcacacaccagcaattactccctccatattttaattaatgtatgacgctattgactttttgaccaatgtttaaccattcgttttattcaatctttttgtgaaaatatgaaaatatttatataattcttaaataacatttaatgatgaatcaagtcacaataaaataaatgataatttcataaattttttaaataggacgaatggtcaaacatcggatgaaaagtcaacggcgtaatacattaaaatatggaggtagtactattctagcctatttaaaatcccatgcaagcatgccacatcttccctcactagaaattactattctagcatattttaaatcccatgcaagcatgacacattatctacaatattatattatagagatcgataaatatgtgtcaaatcatattcctcacattattttctctacatttcaactttcatcatttcgacaatatttaatatatactcatccatgatttccgtagcaaagcgcggggtatcacctagtattaactataacttgtaccccagccactaatagctcataggatccctttttctcaattttttgagttgtttttgctcctcggagaaaatgtcacatggtggctattttgaaaaaaaatatcctcgtgtttgcatgtaatatccaatgtcctcgaaccgattgacgccccgttgtgttgtatctggaaaaaccccttgtcttttagagaaatacaacgtgaagaagaaaaaattctgcttccacggataacgatgtaaacataaaaaccacaatggatttttcgaaaaacaaccgcatctacccccacccaaaccctatccctcgctgtctctcacctacacccaccacgccccacccgcgctccacgctgatgccggcgtggggttgccttcaccgccgtccatctttccaccattgtcgttgtccattctcctcccgttgctgccttcattgtccgtcttaccccccgataccggccacaacccccctcccgatactgtgtgccctttctccaccattgctgctctccccttaaccctagcagccgctcgacggaggccttagcagagggtggagggagagaagggagggaaggagggctcgatgcatggtggaagggctcagtggtagtcaatcctctcccctctactatgtctcctcctccgatgcaccaacacattgccttgtccaccgccgtccattcctcgtaagttagtaggttgacgaagagaggcgtagatttttatttagattgattatgaattcgtggaaaaaacgatggatctcaacgaaaaaaaaatgatgaggatgatacatgctttatcacacagattattatgcatgttattatgaactcatggttcaatattaattaattaatttcacgtaagactactagagttgataacatatataatatgcatgtcgttatatatggtttaatatttcacgtaagactataataatgcgatgggttagagtcgtgacaaaacaaacgtacgtcatcgttttactaaagatgaggtttgatatcgacctccaccaatcatagagcaggttaacttctccgagatatatatatattattattgcataatgatttttctccattggaaaactatctagcaatataggagcttgctagggcaaggaaagaataaagatccatgcgctagctaggagttgtaagacactccaagattcgtgcacacgtttgtttttcattttcacccacagaatttcaataatcttaagatgttgatagatgtacctgtagggaaaattaatacttcctccgtttcatattattagactttctagcattgctcacattcatatatatatatatatatgtgtgtgtgtgtgtgtggggggggggggggggcggcgcctagattcattaacatctatattaatatgggcaaaggtagaaagtcttaacctgaaagatgtagcatttcccatgcacggagaactgaaggatagcccatttggttatgttatttttggtggatcctgccccacctgggtttaattagtcctaagcttttcaagcgtgctcatatttacatctagttattctttcagtgttaggatatatagttagacgcacgtggtgacgttattaatattaagatacgttggttcagtttttatgaatgtgcttatatataggagcatgatttc

SEQ ID NO: 1697 - DNA, 4644 bp, Oryza sativa
tgaaaaagaaaaagaaaatccaaccagctcaagctgagccgtgaagtgaactgtacatatatagtactgtagacctatagtatggttgctgcgatgctggctctgaggagtacaagctggcctgatgtctgtatatattggtcagtctcagctcgctccctgtggcaatgaattatactcgctccgtcccaaaatataagtattcttaggctgtgtttggcaccctatttttccaacccatctccctcgttttccacgcacacgcttttcaaactgctaacggtatattttttgcaaaaaatttctatacgaaagttgcttaaaaaattagctaatacttaattaatcatgtgctaatggaccgtccgttttccgtgcggtgagaatgagtttccatccttgagatgcgaacacagccttagcatagcgacaagtcaaacatttttaactttgactattaatagaaaaaaaataaaaaagatcaatcatgtaaaattgatgttactagatttatcattaaacaaactatcataatacgcaactctttttatttaaaacatgttacttttatagatattgttggtcaaagtagtatctcgtagaccgtgtcgaagtttaaaaatgcttatattttggaacggagggagcagtggttaatgttagaatatgtgtttggatatattagctagtgatcttattaactacagttaaatttggtgggtgaaattagagttgaactctataacccgataacattttaaataaagagaaaggtgccacagtataaatacggcgatacatagagagagaatggtggcgaggccatggactcttagcagctaggtgtaatgttgattgaaaaagttcctatataatcagagctctgaagatgtatagttcgactgaacttcgttaataaataccgtgtgttcctatatcattatttgttatgtctgagttgatcgatgtctaacttttataacaagtaaaaaagaccataatgcaatttcattatcttaatttcatctggtctcagaaaaatacattacctatgaaagtatgcatgtattaagtttggcgctagatggcgatgtacgtatgcgcacatgtgtcatatatattatcgctggctataccaataaaaattagtataaataaactgcaaaatcaagggacaagatatccctttctagattatttaagtcataatattatatattaatgcttcttcttcttctccttccttttttccctccgatcctcgatctgcataccaaatatatatagtagatctcacttatcggtgaagcctcaggtccatgtcatgttatatttattgagatgacaaggtgatggaaactactcatcagaacaaaataaaattggctagtggttaacgtaaatatatctccttgattttcagcatcttgaatcatttgggcaataataaactatatattaaatgttgttgtatacttccttcatcttaaaaaaaaaagataaatgtgacatatcttaatataacgaatctgaacagattcctttcaaacgtagaaaaataggtggaactctttccaaacaacataacatgcatggaacatcacaaacaatgggatatactcggtagcttcagcgtacaaagcacaatcccttggctcgatcaagagaaactatgaatggtcgatatggaaaccttaggcctcatgcaaatgcaaattctttgcctagctcatgtaaaatagattttgacgtcctacaggctagcggcaaggggatagtcaaacaaaacatattgtccactatatcagcgtgtcctaaaggcatcattccatcttctcgtagagtgaagatacacaataaggatctgaaacatgattgcaacttggatcacacaagaacaactcaaaccggcatcatggaagccaacgatgtttcatgagtggtgggaagttttggtcttgtgcaaaggagtgcccaaacaaggaacgcgaaccctcctactgctaacttattgggaaatatgggaaatatggaaagaaagaaatcaatgaatcttccagcataaagaactctcgatgatgtcgtttattaccaagataaaagaggaagggaagacttaggagcgcgtgggagcaaagagactagaggaaattttaccttaagccctgtatattctcctttaggttttatacctgtaaatacttttactcctctatttgataaattagcatcgtcttgtaccagttcgttgaaaaaattaatttaaaagcagcggttcctattagatgggggcaatactaattgatagatatataaaaagtaggtcaagttttcaacataccaggtaacaatttggaggaaaattgttatattattttttaaaaaaaatcgtgaaatactaaaaagagtcattttttggtcagaagatcatcctaccaggaaccaccaagacacgaacttttttatttttttaattctaaaaataaactatttgaaatttttttattgaaataagatggtgagctggcgtaactaaaaggttttagttaaaattctatactaagtttagaagagtttatttttaaaatttaaaattaaaaaagttcaaaaattttaaaaaaaatcccaggacaccattaaacctgaaatttcagaaatttaactccatagttgtgaacgctagctagctaagatgcttctaccaataattgcatttgatttaattttgcaattttgccatattggagtgacataatactatgtctacctacagtctgaattctagagatctcttgcatatgtgtctcatgcatatgcttttgatcagctccccatgcataatgcacatgatgccagtatgaaccctagaaacggtcactgagcctccacagttaactataacaagctacccgtagctagctagtctaattaattgattaattaaacttatttgtattatataatataagctcaagttgacttggaacgtggatcagcacacaaatacacacacatgtataatctacgtctatatattatatagtactaccgtatatataaatagttgcaatctactcgatcgaataattaaggctagggcgaggacggttaaatcatggctatagtttataaatatatggatagtgtcgtgtcagatcaacagttcactgcaattatagcgactactaggacacctttctctgtggggtgtgtaggtgtaaaagcgaagtacacagtataaccaattctataataattaattgccaggattaggccacacaacaacagagagaaaactattcttctgtttgttcttctcttcagcttttgctggctaactagttttatctcttttgtagaaagagatgtgtagtgtgtgtgatggagagaaataattaacgaggaaaaacatacatatactccatccgccctattttaattgtagttgcggatttctgtgtcgaacgtttggccgtgtgcggtagtagacaaagagagggagaagcataatatgtcgacgctgataaacaaggatccatccatatatgctaaaaaatgagcacactatatatcgtctactacctagtatagatcgatccagatgcaacttatgcttcagctgcaaatgctatcaaggcaataatacatatacacactactactactactacaacataatactactatactagataggaggaggaggagcagcaacagatcaatctgcctccagatttgagcaagaggctttgcttaatttgatctccaagctagcaaagcaaagcaaatctcaaggtgtttaatttcaggtaaatctacatgcatgcatgcatcagcttaatttgcttgcttgtttctcgcttcttgctttcgatgcggcaaaagaaataaaggaaggaaaaggatgagacgacatgtatttgggtcacatcttgttccctccagctggctggcctcctctctcatgtcgattcatccgtgacatccatgtatcctcctcgatctcaaattctcaaatcagattctttgttcgctgtctcgtccatatgattgatgtctttgcctcttttgctttaatcttgatttgttggacctgctgcttattgtctttgttgattgattattaatattattcctcatttctcttctctctctctctctcatcacaaattattatccgatttgatttgttttgcggattgaatacaattttcttgatctgttccagataggattggttatacacagattttgttgatatatattttgattggataaatttggttgttgatgcagtggagagagagacgacatggatgactcgagcttcttcatgcagtgggcgatggacacgctgcaccagctcccctccgactccaccgccgccgcagcctacgccactgacgtcgccggcgacagcggcgccttcccgtcgctgcaagctctccgcaacgcctcggcggccggcggcggcggcggattccgggacctgacagtgcaggtggaccaggtccaccgcgccaacagctggagctccagcgacagcccaggcggcggcgctgccacggccgccggcgggtggtccccgcatgtcaccggcggcggcggcagggggcacaggccgatgagctggaacttcagcgc

SEQ ID NO: 1698 - DNA, 24619 bp, Oryza sativa
  unsure (1)..(24619): unsure at all n locations
agtttcaatccatggatgcattcttcttctaattctcctctaatttcatgcatgattaggctaacaacaagatagctagtagattgcatgttattattactagctagctgcacagtctagtactgatctactgttcagtgagcaaatcatctaattaacttgaacaaaaattaaccccaagagatttgtgggcaaattgaaagacaaacccgaaagaaaccaaatgaagtacagaaatcacacgtttgcaatctgcagatcgaaatcacaatgttgttgaccgtgtcagtcggtcgtctaatctacagaaaaaggcagtgcctaattaagcagcaagtacagtgattaattagctagatatgatggatgctggtaataattgcactgaattaatgagataatattgcgtgtgttcgtgcagatggacaaggcgaccatcctcggggacgcggtgaagtatgtgaaggagttgcaggagaaggtgaagacgctggaggaggaggacggcggcgggcggccggcggccatggtggtgaggaagtcgtcgtgctccggccggcagtccgccgccggcgacggcgacggcgaaagggcgggtgccggagatcgaggtgcgggtgtgggagaggagcgtgctggtgcgggtgcagtgcgggaactcgcggggtttgctggtgaggttgctgtcggaggtggaggagctccggctgggcatcacccacaccagcgtcatgccattcccggcctccaccgtcatcatcaccatcaccgctaaggcaagctcgctctctaaccatcctgcattgctttgcttatatatatgcatcaaattaccatgtgtaatttccagctagaacacatatactacatatatagcaaattaattaaccttgattattattagtaattacttgatccggagtccggactccaactgattattgatggatcggatcaagctagatcgatctctacatggtttgcatacatagaatttctaccaattctacaataataatgaagagatatgtattatatgctatataaaaatataaagatatatacatgttgctgcatgcagctgctgaaaattaagactactctgagtgcaattccattccatacatacaattcactccattcctgctatatttataagctagggcctcaaaattaattggtatggtgtaaagtattagtaactgcatttgtgctgcagctgaggaaaaaatactagtgcacatgtacgtgtttcttaagatttttctccatttaattaactatatacatccctcaaaaacaattaactatgtacatatgtttgtatgggcaggtgtactttgttctgatctgcagggtactccattcatgggatcaaaaaaattctaaaaaatcattgaggggtgaagagagagttgtgcatgcgttcatcctaaatggaccaaatagaataaataatatgaatgaagactttgtagtttccatgcaggcatgcttcatgcttttaaaaatatttatatgacttcaaagacaattctgctgactaataaggggtagcaatgtatctagagtgagaggcccttgttcagggtaaatatatatatgttggactcaaacatgtgctaggctgctagctagcatgggagagagcaaggaatgcagatatatatagcatgtgaatttcgtctacagaatgggttcttttatataattggggattggctgggtgggtgcatggattgaaaataaagcatatgctagacctatataattagggattggctggctgggcggatttggttggaattaagtagtggatcctacgaagaagcccacggtgagaagatggaaggaggatgactgcgcttttaaagtagtagagaaaactagttgttactagatttgtggttgagtcatttagtgaataaatcagtcgaaatgcagtgtgaaaattgttgacaggtaagaaatcgacagcgagctaggtcgaagaaataaaagtttctctagtactccatacattcacatccccttctatgatcagtttgatcgatctgtacggtctttgagcccccattttataaatgttattggtgagaggccaacgtgattacaatttgatcaatttacttatatagagcataagctgcctatagaaaaaatgtatgcatgttattttcttctgaaattaaccaagttggatttgtacatttgtcagaaacaatatggcatagtagtgcatgctctctctctctctctctctctctctctctctctctgttattaatttaatttgcgtcatattggttatgatattctaccactctatcaggatatataaaaattaattaacatcttatttgatcagtgctagctggtgatgtatttcaggtggaagagggattcaattccacagtggatgagatcatgaggaggcttaactcagcactactggaccaatacaataatggtagtgttgaagaaacagatcaagaaataagaagagagtagctaaattaagaagaagaagaagaagaagtttggtcgatctcaagctatagcatgcacccatgcacgcatgtctctatccaagtgaacacatctgagcatgcaaattaattaatcctcttatctttgatgcatgcatggtacttgtggtgaggaatcttatatcgactataaaaaaaaaactctggagatcagacgacaaaacttatggtgaggaattcctcgtcaagcactcgtgcatgatctactagctagtttcacatcacattcatgatatgatcggccggcatatatagcaaaagcactgtgaggtaaatggtgatgaggttgatgcatggtgacgagactttactttatcaaccatgcactgcacagccaatacaagctgcaaattttggtcttaatttacttgatgtttgttgatcaatccaaatcattaattcaagaagaaaccaaaatgatcttttgtttgcatcttgctgtggctgttttcccaaattttggacgccttcggtatcatgttataatatgttttaatttgcaagttgcataatgacttgcatcatagtatatatctaccccgagctaataatgtagtataataatgatatagatcgtgtatgcatggtcaaaactcgatcatatctaattctaaataaaatttcataaatatctaaataattgggacttttgtgattcttctgaaggcaggtatatatgctattatatttatttagaaaccctcaaacattttttgttttcaaaatgcacgcaccatattctctggtacatatcatcctgactcgtgcatgatgagtcatgcatgcaggaaaaaaactatacatatattcatactaagctgtcggatatatatagtttttctaattaattaaggtttcagttagttctgcatgactattttaattggccctctttgtttaaaagatattgcgtgatctctacagtacagcactaaagatatcaattcatggaaggatcctctctcgatcgatatgatccttctctaaaaaaaaggaagaagatatcaaagttttgtgagtacacaattaaagttgttgagatatgcatgcagtgcaaagttggcacattgctgttcgcataaaatgcagcatgtctttagttggtaggacacaaagccatgaagatctgatcgatcaagtatatgtatattctacatgatcgaagttgttggtacccatttaatataatcatgtatacatatatatacacatgaatatatataattaaacgaacatacacgtgaaagtgatcatcaatacacaaaaggagctcgatctcgtccttgttccccatcatggagtaaagcgtgatattaagaacatgctaacgatgatttcgagggattcgatgagtgtattaatgtgtgtgtgttttgtttaatttggtagtgacgatttgaagcattagggcgatcgatcgatgaacactgaatatctttttcggggacccgtccggttattcccagacaaagtcctccaatttcatattaaggatgcagtagagtatcaagctagctagtagtagttaattatgattagaagcaacattaaaaattacaatttgatatcagagacagcgctgcatatctcaggaaagtatatactactaatttttatgtctaggtaaactttagtttaattagctgatcaagccaatcaacgcgacaattaattattattcaatgtgtaattgggcacatgacatgctgcctgcctgcatggataaatggatgaaaagttgagaggcttcaataattggtcgatccattaggatcgacatggtgtctatagtttattaattgccaaaggcttggaggttgcagcagctagcagtttataatattagcaactttatattaattaattgtctcattagtcatttctgctggccggtgtatgttcagttctgaatggatgcattctgactgtaaaaggcacgttttctcttgtttttcttggtccagatcgatgccttcaattatttgttgagggattaatattatcagatctcagattgatgaattttcaggccttgaacctgaatttccatgatggttaactacttgcagctagtattccataatatatattgattccacctgatcaactgcagtatcaagcaactgataattcacgcatcaagctgccatatatctgcaattgcttgatactcattcagaaaacagtatcaaagcaactggtaatgcacgtataccatgacgatggatttgatgtgaccaacacagtaatctacctgatgaactgaaccttcaggccactggctttcatgcctgtacgtttgcaactctgtttttgtttattgaaaataactgtagacgacagcgtcagtgtcgccattgaaggtcatttgctgctgctgctttcttgagagtttgatgtcccaaccacgcaggcttgtttatactgtatttaggagcacagtgttgttcagacccaaaacaagtaaccttgcttccaagataatattgttttctcctgccatgaaagcaacaaccctaccaaacatcacaaatgtctcacacgtcacatgatcttgttgacgttctgcattggtgcatgaacaaacaatgaaacaatccactgttcctaactgtgcatggcatactgtttaagactcaccacttggttacttgatatgtactccctccgtttcacaatgtaagactttctagtattgcacacatacatgtagatgttaatgaatctagacatatatctaaatacatacatatgtctagattcattaacatttaaatgaatgtgagcaatgttagaaagtcttacattgtgaaacggaggaagtaaaatttagttccgcttttctttttcctctataatttgcaagtccatcacaagatcaaattacacctgatgagatgttcactgtccagggaaacataattaacaaggcagagatcagagcagggttcctttttattcagaagcaacttttattagcagacttgtgtttttgcatctgctacagctgtataaacatcgtgtaggcagcttttacatttgagacaagatgatacaagtgttcttcccactccccaggaagcaaagacacagcctgtgtatttccatgttgaactaaattggggcattccaagatggcctcacttgttgatgaaagcgacccccttttggatactctcggccagctccttcttagccttctccagtccagctctgcatgacagcgatgtatgaagataatcagtaatgcaggtcaatacagcagtaggatatatcaaatcttaattggctgtggacctaatgcagcatcatatattgtcatatatatgccgcagaggctttcaattcagacgcagcgtgttcttgtcggaggggtcatatatcctgcagttctacagtatggatatgaagagataacttggcaatagtattatttatattgcaatgtgaagccatacaatctgtagtggggcatctctactttcaggactctttctaagcactgttatacggccgcagtctgccatgattatgcattcatattttcagcagtatttttcactttcaaaagggggacttgtcagtatttgctatgagctactaaatgcaagtaatagtacttgagcccagtccaatagaaaccattaggcagacttccagtcagtatctactgatctggcaatcaagtcatgaaggttttaaagactgttatgagctggcgatataagcgttgtgcgctactagaagatagcttgataattacacagtgtggggatttaggatcaacatcattgaaaagcatataagagcatgtagcactaaatatgagtgcatgttatgcatgccaaatactggaaaagcatacaaacctttcgaattcattcaatggaccaagtgataagatctcctcgatgccacagcgacctaaccgcactttggatgcaaagaaaggcagctctgtcaccttcaatacccaccgcaagcaaaatttgcaaattagaaatatatgttcacacaaatgacaaatataaccagcataaaagggagaaaagaaacctgagaagctacaaaagagcactccactatcccagcgtcgccacgcaatcctctcaagcaagcatctgcaaatttagaagctgcatacgcctacaagaaaaattgtccatgttaaatcttaattgttctgataaaagaactaaccttcatacgctaatacgcatgtgacagaaaccaaccattgaaagggttgcagaccccgctccagctttagcctacatggataataggaaggggggaattaaaatgctcagtattagcaacatataaacattgagaaaccaacagtacacaggaatcgccaatagggaacaacacattaaacttcagccaacaaacaactctgtaacctccatagaaaaacatttaccgttagacagactactgttaaactttcacctagcaaaagcaaacgtaagcagaaaaatctagaacatgggaggcctttatattgataaatgaagaaagggggatttcgacacttaaacatgcattgaactagtagttttctgccaacaacatgaaatgtatgcaatatgggcaaacagacattcaaggcatatttagttaaagttcgacatgcacttaatacttgactttgttgttaacaccatgaaattcatttaactaatatgcatatgtacaaggattgaaagtatccatgctataagtggtcacttatattcaaacaaaattagcatgttgattcttttccagatttattaactttcaagtcaaacaactacaaccattatgcatgatacatatcagggactgtgaaaccaacttccctttcttctttatgaatacaattctaaacatgcatcattagatgataaagaaaaaatcatacctcgactacttctgtcccaccattctgtatgcgagtggtaagataactaatttcttctgaggtgaatgagcagggaggattcacctagggggaatagtagtaaaattccatcaatcttttgaaaaaataaacagggtaacattgatccaatactaattgtctatatccagaaaaactaatttgtcctacatatgtggctcagatttcagatttgcaacaatggaaggtattcctaacctgtgaaaggagtggtaatattgttactcctgcatgcccaccaatgacagggacatttacatctctggggtcaagcccaagaacttctgcctgtaaacaaaacaaagacaaaaaaaaaaaatgagaaactgtccatgtaaagttagtacaatgatatactacaaagcaaactctgttgaagttcataccacaaaagtattggctctcactacatcaagtgtcgtcacccccaaaaggcgcttagggtcatatgtcccagctttcttaaaaacctcagcagcaatcggaacagtagaattgacagggttgctgatcacattcacaattgcattggggcagcattttgcgattccttcacaaagagtccggacgattccggcattgatgttgaacaaatcatcccttgtcatcccaggcttacgaggaacaccagcaggaatgatcacaagatccattccagtaagggcattttccaactgtggctggcccaagaaaccacgcacctgtagatttgagaccttagcataattaaatacaatgatcgaaataccttttacggttcaataaacagatgaataactataggaataccacatggtgataaaaaaaggatatctggaaactacaaagctgaaatctaataatagttaaaatactttaaatatgcatgaaggctacgacgtattgctagcagtattatataatatctgtattttgatcaacagtagccgctcaatgatcagacaccaacttagtaccttttaagttattaagatatgactatcagatagacaagtttcattggaattacttgtttctttcattctggataatcaatggtttgaaaaattaaatttgtcagaactagattgtcttctggatgattcacatgttatgtaaggaaaatatagatgaagcatatgtaccctccctcaagacatacaactgaaaattatagaaattgcaactgaccataaaagtagtagcaaaatgcaacggttacagaatgtggtatttcaattatgaatagggggatactaaacataatgtcaaggaacataccacagcaccagtgttcatgtggctaatgtcagctgtgacaccgggagtgttgacaacatcgtacagatggagcacagaaacaagagggttcatcttcatgagcaatgcaagaggctggccaatcccaccagacgctcccaagatggcgaccttgaaacccggagcggcaccttttgcccggcaattggagcccctcaggaggggtgattcctccatcttcacatacaccaaacagagaaaattaagcaggataaaacagattataaacagagagcagagaacatggaagggtaagcttttatcttccggccatatttgcataccgtgtatgcttgtaaacttcctagatcaatggctaactatcgttttaaagtatacataataaaggaagagcatggttgtagtcgctacaaaagtggcagagtcaattgctgtttattgaacaaatgctgttctaacaaggtttctggtcaaaatgttctcccctgaaaacttacggctaagcagagaaggtgcaaagtagcataattgtcgatcacattccctactcactatcactagtagaaagcaaatagctataagggtaagatcctagtatcagggttcaaagtttcaatcagaaactaacaagtcgtccagagagcatatcatcagaaaaaaatgtaagtcaattttcagttcacttgagaatctgtgggaagtagcaaaaccagagatttggttcccccaaagctagctaacgggacctcctccaagtccagtaaagttggtagctttacactagtagtacattgcaagtgataaactaaaacataattcgatcagaagcactgtgaaatcggtaccccgcggcgtaggtaattcaagaaggagatccaaactaaaagtaactgaatagtagtagtagtaacctaggtccagccatccccatggttgactcgccacctccccaatctcaactccccgtaatccccaagcttgcaagaagaaggtaacctcggatactagatgagcaagatcatcttgcagcttcccgaaaagcaaacgcgcagcaaaccaaactaaactaaacctgaattaaatcgggtggaaaagaaaaagagggtgggggagagagagagatggggatctgggcggcgtgtggggtgctgacctgagaagcgggcgggcggaggtgggaggcaagcctctccatccgccttgctgctgctgctgcgtcctccatggccgccggaagaacggaagcggcgcgacgacgaagagttggtttggtttggtggcgcgggaacggcaagagaaatacgagaaaactggagggctttcttgtaaaagtagtgggatagagagcgtgtaagggtgggatacgtcttctacactagggaggcgtactcttgctggataactataactagctgtgtcgtgtacgtttccgttccgtttggtgtgacgcaatatgaataatattgccagtatgtgcatcatcgccgtcatagcctagtctatctgtttttgtatactttatactattacgggtaggagatttttatgaccaaactagtaaaatgttcttaacgaaaatgtattaatatgttatccatctttttttatagaaaatatttatcttaatatgattttttatgtgactatttgatccttttaatattaagaaattcaaagggtaacttgtaaaatttacaatggaaataggtgaggtgacatatttacgaaaaaaaattgaaaatatactgtttatggatttgttttgcaaaaatataccggatggagaatgatttgcacaaatatactatcggtatcgcggcttggaagagcgataccgaggttcgcaagaacaaaatgcgataccgccacgctatcgcactatcaactcgcgagggtgcatttgagctggcggtgtcgcttgtggaaacagcgagaccaccacgatatcgctctttcatagagcgagagtgccacgtgatggaaccgacccgttgtcgcgccggtatcgcggtgtacaagagcgagagtgaaatcggtctcgtaatcccgacgcacgagactgagcatgtcatgggacccatattggcgaaacgaccggacgcgagtgggccgccggtctcgcaagcgcaaagcgtgagaccgagaccgatatcggtatcactgtccgaatgtgcaagaccgacgcgcggtatcgctctggcaaagcgagagagcgctttgctatcgctcaatcaaaaatggatacgtacatatatcgttagtgaatccgggcgctgaatcgtatatacgaatatgcatacacatatatatagccgtcaaatatatcatcttcttgttggctcatgcatgtatacgtttatacattggccaagcatgcatctatatatggctgaacacacatatagatggatatataccagtatgtgcatggctcatgcattccattagcaggtgggacgcgctctcgagactgcttggggcccgccggtcttggttcacgtcagacggccgcgaaatcgcggtacgatcgtgcgagaccgagtcgttctcgcgcttttggaatgcgagaccgatgcgttagcgctctcgcggtttcaattagcgatagcgctgtttcaattagcgatagcgctggcatcttcgctaattcattatgcgatatcgcgctctcgcttaaccaaagtgcgacggcggtatattttctcaaatcttcccctaatcagtatattcttgcaattccggtaaaaaaaattgtatattttcaaaaaaaattcacatatttactaccatagtatagataagcagtcgtctactccatccagcatacacaatacaatcataattatttctagcaatgtatacttagtttgtagttagctagctggtttaacttgtcaggtaactaatcaatatatatatatatatatatatagttttttattacttttttttttaacttttggtccgacgtaatccattgttaaaaaaacttttttcacaaaaaatatgaacaaatatagttgggccactagtgccggtgggtgttcaattttgatgggcttaattatagcccaacttgatatataatcacctggagctggaggcctacggcatatgggcccaaaatcattgctgcgaaggaaatcaggtaggcccagcctgctactctaagatcagtgcttgatgatgattagtactactaccactagcgattctgattttctgaatcgcaagcatccaacaatagtttttttttccacatatataaggatcactactatgcttaagtagtgtattattatgctcagattaactgtgcttaatagttattatctgattatcccatccatccatctcccaacattgctaactctagtatagtatatacagtgtcaaggattaaaaaaacaatagtaagtccgagcaagtctaacttaattattcgttattattgcctactactagttaattaatttatgaaataataataacccatacagatccatggatcaattcatttgtctgtcaggatcagctagctggtcaaacctgatcaatatgcatgaatcttatgtagggttgctcatcagcatcgatctgtctgtctactactatttgcttgcttaatagtggagtagtagttgcagaatttctgcaaactgatggagacacaaaagctactgcttaacactgcagccggccaaacatctcatgcgctgcatctcagagattaatttcaaacaagggcctttgctttcactttcacatgcatgttatcgatcagtttggattgcgacaaattcacgggaaatggggcctgaacaaattgtgtgtacaagtggcattcatgtttggttgtgtttagttcagcgtaaagtttggattttggttaaaattggagatgatgtgactgaaaagttgggtgtgtatgacaggttgatatgatggaaaaggactgaagtttggatccaaactttggatctaaacacatcctttgtgtattcatatttccatttacattcaaggtaattaattaatttaacgaagttgattagtttctgctggatttgtgtacattttctctgcaaacttatattgtggcaccagcagcctgctaattaattaactgaacaaggattactaacacaaaggggggtggcagtacatatatatagcatcacattatactgtaatatacatgaaggaaccgattattttaaaaaatataaatttaagaagcatcttgagacatgaagtgtgttggagctggcatgcataagcgcgacacgatcaatagaacaccaggttgtgttgatgctttcggtagttaagtatagaaactctctttccacccatgtaaaacggaataacttattaccatatgattgattacatattaattaaaaaaaacttaaaaaatagattaatatgaatttttaaaataacttttctaagattttttttaaaaaatacactgtttaaatagttcggaaacgtgcggttggaaatgagagatacaaacacagctagcgaaacgcaacattgattttccctttttctttattagataacatatgcatacgcgcacacatcaatacacatcaccacacacacatttcacagaacataacattggttgatatataaatataaatatatactgtatgtatcaatgtgtgaatgctagcaaggtgccgttatatctttttgaaattttgacgagggtcgtctcgttagttgcttgatctttttatcatgttctcaagagtcaaaaaagggtcttgtttgcaaagaaattaaaaagagaaaaggtgtaatagtggggtacatgcacatgtggtgctagatatatctataggatcatcactagtgtccttttagttagtgcgaaaacgacacatcagtatatatatgagatacttatagcatattttgcttgtttaatataatttgtcccatgcattctatgtactccatcaaatagcaaaacttaacccagtggtgaaagaaattaattaaccaaactaattaagaatatatatactcgcttgctgggattattcttacactagttcttccgaggatgatcccatgcatcgaatgtgtcagtactgtcgctctcataccagcacacaagcaacaatttagaattttagataatggaatcaaacaaccaattaatatgaagcaagtgtactataaaaaaatataagcatatgcaaacctacgtacattacatatggctagagcctagagggagcatatgcttgtgcttatataacttatattttcaaaactagactaaattaacttctatataaattaaaatgctctcgtgcactgacatatatatgcatggctacaggtactctctccatcccaaaataaagatatctttgtagtagctatatttgagataggggaagtagattaatactcatgtgttattttttttttgaatgactaaatagacatgatttgtgataattatctgaaggcacaaacaaataaattaattattatatatgaagttaaaaatgaatttaagacaatatcataataaattcatatataaacagtttttgaaaacatcacaccgtgtagatgttcggaaacatgcacgttaatccactgagatttatatttatctgcgtgttctttcagctacttcaccgtattattttcgtgaattatttgctcaacgtctttcaaatacatattttcttataaaactttcttctagcgcacttcagttcacttgttattctaacatatttattaagcttattttctaaaacatttaatttattactataattaattaaataacatgttgtaataatcaagtctgttataaacggggtaggcattggcaccatatatatatatatagttgaagatcaaaagcacacaattaataatgaggtaaactatgcacgctacagttttaatttgcagttatatatatgttgagttggcatgacgacatacaaactgcatgcgtgcactagtcggtgttaatttggaagcttgtgtggtcactcagatatggctatagtggtgtggtcaagccatgctcatcagctttgcacttgtagtagttgtttatattaattgtgttttttaattgcgttaattatatttgtcagtgatgatctgttaagcaccaccaccggcatatatatctagaaattatagggtctacatgcatgtatatatgagataaaccaccatgaggatatataaataatacatacatgcactttgttgacttgcacgtacgtctaattttcatgctgtcctaaactagcctgcagccaccctgatccttatatatgatgcataataaactaacgtaggcaagctatagtcttgttcttcttcctaatttaatttctgtacatcattacataataccgatacgagttttctttaatttcacatacgctctctgaatatttagtctccgtggcaagagaaagaaaaaaaacattcttaaaacaaaaaaaaaacgagtaatagatttctcaaccataggactaattgaattccatgaatatatatatatatatatatatatatatttgtagtatcatatcatctgaatttttgcacagatcaacagaagctgctagtgctacctatatcatgttcattaccattttattaattgtactttcattatcacatctttttggtgaggaattcttccagtttttttttaaaaaaaatccactacgcacggaagtcacattgtattagtcttccttgtgattatttcctttttgacttgattgtaaatatatggcacatgaggaagataattaagttaataattacttccttagtgggcaatacctggaaaattgactaaagaaaagagcattgtgtctgcttttgtgatgcatgcatgtaagtgggacaaaatggtggagcaccaagatgaaactaacaaagattgcatggcatccatgtgattgtgatgcccacatatagctagactgacaataacatttacccaccataaaattttacaaacagaaaagaaatacaacaaataaagcagcagtttaattattattaggggatcttttacagttcatgacgagatcagggttctgtatatcggcttgcgcatttcttctgggggaccgatagaaaaggaattacggaccgaaataagtcagtattcgaacaaattttggttaaatttgaatataatttgcttgattcagaaaattaaatatttcgactgacataatattgtacggatgaagggttctcatagccccacaattttgggaaatttgaaccctgaggtcataataatgtaagggcccctttgaatcaaagaatttatgtagcaatttcataggattcaaatcctatagaaaattttcctatttggctctttgatttaaaggattgaagcttttcaaatcctatgaaattcctatggaatgacacattgcatgtggattttggaggaaatatagcaagagcttcaacctcttagaaaatttcctttgagtctatctctctcatccgattcctgtgtttttcctgcgctccaatcaaacgaccattcctatgtttttcctgtgttttgcaatcctctattttacacttcaattcctatcagaatcctatgtttttcctattcctccattttttcaaccctgcgattcaaagggggccctaaatttacttgttaaaacatacttcctctgtttttaaatatttgatactgttgactttttagcacatatttaaccgttcatcttattcaaaaacttttgtaaaatatgtaaaactatatgtatatatataagtatatttaacaatgaatcaaattgatagaaaaagaattaataattacttaaattttttcaataagacgaacagtaaaacatattttaaaaaaaagttaaatattaagaaacggatggagtatacagtaacatggtagtagtaattaccatgagcagctatcttaatcatctagaagcaggtaagctggtcgttttctgcatgtgtaattggacggcatatagcatcgcatcgacgatcctgtaattcctgcagagaaagaagtagtaggagtaatagagattacagggacagagacaggtgtcctgcactggttgcgtttcagctcaatatctccatcttggaagctagggagaaagaggttggaaaagaatcggcagtggacatggatgcatgacaaaaagaagccatcaacacatcaaatcacaagggacagcaacatcaaaggaagaagaaagcaatagagaaattaaaggagaaaaaagagaacaagtacagtgttcaagagtggccatatatgagagcacgtgtggcatttggcaacacacacgtaggttcatcatcatcagtcgttgaggtccactggccagtggactgatatatattagcagaggatcggaggaaggttaccaggaaagccaaggataatcaatttggatcctctgcagtggagaagagaatgcaaagggagctacagtgcttttgcattagggtgtgttgtttgctgttggatccacatccaacggtctaaaacaaatcgatacagtagatgggaacagtaaacgggaatagtaaccaatcaaacagcaaaaagattactgtttacgaaatactttgctacagtacccgaacagtgttcggcgcattgattcactgtagcagactcagaatactgtagctgcagttcctctctgctggactgtggaggacctggatccaaggataatcaatttgacctcaatcatactatatcactctgcttaatttcggaagattctctgaattgcaacagttgagtgtgtcttcttcagagagaaaaactacagaggaattcaggttttaggaggactattattacattctagaagaaattaactaatgtaatcctgcggtataaatatgatctgtgagcggataatgaaatggagtgtgatgcgtgcaggaatgcagtgtgtgggaaagcgttggtgagaggtcaaacgcggcggctgcagcaacttgcgagcatttgcattcaagagtcacactgaagatatatacttcagcaattcaccatccgatccgaccgaatcatcgcatcacatctgtccacgatcgatcgtatatgtgtgtgtatgcgatctctcccacgtcagataattagctacctgttcctctcaaaaactgccaaaatttgagcctcaaaattcagagatccattacatttttggtggcctgctacagatagtgctccctgaatcatcagaattcagtcatcagttcctcgtctccgctccccacaagccaagttgtcgttggactcatttttttctcccattcttggataaatatatgatcgatagatgattttttttaagataatgatgatcgatagatgatgtagtagtatactcctatatctatccagctgagatcattcttgatcatatatctatctcaccatttaatatattttcatcgttcttccattattattaatcagatatatgtagacgacttataagacaatagtaattaatatctgccgcttaatcatatatagctagatgctggtgtgtgcgttgaagggctcaatccatgattgttgcttaaggatatatattattgaccctgcatatccgttccatctaactatagttaaattactccagcacacgctcgtccaacctatagctgttttgcaccaatggatgctagtaatataagaatattaatattactacctttgtgacattcttcaaaaaaaaaatgctgcacaggctagcactactggaattaagtctcaatacattatatattactccctccgtcccaaaataagtgtaattttgcactattcatgtctaacctttgaccgttcgtcttatttgaaatttttttataattagtatttttattattattagataataaaacatgaatagtactttatatgggactaattgttttcaattttttcataaatttttcaaataagacggacggtcaaacgttggacacggatacctacggctgtacttattttgggacagagatagtacatcttaattgaagtgggtttacagttatacaaacgttcattaattagtccaagcctggtacggagtagttagcatttctgcatttgcttgaccgtcattagacaagaaacagggttccacaaactagtgctatctggactgaaccttttgcccattggtcatgcaatgttgccgtgcatggaagcaaagcaatggtcaattacactggctaattagcacgctagcttaacacagttgttagtccctccattaattaacaatctagctacttatctcaaataaacaaccatgtactgatcagctcctatattgtaccgtaacaatccatgtcaaccagttgtcttatggaaaaaataaatagtaaataaaaataaaatataaaatcatgtttaaaattatttaatgataaaataaaatgcaacaaaaataaatgacatttacatagatttttttaataaaatgaatggccagatatcggataaaaaagtttattaaatatgtgatgcgaatatcgacatacaatatattaggattagtcttcgtttagtccttttctattatgactcttagctttttccttttttacctatatccttgtaaacggcatgggaaggatacgatggctagatgtatactatgtgttcgtaatcaactcctcagtattacttattggcaattggcgtctgtggtttttttccgtaatgatttttcatgtaaaaagttaagtctcatctataatgtaaatagcttcatatatttaagaacagagagagtggcaagttaaattaaccaccattaatcaataatgtctctgtttggaacagtacaaaaattggctaagctaagctaattaaaatagcatctgtgtgctgtcgttggaacaggctgctgacctacttactaccttaaagccaatcagtcagcttcacacactgacaccaaaggaagcatctttcttccttctcttcctcctcctcttcccggcagccatgccaccgccctcccttctcctccctcctctcctcctcctcctcggcctccatgccgccgccgccgccgtctccgaggtgtcggccctcatggccttcaagaacgccctcaccatccctcccaccgccgccgccttcttcgcccggtgggacgccgccgcggcttccccctgcaacttcaccggcgtcgactgcgccaattccgacggcggcggcgtcaccgccgtcgccgtgaagggcttgggcgtgccgcaacgtccgtcccgttcgacgttctgtgcggctcgctgccgtcgctcgagaagctctccctgccgtcgaacgcgctcgccggggggatcggcggcgtcgcggggtgcaccgccctcgaggtgctcgacctcgcgttcaatggcttctccggccacgtcccggacctctcgccgctgacgaggctgcagaggctcaacgtgtcgcagaacagcttcaccggcgccttcccatggcgcgcgctggcgtccatgccgggtctcaccgtgctcgccgccggcgacaatgggttcttcgagaagacggagacgttccccgacgagatcaccgcgctcaccaacctcaccgtgctctacctctccgcggccaacatcggcggcgtcatccctcccggcatcggcaacctcgccaagctcgtcgacctcgagctctccgacaacgcgctcaccggcgagataccgccggagatcaccaagctcaccaacctcctgcagctcgagctgtacaacaactcgctccacggcgagctcccggcggggttcgggaacctgacgaagctccagttcttcgacgcgtccatgaaccacctcaccggcagcctctccgagctccggtcgctcacccagctcgtgtcgctgcagctgttctacaatggcttcaccggcgacgtgccgccggagttcggcgagttcaaggagctcgtgaacctgtccctgtacaacaacaacctcaccggcgagctgccgcgggatctcggcagctgggcggagttcaacttcatcgacgtgtccaccaacgcgctgtccggcccgatcccgccgttcatgtgcaagcgcggcaagatgaccaggctgctcatgctggagaacaacttctccggccagattccggccacctacgcaaactgcacgacgctggtgaggttcagggtgagcaagaactccatgtccggcgacgtccccgacgggttgtgggcgctccccaacgtcgacatcattgacctcgccaacaaccagttcaccggggggatcggcgacggcatcgggagagccgccttgctgagcagcctcgacctggccgggaacaggttctccggcgcgatcccgccgtcgatcggcgacgccagcaacctcgagacaattgacatttcgtcgaacgggttgtcgggcaaaattccggcgagcatcgggaggctggcacgtctcggcagcttgaacattgctaggaatgggatcaccggggccatcccggcgagcatcggcgagtgctcgtcgcttagtacggtcaatttcaccgggaacaagctcgccggcgcgatcccgtcggagctggggaccctgccgcggcttaattctttggacttgtccgggaatgacctctccggtgccgtgccggcgagcctcgccgctctgaagctgagctccctgaacatgtccgacaacaagctcgtcgggcccgtgccggagccgctctccatcgcggcctacggcgagagcttcaaggggaaccccgggctgtgcgccaccaacggagtggacttcctccgccgctgctcgccgggatcaggaggccactccgcggccaccgcgcgcaccgtggtcacctgcctcctcgccggcctcgccgtagtgctcgcggcgctcggcgcggtgatgtacatcaagaagcggcggcgcgcggaggcggaggcggaggaggcggccggcggcaaggtgttcggcaagaaggggtcgtgggacctcaagtcgttcagggtcctggcgttcgacgagcacgaggtgatcgactgtgtccgcgacgagaacctcatcgtcagcggcgggtccgtgaacgtgtaccgcgtgaaagctcggagcgcgcggtggtcgcggtgaagcacatcacctcgacactcgctgcggctgcggctgcaaggagcacngcngcgtctgccgcatgcttcgttcgccgtcggcggcgcggcgcacggcgtcggtgcggtgccgcgagttcgactcggaggtgggaacgctgagctcgatccggcacgtgaacgtggtgaagctcctgtgcagcatcaccagcgacgacggcgcgacgagcctgttggtgtacgagcacctccccaatggcagcctctacgagcgcctgcacgaggggcaaaagctcggcggccgcggcggcctcgggtggccggagcgctacgacatcgccgtcggcgccgcccgtgggctggagtacctccaccacggctgcgaccgccccatcctccaccgtgacgtcaagtccagcaacatcctcctcgacgagtccttcaagccgcgcatcgccgacttcggcctcgccaagatcctcgacggcgccgccgccacgccggacaccaccagcgcgggcgtggtggccggcacgctcgggtacatggcgcccgagtactcctacacgtggaaggtgacggagaagagcgacgtgtacagcttcggcgtggtgctgcttgagctggtgacggggcggacggcgatcatggcggagtacggggagagtagggacatcgtggagtgggtgtctcgccggttagatagccgagacaaggtgatgtccctcctcgacgccagcatcggcgaggaatgggagaaggaggaggccgtcagggtgcttcgcgtcgccgtggtgtgcaccagcaggacgccgtcgatgaggccgtcgatgcgctccgtcgtgcagatgctcgaggcggcggcgatcggccgggagttcgccgtggtcacttcggtgaaggtcaaggtgatcccctaggactaggaggcatttggaccataagggggagtgaacaacgtgggtccttgttggtcgtccgatcagagaatcaacggctcagatcaagcgtgatcaaacacggataattcatcgtcgtggctcgatctcaaccgtacttcatcgatcggatggtttccaaagcttgtagttattacattagcaaatcagcttcagatgagatgaaattagcaaaatatatatgtagataggacaatcaatcatgaattatattccaggtcaatgatgcagtagcatactagcatgtgtgcacaagtgagatttccacagaataatggaatctgtagttagtactaatactagtatgcgtgtaactgtaaaacagtaaattttgctaaatcattttcaggtcaatgcggtgaaaatactctgccaaacattctcttggacagttggactcgctcaactttgtgcagataaataaagtactggatgctggagattagattaataatcagatgagacaaaccacctgcacgtgttctagatggtttgaacaattcggctttgaattgtgctgacaggaaggttggcatcgccatcaaggttggatggtactcttgtccgggaatcattgcagagattagtccacgttttaatgcaagccagagactcccttgcatgattaagctcaacagaacaatttatcagatagtagtacagtatttctaccttaagggtgtgtttgaggattggggagattggggagattggggagattgggaagatacgcaaaacgaggtgagccattagcacatgattaattgagtattaactattttaaacttcaaaaatggattaatatgattttttaaagcaactttcctatagaaattttttgcaaaaaacgcaccgtttagcagtttgggaagcgtgcgcgcggaaaacgagagacaatctctctcaatcccccagattgcccaggaacgaacgttccctaagacctggaagttgtcttgtgtccatcctgatttcttgtccggatgttaagatgagatgacagtgtgtatctgcaggtatttaactcctcaagttgctgtgcaacagtacactgaaagctcataattttttttttttgtttgtgatccttaaaagtcatgtttactcatcaagttgctgttcaacactagactacacggctgcagttcttagccggcgtgttcaaaagtcttcttgcccaatccggaacgtcagcgtaatgtttaccgttaattaattagttaatttttccaagcaaatccatttgttagcgtcatagggaaccaagtcagttttttttaatcggttggaggcaattgatcatgttgttacaagttatctttgcaagagaaattgaaggatgtacatcagtaggtagatgtatcattgatgttcatcttgaggcgaaattcttaagtttcatagtagaacacagataacagtatgctttagcaaagctgtcacatgatgaacatgtatcaaattgtgcgacgtctgtacctgatctcctccgaaagttagtatattgaatatatacataaaaaaagttgtgataaatgaaacaaattaatgtatcatagaagaagaaaggctgataaaagaaattaaaaataactcaaagaacaattgagaaaggctttgtttcaaatttctcattttgttatatcttccaatgggagccgccgccttggagatcatcgggaaagagagaaaaggggagaggtggagacagataggggaata

SEQ ID NO: 1699 - DNA, 7911 bp, Oryza sativa
  unsure (1)..(7911): unsure at all n locations
gcccccgagacagtggagacccccctaagcccccactaattttttttccatagatctataggatgtggggacaggaggttcgatttatgctgatgtagtttattcagcccccactactatttttttctagatccgccactgctcaccagctagcttctcagtagctgcttctcataattttaagctccccaaacagggcgttatatactcatatgtttttagcaccaaagtctaaaatgcatgaatttttaggtgaaaggttaataatcacgaattttttagcggaccctgatattcatgcctttttaagacccaaggtcaatacacatgtatttttcaactcttggttaatatgcatgatttttttgggccgaagataaagattcattttcggacaggagagtaatattcactctcgtttgggcccagtactcatgattttttttagtccaacgctaaataaataccggtatgttttgggccgaagtctaaaagtaatgaatttttaggccaaatgtttataatcatgaaattttgagcaaaagtctaataatcacgctcttttatgactaaggctaatcctttatgggtgttttttagccaaagcctaaaatcaagaatttttaggccaaaggtttaaaatcacgaaattttggataaagtaatattcaaacctttttttagcccaagattaatactcatgaaatttgtagcacaaagccagaattcacgtgtttctttagagatctaagctaatttgagtggaagtcaagtcataaactttttaggacaatgtttattacggtgaagtagtagagtacagagatctatgtccttgcagtgaaaagttaagtttagaaccacttttattcttaacgtctaatgaacttgattgagctctcaaatgagctttagcatgtcacaatgagcaagggaaaatgagatattctgaagtgatctttaaattggaatctaagtacataaagtgtgacccactgaactttggcactcatctttgtgcttccttcaatgcacatatcttcttgattggagatttgacaaccattgactaattcatataccctttagcatcattcaaaatacacgagaaggctcaattcaaagtcatattcgcagttatttgacctggcttgtgtctattaggaagataaatgactagaagagcacctgtgtatctttcttgacttcatctcggactaagaagtaaaaaaataactgctgggaacatttcgaaacaacttgcgtacatgttcgagcaaaaatcatactccctccgtttctaaatacttgacgacgtttacttttttaaatatgtttgaccgttcgtcttattcaaacaaatttaagtaactaggaaggtagcccgcgcgtatgcgcgggtatgtatcgtaatatgtgttaaagaaacttataagattgaaatattaaccagatagtacatgctacgcttcaaatttcaaaagtagtatttctctatgaatgtttttcaacgatattgctttgataatttttataagctatttgtttgttttatgcaacaaaatatttaattcatccctacgagtaattatctgtccacgttatcgagaaagaaggtcgacttattttattaagaaataatttttaataaattaagtgtaaattaaaattgaagtgttattgtttttgtcgaatgtttagggtctctttttttaagtaaatcatggaaaactactattactgataatgtgttttatttataccattaagctaggtctccttctaatcggttatctattaagaatttggaaggggattagagggcacgggtgggagtcacggagggattggattacatacttgcgtttctttgcatgtgtggtggaagccacacgaaggcatgtgcctaatatttctcattcatccaagaaatattaaatggtaggtttctatctcaattaaccaccttacagaagagaagaggtgtgttgcgccatgataacagaatatgtgcatatttttttttcaaaccgagtatgtgagcatttgtagggccagcaggggataagggtattttacaaaatgattcatggttgaaaataaatgggttcaccagattaaatgaaaaccgacggttagacttttgtttctctctcaaaatttcttggaattacactaatttattagagtgccacgtggtggccactgtgttctttctccaatttcccaacatctactcccttatttttcacatgcacgctttccaaattgttaaatggtgcattttttacaaaagaattatatataaaagttatcgtaaaaattcatactaatccattttcaagttttcttaagctaatacttaactaatcatgcgttgatgagctacctcattttccgtgcagggagaaaaagtttttgcaggaatccactaagagcgtttgtagcaagtttcatagacttttagtatttaatatatagattgatatttcattactatttggttgttatataaaggatatgttctaggtcatatgacgtattttcatatatagcaaaaatatgagcaatataggttgctttaattataaattaagtaacaatttaaataaattaaaaagtaaagaaatttctaaaaaataatggtcgtgacaatacggagaatggtggaggtgaaagggatttgttttcttataaaagttggtctaatcgtctaactaatattgcatgaaaataagagataattaatattgcataaaaataagagatagaacagaaggagagacttgcataattaggatggtgtagggatgtcaatacacgtaccgatgtacgtgtgtgtgtgtatatatatatgtacatagataacgtgataaaccgaaaagagtcggaaagatgtggtttttttcactaacataagaaaacaaaaggatggatccaatggttcaaacctcggtgcttgattcttttttttctatcaccacaccttcaatttgttttcatgttattaacaaaacaaaccattatacactgataatttgattcatcttcaccttggcaaatcagtactgctgcgacactcgtgatgaccttggtaaatcaccttagctgccttaggtttggtggttcatctcggatattttgcttttctctcataattttttggatttatctaatttattagagcgccacgtggtggcttagtatcatttgtaggaagtttaatagaattttagtactgcctccgtcctagaatgtaacaacctaggataggatgagatccatcctagctcatatccatatacattgtcctagcataggtctcatcccatcctaggttgttacattctgggacggagagagtatatgatagatagatagatatagtattgtgaaatttactctttttgtttgtatactgagttgcgagctaaaaaatagggaggagaaagtgagcaaggagagagaggagcgaagatcagatatatgttattaatttaatatttaattactttttatttttcatgtaaaagataggagttttttttccaaatgatatattcttgtatatccaaacatggccaatgcagataaattaaatatattgtaaaaattataatcatttagataatttgcttttatttacatattgaattttgctaggtagaaaattgggtgattgaaaggtaaatggcaagacgaaaggaaggacatgagagggagagacgtatgtacgtacgtacgtgaaggggagaggaggtcatgtacgtacgttaagtggtggggttggggtgggaagaaattatggattgggttttaggatttttttaagatagatttaatggtgaagaataatgggtcccccatcttaagtgaaaattaacggttggatgttttgcttttttctcagatttttttggatttctctaatttattagagcgccacgtgacggcttgggagcgtttgtaggaaatttaatggacttttagtatataatagattattaattcttttcctatcatttgattcatagttaaatatacttatatgtatatatatatatatatatatagttttacatatttcacaaaagtttttaataagacgaatggtcaaacatgtacttaaaaagtcaatggtgtcaaatatttaaaaaacggagggagtatatggcaaccaatcacatataacacaaatataaaattcttatctataaattattttttgttgcttcgttcatttttccgaggcttatcaactgttgagcaaacgatgagaggctatatatggcagagataaggcatgtgtagtttagtcaatcaacaatttttcaacgttttcttttagtaattcttttaatctagctccaactaacagaagtttaaagtaaactagggacaaactgtagcttcagtttaaaataaacagggcaaaatcacaattgagcttcaaagttgggaaaaaacaccattgcccccctttaatatatgggaaaaatgcattggatgactgacgtgtagtgcaaattaaactcataattatactagtagcttgcaggattagatgctccagctgttgcaaaaaggatggatgaatgtaggcactaaaccgcacacttcaggtttctttggtattttttgcaagacttcaacattgacttgttaattaggatgatcgttcgaattgatgcaacttttgtgcttgcctagtcttcaaaaggagttctcattctctatccactacaataggtaatgctatgtgaggtgttttcacctcgccttgttaatggccaccacaccatcattcattcccctaagcttctttactagaacattttataacttgttgattaattaacaccattatttccacggtgaaaaagggtaaaattaaaagggttttaccatgtatacctaactctgccgttttcaccatgtgctgtaataatcttcatgtcacacaataagcacactcacacaccactaagtatatctactcagcttccagagattgctggcaactttgacaagcaccaccaaaaacctgaagcatacaaattcaagagtcccatatatacaagtgcaattgaagattatgtattgtttttaattgattgcaaacacacagtcctccacattacaacttataattcatgctttattggatagcaattttactgttctcgtcaataagaaaattactgttcctatcagtcaattcttctcaccacttcatcacttgtacaacatgccttgtcagcatccacaaaaacactgcattaatttgggcatgcaattagctcctgtattcatatataatagattaatagtaaccttgtttagaggtcagtcagtcatcatcaagattaacaaactagccaacttttttccatatgtggcgaaccgtgttgcttatctatgtttaacagagaattagtggcctgatgtggttctggacctaactaactaatgtcaatagcaatcaattgaagcaagaaacacatgagtgtgtatgtgaaaaaatggggatttttttggcatgtcaaaatctccttttccacctccccacaatggtgagtttttttatctaatcacaaatgctcccttttgagtgagcatctatgtgtgttcatccaccttaccatgacaccatggcacacataacatacctgcttatccactatggattcctccaaatggacccactgccacacaaaaaggattgttcctgttcatttttcaccaaaaaagtaagtggagaaactcatttttgaattttttaaatatatgtgaaattccttcaaatgtttgtacacatcaatataatgggaaatgtcatttactcattttattcggtgctatccaaatacctatattcctaccaaggaaagatggaagataaaagaacagagtggagcacacgtgtgccttcatacatatgcttgtgttgttcaagtgagatttttaataactgtgcagaatatgtgccaaacttctagaaatgatctaggtagcactaatgttaagagtggataaatcaaattacttcttttacatttttacacattccatgttgcaaaagaagaatgttgactatgtgactttgaatgaaattcccaaatctctctgaagtaaaattccccctcaaaagatttcttacatatctcccgaacatgcatgctttcaggctttactcctctacttttgtgaatataataaaactagatggagacccccatgattaatttatgagcaagtacacactaaacggaaaaagatgcagattggcgtatgcgaccattgttaatgagctacacatcatcattcaggccactaagcacagatatgcagtagctgcttagttgctactactactcctactttctgatgcaggtgtgtgatcactgatcactgactgtttgttagttactactgaattgttttttaggaagaaaagggcctcagatttgtcagctccttgcttcatctcctcctaaagtgttggcaatgattgggacaggcaccaacttgcagttcctttgttccccatagagtttgcaggattagctacagtaactgtctatcaatcagatttgtgcaatcttagctcccctgtatatgcagcaactcaattgcagtagtagtgttagtgttagtgaagaatctagagcctagcagtaacaatgccatccatttcagcaaaaagaggagaaaatgcaatgcttactgcattatgtcataattatgtgtgtggtcatcattgagaaatggcttgtctgatgagaaagtgctgaatgggcatggctttctgacttggctacaactgaaagtgagagaccgggttcggtccgggcctatgcggatgccgggcctaggtggataccgggcctacagctagtttgggccaggtgaggcccatccacagttccagaagatgtcacaattggtttgactggtcctgaagagaagaagaggctggagaaggttgtcactgcatattgcatcattgcatgagtgagtgataatcagctagcagagcttgtgtaagtgtttgggcatatatccccaatgcaaaataaagccaagaaagaaagggtctttaagctaaagccatgcatctctctggtgtggggccccactctttatatcatcaccacagattctccctccacttatatactccctccatttctcatcacaatattatgaaccattctattctaccacatcacacacacacaaacacacacatattctcaatctaacataataacactacactacactacacttggagttggtgatcatatacatatactacatctcaagaacaacaacacaagaagaggcaaaaagaaggagcaaattaagccaccatctgatctgtgcatgctatggtgatcaatctctcttctcctccaatcttcttgttgttcttcttgtggtgtgttgtcgtcttcttcgtggccggcgatggcggcgcggtggtggcggaggcggcattggatgctcaggcggcgtacctgtcccagatgaagcaggagttcgccgggccggccatggcgaggtgggacttctcggcgccggccgtggactactgcaagttccagggtgtcgggtgcgacgcctccggcaacgtgacggccatcgacgtcacgtcgtggaggctgagcggtaggctccccggcggcgtgtgcgaggcgctcccggcgctccgggaggtccggctcgggtacaacgacatccgcggcgggttccccggcgggctggtgaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1700 - DNA, 1513 bp, Oryza sativa
ccacaagctgagcttcgaccagcacgagatcgtggaggcgctgatcgacaagaacatcgtcggccacggcggctccggcacggtgtacaagatcgagctgagcaacggcgagctggtcgccgtgaagaagctgtgggtgtcgcggcggtccaagcaggagcacggccatggcggcggcggggggtgcctcgaccgcgagctgcggacggaggtggagacgctgggcagcatccggcacaagaacatcgtgaagctctactgctgctactccggcgccgacagcaacctgctggtgtacgagtacatgcccaacggcaacctatgggacgcgctccacggcggcggcgggtggggcttcggcttcctggactggccgacgcgccaccgcgtcgcgctcggcgtcgcccagggcctcgcctacttccaccaagacctccttttccccatcgtccaccgcgacatcaagtcctccaacatcctcctggacgccgacttcgagcccaaggtcgccgacttcggcatcgccaaggtcctccaggcccgcggcgatcgcgacgcctccaccaccaccatcgccggcacctacggctacctcgctccaggtaacacatccatcaattgtccgtcttttctcatcagcttaaacttttagattgagctgttaatcttttcttatcagtttaacctctgatcagttgtttgtcttttcatatcagtttaatcttttcggttaaactgattgatggatatacatatgtatatgtattcttatcggtttaaactttttggttaaaattttgagttgaactgattggtgcatgcatacagagtacgcctactcgtcaaaggcgacgacaaagtgcgacgtgtacagcttcggggtggtgctaatggagctggcgacggggaagaagccgatcgagccggagttcggcgacacgagggacatcgtgcagtgggtctccggcaaggtggccgccggcggcgagggcgaggcgctggacaagcggctcgagtggagccccttcaaggaggagatggtgcaggctctccgcgtcgccgtccgctgcacctgcagcatccccggcctccgccccaccatggccgacgtcgtgcagatgctcgccgaggccggccccgccgccggccggaccgccaaggacgccgccaacaagaaggactcctccggcgagccaaagctgtaataatcatctttaatctagctaatgcgtgcaaacgtactgtgtaattatccggccggattagtagctagtgatcataagcaagaagagagattgttcatgagctagctagctccaactaattaattagggggaaaatattaattactactaattatatttacatgtaataatactaattatgtagatagaatcataagaggcaagttgcaaaggttgttcgctcttgcactaggggatatatatggctagtatttgtagagtcgtagctgcctttttgtttttttgggtttgggtcacgtaccattcac

SEQ ID NO: 1701 - DNA, 2087 bp, Oryza sativa
agtagctagtgatcataagcaagaagagagattgttcatgagctagctagctccaactaattaattagggggaaaatattaattactactaattatatttacatgtaataatactaattatgtagatagaatcataagaggcaagttgcaaaggttgttcgctcttgcactaggggatatatatggctagtatttgtagagtcgtagctgcctttttgtttttttgggtttgggtcacgtaccattcacatatactgcttggtgtttaagcagaatctgatgctctcagtggatggaccaatataaaaatatatatatcaaatatatgtatacatggatgcaaatatatatactatatattaattagtgcattcagctttgaaatgttcctttctctttgcatcgatggagaccttttcatttctttctttgttttcctctccaaccttttgtttttgctgagtgagtgaggtgacagcgtggagcatgaactgaagggaaactcttttaatctctcaaggagatgctccctcttttttggtatgttttacaaatagttatgaaaaaatatctaacaagttggattaatatgcagtatatcacttcacaaacacataagtttaaatttgaattctatatttttttttaaaaaaatacgattgtgagcacatgtatgctagtacaagtttattatgttccctttgttacaacttgtggattgaatttaaacttatatgtttgttgagtgacatatcaaaaatctatcttatcattttttttctaaattttcataattctttaaataacattttctcaagggattaaaatttctgaactaaagctaagatgataacgagtccccttttttttccttttttcagctgaggaaaattcattcatggaagaagtttttggccgcaagtgtagtgtacatgtgcagttgaaaaggtagttagattctgtttgtggggccccaacagtgacgtggcagtgagtgcattgcatatttgcatgatacaagggaatgattagcgtacgagtgccatggaagttgactcagcctattataaatttataataggttcatgattagtgccactgtggcatccaagtcactaatcttgtaatccacgtgccaaaattctggcataatgagacatcaaattacttaaaaagaaatcttaagaagcgtatgaaaagttgttatctctcatatatttaaataaagttacacacaataaaaataataatggttccttggggcagagagagagcgagagattttatttttcattatatgacaaataaaaataaaattctttcatgcaaaacaaacaaaaccctcagttatgcttttggttaccaagaagcactttatggtacagtgccatttcaagggaaaaagcttaaagcactaaagagtaaagctaaaaggatataccacattttttttaatcttttcatctatatgccaatcacaggatgtctcaaaactattggtgtcactttcattgcttcattttcatatagcttacatgattttgtagccagattatggaatcccacaaccagaagtcccttttctgtaaagaatgtgcatgtaatcactcaatttatggcaattctaatgtcttagagaaactcaaatttcttaccttcttttctgaaaaaaatagggaattttcataatacttcagatcagattgtgctctgccctaaggtaccctttcataaacaggcatatcataacaaaggaaaaaaaaagcagaaaatagtacaggcaacaatatgttaaaagaaaaaaagtgtttgctagcaagttgcaagaacttggtgccataggtatctaagcttgctagagcctttatatcattaaccatacatagtggccacgtatgcttgactgtggtgtctataagaagaatccactaattcagtaagtggcacaagtgcatgcagtgtaaatagcagtagctcactagtagattttgcaaatttggtggccatccttgtgtaaccctcaccttgtgtcatgtgagtaggatgccattcaccagcagaacatgcatgccatttgacctggtgat

SEQ ID NO: 1702 - DNA, 2543 bp, Oryza sativa
tggagaacagtccactgttgagactttgggaccccccgcattaagttctagcacaaatacacaaatgctttatgaatgtcgaccaaacttctcgacaagcttttgttcaatctccagccttttcttcatcaacaacgtgtagttgttcagaaggtcaatgtcctcctccgagtctccaaatggagcagccagcttaatgcttagtgatgttctattcagtctgtccgagtgcagacatgaaacaggcacaaacttgcctttctggttgcaaatccacccatgggctgctctaagagcagcacccagtgaggcagagtctgtatcaattgagcattgctatgtaaaggacacaattatgctcacaaccagatggaaaacatgataacagcagattaattcgaatccatatgtgatgcacatgtcttatatatacctggtctttggacggtgtaaaccgagcagccaaaaatggatgccatcgtcttgagaatgatctggttcgacgatgctccaccggtcgctataatccgctttggaggcactggcagaccacacctttcagcatggcccctcatggacaggaactgcccttctattattgcacggacctatatcacaactgttagtgaacagcctgaaggaaagtttattagatcgtttaacgaccagttatggaagtccccgtacttctgaaggaggatcaaactggtttatctgatgctccaccatctcatctaaagatccactggctgaggagctgacaacgtaacggtgaaacccaactacagatttataagcatagcacatgagtaatgacataaaaactacacgttgaagggaaatgaaatgtaaggtcagaaataacctggaagtggtggcagaatctcaggctcattgtagtaatatcccaattttcttcctggtacaaagaaagaaaaagggggattcaagaatcctcaggaaagctacctttatgtggtcaacgcaagtaactatcatgaatgggaggaaaggcaactgtgtgatagtaactggctaaacatcaattggatgatctacagttcaaaaaaaaacattgatgggatttaaagcataattatactggcttatcatcttgccaaaatgtacaagctttataaaacagagtttaatatccttatgctgtttgtgatttctagtgccaatcagctagcctgtttgttctagaaatatatgggctggcatccttttagtaaaatagaaaggaaagaataactatattggtgtaccatttaaaggagctgtattctccaaatgcttgttgaacacatcccatgacccgtcagcataacgattgcggacatctggtgaaaaatataagcatttatagtttcaaaaacaaaaatataggcattagtaatggtaacaagtgagataaaaagaatccaaatggtaccttcccgtgttagagagccatttttgtagcaaagcataaccatatatgtcttggggtccactgggttagggaggatgttcccatccagggatggttcaggtaaatcagttatcccaaaaacctgaaggaccataaaggcatcagaataagcaacaagggcttgtttggcaaatgggtttgggaaaagatttcccaccacaccaaagggtaaaattcaatcctagccattctttcttttcgcctcatttattatttctgtttcccaatccaacctcccataactcatttgccaaacagggcccgatggttcatagatgtacagaacaactttgtgttgtgagttgttttttatttgtgaatcctgtattcagtgtaagtacaagtaaaacaaggttcaatcagcagttagtgttattgccttattggtagataagaactaggttctaatgtatctgttcccagacattgttggtaccattgcccttgaaaacaaatggagcagattttgtaaaaacaaggtgatagatgattactgtatcacttgtcccaagactgattgctagatcaccaggatcgctcaaagttaaacctgcataatcacataggagtgatccgaaaatattcttttgaccaaagtttctggcatatgctttgaatcagatcatcttttgatttgaccaaacagacatgccatatgttgtaagatattagtaggaaaattgggagaacttatatacctgcaaggctgttggggttgtcccctgaccactgaacaactagacagttgcttgaaaactgaaatctgatgaaaaatgaagcatattcatatcagtaattcgtcgagtcagaccccaatgcaaaagtgtctgaagttagtttatacatataataattcaatcttgtagtttgatgatgttgttcactataacataactcctttttcaaacaccagtttagcagacactgtaaaaggggaggaaaacagattgatcaatggctacctctgaacgaaataaggagataaagttcctgcaacagcatgcgccggtgctagcttcccaatcttgtcttctaaatcaggagcagtagcctacaaacttgtaaattg

SEQ ID NO: 1703 - DNA, 497 bp, Oryza sativa
cccggattggtagaatcatcagatgaattgattatacgattacaaaatcacaccagcggatcagaatttatcacatttctactatatataatgtcccacacaatttatcacatttctacttagaaaatctgcatctttggggtctgaccaagcggaaatatagtgagttttgtcacaatcataaatctgaaccataatctccgatccgtcacaacagcgttagatgaaggacgttggagcagttcccaagtgtcctgtcgttgacaaagtttgagtgtgatcagcatacatactcctctcgagatgcatcttgcgctccctgtttggaagattctttcgatatttgccagcagtttggatattacatggtacatgttactgcagcgacatggttatatacgatgggcataacacacgataattaaatatcaaattacatattgcaaataataggtgcaattaaaccttccaaataatagtgtattttatagttttct

SEQ ID NO: 1704 - DNA, 10239 bp, Oryza sativa
ggatatgggtcgaccgaccaaagatggtttctctaccagtgttagtgccgaaaactatcatgggaatacttatggtgtcacaacaaattaaaaaaaaatgtaaaaacggatttcccaccaaaatagtatgtacgtatgaaaaaattgaatacgtactacgttggagacaggttggatatatgggtattgcaagccatgaggccacggtattaaatgaaaattaataatctacggctaagataacacggtttacttggtcaatgtccagatttatctggttaacacgagagcttgtagaaagtgttgaattaatatagatatacatagatagatagatatataggtaggtagatagatagatagatagatttgtagaaagtgttgaattaatatagatatagatagatagatagatagatagatagatagatagatagatagatagatagatagataggtaggtaggtagatagatagatatacatagatagatacatacaaattacttagagggcaagattatccatacatataaaatagagtaattaaattatactaatggtacacaaatttaacaggaaggtgcaacctagtatacaaacttgcaaaatattcgtttaatttgatgcacaaactagtttggtgcatgcaacccaagcccaaataacaatttcacagttatcttagtatacatgtacatgtgctcaatcaaacctatgtataatagggctgttaattatatagagaaataatatcaaatatatacactactacaaaaaggggcataggtgccggttgggaaccggctataagtgctggtttcccaaccgacacctattggtcagcactaataattaaaactggcacctatgacaattattaaaccagcacctttagcttagctcgagcaaaaaaaaaaagagagccggctcgaatggagccgacctcactgagcaccaccgtcgccatgcgcccaaataatattgaaatccccaaatccccaaatcatccacagatcatcacaaatctatcaccaaaatcgattgacatcacaaataatcattcatcgtcaccaaaatcgattgacatcgcgaacatactccaataaaatcattcacaaatccaccaaaacatctaaaaaatctacaagagaagagggaggaagagaggctggcccaaggcttcatctgcttcgtcaccggcgggccctcttgcgccgccgcccgccgcctcccctctcgccagatccggcggaggggatggcaccgccacccaccgtcgcacgccgcctcccctcctgccggatccggcggaggggagggcacctccgcctgccgcctcccctcccgccggatcgggcggaggggagggcgcccgccgttgcctgccgcctcccctcccgccagatcgggcagaggggagcgcactgctgcccgccgtcgctcgccgcctcccctcctgccagatccggcggaggggagggagcccgccgtcgcccgccgcctccactcctgccagatcgggcggaggggagcgtgccgctgcccgccgtcgcccgctgcctcccctcccgccggatccggcggaggggagggtgccgccgttgttgcctccaccgggacgccacccgactgccgccgcgcgctacactcagaggcgagagagagagagaggcgagagagacgaggcgataaggacgagactgatatatgcgtcggcctggatcagctggatcggctcggctcgatagctcggctcggtttggataggtgctggtttttttaaaaaaccgacacctataatttattattggtgtcggttttaaagaagaaccgacacctatagtataagtgtcggtttttctatagaaaactggcacctatactatattaaaggtgtcggttcttcttagaaccggcacctatagttggttaaatgtgtcggttttacgtgttttgagtccacggatgagagaaaagcattataggtgccggttctagctgtttcagcacctatagtaccgatctctatgaggttttttgtactagtgatatgaaggatatgcagtcaactgaaaatagtggatgaacaaaaataaatacaaagtagaggttatttgcacatgtagcatgcctcatgacccgcttaagcatgcggattctattctaatgtaggttccaacacattattactagtcataatgtaccattttagccttatttctcacgcatcatgcaagtctgtataccaaaacaactattttgtaagtttatgtattgcacccacctatcaagttattataccataccaatgtaatttactctatataatatatccaaataaccctaacaaaatattatgaccatccattccaatatttttctccttttttttaagaaaaccaatggtactattaaacgtaaccactacttggtagatcctaaaaataacaacttataggaatttaataggcccaaccctcaagtaattgaattatcatgtgtaccagctgatttattgcacgccactccctcatggttacctgattagtctaacagctgacaaacaatattaagccaatcaagagttgtctcgtgtgtttaatgaggggcacgatagacttttgtctttgctacttagtccaaaaattgtgaagtgttgttatattttggcaagaagagagtatttaaggatgcatgcatgttttttgcacctgtccatgcaaaatgatagcacaaattaaatgtagtgccatcttttaattagaaacagaaatgtaggattttgagaacatgaccatgcgctttatctaatgaaatagatgaggacacaactaccatgactaacttatgtattcatcaaccaaagatgcatatgttctatgttagatttacttattatatatttgaacaaacgttactacaccatgagttttgtatcttttcgtttgcagagatacttgcttgggtgaaggaaaagaaaccgagcgtaaggaatgtatggatgatcaaagaagttgattcgggaccaaaccaagatcttctccaagtctacttctacctcaccacacttttggttcatagaagacaagagataaagttttacacgttttggattcggattcggttctcctgacagcatcaacttcaaatggacctagccgctgatctagaaggaatttaagggcccatgagtactggttggaaagcttattgagcctaattttcgatggttttggtcccacgtcaaaattccccaccgagctatcgggaatctgcaaaacaagccacgcacctcatccagaccgaatctgatttgggttttgggccttataattgtgccatgggctaagcccaagggggtgtgcgccctagggcaaccctaggactccccaaatcatattcattcagtagccgtcatagtttagagtagggttttgcttagattatttatgtcattgcagtttcgctgctagttcggttagtagaaccccaaattcgagtgcttaatcattcatatgcaattgtgttgcaatctatattgttcttgcttgtgttcttcgattcgcatgcagggattagtcttcttggcgaggtcaaccgagcagtgcacggttgataactagtggagatatggtgctacaattgcagggttcggattgtgttgatcgaaagccggatcgtgtgtgtcaagtttccaccaaatcgagagttggcattgtctcttgtgccagtttgttcagaaaaagaagaatttgggcacggcaggctagatagcggtatttgtgtacaaatcaaagtgatccatgaactcaagaaagagcagcggtttatgcacacatggatgcacatggcaagcaagcaaagctataaagtatatatgtatggacataatatcaaagacatttcagttaaataggtcaatttcacttatatggatttaaaggaaggcaagcaaagctatcaagttatgcatattagaagaaatgttacagattgaacgttggacaatcttgtagctatcacaaaatacacaatgtagaacaagctgcaagaaaaaatgtccactatttttacatgagaatttaaagtttttctcttctatctttgtcaacttttactttcactgtgcatttcgattttgcatgttctgctcaaaaccagagttttaaccctttctagttccacaacataaccaattggaatctaagtgatgaagctattagcatcaattttttgcttagatattgtatgaatgggatgtgacaaatttcaagatcactttttttttctacatagctctcaagtctggtagtataaagacatatctcgcctcttgagaatgctcttgcgaaccgtaaatcctcagttttcttcaataaaagagagaaggtggaaaaatatagatgtttatgcttaaattagagtggtcataatacgtactccctccatccaaaaagaaagaaacaacttctggggacgaatctggtcgagcatatgttcagattcaaccccaaaagatagtttttttttacagagggtgtaactaagtaagagtaacactttgtatccatcgtctcgagcaaaccatttaacatctagctcaacagagttgaaaatttaccccctcaaaagaaaacagaaaaaaaacatttttatgggattttctaggcagctaccggctgttttattttgacttgttggccggaattgcgtcttcatctggcccactaggagacaattggcccaaagctctgcccaattaagaagagacgcccagctgcccgggccatgcttccccttacttcgtcacacatgtcaccatgtccagttgtcgtcctcgactccttcctgagtcgttggcttcctcacgcacgttgctgccatcattgtcgctccagtgtccccggcctccctgccagtgggtccagctacatgaggggaagaagatctgctagatgtgaggctgtgggtcattcttctcctcttcctctctgctctatccctagtctccctgccggcggatccagctggctagaggggagaatatgagttgctgtcgtgcgccatctatctctcaccacctctctctctctcttcctttgcactctccgctctgtccctggcgtccccaccaaaggatcccgccggccggaggggaggatgcaagttggcggtaaggttttgttttattttaactggattctcgtttcttgggctcgtttgaacatgacatgttagcattcttttttcaccattcttttgtgttttagaggatgcatgtcatgtcattttctaattgcaagaaaactagaagaaaatcttgcttgtttctgttagttgttacatgctcactaattagaagaaactattttttgagctcactaattacgtgctcaatttgtctgaattgataaaattaatttgctttaacttgtctgagcatgaaataagaagtttaaattgcttccttcctgctcatactatatattttcgaattaagaattctggcagcagtgtgatggtttatagctcaaaccatatgtttgaactaagaagatattgctaaaagttctgatgaaaattaaggatttgaactaagaatttgtcatgtatttttgctttgtaataataaagcatagctttgttaatatatttcagaggaaattagtagttacaatattcattagttttgttgcttctctctccccttctctttctgttggactagcagaactgttatgttttttgatggcatatgtttcgtatcagactagcagtgtgtgcaggcgtgccaaaatttagtttcttagttctctatgtagttatgtttcccagtagtaattttatttaggaggggtttagtaattctcagatattttaaaaattatcttatatgaatcatttaagttttgtgttatatatgttcagaaactacaatccttttatgtttgtttccatcaattttcaagtgctcgtcaattttatcaccatttgcaggggtaaaccaaccaaactaaagtgcatttttaattcaactctactatatatgttgtttacattgtttccagagatatatggttctgaattttgttttccaactaatagccctaaaatgtaatcattggaattattttgatctttcgtgcttcaaggcatattatactagttataatatattggcggcataaatgatccatccattaggaatggcggtcataacagggcagcataatcaaatcagattgctaggtgggtactgagcagattttcagaaaatctgcatgaaggttttgatagatttttcacaatactctatatgtactaaactaatttgtttttgttattggcattatgatgcacaattagcaacaattattatgtagtttgtgtgtttgtaaaagaggttcttgttcttgcgattgaatatatatacgtcttggtaactaaaagtgaaatgtacaaatattgcatccccttttgccattctactgcatggcatatttgctgggatttgttgcaaaggagctcatgggattcagctgcaggtttgttgccatcaatttcattttattagcacagaagaatttcatccattgatatatcccatttgttcttgagtctaacgttattttcaccattaatggacaaggcagcagctcatctcttttgaacgtgcattcctatgtcaattcctttttctgatggccaaggtctgaaaattcagtaaatctgattttttttctatttttcctgctttttctgtggtttgatgtggttatggaggatgatgtttctttgtttcaactctgtttatatttactattagattgcactaatagtcagatctctttttcgttgtggtcctagtgttcaatgggcacatgatgccgcacaactgggtgatgttcaccacaacgctctcctcctaaaggcaaattcattgtaattatatatgtttctgacccaactccaaacatacttatttccttatggcacatatgtgtcgaaaagttagcactgatcatatgtagctatattatcaaaatttcagccttgggatgttacctttgttactagtacctgctcgaatacgaagcatgatttatgttttttgttttctctagcagtagataatttttgaaatattcttttgttattttgtagttttgtaatctattaatagtacatatggttttgttagttttgtcagtaattagaatgcctcatcacaaaattttgagtgaacaatacttagttttgacagttttcagttttgagataaagttgaacaagattagcaatggttgacgatttctgaaattttgtcaattttgttagtttcgtttgccaattcaaattaaatttaaataaagttctgtctactaatcatggtactgcaagttttattagctttatattttgtcttcaattctttggctttgtattttcatagttttgtaagccatcccactattctgcacaagttagtctttttttcccatattagtgtttgtttttctgtcagttttctacattaaaaattgattttgggtgtcccatttgtaatcttttagtgagtacttgtgttagatacatactccttccgtcccaaaaagaagtgattcctggagcggagactttgtccctcaaaaaatgattccagcacaaaaatccagatacttcatctctgttgcataatctgtgggccatagtagtgggcggtgacctctcttctctcacacaaaaaaaaccttatctcttccacgcggtctctcgcgtatttctctctctcattctatctcatctctttctcgttcccaaaacgactgaatcgaagccacgacatcgtctagatgcgagaccttaccaagcttcctaccccctctgcccctccctcccacacctcccggcacgcccctccctgctccacgctgcttcccctcgctcctgtttcttcccttaggcggcggcggaggcgacaagtggatgcggcgtcggcggcgtcagagggaacgagtggacgcggcatcggcggtggcggaggaggtgacgagtggttgcagcatcgtcagcgactgaggcgacgagtggatgcggctccattggctgtggggacttgtttgcctatcatcggcggatctgatgcagttgctccatgcacgaacttgcggtgctgaaggcaaacaacactgcattccttttttctaagctgtgatcttgctatgttcctgctattgctagtagtagcagttcttatagtgctattgctagtagtagtagttcttacatgtgatttcagagaatttattttctcaattggagagatgttctagtagtatttgctttcagcaagttaaaattttcaaatattttggcattttttattttgcctcaaatgcctttgcctaaggtgagagaaacgacattgataattgaatatgcagttactaagggtatttttgtcttttcacattagtactaaacatgcattagggatctaggaatcacttctttcagagacggagggagtacatacgaagttgtgttagatacacacatacggtattgtagggcgttcaagttccaaactacaccagctgactcaactgatcccccagctggccaaccaaccatgttgtgcttgtctaatgttgtttcattcgatgttgtctctgaaggtagccggtggcacacaggaatcacaggacaatgctgggctaggaaatcaacaagattatagatgtttcgcttatattgatgagttgctatacccatgcctgtgctacattcaatttctttttgttgtaatccctatagcagtatttaattcccgtgctgcttaggaccgaattgatgagcactagccttcctccagttgataaaaattgtcctttccaactacttaaccttttctaaaacctccttagagagaaaacattttctctttctttggccttaccaaagtagaacatttcactcttatgaaaattgatttttaagcctgataatttctcataggcacctagtactattttgaggttattggcctcatcaatatcattttccataaagagtatagtgccatctgcatattgcaggattgataacccattatcaactaaatttggaacaactcctcgtgtcatacccctttcaaccgatctacttataagaattgccaacatgtccgccaccgaattaaataaaactagaaaattgtcgcgccaattggcgcgctctttttagcctgtgcttacttgtatgaacatataaatttcaaaatattttgcaggattagaccaacttcaataaattattcatttaacacgtagatttatttaactgaaaatcatcagattttaatctatttatggcatagctattacaaagtgtttttatgtaagtctacattatttgaaatatacttattttaaaaaggcttattttaatacctatgagcaacttcagctaaatattttaatttacttatggcatagcttaattttaaaatattaattatcaagtcttatcttcagctaaataagccattgtcaatttataaataagttttgcaaaaatggacatttttaaataatggtcgtactatttttttacgtcaaagaaagaccaaattgaattaatgataaaatacatatttttcttcccttcaaaatagagtagtttctagcatctaaagtctatctcaaaatatagcaattgagtatctactcacttatctcaaccgatcatacctctcttatttaatttctctacttacacgcctaatttattaacacctatacccaacttcgaccaattttatagacattataatgacgaagcatttctcactaaagtataactaacaaaaaaaactaccaattaaataccctcgaaaactttatttctagccgttctcatgcatttttgtactggggaggaatacttatgatgtccttatcaatttgtaaatccaattaaatatgtataccttggtttgattggctagaaaaatgtttttctaaagggttacgtaacaaaccttttagtatttcactgtttctttttacatcacacctcctgttattatagggaatctattatatgccactgacttgttacatgtctatgatttgccaccgattttgtcacgttctacaatatgccatcgacttttacttaacttctacaatttgccatcgccgtacggttagcctctgttagtactgtacaattt

SEQ ID NO: 1705 - DNA, 4204 bp, Oryza sativa
caaaattgtacagtactaacggaggctaactggacggcgatagtaaatcgtagaagttaagcaaaagtcaacggcatattatagaacatgacaaagttgatggtaaattatagacgtgtaacaaagtcagtgatatataatatattttctcatgttatttatgtataaactttaagcgcccgtcattttgcagggtttctataaatattgtaaaatattttacatgttaaatataactatatcatttgcatccacaatttgaaaagttgttactggccaacagttatcaatgaaaaggaggaatggagggggaaattggtaagttaagcatttattaactctcttagttagtagtatttacttatttgttgatacttatcatctggccaccagtcactgcatccagcaatccagattccagcggatagctacgctcttctgagtccattttactttcccctttttctgtcgtcacgggcggccgacacaggcggacagaaagaacaagctggcgtacttcttccttccttggctctgtttcttttctcgccatagtcatgcatgcaggcagatgttgagctgctcatttatcatgatgtgtcacctcgagcggctgtgcagcgaacctcagcgtaggtgtgttgtggccgacggaggtgcttgttgcttgtgttccagaggcgacttcttcggatttgtccagttcaagaggtcagtcccgtctcatggtgagcgatgggctaatccggaggaggtaggggaagaaagggaggggatggcgtcgtggtggctgtctgcccaccagatctggtacatgtggaggttatcagctaccatcgtccttcccttccctaccatttcccatagtgagaagttggaccctgaatcggagaggcggtcggctcaagcaaacgagcacatggaagagcgcacaagagggtttccatctgaaccatctgctttggccggcgccgcgcgcctctcgcctcctccttaggcggcgcatgtctagtcggagcaggccgcgtagagcaagcctccatcacccctcatcacccaaagcagatgccggcagcatagatcaggacaaggcggcggcacggtgagtaagagatagaaattcatttttcttgcgatttgtttctctgggatttttcttcgataatctggactcctctagatggaagatagcatcacacgttttgtaaaaaacccctctaggaacttgcaatttacctttaggtccgccagattgtttttcaccgttgatatttcatctaacggctgtgaaaggtgttctccggccgagaatacgtggcgcgttctccggccgagaattccgacggagtgcaatgagtggtgacacgtggcccaattagaggcccgagattagaccttgaaatcggtttataagattggtgaaaggggatcaccttgatgcaatcctttttttttttgtctgaatatagtgcccagtttcatcattcatctttatcgccacgcttcctcccgacactatttgctctatccatttacaccatcgattcgcaaatcctttcgtcctcaaggtttgctgaaggaacctccagcctatcttatcatatgccttttcgaaacaagcttcagaatcaccccatccaactttttcctatgcatctcgtgcaaagtttcaagaagaataatagcaccttccattatattccttcctttcaaaaaggcggtctgtgaaggttttatgacattttgtgctactagactgaccctgtttgtcataacctttgtaaagactttaaaactcacattaagtaaacatattggtatgtactgttgaattttccttgcctccttatttttaggaagaagagtaataattccaaaattcaaactctcgagagaaagattgcccccatggaagtccctaaagactgccgttaagtcatctttaattacatcccagaatacttgataaaactttcccggaaaaccgtcaggtcctggagctttattgtgttccatttgaaaaatggcaattttgacttcttcagaaaattctcttgttaacatttcattttctgtcaccgtcacctgtggtatatcgtctttttggtcctcgaacatagaaaaattatttctttcgggggccccaaaaaggttcttatagaacttagttatatacttcctaagctcctcatctcctttgattacaccctcttctaggtcaagctgaaaaatcttagtttttctatgctttccatttgcaatcatatgataatatttagtattattgtctccttccataattttctttgttttagctctttggtaccatttaaattcttcttctctcaacaactttgctaaggcctgctttactgaattttttagctcatgttcctgactagtcaaaattctcatctcggctaatttatccagctcatttgcctttgctattagtttagctttttccttttttatatgcaccactaacattcttcgcccatcctcaaagtaattgaagcagtgttaacgaccaaatttggtaatattggtatcggagaagaagattagatcgaagcggaatcaaaaatgaggatcgtcgcggaaacagagtaagaatcggctggagttcggatcagctacgatcgggatcggctaagttcgagtcagactgggttaggtgatacagccgattcggacaatacgatttggtgtacgacatcgggttgagttgatatgcttcaagatggttgccacacatggctagagtcctgagaaggcaattgtatctattaattaggatattttatgtaatttccttagagatatgtttgggcaaaagtctgccgtaaagacttatggtttcttagtgtttgttagagataagagtcgtgtccgatatggacatagtttgtaattctcgggtataaatagacctcgaaccccatgtaattaaataaacacacgttcaatacaatctcggtgcatcgccactctttttactttcgttttatttcgacgagttcttgctttcgggttgagctgcatcggtttcgatcttcacaagaggtaaaacttgttatgacggcttgcgttctcgggattagtgcttccatctttatgatactcttatcttgtttacgtaattcgtcgagttatcatatatcttgcataatctctggcaatattgctatctaatctacaatcggctaacatctattggtagagggcagccgattaggttagatatcgatgttgacttagattatataaggtatccaccactctatgaaacttccaacggcttgattgtctagatattgtccttcttttcatacttatagctacattagttgagtttgatcttatgagtcgtgattagaatctcaatctctagcctgcttcttggttgccgattagggtagtatcggagtttcagccgatcttacctgatttaactatatttgttccatatgctttagtgatatgttaaatatgccctttatatcaagatctttttgcattcaagtatatttggcttttgtttgatatattttacttgctttaatatcttagtatagagtagtatcggagtattagccgatacatgctagatctatctgatctgctatgctatgaacttatatagtttcattgttagtatatacttcgatctaattgatttatactgtctcggcatggcgaccgatctatcccaatcacttgacttaagtatatatcgacatagaaattatatattgttaatatctacagccgatcgagtagatttagtcctttattatctatttataactgccgatcgatacgtacatgacatcggctcaaagataaatgatatgtcatcggcacctagccgattggctatcctttataggtttaaccgcggtttctttgtcttcgtttgttgttgattgcaggatcaaatcaagtggcacgcttgcatacccgaaggcgagttttggacctgcactggagtttttcatcaacacgcttttggcacgcttggtgggacccattagaagtcagaatcacaacagcagtttttctccatggccgagaaaccaccagcatcgccgtcctcggctggtcctggctatgttaaagacaagatctaggagctgggcttatccgaggttgatgaagccaacattgtgcccgtcactctagacaagttgacacctgagca

SEQ ID NO: 1706 - DNA, 1469 bp, Oryza sativa
gaaaagaaagagttgtattctacttaagtcgttgactcatggatgcaaaaactagatattctcctgtggagaagttgtgcttgtgcttgtatttttcatgtacaaggttaaggcattatctattgtccaacgaatgtattgtcatatgcaaagccgatgttgttaagtacatgttatcggctccaattttgaaaggaaggattggaaagtggatattttccttaactgagtttgatcttcggtatgagtcaccgaaggctgtcaaagggcaggctatagccgattttattgttgaacatcgtgatgattcaatcggctcggttgagattgtgtcatggactttattctttgatgggtcagtgtacactcatggttgtggcatcggcttggttattatttcccctcggggggcaagttttgagtttgcttatactatcaaaccttatgcaaccaataatcaagctgagtatgaggtagttctcaaagggttgcagttgctcatggaagtagaagccgatgctattgaaattgtgggggattctttgctagtaatcagtcaattggcaggagaatatgagtacaagaatgatacattgatggtttataatgagaagtgccaagaactaatgaagaatctttggctagttactttgaagcatgtatctcgagaacaaaacattgaagctaatgatttggcccaaggggcatcggggtataagctgatgatcaaagatgttaaggttgaagtcgctgcaataacaaccgatgattggagatatgatgtgcatcaatatttacagaatccatctcaaccggcttctcggaaattacgatataaagcgttgaagtatactttattggatgatgaactctattatcggacgattgatgcggtgttgcttaagtgtttcagtgccaattaggctaaggttgcaatcggcgaagttcatgaaggaatttgtggtactcgtcaatcagctcataaaatgaagtggttgctgcggcgtgtaggatatttttggccgacaatgctagaggattgtttcaagtattacaaagggtgtcaaggttgtcagaaatttggagcaattcagagggcaccggcgtcggctatgaatcctatcattaaaccatggccatttagaggttggggaattgatatgatcggcatgattaatccaccctcaagtaaaggacataagtttatattggtggcaaccgattattttaccaagtgggtagaggcgactcctttgaagaaagtcgattctggggatgctatacagtttgttcaagagcatataatttatcgatttggtattcctcaaaccattacaaccgatcaaggttcaattttcgtgtccgatgagtttgttcagtttgccgatagcatgggtattaaattgttgaactcttcaccatattatgcacaagctaatgggcaggccgaagcatctaacaagagcttg

SEQ ID NO: 1707 - DNA, 5197 bp, Oryza sativa
ccttttgctcctcgacagactttgggagatcggctagcattttatgttccatatccagctcagcgttgcattcttcaagttgtgccgatcaataatagatttaatcgggccctcagatagctgatcaagtttggccttctcttcatgaacaagctgtcgattggcttggattgtagcttcgatatatgtttgcgctcccgacattcggctaatcttagtttggcttttttccagcttgaattggtgctgctcaagatatatagctagagtaaggacatcggctagctcatctgggattagagcatggatctcgtgtaaccgagtcctaatcggcccacagtttaccaccaagttgtctagtgatgatgcttctagccgatgagagatgtcttcaagggttttcttcacatcatcagacaagggagccaaagacttgctggtggtgtcttcttctgtttcttcatcaagatagtctttaatttcgaaagagaacagatcggctaaggcctgcaagaaggaatttaaaaacagttgagtatcaacatgagttatttggccgattcaagatttgtatagacaagacttactgggatagtaggaatagctggttgttcttcttcttcaatatggtgcctctctacagccgatggagtttgatcactcaatgattgttgtacaggggaagaaggaggaggaggaggctataaaagaggcaaatgttagacaaaatcggctgagatcaactagtaaaaaaataaagaatgtcttactggtggagctggtttgaaaatcgttgctgccgatttcttctttacagcggttttcttcttctggaactataaagtctgtgaggaatcagctataagtgaagaagttgcaaaaagaatcagaggaagttgcttacccttgaaaaatgggctggagcagaaggagttggacgagtgtgcttaggagaagccgatggagttctttcggtatcgcttactttatctgcggcttgatcaacatcctcgccgatttcttcttcatctagagcttgttcaatggatggatctagggcaggcagatcatcggttggcataggcttctttagtttggccttcttctttggagcaggagctgatgcatccacagccgatgatctggttcttttctttttgctggcatcggctggttctctgatgagcccttgaagaagagttgaagtcctgggggcatgaaagccaatgatagggggagatggtccgcctccattaggaattagacctggagcatatttgatatttctgttactattgctctggtgaggaggagaaaattctgtcgtctgcatttcaaaagaaaattagtcaagttatgaatcggctgagcaattattcaaaaaattaatcaagacatacctgagggataacgtctggaaagagatctgtcatggaagccgattgatggaatagatgcagtttccactcgcctcaccatctgtcaaatgttttgctcctgaaggtttccagctctatgttttcaatgcttcctagaggaggtccttggagatttagcagccgatacatcatcagggttgatgagatttctcctgggcactggatcttatcagcaaagaataagctgattgggagttgacccattcccaattgtctagctgagctaattgggtaatagaactcataagaaaccttgatatttcttccttgatgaatgccgacaggaaggatgcatgggctgattgcagctaaaaggacttctctagacttttggtatctttcatggttgatgtcttcaaatctaaagtctgatagattctctagaagcgatgaatcttcgtagaggaaccaaattcgagcttctttgagaaagccatcataaaagctgcaaaaccagtctttgagcagctcggtcgatagctttgctcatgcatcggttggtgtggaggtatattctccatatgatgtacacctacgatgggtgtgttcctctccatcatcatctataatcggctccagtctcgggaaatctgcttctgttacggacggccgattgacaaatttcatgactactagattcagccaagattgtaacaaccaccatggtccacctgctccgactactgagcggacgactattttggctgatgcattgtttagcatttgatataagtagccgagaaggatttttcctaaaggaaattgcttctttgtttccaaggcttcggctataaactgccaattggttgtagggccacagcttgatccacaaaagagatttctctagccacatcagtagaaaggctacacgctctcgaggggtgatagagccttgacccatgtatgttgctacataacctgaccaaccgcctatgctcttggtcatgaagtcatactgattcttcgtgttcaaactcatggggttagccaatgaggtgacatctagaccggtgatcatagtgatgtctactagagttggggtcatcggcccttggttgaacaagaaggcattgatggtgttggaccagaaataggaggcggctgccattaggggttcgtccttggctgaattggctatggtaaggtcgagtgcttggccgattctaatttcgtcccaatgaactcttttactagctgacatgcgcttgaaccacgtggtccagctcttctcgggtggggttttctcaagagatagccaagatatgaaggtgttcttccaatgacctagatttgggttggctaatctgaaaggaaccctatttgtttcaccgatgataaattcggtaggatcagggttgccaaccgggctgagaaatttgtaattttcatgcgagaggcttggaattgcaactagattggagaggtgctacaaattcaagagaatcaagaaggggaaagcaggatgaggaatagaaaaaccaatctgatccgagaaaagagatctagccgatgagaccttacctcagcatactcggctgacggcgcggtagactagctagcggaggatgacatcgtcgcgggcgaagatctggtcggagatggaatcgcctggggatcgccttatgcgttggaggaatcgtcggagagagagaggacaaagtttgctttggcagtgaaaacggaagtgacggagtgaagatttttcgggagcaacggttagtatttaaagcactggaataacggtcaggaaacgacagagtgcgaatcttgctcggagtcgatatatggaaaatccgaaacattaccaaatattccggacttggggagcatgtgttaacgaccaaatttggtaatatcggtatcggagaagaagattagatcgaagcggaatcaaagatgaggatcgtcgcggaaacaaagtaagaatcggctggagttcgaatcggctacgatcgggatcggctaagttcgagtcagactgggttaggtgatatagccgattccgacaatacgacttgctgtacgacatcgggttgagttgatatgcttcaagatggttgccacacatggatagagtcctgagaaggcaattgtatctattaactaggatattttatgtaatttccttagagatatgtttgggcaaaagtctgccataaagacttatggtatcttagagtttgttagagataagagtcgtgtccgatatggacatagtttgtaattctcgggtataaatagaccccgaacctcatgtaattaaataaacacacgttcaatacaatctcggcgcatccccactctttttactttcgttttatttcgacgagttcttgctttcgggttgagctgcatcggtttcgatgttcaacaagaggtaaaacttgttatgacagcttgcgttctcgggattagtgcttccatctttgtgatactctgatcttgtttacgtaattcatcgagttatgatatatcttacataatctctggcaatatcgctatctaatctacagtcggctaacatctattggtagagggcagccgattaggttagatatcgatgttgacttagattatataaggtgtcaaccactctatgaaacttccaacggcttgattgtctagatattgtccttcttttcatacttatagctgcatcagttgagtttgatcttatgagtcgtgattagaatctcaatctctagcctgcttcttggttgctgatttgggtagtatcggagttttagccgatcttacctgatttaactatatttgttccatctgctttattgatatgttaaatctgccctttatatcaagatcttgttgcattcaagtatattaggcttttgtttgatatattttacttgctttaatatcttagtgtagagtagtattggagtattaaccgatacatgctagatctatctgataggctatgctatgaacatatatagtttcattgttagtatatacttcgatctatgtgatttatactgtctcggcatgacgaccaatctatcccaatcacttgacttaagtatatattgacatagaaattatatattgttaatatgtacatccgatcgagtagattttatcctttattatctatttataactgttgattgatacgtacatgacatcggctcaaagataaatgatatgtcatcggcaccttgccgatcggctatcatttataggtttaaccgcggtttctttatcttcgtttcttgttgattgtaggattatatcaactggcacacttgcatacccaaaggcgagttttggacctgcactagagttaagcagatctcccaggcctcgtgtttttcatcaacacgcagtctctgaattttattttgccatctctcaatgtcctccctctaacttgtttggaccaactattgaccaccaattgatgaaagttctctctcagcaaccacccaagttcgaatttaaacaggggttggttgttcttaagagaccctttccctgtgtctagcagcaggggggtgtgatccgagggatctcgggtaagggcatgaacagacaccaatggatttttctcctcccactccgcactaactaacacgctatcgaacttctcatagattgggtttggtaaagagtttgcccaggtgaacttatgccctgaaagcttaatctctctcaaatttaagctatctatgacatcgttaaataagaagggccatttattgtcaaagttctctttatttttctcttgtggattcctt

SEQ ID NO: 1708 - DNA, 581 bp, Oryza sativa
aaatcacaacttaggtgaatgtctcttcatccataacctcatccatcaagtcgccacatgaaaggttaagcaaagaactatcctcccgatcctcctcatgaactaagtctgagttactacaagaccccaccatgattttctaccaaaagagaagccaaagcacctaagttttcaaatttgagacaaccaccctcccttaagagcaaaaccaaatcagaaactaagttactagagtcacctaggttcaaacctatatcatttaaatttctaacaacatgaggatgcgagaaagaatgacatgaattcttaaattcattacctgagagagggtcgagattcatccatgcctttttggacttagccttttcaagtgaatgtctcccgctgctgcccatcaacctctcgctagccctttttggtgtcaccaccacctccccaacattagccagctgaacaatcttttcctgctgcacccccgcctcattttcctccatttcctccctctctaccctctcatacacctcctccaacacatcttagacagccacatccaagatattttcagccattatagaaaaatc

SEQ ID NO: 1709 - DNA, 17174 bp, Oryza sativa
ttaacatcaatatgaatgtgggaaatgctagaatgacttacattgtgaaacggaggaagtaccacaaaatctactctcttgtcatcaattatttctttttatacacctccttctatatcaacatatatatcattgtctatattctccaagtgttataaatagtaatattaataatcatgccgcaggtcaaacaaaaaaggcataatcaccatgaatgatttatcttgagattaactagatgaattgtttcactagataaatatgacacggatggtatctctataataatatcctatgtcgagcaatcaattcaatcatagatatgtggcaagtgccttgttgcatttgtgatcaccagatcaatagtgtggatatcaacagcatcaatcacatatagagcgctgctgcagagtgaacaagctatggaaattggaacataaaaagcatatagaatatagaggcttagtatatgacatgataaaaagcacagtatattgaagagcggcaattacctctaccataaaggtagttacctccctttcactttatcttgcatcttgggcgaatgtgtcttgtcctagaagctagaacactggtgcacttgactttcccaaaactaattcaacactctatagattccaacataaacagaaaaacatagactccagcttcaacatcatagagtaccaactcaattaaacataatgcatagtctcaagcacaaacataaaattaaattgcataaatagcttgcaggtctttcttgcgatgaggaagcatcccacctgcaatttttattctaaactaagccgagtttcttccttctattagttcttcccataaccatcactgcccttgtcctttgtgatgacattggcagactcatcactcccctcctcgaaacatctatgccctgggaagtcaatgaagtgacttgacgatcgcctgcattgccaatggcaggaacggcgaggacagcttcccttgcattgccaatggacggagggatgatgacctgcggtgcacgctgcctcttcttgtaaatgcgacatatcatccaagaattatcaggttcgaccatggtttccaccagaggggcatgagtatgggcagcagacggactgccattgtttttctgcaaaacagttcgcatatagtctattaaggtgcaaccgtggtatagatggcatctacaataaagagagacggatgaagtgtactagtagtaaaaaatagttgcatgccagttttgtgctactcatgtactgactgaattagaagaatttggtaacttctctatgtccaattttctactccctccgtttcaggtcataagatgttttgactttggtcaaaattaacttgctttaagtttgactaagtttgaaaaaaaaacattttcaacccaagacaaatttattatgaaaatatattcaattattgatttaatgaaactaatttggtattataaatattactatattttttaaaaacttagtcaaacttgtaatagtttgactttgaccaaagtcaaaacatcttataacttgaaatggagggagtacctaatatgggcaaaggagtgtcacccccattcgattcaccaataactgtagtgatgccacttttttaaggaaaagtagcgaccaggagtacaagatcaaatcatgatctaaacatcccttaccgagactaaggggacaagcatgcatagtgttcagcaaagaatttcattaataaaaacacaaactgacaacatagccctttttgcatcccgacaaatttgaacattcaatagaatccgtacttgttagatctccaaacgtctcaggactaaggggataaaaacacatggtgttcaataatgagtttcactaataaaaatgcaagccgacaacatacccttttttgcatctcgacaaattagaatctcttatggattctgtaagtgaaaccattagaccttgctgggtgacacatcctactagattgaattatatagaatcactatgcgaaaaattgaaatcaaccctagattccaccatctcatagatcactatataacaaaatttgaatcaccactagatcccacgcaccttgcatggcatcaatcaatcaacccaaacctattggcacccctcaatggcgacatgcacaaatactctatataattataagatagtaattcctcatgtttccctattccccaacttgaacctcacagtcctacggttttatacaaataatttaccaatcatattaaaaatacagaaacaaatctatatcatatccttttttttttgagggggaatctatatcatatccaatacaatgacatagtgatgtttggatgcagcgtctcaccttggtggtggttgtttcggtgcaaccacagggaggcatggagacatcaccggtggccggcctcatcacaaggcaaggcacaaggctggcaccggcaagtcggcatcacccatccggtgcgctctgtggatgaagacttcctaaagtggaacaccagggtgcgtttcatccccactagtttttcatcggcaccaccgctgggtttgttgtatattgggacctctgtgcctgccaatctccagaacccatcaccagcggcatggttgctttcatagtccctagggtggctgttctccttgcgggtgaagaagtgcttcccattcttcttctcccctgctgctccagcatcaccaacataacaatagaaaagttgacactcaaacataatcatacaagaaattaactgtcaaaatccctacaaacgatctagctgaggagatactactgattgatgaaactaatcaaagatgctgccaaagatttgggagtgacacagtgcgagtcaaaatatatttaccgggaacgatttcccaagggttgtggcactggatgtccacatcggtgatgaagtcgcaaggcagcggctcctgcatggcacggcggtacaggtagttgacaacaagctcaccctcggtggggcggaacacacacccaacggagaggtgcatcgtggtaccgttcagcaagttgatgcaaactccaggaccagccatcgtcctagcttgcaacctacaaacagatttcgctcgcacgctcgcttgctctcgctagactcactaaaacgaatgtaagattgaatggtcccgtggggatggagatggaggctgggaggagctgtatttatagaaccaagagggttgtttgccaactcaccatattgccacctgtatgggcaactgagagtgccgtgagggggactccacttcactgttttttgtctctctatcgccaggctgcagatgggtcagatagcatccagggtgttgcaaggcatgcatccatgcagtaacacacaaaatccaagaggaagaaggtaaagatggctggggttgatggaggaatgaggatcccaacgtcagttatatcttctgatttgttttttgtgtttttcaactggtgaggtggactactctatctccttcttggagtgttattatggacaatataacagtgatgagaagaacacaatagtgctgatctaggagaactgtgtgtgcctataaggatgatattaaatgtgtgtgaaccttgttggcaagccttttaatttgtggccttattgggatagttgatacagtttttttaggcttgttaatttgcagcattaaagattgggggtggggggggtggctgctggaaaatgtgagtttaaaatccagtccttgcctcactgaattcctaaatttttttttggtgctacatgagcgcaccatctatacgtaacataggtgtagtggcagctaaagtctatgtttatgttatacatgttttctttcaatcatcttattttcaaatacatcttattttccaaaaacagttagaaattttatgaagagctccaatttcatcataaagatagcaagaggtaatgaatttaattgtagtgaacaaaatatcttcctattgaattaaaaataaaattaattatttgccacccaaacatatgtgattaactgttttgaactcaacatatgttaattaattatttcttctactatttattgtcagaggtgatcagggtataccctccctcgtgcgagctattttatcaactttttgatccccaccgagaatgaaaataactaaccacaatcttaaatgttaaagcctatctctactccttaaatgtaactaattaacccccttctcccatgtaaaagatatcaagcgattggttcaaaaaattgttactttgatcccattccaaccattccgaattacaggacccataaaatagtgaataacccatactaatccattgcgaaccacaggaacctgactagtacctataaatagaggaatataataaaaagttagaagcccaaactgccaaaatctgccactctcttccattcctccctccgagcaccgctcctccttctcactagagcaaaatcattacgtagaggcacttttgtggagacagtttttattttgccacttaaaccaagagttctatagtataaagatactttttagaggcacttttagcatattttgttaaattaatgttgtagaggcatcttttctgcactttaatatttgcctcatatgtaaaggaattttgttatggcgttttaacctctgtagaggcactttttcaaattttgatttaatgcaagaatcgtcttgcacaatatgtactgaaattgttcgggagacatggtcaaagcccgggttgaagtaatgctaaaggagatttcttgaagccaacgtccagcataagtggcccctctctggtaaggtttgaaagttttcaaaacgtaaatcaaatgatctgaatcaaaatgcctcatcttgataaattgacttatttctcaaatgacatgaggtggagatggtaagtgtgttgaagatattctcaaaattcctctacaggattctagaggcattttaaaactgcctctagtgttagaaaaatgtctctacgaagtattttttgttgtggtgctccttattagtgcttcctctacaccatgctatgccaatggtgatgattgatggtgccagagatgtagtatcgtcgatgccatgccgatttccatatgttaagtaggtccttgttttccatggtggttgatcatcttggatagcaactgagaccaaggtatacagggggcatgatccaccttgttccactcacgaatgttaactagttgtgatcagaggcatcctaacgtcctgattgggattacccctgagttcgtcagcgatataaaaacaacaggagcccgccttgtggtcaagtgaagacctctccacttcccctaattccttgataaagcctaatatcatcgttccttagctaatgctggatgaggcttgtagtgcagttctagggcactgaaagtggcactcagagtgaaaccatcacccacttgtcgatcgctagcattgcctaggggatcaagcaagaaatctcatactcatgactcatatatctacatcgacaccaaaagaagcagagaaggagaaggaggtcgcatccatagatttaaacaatgttagtcagtttaatcttctctttcacattatattaaggtgatgatgttaggctaagcacatctttataacatgtaaaaccaatgagttgatttagattttgcggtgaaaattttggtggtttgctgatgttattttggagattttgtagacggttgattttgtgaagtgaaggtttttggttgaccctggcggtcagaccagccgggtgccgccggccagactgcaggtgttgcagcggtcagaccagccgacctgatggtctgaccggcaggattcttatcgtgttcggtttcgggttgtcttgttgtatttagatgtttcctttggggatttggcttctagatggtttctatgcgtatggatactgttgttatactaatgtgagtcaagtagggacgaacttgtgcttggaatatggtttcttcgttgttgcatgtgcaggtgttgcttgaggcctcgggagagtattgccggtgatagatcggagtcgacttaggagaagttgatgtccatggatcaagagatcatgcgggacactaaaaggctagagagcaatgcacgtggcgatgaagaatccatatggtatacaagagggattgtaatcgtatggaaagaggagtcgaatttggaagggagtccgaatttcggaaagattgattgagataaggaaagggataagttggatacttgcaagagaaggtttcctacatgggttaggcatcttaagttatgttagattcgtgggctttgcacagtctaactcatgtataaatagagagggagggtgaggcctcccggtattggttttagagagactcgagttgagagaaagttaaggtttcgagtttagttcgagattttggtgaggggtgctgttggtgcactttgtaaacactagttgatgcaataaagtcgaaagtttcaatgtacatcttcgagtatgtcatctaccggtgtttctaggtcttgatggtctaaccacagatgtacgcgttctaaccgatagcggtgttctaaccgcaggtgattgggtggtctgaccggcgaggcttcggtggtctgattgatggcaggagggcggttcgactagcggcgacaggtctttgtcatctactccatttgaggtaaatcttttatcccgcaaaagattttgggtttttggttttctctaccattcacccccctccagtaggtttgtttggtcttgtgcaatcctacataacattgattataaactcacattcctcccctgtagccaccatagtatgagggaagtcagcaaaggtggctgatttgagtgcatgagatgtagaatgagagggcttgggaacagtggctgacatgagttcatctgtgtgcgggacagcgcacaaacatggtcctcctcccttcccattgagggccacactggtagtttcgtccatccacttttatcctttttctccatgtaaaagatcgacgccattcaagaagtagttcaaaactgtggcctacgcatacacaaaaaatatgctaggcctaggcatacaaaaaattaacttttgttatcaattattttttgtatccatctccatatatatcgtcatctcattctctacatgtaacccatactccgagtgtaatcagtaatattaataatacagcagcagctcagacacaaaagatgtaataatcctctcaccgcgaatgatttgcccaagattaactatatctattatatcactacatgtgattcagacggtaactctgtaataacatcccatgtccaacaatcaattcgagcccaaacatgtgctatgtgacttgtcgacacacgtataccacacgcatatgtgaatcgatcacatgcagcagagtgaacaagctatgcccatggaagaaaaaaacacaaaagcacaatatattgaagaagggcagttacaacagttacctctaccaggtaactacctcccattgatcttgaatctggggcgaatgcgtctcatcctagaagctagaacataggcacactttactttccccaaactaattaaatgatatattgtctacaacttaaacagaaaaacatagactccagtttgaacagcatagagtactccgacttaattaaatagaatacatagtatcaagcatgaacttcaaattaaaacacataaacaggtcataggtctttctcgcaccgaggaaacactccgcttgcaatttttactggacacagctgagtggcttcctttatttagttcatgccatggccataaccatccttgtcatccgtgatgacatcggcagacacatcactcccttcctcgaaagatggctgccccaggaagtcaatggcaggaagggcgagggcgacttcccttgtattgccaattgtaggaagggcgaggatgagttcccttgcatcgccaatggatggagggatgatgaactgtggtgttcgttgcctcttcttgtagatgcgacatatccgcaaagaactatcaggttcgaccatggttttctcaagtgggccatgagtttgtccagctgatggacttccattgttttcctgcaaaacggtcgacatataatatgttactagatgctgcttaaggaggaaccatggtatatatagcatgtacaacaaagagagatagatgaaatctattaatagcaaagacatagttgtattccagatttgtgctaatcatctagtgactgaattagaaggaattggtatcttctatgtccaattttcttccatatatgggcaaaggagtgtcatcaatctaccatccggtttcaccaataaactgtagagatgtcactttccatgaaaaggtacagaccaggatcaaaacatgatctgaacatcccttcccgacactaaggggataatgatcatgcatggagctcaacaaagagtttcacttataaaagcgcaagccggctgcatacctctttttgcatctcgataaagtcaagtatcttattgatcccataactgttatgtctctaaacaacccgggacaaaggggatagccacttgtggtgttaaaaaaagagtttcactaatgaaaacacacggcgacgacataacacttctcgcgtcttgacaaaattgaatatcttatagatcccatgacagttagatctctacacatcctgggactactaggataaccacgtaatgtttaataaagagtttcactgataaaagtgcaagccgacaacgtacccctttctgcacatcggcaaaattgaatctcttattggtcctttaattattagatcttgattcatggaaaaatcttatttattgtaattagatcttactgaaatatatagaatcgctatccaaaaagtcaaatcaccttttggttccagcacctgtaggtctgacatcataacaaaatttgaatcaccactagctaggtccatcctagaccttgttgcaccatcaacgtcaacatagaaaaatattgttcttataattataagtttgtaattcatcatgtccatattccccaagttgaatgacacagttctatgcttgcatgtaaatacttaaccaattagattataaaagtagatcgattctatgttatatccaatatataggcacggtgatgttcggatgtgtagtgtcttaccgtggcgatggtcgttcctgtgcggtggcagggaagcatggagccatcaccggtggctggcctcgtcacagggcaaggtataagggtagcaccagcaagtcggaactcctgcatcacccattcggtgcgctttgccggtacgtaagaaatgtccgcgtaggtgggacatacccataggctgacggctttcattccgccacgcaggtgtcttcaatcgagcgtccactcactagcgtttgctgatattatcggctacctctggagcctactggacctccagaaacccatcaccagcagcacggttgctgtggtggttgccaaggcgttcgttctcctcatggatgaagaagtacttcccatttgtcttctcctccgctgctccatcatcatcaacccagcagacaataaattaactatcaaaacaactgcaaactatctattgaggttatactacagattgatcaaattaactgaagaagctggcaaagttttggattaatatatctaatgggagtaagcctgtgtgggtcaaaaaaatatttaccagggacgatgtcccaggggttgtgctggagaatgtcgacgttggtgatgaagtcacagggcaccggttcctgaatggcgcgacggtgcaggtagtggactactagatcagcattggtggggaggcgcgtcgatgtaccattcaccaagttgatgcaaactccagggctggccattctcctcaatcgtagaatacaaatatattccgctcactctcaactctcaaatgaattaaagattgaatgatgctattgtgatgaaggtggagggagggaggagctcttatttatttacccaagaggggtgtttccaactcatgattattgccacctgtatgtgcaactgtgaatgttgtgacagagactcaactctacgatcacttcctctttctctatctccaggctgcagatggtgagatagcatccagggtgttgcaacacatgaatccatgcagtaacacacaaagtccaaaaagaggaagaaataaagatggccagggttgatgagggggtgagaatcccaatgtcagttatatattctgttgttttgtgcttttcaattccttttgagaagctctctctctctcgctttcttttttgtgtttatttgggagaagataacagcaatgagatgagcacaatagtgctgactaggaaaactatgggcgcctactaaggctgggattaaaagtgtgtgaaccttgttggcaactggcaagcttttttttattttggccttattaagtttctagaataaagatagggggtgcaggaaaatgtgagttcaaaagctagactatgcctttctgtattcccaattttattttgagctatatgagagcaccatctacgtaaagttggagccggccgctgcaaggctaaggctaagtttatgcatatattctttgaaccatcaaaattttcaaatagatctttccaaattaccagtaatgcatgtatgatgagttctaaatccatcacaaagatgacagaaagtaacaaaattaattgttgtgaataatgagtggaccatatctctgcgtggattaactataaaattaattatttgccacccaaagatatgcagttaactatttgatacttacttaattgttgcttctacaatttatttattgccatcggcgctcagggcagtgatccgtatactagtgacaccgttttagcacttgtccccccatgtgattgaaaataaccatccacaattttaaataatcaagcctataactgtaattatctttttagaaaacgcatgagagttgcacttcatttcactaagaaggaaaaatacatatacatatatatacctataaactgaggagtataaaaacttatagaagccctaactgactagatctgtcactctcctccatcctttttaacctttaatcgagcaccacctccttgctctccctccttcccggtgcttcctccacagcatgctgtggccatcgcgaagatcgatggggccagggttgctgtctccttgatgccatgcctatgttatgtaggatattgtttttcttgttggttgatcctcttgattaacaaccaagaccaagtcacaaggggcgcattgtccatccttttctgtcatgcttgttggttcaccatgatcgggagcagcataatgtcctgattgggatcacccccaagtctatgagtgcaataaaataaggagagctcagcctgtggacaggcgaagaactctccacttcctcaaactccttcataaaccataccaccactgatcctaagcaaatgctagagaggacccatagtgtggttctagggcagtgcgagtggcacctatggcatcatccgctcgtttatcgccagtttcacctatggtatcaagtaggtatactcacattcaggacatgcacatctacaacggcaccaaaagaagcagagaaggagacggcggcatccatgtcctcaaacaatgtatgttagtttattcatcttttccattgttccacattatattaaggagatgcgtggtggtgagcctagtagggcgttgactgtaaagtatgcctaggtggcagagggaagcggatgtgagtgcatgcactggatagtgtgaccttgggtttcaagcagtagccgccaggtaccaacaattgcagtgctccagaccatgtgtgtggtggcagggtgctaggcaacatggtttgtgcaccgtgaagcggctagtggaagccggtggtctagtgacgtcaagatccaactgcgcatgtaggcacccctaaggccctacctctccttcaaaagtgcatgtgtgcagcttcatcaaattgatcaaccagctttgccggcacctctcctcctagtggggctgtcataaatgtgtcgcatccttactcagcctggctggtgccgctatcaccgcctctccaaacctcacctagtgcccgacgaacatccatctttccctcgtctagggttggtcactgctgtgctgttcacctagatcagcggccaactccatcttcaaccaagccatcatcaacctttccaagcatttaacctctgctaccaccactagctgcaccaagccaccaaccattgggttcagagcagttttaccgtactccaacttacaattggtctagcacttggttattgtatacattttccaataaaaaaatatttgctcctttcaattgatatatcacaacagaataaggaaatattagcacctattatttacccttcccaaccttaatcatgcacgcaggaaattaaggactataactttggtagcctatctatattgatatgaagatctggatgcccattaatgcttaaatttaatgtgtgaaatcacacgtaaatatatttcaaacagcagcacatcgcaaacttttcactctatatttaaattaagagttgcacattagtttttcgcaatgtctatatatttttgtattctcatatcagatttgaaattttgcattttccatttgatcgtgattgaaatgccattaaaaatttgcattcagggtaaacatataattaccatggtgtatttgtaaattagtacagcataaatatttaatatcattttataaattactccacttaccttattaattgtgttcctaataatgaatattatccctgtccttattacttttggaatgtaagagactgtgtccacagttggaccttagtctaatgtacggtcagagaaaaacttggagcaccttaagaagtgacggtactagtacactaacttacctctaaatttagggacttaacgctgaagctatgccacaaaattcacacttgtcattaatttttattattattcgttcatctatattgatatatcattcaaattcggtataacacataggtgttccaacttaatatatattactcctaattcacataggccacaaaatatatagaaaatgctctcactgcgactaatttgcacagcatgaatcaatgcttgcttcactataaataaatacatgatatggatgacaactctgttacctcccatgtccaactatcacctcaagcccagatacgtggtaagtgaatttgtttccgaacacttggtaagtgaattctggacatgcatttcacaatgagcaattttacggtccttaaggaggtaccatgaggtaccactttttctattgtaaatttggtacctcttggtacatagatactatgaggtaccatgagataccaaattttacactaaatttttggtatctcatggtacctcctcaaggaccgtagaattgatttttcacaatctgatcattattaatgtgtgtgtttatgaacaacacatatcaagtaacatgtagtacagagcaatgcagctcactcgatgcaacatagtgaataaagtatggcaacggaaatggatatatagaatatagatagctggctagaatgacattatgaaataggacaatatatatatattgaagaaaggaagatgcaacaatttccagaaatgtagctacctctctagaacttcttgcatcttggacgactttgttcatcctagaacccaaacacgcttggctttcttgaaactaattaaacaggacagatacacttcaaacttttattaaaaacagcataatctccagatcgaatagcttagagtactccaacttaaagacaacacacatagttctccaacttgaacataaaagcacatatataggatgcatgcaggtcttccatggaatggagcgccatacttgcagtttttattcttgagactcagttcacttccttcacactcgatcaatttgcttcattcatgccatcaccatccttatcttcaccatcaccggcagactcatcactcccttcctccaaagaggaggggtcaatggtgcagctatggggcgaggatggatcattgcgagctggctgccccaggaagtcaatgaagtgaagttggccttcccttgcatcgccaatagcatgagggatgatagcttcccctacatcgccaatgacaggagggataacaacaggcggggcacgctgcctcttcttgtagatgcagcagatcacccatgagctatcgggttctaccatgattctcataagaggggcagaatcacgcttggcacgaagagttgcagagagaccatcacttttctgtaaaatagacaccattttgtctgttagtggatctacttaaggtgcaaccatggtatatacaacatatacaacaaagagaatagatgaattgaccattatagtaaactagtttataagcctcttactgtgacaaatcatatggggactgaattagaaagatgtgtgataacttcatgtccagtttgaatgttgcaactaatttgagaagtaaactgttgacatgtcacttatataaatcttgtggcaatgatcaaattaaaaccagatgtacaaatccaaatatcccagtatcaagtgtatcatgacacgtggtgttcaataaagaggttccctactgaaaatgcaagtagacagcaaacccctttttttctcaatatatttgaatcactagtagatcttgtaaccgctagatctcgcttcacggcaaaatcaattaatcatcattacatcctagtaatacataaggaaaaccatgtgaggctatgacaaattcaaatcagcaggcccaccacctctagattccttgtcacgacaaaatttgaatcacttctagatcccgcgcatcttgcatggcaacaataaatgaaccctatatcaagcgtcacgtacccttagtcctaagatcgaaaacaactacccttcccttatttaataaatcaacacaagagttatagtatatcatcacgtatactaagtcatcatattttccccattccctaaagctaaaactcataatccaacctatccaaataattgagcaatttaattcaacaggcatttagatggaatcatgataaatggaacagtaaaatttttggacgtagcatctcaccttagcgattgtcgcttcaaggcagccacagggtggctctgaaccattgctggttgcatgcctcatcatagggtgaggaaggagaccagcaccagcaagctgaaactcatgcatggcccattcagtgcgctctgcagatcgtgactttccgtagtggaacactagagtccgcctcatcccaactagcatgtcgttagcagcaccttctggtttgtaatagatgggcacctccgagcctgctgctctccagaagccattaccagcaacacggttgctacggcggctaccagggtacttgacctcctttcttgtgaagaagtgcttccctttctccctctccgccacttcatcatcagatcgttgccaacgaacaaacgaaaaaaatgataaacaaaacaagagaataaatatcgtcaggacacacatgcaattaatcagtcaaatcagagatatatgcagacggatgtggtaataattttcatagaagcaaagaagtgcatatcaaaattaacctgggacgatgtcccaggggttgtgatgatggatgtcaacatcggtgatgatcgcacagggcagtggcacatgaaaagcacgggggtagaggtatttgatgactagctcatcgtcagttggacggaaccggaaaccagggaggaggtggattgtggcaccattcaccatggggatgctaagtccggtgttagccatcaccctagctcacaaactacacaacacagagatcgctcgctcactcgctcaagattcaccctagacactctagagaacgaaagctcaaaggcactgcagtgatgttgatggaggcaaagagggacaatatttatagagcccaggggacacccctttatcagatggatgggcaactgtgagtgacgtgacggagattcaacctcactttctccctttgcaagtttctggccctcacacactccctctatctccaagatatggctggtgagatagcattgaggtttgtgttgatgggatgagaatcccaatgccatgttttgttcagttctgtgcttttccattcttggaagctcatacaaccggttaatttcactctacctcacttcctatttggtcttttatgggggctagagataactatgaccagatgtgaacaaccatgctgactaggaaaactgtggatgcttattgaggctgaaattaaaggtgtgtgaatgttgcttgcaagcatgtttatttgtgtccttatttggattgttagatagctttttggggtttgtttcctagtaaaaagatagggggcttgtgttggagaatatgagtttaattggggtgggaccacaaggtttgtgttgtgaagaatcctaacatggaggggtagacatgaaaaaaaaaggaattttccttctaatttttgcattgttgtccctaaattaaagtttatctatttaatgttttttgggtattaagataataatatttcgtaatattgatagaaaatttgcaacagtttgtcctagtctctttttttattcttaccattttcattagtaatattttattttgttattattcttaccttgcactaattgtcatatatagttattgttgaaaatttgtattgggtaaaaaaggctacagacatattatacatattgtgtaccaatctaatcttttcaccctatagtaagcattcatttggttaaggttaggtactatagagatcacaccataaaaaatggtccagtagtatagatctttttgacagaactgtaaaacttgggctgcatctttatatatacagatggaaaggtctactagaatccatacatattaatctaaaacataaacaagatataaattctctcattaatcagaaaaactagaaattcccacattacatctaaaggcaaattttgc

SEQ ID NO: 1710 - DNA, 2550 bp, Oryza sativa
caaaaaattcaatactattaatacatgccactcatggctgaattttcatttcaaattaaactgagatttgcattctcaaactttaatggtgggtcgttattaatgacttagatcatgtccacatattccctctctcatgcttatcatgaggtgaaaaataacggtgtaatatgtaaaatgttattttgaagatatagctggtatgtgcaatcttctcatattgttgtcttagaggtagggcatgaagttcagcattatattggtggactacggcaacaaggggttctaaaaagatgacaggttgtcctacatggatgcaagagctgtgacgctataaattttgatgaagacagtttgtggcaattgattgttgggcttctatgcatttgaatattgggctcatgaattgtagagcttagtcactactacatattccatttccataggcagcaaaaggtggttttcacatgttggccaacaagaccgcctgtgagcgtctataaaatggatatttgcacacgcggccggtccaaccgcatgtaataaaccatttactcaggcagctatgtaaagtaggctagcctgtgaaaagaatttttcacatacggcctgccttactaagataggttgggaccaacatatataaatttaagcattccaatcataacaagtataggataaccttttttaatgatgatagggaagtagcatacaccaaatactattgtgcatactaggtctacccacataaaaagagtgagcatgcatcaacaaatcattgaatttttgaagctacggcattcattacgtaaaaatgagcaaatagttccgcaacaaggcctagtaaagagctgtctatttcaaacaaggtagagcataatctaaagtaatgatagcaggtaaatgagctagtctaaaggagtggtacagtgttgatgaaagagactggtctaacaggcctagttgagtcatgatcttacttggggatttaaaaggccctggcctaagtgcgcaacatttcaatgtgatggaagagatgatgaatgatggaaggggaatggatctaggagagagagaaattgataggcgttgatgactgctccaaacattgcacatttttaaaaagccagcctttatacagactgatacattttctccaattgggagggggctttcagtccattttaatttatcttccattcttgcgcatgaaatatgtcctaactagcccctctctatggattgagcaagctgggctcaaatacactaaaccaaatatcatgtgttgagccttgtacccaaatgaaataacggacaagtatatgacaacatctctaactattcttcttcaatatttatgatcagaggaacaagtatgataatgaattacatgcattactttacgaaatgccacaagcaacctagtggtactgatcgttgtgggcaatatgtttgtgagtttgttgggttggagtgaggtacatgatgaaccaagacaagtatgcaaccatttttaattgaacaatggctattgattatattgttctctattgtgactgtaatgttatagctctttttgttgttgtttcattgcagcggcccgtagatccaaccagtggagcactcaatgataggcatattgctgtcatacaaaatgacatgtgccggttcatccaccataggatttgcaacaagagggataaatattttgactatgagaccaacgttgcctcgcatgagtcactttattgttgggaggtagggatgcctacctatgtgcatgacactcaaactattgatgttatttgattttgaaacatgataatgtggttgcattgtgatgtaaataatcatgtcattggattgtgatgtgttgtaaatagaggattgcatccaatttctctgtttgatatatgtggtgggataatgatatgaattatgagatgagtcaatacaatgtgtaatgaaacatctgggtactgatgaataaagaaataaataatttctgcatctgttcaaataaaaacaaaggtggttcacttaactgaactgcccatgacaaacaattttcgcatgaggtttggcgagtcgtccaccttgaaaagtgtttgcacgggtggttcttttaagtgagctgcccatgaaaagatgttccatgcatggttatcttaagtaaaccacttgtatcaaggtttctccacatgcggctgactttccacccttgtaaatagctgattttcacatgccattgattgcaggcggttggggaaacacctatataaaaggtttatcagacgcctccacaaatgttttctataccaatgtaaggaatcttttgcttcaaccaaagtagtatattacaaaatttttgtaatagctacacaataccaacggtgtggatcttgctaactagctatgcatgacttggctacttagcaaaaagagaaaagaatttgcttaagctgtctatcaatagtttgcgtgctatccttagaaccctctatatattcctttacactacttaaaagaaatatacattcaaacaacact

SEQ ID NO: 1711 - DNA, 13026 bp, Oryza sativa
  unsure (1)..(13026): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactaaagataacccatgtgcaccagcaaaacgcttggaaatgaaggaatgggttgcaccagaatcaaacaatattactgccggtgtcgagttgacggggaatgtgcccaatataacttctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggttgaactgattgagctggaatctttagtgaactcggagtagggttgagactgtgctgctcactgttgttgtgactgccactatggtggttcttgttgaagctacccgggtggtagggacggtgctgtcggataatcatggtggaaggtccaccgtgacgtcccatcgtgaaacgaggcttctgactcttcccctggggagtcctgaactgagctgccttcctcttacggtttattttgttacagtgctcctcctgacggatagccttatccaccagcttctcaatgtcctcataatctctagagatcaactggttagtcaattcatcatcaagacccgacaaaaacttctcctgcctctcggcatcggtacgcacgtcctcaggggtgtagcgcgcgaggcggttgaactcatgcaaatactctataactgttctggttccttgttgcagggaacggaactctctcttcttttgtgccacaattccctcgggaacctgtgctttattgaaactatgacaaaactctgtccaagtaacttctgccccagctggacgggtcaccatgtagttgtcccaccaaacagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaggtgggcggcttgacacgaagaaattctaacagtttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggtggtggggacggactgttgtcagatgcaccgttggcacgtgctccattgatcggctcttcactgccactggcgttgttcgagtcgcgtgaaccattccttatctccatctgaaggggataggtagaaatatgagaaatggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaatccgactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacatttttcatgaactcaaataaagacactaatgcaagtaaacaataaattaatgcatagactagttgcatggaaaatgatgcgcataacattgcccccatcgaatatagacacgacctaatgcataacccccaataaattcccgactgactatcgaataaactccaactaaaatttttctaaagccctagactgagctaatttttttttttaaaaaaaatccgatccgaaagaacgaccaagatttttcctgcaaaccaaagaggcaaaactccaaattttcccgaaacaattccaggtgcaaaaaggcatatgcagatgaaaaaggggttcagagggctcttagggtttccagttggcttgtcctacggtcaaggtcggctctgataccaacttgtcacgcccagaaattctcaaaccagaatttctaagctgaatgtgcattaaatccctgtccaggaccagccagggtacacaaacggcaattgttgacatacagatccacgtcttacaaaaatagaaaagattacaaatgcagcggaaaagatgaaagcgagctaaaccgggaagcttgacttcagcagcgagcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaattgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcaatgtattttaattaactaacaccattgcggtggcaccaatccaaagctatgctcatagacaaagtctatgtaataaagtgatccccatttgtgtgctagttgaactaagcatggctaagcatttcctaaaccaacatctagtcattttgatacccaggttatcaatggcatatggtaaacaataaatggctgagtaataggacccatcccacatgatattgtaaaagaatgcaacatttaatagaaatgcgggatatttgtaaattgggtacaatatgatcaaacgtattgcatgacttgccttgctctcgcactgatgagatcacagcaacgtcttcgagaaactgcggatcgacgaaacggccgaaacctacgcgacaaacaaagcacacaagcaaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcatccaaggggggggggggcggcgggcaccgacaggcgtgccccatgggtcagcggttcaagagaggggagagagaggcgccggcaaacgggcccactaggcagcggctcaaagggggtcggtccaccgtggaccgggaccacgcgggtggtccaccgccggtccacgggaccgacggtccagatcggccgggagaccgatcggacggcacggcggcgactaggcacgactcggctcggcttcaaaaccggccggccggccatggcgaggcgacgacggcgcacgaccgccggcggtgcggggagacggcggcggacggcgcggaaggcggcggcggacggccggagcggcggcacggccaaaggcggcggcgcacgcgtggaggggagaaaagggagggggagggaggcatcggccgggctcagctcggcctcaaggccgaccggggcgaggcggcggcgaggcacgaccaccgacggcggggaccggtgtcgcgggaagcggcggcgacggccgaaaggtggcggcgcatggccgaagcgcggcgatgcacgtgcggagggcggcggcatgcacgggagagagagtaaagaaagaaggagagagaggtagtcctcaccggcgatgtgggggaatcggggtccggcggcggcggacggaaagcgagcggcggccgaggtagctctcgcggcggcgaatctagcggcggtgattgcgcggcgaggcgatggctctagcgacggcagcgtgcggccggaggcggcggcaagcggtggcgctagcggcgagcggcacgggctcgttaggagacacgggaggggacggcaaatgggggaaacgagagaggggactcgggggagggtttttatgggtgagggaggggcggaaacggccgggaatggcccctatttggccggcgatgtggggagtggagggagagagagaggggtgggattcgaaatcgaatcccgccctctcgagcgcgcgcgcgggccgggagatgcgggggaagaggcggcgacgtggggaggacgcgggagcggcgcggcgtgggcgcgggaagagcggaggaggcggcggcgtggcggattcggcggcggttgccgtcggaggcgggtggctggaggaaggggacgacctgacaggtgggccccacctgtcagcgtcccggagagagggggaaggagaacgggccggcccacaaggggaaggccgagcgggagagggatgggccgacggcccaacaaaggaagaggagggaaaagaaaaaaagaaaaaggattttcctgggattaaaattgcactttggtgatttttaattggtaaaaattatttccaaggctctgaaaattccactaaaaatcctgttaatatattgtgacatgtggaacccaagaaaaaatcccacaatgccaattccaattattaattgcatttattaattatggaattagctctaggttaattaagataatttcttcggacaatttatttagccaatttttaaagctaggagagggggaaacttcaaggcgtgacaggtatcgccgtggttcgctccgccgctcgccgctgttgtccgccgtcctttccggctggcgtcgtcgtctacctcccgccggcccgcgtggcagccacgtaggtgccacgtcagcgccagctcagccgaggtcgggacgggccgaccccggtcagccccttccgtgcgcgtgttccaccgcgagccgtgaggctgcgcgtgggcccgccgcatccgttcctccgcagaccgcgcgcgtgcaccgcgtccctcccccgcccgcgcgcgtgcgccgcgtgctccctccgcacggtgagccgagccgctgacaagcgggtcccacccgggaccgcgcacggtgagcccggtccaccggcccactctctcctcccctcccgcgcgcgcgcgcttgggccgtctttggccggccggcccatttagctcggccggaccgccccatctctctcgggccgcgccctagccgcccgaggaaaagtctaatttccatccctcttttcttttgttttcttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcatgttagaggtcattaatagggctttattttcgccgtttgttgagttgccccgtttcgcgtgtagtttcggagcccgaagacccgcagtgcgaggatttcgaggatcaagctctagatctcgagcaaggcaagccacctttgaacatcttgagcctatatttgaaatttaattatgttgcttgcaaaatattatgcatcgataggatcgcacttaatctgttgtcccgtctgcaaggcagattggcggacctacctaacttgttgcatttgatccttccattgttaattgctataccatgtccccttgtaaccatccagttgcgcctcgatattcgtgcactctgtgcgagtatcgacggtcaccttcaaacttaaaatctgagtaacaacttgggtaaaactggagttttacaaaagacttggaaaacccgacacctgggtcggcgcttgcgaactaaaggaatttccaaaaccgcggaccggggaacgtaccgggtgtacggtttttcccgctctcgcacttaaggaccgattccttggaatttcatccaaacataagacaagtacgaccacatgggtggaatgggacacccctggctgagtaactagcttatcaggggagccttgatgtcgagagacatgtggattcgccggggtggtgtcggggaggacccctgggcttcctggcacagtatggtctgggacctaacctgttgttggtctgggacccctctcgtcggcatatggtaaacctgtatcggctttggaaatgccttgtcatgaaagtttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagtttgtttgactactgcttgtgaaattgctgttatggaaaggggttcgatgtttgaaaaatctgcagctgatgggatcagctaggcccgggtggccgtttgaaagttgtaggcccgggtggccgtttgaaaagctgttggccgggtgccaaccttgttttaaattttcaagactgatacattgcacatactccgaccggacgagacgcactgtctcatccgtgtcgtttgaggagcactcacttagttgtttttagaaaagagttcaactaaaatcaattgcaaaaacaacagcctttccttgaagcctgcattaaacacttatttcccatggcttgctgagtactcccgtactcacccttgctctatataaataatcccccccagttgctgaagaagatgaagcggatcctgctgatgaggagttcttccaggagcaagccggctacgatgagttttagggtttcggcctagttctcaagtcgcgcctgtgttgtttggtcctagtcctggcttccgctttccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagttccagttgggactagttcggggcgtgacagatatttttaattattaatagcttttttcattcttttcactttcgcagacttcctttaaatttcttttatttgatgcaaatgaactagcaacggatgtataccgcggaccgacggttgaagaagtttattgatggctatttttttaggtacccatttctagtcatgaattatgcgtaccgatagcacaactgggactagaaggggttgctaaccggccagtactattgtacacttctccagcagtacacatgcagcttagagatgctatttgacataggatattaggcctcttgagcaaaaagaatacaattattatatgggatctaatgtggatcactatttatcatctatgtaatcgatcaccctttagccttctttaattaaaggatgtaaaggacggtgtaacggtgtttatttatgcagatcgaaatccccaatgttgataattctatatattacatatgtacaaagagaacactacgacagaaacaatttttcctgtgtgggatggccagtagattgtaggcgggccataactactattgcctgccaaaattgctcccccgatgggtgcttcaagggtcgcagcgaaaatatattattgcatgcggtccattaagagaccagtctaaaaaatagacttatttcttaattcttaagaaggacctcttaagcggttgcatgggaaaatgcattattttcatggtgggctagagtgggaccgcacagctgcgggttcaacggcgacgacagcgattacgatagatccatagcttctctctcaattccatctgggtggcaccacgacagggatccaccgctgagcagcctcgcgatgggcaaatccactgctatcggccctttgaccggtagatccaggttgctgccgccatcagggtatggaggggcagtggagaaggttgtggaggcgcagggagaggtgaaggcggcctcagtgatggcagcggctacaacgacgacgagctgtggagactcggcgactgcgacagcaacgacgagctacaatgacaacgtcaccggtgaatgggagctagctagggttttggattttggtttttttatttttttcatgatttttctttttgcaggcagacgacataagcacccgttggcaaaaaatctaatttttgcatgcgagtgcaccacccacatggaaaaattatgatttttatagacacctccgggtatacggatggccaattactgcatgcaaaaattgggtttgggcgcatacaataatgtttttatagtgatatataaaaaccattaattacatcatacaaaactagtcaaaaagctgtggcattattaattttaattgttgcaaataaataaacgacctttgttgtatatatatcacaaagtgatcctattataagcagtacatacaaatgaattattggtttgttgattgagtcgatcatgtgtgcatagtggttcggacacccgaagttatatatatatagtcccgattatccaaaacataaaattgatatcctaaaaggtcaggcagtgactagagggatggcagatttatcagtactaggtccttttatatgacataagcgaatgagcctctctatctgagttagttaggtgactctagtagcactcctcgggtcctgggttcgactaccgtggagcgaatttcagactggggttaaaaaaattctctcgcctattccatgccaaagcacaggtctaaggccgtcgttggtcattctcacatgggctacagtaccgttgtataagggtgcaagggtaagggtttagggattttcactactagaaataatattttttcaggtggcccaaaaccattttcgtaggcgggggagaggaccgccgctaccatctcgcctgtgaaaatagactattttcgcaggcgggcccatggcccgcgtgcgaaaatcatctcagaaaaataaaaaaaaaacatggggcgccgccaccggcctcaccacggccgccgccggctagggctcccctcgtccactgtcgtcggcgccgccggcgtcatcgtcgcgtcaacgaggagagccggcggctggatgcgaaccgtcgtcgtcgcctgtcgtggccggcggcagagggggcgaggaggtgaagcggcgaggagggatagccggcggcgcgcgcacgtgggagaggagggagccgtcggcggaggtaatgagtcggcggcaaggagggagccggcggtgtcgcggtcgtcgtcgtcgtcgtggccggcggtgcgcggacgtgggagaggagggagccggcggtgcgcggatctggagcggagggagctgtcggcggcaaggagggagccggcggtgtcgcggtcgtcgtcgtcgttgaggagggaggcggcggcgcgcggacgtcgtcgtggagggagccggcggcgggcggacgtgggagaggagggagctagccggcgattttactaagtgtgtgtgtgagagagagagagatgagggggagggaaatgagtggtagagaggagaggataaggatggtggagaggataaggatgactgatttttttgtaggtactatttttgcaggcggaccatataaggtgcgcctgcgaaaaggcgcacattcgcaggcacaccttatatggtctgccaggcgtcgcttcaccccgatttatattttcataggcggtcatttggctccaaaagtcatatccgcctgtgaaaataagacccctacgttagggaaaatgctttttctagtagtgtttattgacctgcgtgacaagatcttctacatatgcgcatgatgctcaggagttgtcttagcctcttgcaggtcaagtttttttatatgtcataattaaatacattggaaaaaccagtagaaatacatctgagaaaaacatacagtacaagcaattggatgcatgtgctactcacaccacacatgtaagaacgtatgtacgtagctatagatcagtcttaatcaatttgaaattgtcactacattgttttacaatgattaaagcgcctgcatagaaaagtatgcgtgttgtttttggtttggaagtgccttttgttattttttgcttttgttgtacgttctttttcaacgtcactctcaactctcaaaggtgtgtaaacatcggaaatttttttttttaaaaaaattctatcatccaaaggttcagtaaagggttggctggcctgaaagcttcagaatacttgtaattaagttgagagaagagaaacagacggaatatattccagctggaattaatatggcagtagaagagtataactagttgcttagcgtcatcaattctcattttataggaataattcaacgaagaacatttgatttcgaacgatacttctgctttcaaggagtatttgacgttgattaattagtttaattgatttataaaaaacaattagtggtggtctgtgcatttgatttcgaacgatagttctgcttatcaaacatccaaccactactggagaagtgctcatctctcccggttcgcaaccacctttactcccgagtagcgaactgggagggagaatccgggataaaagatggcagtctttagtcccggtttaaatacccgggagtaaggatacagaaaacttctacatttatttcctagtatttgacgttgattagtttaattttaaggtaattaactagccttaaacaaagaaatgagggagtatatgaaattgtttgtctagacatttgtacactttactttactctataattttttttaaagaatttggcatagtagcatatataccattacatctattttagccacataataagaaaaaacaaaatcacaatttatatagatttttttaaatacttgctagttgttacaaagtctttttttcataatttttaattgactaaatttcacaaaactatacttaaaaaaactacatatataagaatgtgggtcataaaactacagaatttagcaccaaatttttcacaaactgtagatttaaggtatagtatcacaaaattatatattaaactctaattatatctgaaaactatagttttttaactaaaaaatagtagtgctatgatttgaaatctaaaatattactgtctttgataacttcttccctaaatctatagttttatagtacgatatcctacatatatggttatgatatatatatatatatatatatttaatgctaaatccattgttttattatacacatccttcatatgtagttttgtaatagtttaatctacgtgtttgaaattttctctttttaagttggccttgcttgggactcacatgtaaataaccagttttcattctgctagacgatcatatacttaagttctttcattagtgcttttattcctagaaagaaagatatcagcactaaccctttttctctggatgagctatacgtaatcttttggccactcggaaataattgaagtagacaaaagaaaaatataacaaagatggccatgatttaaagcgctctgattgttgacataacaactttaatgataatttgatctccttgacaagtggtttattttgatgctatccgttgactgtgcagatggctaattaaggtgaaagatgtcaccataatgtacatacattgaatagacaagctagggtctcctatataatatttgtatatatgacgaaatatgtgtggttaaaattaattaattctcctctttaattcgcccctataattaaaaagttccatacatgccatatcaccaagactccttgaaagcattttcaagaccaagttgattaaatttggagctttatgttatttcacccgcctcagcacaaagaacagtgctagcggctacaatacattttaagaggttgtctgtccaaccatctctatcctattcaaatgtggtggaaagacacgtccatcatccagtccgagtgtgattaggatcctgtgccttgtgattgtattgtgggctgaaagggttgggtgaacgccctaaggctaactataggatatccctaattatcactggaggagaaaccatctttgctcggtcacccaaaattcacaatagtccctgttcgaatagaaaccgggactaaagatgatttttagtcccggttaaaaactttttgacctttattcccggttggtaatattaaccgggactaaagatcatttttagtcccggttcaaaaagttgtcgggtcgagttaggtcccagctcatttttagtccc

SEQ ID NO: 1712 - DNA, 2516 bp, Oryza sativa
cggtgctcccggtgcggcggcgctccccaggcggcggcggagcacaaggcggccggcgggaggacggtgaggcggcggacggccggcgcccgatctctgtgttgtggttttttttcctgatctgtgtgatatgtgcggccgatctatgcgatgtcgattttttttctgatatgtgtgatgtgtgatgtgtgaatgaatttgtggagatgtttttgtgattttgtgaatgatttgtgatgtatttggggattttgtgattgatttgtgatgtatttggggataaaaatgtagcttgatgtatttggggattttgcgaatgatctgtggtgttaaaatgattcgtggataatatgaatggtggtgctcgaaatcatgaaagcaggaaaaaaaagaaaaaaaaacattagtcctggttgttaattctaaccgggactaaatctttagtcccggtttttaacactaaccgggactaaagatccatctttagtcccagttattttaaccgggactaaaaatatgcatatttagtcccggattcgtagtctcggttgtataaccgggactatatgaggttgcgaaccggtattaaaaagggtttgtccaccagtgtatatttattcaatagccatcatcgtttagagtcaggtttgcttagattatttcttgcattgaatttttgccgctagttaggtttgtgaaacccaaacttcgaatactaaatcatttatctgcaaattgagttgcaatcttccttgttcttgcttatgttcttcgattcacatacagggattagccttcttggcgaggtcaatcaggcaacgcacggttgataactagatgagacgtggcactgcaattgcatggttcggatcgtgttgatcggaagccgattcttgtgtgtcaagtttccgctgaattgggaattatcaatatctatcgaaagaccgggacctagttcatcatcactaagggccacttctgcaattgcaaatttgtacgcatatagaatatgagccaaaacaagaaatacacacagaaaatacagaaatacacaataacgtattgcaagaataatccagctcctgctcttttgctcatgctctggctggagcgctcctgcacttggtgattgctcttgcgagaaatcgtggagagtagtcagggttttttccactaggtctaggaccaccattgccagaactgaaaattagggtttccctcgcaccggttcttgtctccaccatgaggccaacactagggagggagggagggaaagagtgaggaagaaagtatgagcacggagagcaaataaggaagtgagaagctagaagccactacattattcatagaagtagaattctagaagcggttgtttaagccgaccacccaaaaatcaaggttattacgcattccaaaagtaattaacttttcatcaactaattaataacacatactacaaattaattacattactaaactaactacattaattataattaactactatactactcctgacatagtctcttcgctagtagctcgcctcccgaaggcgcgctggccaccatgcgggctgccatgcctaccacatgctcctctatgtgcctcccgtcacatcctcctctgtgccagtcacatctcctgccacttttttccttgttgttgatgtcctcctcctcatcagagtacaatggcactattgacctatcatcgaaaaaacgctcatcattggtgtttcatagttcttcctcagtggaagcgctagcagggggaggaagtagtccgacaatagctcagggagctcctcttcctcatcagtggtgttgtaacaaagttggtgcggcaagtccatcatggtcgaaggcatgcgagaaagaagaagagaagagtgcgatgagaaaaacccacccatattgccctctatttactgaatatgaggagaggggaggtgaggaggtggagtggtagtggatgatatgactggcgttcggcagctggcatggacgtctaggctactagtgtgatcaatgaagcgccagctcgatcggcttcctcgaggaagatgaaaggactagacatttttcagaaatagttttttaattataggcggtcccttaagacgaccgcatgtggaaatgtgttattttcagagacggtcatcctataagacgacttgtcagcttgtatatttggggcccatttatcagtgaccgataggatcctctgatgaaagattgaccacacatatatctcccacaagcttttaaagcctttacatgcatggacaccacgctcctcgagaccctgatcgagctaattgagcctcatcagccagcttatcctccttttgagctcatgcatgcacatatctgtgattgacagaaagcgtacgacgatggcgagatttgcacggcccatcttgtcccctttagcgcgcatttgctgctgtttggaccaatctgaattcatggagataagcgttatcacaatcgactcaagaaagtgtggctcaatcc

SEQ ID NO: 1713 - DNA, 5552 bp, Oryza sativa
ggcggttttttagaaccgtggatccccctttatgtttacgttacaccattgctcctcaagtgtgcactccattaaccaaagatgatttgccaaaagaggggtaatgagaggtacttatggggggtcctaatagcgtttggaaggagattagaggtgtgtttttgtgttttgccagggctactttgggttgctccttgcatcatttggttatccttgcatgcaccttttgttgtgccaaattatttttcaatatctttggcacattctctgccttatcttgttagctagtgtctagtgatgcatgcctcctgcagttgtcagcagcttcagagtatgtgtgttatgtgtatgaaaccctaaaccctccaatcatgatccaggatagaaaaaaatcttaatttgctgatgtctagctctactgtgcatcaaattgacccagaaaatgttgtatgctaggactaataaatttccacttctttcaaaaggaggactgaattatgtgttaggactaaatttgtagaattgtgccaaccaataaagattgttgtctttcagcatatactataataagcaaattgtgttatttgtcaattcaaatggagatatcattttcattcagaaattttgcttatccgtagttttttagcatactataataagcataacaatattgcctcaataatctcgaaaagatcaatatatagattggtcctaaagcatactaacgttgaatttgcaatcatccactaataatactgagcactacagcatcattgtggccatgcaagtggcaagtcaaatataatccatatatcagtctcaccatttcttttctttcacataatgtacatgtacagaccctatcaacattgacatatagatagttggcatatgatatgattaacgcagatttcaaggatgtacattgtgcgctatatcatcaacattatctctaaagagtaatacttgaaggcatacgcgtaggctacgatagtataaatcaaaattgttgtacagcataaaccaaaaaccatgcaagtattagataataaatcattaccactcaacaagctatgcagcagaagttagcgctaagaagccgaagaaacgtcgggacgtagtgcgcgtcaatatagagaaaatagtcgatcgcaacagctcgatcttctcctcctcaagtgttctcctcgccatgctcttacgctaatcagtaccacaaaccaacagcgcctaattcagaatggtttggccacaggtagagagctgcagagaagaaatattaaatagggagttcgatgcttatactgtaatcgggaggaatccctttttcaccggttctgggactgcccatttgctaggtggatttggcagaaattggaagagcatcgtggtgaggacattccacaaccgccagcggaatgcagaaacaataaaatcttatctgtttggctactggatcaattatcaatacagacacaagaagtctctttagtgctgttagttacaatctacattatgtggtcagcacggaatgatgcacggtaatcaacagatcccagataactccagtacaggtacggtggtagagctattttgtctcctcctggtatgagtgggtcaagttctatcttgaaaaatctgtatcactactgtgcctagctccgtacaattgcactggcaggttagccggtaatcaggtatggtattaagtctgtaaatcggtatgggggtatttgtctgcagtatgtaactagatgggtaagttgggtggagtgtatagttgagtaaatgatccggggctgagctttatgaggtcgctgaacaggattttcttcggggaagtgttaagtgcaactcatgctgaagcgttggcttgcctcgaagcgacgcgggtgggtgcaagacttgcagcaaccagagtagtcttcgaaacggactcagttgaagttgtgagtttggtcatgaataaaagttttgatcggtttgaaattgggcctgtaatccaagaagctgaagaggggaatccagtcattccaggatttcaagctcatatgaacgaggagatcggcaaataaagtggcacaccgtttggctaaggaaagccttaacacacgtgcttcttctagctggatagtgtcagcacctgagtttttattttctctgttatcagaggactgtaatctggatgctgtaatttgagttttgcttgctttccactctcaaaaataagaaataaattgcccttattagtcatttagtctatcccaccatctcccttcgctgttcacatacaatccatccggtggcgtgaagatttcttctctgtcactaacgtgccacacctgagatacattcatatgatcaacatattgttaaccttcagtctgtacgatataacgagattctctacagtattacttgttatcctgcaaaatataataatatataatatgtggctctcacttgatctcgaggtattgtgtgcctctacagccaagtctccgactctatatccttttaacaccgtgactacttggctgtgttcttttggaggggtttccaacccctcctctccgcacggaaaacatagtgatagattaacacatgattaagagcaagtttaatagtatagctaactactagctccaattcatctatagccaatctaatagctcattcatacaatagttacatactacactattaatgcatagtcccacctgtcatacacacgctgcgtcttggagtacgtgctacagctggctacaaatctgtagcccgctgctcttctctctcctcatttatctctttaaaatatatttacagctggcttatagcctactattgtacctgctctaattaagtattagctataaaaactttgaaaaatgaattaatatgatttttaaagcaacttttctatataaacttttcacaaaacatataatgtttagcagtttgaaaagtgcgtacatgtaaaaaacgagagagatgggttgggaactcatgtgaaagacatatataccaacgagtggataaaccccagcccacccgtcattgtacacagcatcatcaaagggggtggccacatgaatttctccttgtgcgttcatgcgaggatcgatatgcatgccatacgtggcaacgcccagcacatgctatcagttctttattttgaataaatcctgtccatgatctttgtcttcatgagattatgtaataaataaaaccttgtaaactgcgatatataatatacatggacaggaaaaaataaggcatgcagtggcaaaaggtttccagcgtgtagtcactaccattaaaaaaagaaagagcatgaagtcactaacagcagcacagtgtgcactttcaatattgcaaagagaacagcattattatccttggttagtactgtacctgtcttaatttatttatgcaacctaactttttcaaggaacctttgtttgttttggaactcggctagcgtgtgattattcctccaaattaacacacactgaacagtacacgtatatttgctgatgtacatttaaaattaatatttaatcagtgggattttcaccttatagttaagtagcaataacagcgagtccccttgcatatatatgatggtgcagatgctgggattttactggcaaaggaaacataacttttattagcctctacatcatttgaaaatacacacagtcaatatttatatttatcaacataaggagttaaacttttgtgggtccatgactttaccatctcaccaatggccaggaacatttatcctaattataccttaaaaaaaagccccagtaacatgagtgcccccacctatatataattaaaatatgtttgttgatacataatttatagataagaagagtggtgcacagccacctggtaaatgataataatctttatccgaaggtacaaaatctaggatgcacctgatcaacaacaaaagatgtttatctttcttacgaggacagggtatatcagagtggatgaaccacttattattattgttataactgtcttaaggtttgcgcaatactataggtcacacgtctcatcacaccattaggtcctaaaataattcaacatcagaaaaaagaactccaagtaaaggagtcgttctaatttgtgcctctcagcctctggttaattaaatgccaaatgagcatgtaactaactagctagcttattcttctaatattcaggaatataatcaagataatcctagttgaaaattaaattaggatggcaacggatccggtcaggcacgggtagagcaaaaccatgcccgacttgttggcccatgttgcccacccgaatcctaccccgctagggttagcaggcaagactctatgcatgtacccatactcgatgggcatgagcatgcccgatggctacccgcgggtttcatatgcataataatttaataaagaaaaacaaaacaaataatttgccaaattattagttgtcaacaataatttagattgcatatcaagttattaccagctagcatcacaaatgagctaaaagaaagagatatgagaattaagtgatgggccaaaatcgactaatacatatgtttcggatcaggcatgagttaccaacgggtaaaatataaaacctggctgcttcccactatgtctccgggtctcgaacgggtatgcctaacgggtaaaaagttacaccacgcctgtgctcatcaggttgggtatccgcggatacctggacccatggatatccctaaaattaatcaaagggggtgccctgcatcgaccccctgcaaattaaggtacttatagtagtaagaaatggatcgtggtacatacatctgtaatatatattaatatttatatatatgtgtttatgaacattgattcttgatatataattaagaactctaaaatacacattactttattccggccacgagcttaagaaatcaataagacacacacacacactatggttcctgagccaaagaatggttcagggttcatattcttgagcaatgaaaagtaatggtccacacgtgcatatctagagatctgtccgtgttagcttcttcttcaacttctctgtgtttgcaagggattatgagattattggtagatcataaagctgctatctgcataacttccacattttctcgtaattactattacgtaaaatctattcagagagttctcgtttttgtcttaactgaatatagagaaaacgtggagtctactacatcatactcgtactgtatgcatgcattttcttaatagacatgcatgtattttttcctcttcaaacaaaatttttctctcaaattatttatccgatctacaatccgattataccattgtgttcgttacaattaaatcttcataacaagatcttacatgattatattacgatcaaaaaatatttatatttataaattgcttttattatatatgtaagttacttttatcatatatataagttacttttagatttaactaaattacttcttagacatactacctccgtattttaatagatgacatcgt

SEQ ID NO: 1714 - DNA, 1493 bp, Oryza sativa
aacatatgagaaaaagtcaacagcatcatctattaaaaacggagggagtataaaagtaaattcaataaagtctaaaagtaatttacatatattataaaagtaacttaacacaaaacggaagtaactttatcacgacattagaagtaaattcgtgtagggataaaatatgactttttagttaattccataatttgtgctgattaatttaatttccagatagagttatgtttttatctctacaacggatttacttcaaatgataccttcgttttgttctaatttacttctataacatatatatatatatatatatatatatatatatatatatatatatatattacttttagacttactgaatttacttttatattttaagaagtaacttaatgaaatctagaagtaatttagacacatcataaaagtaaatttgtgatttttcatcaaaatataatcatgtgagatcttgttgtaaagatttaattgcaacgaacacaacagcgtaattggattataaatcggataagtaatttaataaaaacttctctaagaaggaaaaaaatacatagatattgagtgtactagtagttttttttttttggaaagaatggtgtctctctttagcactatccagctagcattctcgctgtagtgtccttttctgcagtagtcgtgtccttttctgcagttgttgaatatatatggtgttgatcgtgtgtaaaaagttccaaagatttaaaacgggctgatagactttccatgtatgtatatacgctagtagctaactaaagcagggcatcaattttgttgggagtaaacttttttttccctaaactcgcttcagacaaattatatagttttattaaatacaagctataaatcgtgtctcatttgtaattcatgatcaatgcatgagtcacttcagttgcatgtcttataacagagctaacacctcactactgcagataagcctataggtacactactgaaaaaaccatctttgctgagttgaccaaaaactatattaatcccagtttgagtaggaacaaggactaaagaatatctttagtcctggttcaaaaggccaggggtacgttttgatctttaattccggttcaaaatatggtaggcggtgtcagaccccttcactatctttagtcacggttagtaacaccaaccgggattaaagatctatttttagtctcggttgttaaacaaccggggactaaaaatcggccccgagcgccgtccactataccaggccgcctcttcgatcctcctcgagcgctataatcccaaggacgctcctcacctagcttcctcgatcctttatccaccttatctcctttctcctcttctcctccccctcattcactcacccccatctccacccctcttctcccctcttctcctccggtcccctcccctctcctccccattctcccctcccctccggctcccttccggcgggcagcagcgcctaggcggcatgc

SEQ ID NO: 1715 - DNA, 12019 bp, Oryza sativa
gcgcgagggcgacggtgggctccccaccgccggatccggaaggggaggcggccgggcggtggcaccagagcgagccggccgggccgcaaccggtggaatgcgggaggccagtggcggctgtggagttgatttgtaatgaatgatttgtagattatttttttgattttgggatgattttgtgattgatttgtggactgtggatgattgtgtatgatgtgtggatgatttttgtggatgattgtgtatgatgtgtggggatttgggtgtgatggagattgtggtcgaggtgcaaacagcataaaaaacaatgaaaataaaaagaaagaaaatcctttattccccgtatcggttattttaaccgggattaaagatgaatatctttagtcccggatttatagtcccggtttgtaacccagaattaaggggagttacaaaccatgactaaaaacccctttcccagtggtggtatcgattctgaaggatctataggtaccggttctggtaccggcactaatggcccaagtctaatagcagaggtacatagaacacctaggtaccaatgagtggttatagattatagctactccctctgtttcacaatataagtcattctaaaattttctacattcatatggttgttaatgaatctagatatataaatatgtctagattcattaacaactatatgaatgtgggaaatgctaaaatgacttatattgtgaaatggaggaagtagttcataaaaaccgacagttatatgatgtccataagtatcagttgatataagaaccgacaattatgacttgggagctatatgggggcgtcttcgttggcactgagaatgaacagctgccaatcaggagcaacgacgcgagcatggccttgccatcctcgactttgtcgtctggccgccagagcaagggcaaggagcgtgaggagtattgaggagatgccaactcgtcgtctattatgtttggccaagggagtgcgggcgacgcgacgcgttgctagtgtcggaaaccggagtgggggcgacggtgaccatatccattggtggggaggccgagagcatcgattgggatgtcgttgatccggatttgacacctcaccgagcggagtggagagagcgagggagagggaagagatggcccacagtggcgtggagatgaaatccctctcatccgggtggccggatatgccagccaggagggcgatgcccggtgccgcaatgatagctggagactgcagcggcggcatatgcgaggggaggaggtgagcatggcggcgcgctgaggaaggagggcgagggcgagggcaagcgcgagtgtgagggtgggggcgacgaggctagggtttgaattggtatgggccggcgaaatcctcactgtccattccggatccaacgatttcacgggcgcggaagggccaccacagtgggacacgtggatgaccatatcgaccctagagagagatcggacggttcacgatggatagcagctgggaccaatgcgtaattaactggaagttcggggacattttgcaaaatatttgccaacgtggcactttaattctcaagcattcccactgacgtttagagaggttaatattagtatcaatgttataaattggtaccaatacatggttatatgtaccggttttcaattttatactgaaaaaggtggaacaagctttacagaggccactctctatggggtgttttgtagtagggcctgtatacatgtcggagaccatggataaattcgtgtacatcacaaaattactaattaataaagtgcactcgctgaatgtgtataactacaactatgaacacactgtactagtcctcaagtaattttattttttctaatttaaatcatggaatgtgcgtacgaacacaaccatttcacacgcacgccacacacatatgggaatgtgttcggctcccaaactcatgctcaaatatagatgataaagttttccggtcaagtataattaactaaagctgaatgtgctccatcagtggttgatctagtttcagattggttgttgctcctttatagcaatttttttgttagttaattacttttgcaaaccagatcagtttagatatagttgtctatctcaccttttttttcctttgtacctaaatggcgcatacataaatcacctgccggccggctcgttctgtgcaaattaacaacaaaataagtaagtttacgtggcaacattctacaagccgcacttaattttttccataccggcgtacaccaccagcaacacatcctactggcattctcgccttataaatatattaactgatcaatcttgtaaacaattccgtacgacgatctctgtgaagcactgaacaaataatccacaaattaattaaagttgaacacgatgaaacgcaatctcgtctaatcggattcccctctttcaaataaagcgcaaaagtgcaaaaagcgaacataaaatttgattaaatgtctgaactttttgtcacgtaaactatctgaacataatgggtgtgcattctctgtggctcacgcctgagcttggtgctgccactgattgcttgaaacaattaacagtaaccggccggcttaattcgtgttctgttcatcattaggtcatgataagtactgtggcattgtatgctttcatggttgcttttgtgcttaatatagtatatcctttctgttcttttggaggtttgaactttgaacaaattagataaagttcacaaagtgtgtactttggcatgttaactgtaacacactgacaagaaagctatgtgatcgataaactttggtacaagattgtaagtatacgtggatggtacagggcagtttgctacaatttttttttttgttgaggaaattaaccaatcttatcttgacgatgtaccagatgtgcctttcacttgacacatttttattcggtttgcttggagctttttggcatcttggtgggaagttctactaactttagctgccctaattaataatgtgtgttaattaacaacgtaacattatgaagagcaatacacagaagaatttattaatatgaacagatctgtgagatcccatactcatgtaataatatgtatgatgacattatcgaaccatacatttgcttgtgataagatttttagggttcttttttcctgttgggaagctgaaaagtttttgcctgattgaccactatgcatcagatgccctttttgttaaggcttttgagttttgagcccctagctggtaaggcttcattataagatgttatgagatatgagaggcatctagccgtataggttatacatccagttcggtcatggatacaaatttaattagaacccataacgggtggcagttcatatgatggtttgcttaggtataattactttaattagtacttccacagtctctttgtagcttattaatctattcataactggcactactacgcataattgacatttcacggacaagaccccctccaaactctaggtggaccataattgcatccacatgtaaaaatatttaggcgaggttcggttaagtgcgggtgggcctcttaagactccagtttgcaaaaatatcctatttttataatcgggaatcttaagagatctgcctataaaaatccattttttaggtgggggtgtctctcttctacctgcgctccactcattttttccccgtgcgcccgcacttccccgcttcccctttttaatcaccctcctctctcccggcttactctatctctctcccacttattcctcctcatcgcctctaccctcctctctctcccacgacatcatgcagtgacgtacgatggcgtccttgcgtggcgacaacaaccatggtagcggcggctacagcctcgggtgatgaggacatcacacctttggatacacacgttactcctcaagttgttttgcaagatccaatcactagagctcgcgcccaacaataaatttacaggtgagctcgttcctatatacttctttatgtactcttgagaatagattactacctaatgacttaattatgattagaaactacggagaggaccatggagcaattggagagtggctgagagatagacaagatcatcatgggcgttcaagtcatgtcgatgtccaactcatgtcaagttcgagtgcacttcgggctaccagagcagttcacactaaaatcatcgtcgggttgcattcggactccgatttcgacgttatacatatatatggaaagctaacgagaccaactttggatctggtcccacgccaaattccttctgagtcaacgggaatcttcgaaataagaaggcattcagaatttgtccgggtgctgtgtcacatctttgagcctgttgggccgtgcgtcgtgtcggggtttaatagggacgtgtccaggggtctaaggtcgaccctagaacctatatattcggtagtcgtcattgtgttagggttgggttttgcttagattatttctgccattgcagtttcgtcgctagtttggtatatgtaaccccaaattcaagtgcttaatcatttatatgcaattgagttgggatctaccttgttcatacttgtgtactttgattcgcatgcagggattagccttcttgtgaggtcaaccatgcagcgcagggttgataaccagatgagacgtggtgttgcgattgtaaggttcagatcgtgttgatcggaagttggatcacgtgtgtcaagttttcaccaaatcgagagttatcgatacctatcggaagatcgggacctagtttccttatcatcgggaccgacggatccaccgttggtgggctcgggaagggcggatccacctccaatagtctcgggagcagcagatccaccctcgtgcgttgtggagatgaggtagaagggcagcacggcgaccaaggaactgggagtgaaggccacaaccacggcagtgaccggcgggctcgataatggcggatccaccctcgtgtgcagcggagatgaggcagaagggcggcgcagtgaccacgacaccgggagcgaagaccatggccacggtggcgccgtgtggtctcaggaatggcagatccgccctcgcacgccgtatagaggatgtggaggactgggatcggcgaccacaaccattgcagtggcgggctcacaggctacgtttgcggtacctgatggcggcggccttacaatgatctacggttttggatttcttttctttttttatttttttaaatcgttgtagtcaggggtccttaattgaccgcttacaatgatccggtctttgcaagcggcttccttaggatgcccgtctgcgaaaatagtttttttgcatgtggttgtggtgcctgcatgataaaatgcggattttcacatacacctgactccagacacaggtgctccactagcctacaaaaactagttttggctgcatgtgaagatcatttatgtagtagtgtggagttgaaagttgtggtacgtagaatccaaatatgagggttagttttttaaaataaaaaaataaaatcagaaataataagggaacaattaaagttgtttggtagaatccagggtgtcatttatccaactaggggcccagttatacagagagtccttctgaagcccaattactacagagaatcctgctcaagcccaattaggtctacccagcttggtctgaagcaaaacaaaataagtccaattagactccctcaaatatactccaatccaattcatatccctaaacaacaatacctgatattttgacccctcaactatgaaaacgggtgtaatttgactccttcagtagttttggtgagtggttttgctgatgtggcactttgacttgatctaacatgttgagtcatcgtacgggacccacatgtcatcgtccccctatttcccttatttctatctccttcctcttcctctttgtcccccttggctcggctcgttcctcttctacacaatggcggtgacgggacaacgaggggagcggtgcggtggcagctgggtggtggtagaggggcggcggccggcgggaccatggaatgcatgaagctcaagctcgacaaggtctgtgttctctcccccaccgttgcgccgatgccgtgtaggagctcggcggaatcggccaacccaccgcccctgaggagggggagatcgaggacgacgacgatggggtccgtgaaatcatctattcatgaaagagagggacaaaaaggcagacgacggagggtggcagaatgtcacgccccgaactagccccgaatggaactagcccgtgacgctccaaattaacctattaatcgataccagtcccaggaaacagtgctggtatcacaggaagacataatatcacaacaacagcggtctctttattgcagagtaggagtacagtcatgttgggctgcggacagatcccgagctcacaactgcattacaaaaggggaaagcggaagccaagacttggaccaatcatcacaggcgcgacttgggaactaggcccaaaccctaaaactcatcgtagccgacttgctcctggaagaactcctcgtcagcgggatccacatcatcttcttcagcaactgggggggattatttatatagagtaagggtgagtacaggagtattcagcaagccatgggaaataagtgtttaatgcaggcttcaacgggaaggctgttgtttttgcaattgattttatttaaactcttttctgaaacaactaagtgagtgcttctcaaacgatgcggatgagacagtgcgtctcgtctggtcggagtatgtgcaatgtatcagtcttttgatttgatcaaggttggcacccggccaacagctttcaaacggccacccgggcctggctgatcccatcagccgcaaattttccaaacatcgaacccaatccacagcagcaaatttcacaaagcagtagtcaaacaaaactacgctaggaatcacctcacatccacccatgaccgtgggcacggctgttcgaacagtttgttaacctctgcagagggggttcactttacccacacgacattactaacccgaatcacccagcccgtgtagaacggccacgtctggtgacctaagggctttcatgacaaggcatttcgagagcagacacagggttgccatatgccgacgagaggggtcccagaccaacaacaggttaggtcccagaccatactgtgccaggaagcccgggggttctccccgacaccaccccgttgaatctacatgtctctcggcatcaaggctcccccgcttagcaatttactcagccaggggtgtcccattccacctatgtggtcgcacttgtcttatgttcggatgaaattccaaggaaacggtccttaagtgcaagagcgggaaatcgtacacccggtacgttccccggtcggcgattttggaaattcatttagttcgcaagcaccgacccaggtgttgggttttccaagacttttgtaaaacccaagttttaccgaagatgttccttagattttaagtttgaaggcgaccgtcgatactcgtgcagagtgcatgaataccgaggctcaactaggtggttacaggggaatatggtataacaattaacaatggatggatcagatgcaacaagttaggtaggcccaccggtctgccttgcagacggggcaaacagattaagtgtaatcctatcaatgcataatattttgcaagcaatataattaagttcaaatataggctcaatatgttcaaaggtggcttgccttgctcgagatcttgagcttgatcctcgaaatcctcgcactgcgggtcttcgggctccgaaactacacgcgaaacgggacaactcaacaaacggcgaaaataaagccctattattgacctctaggcgtgccattagatagatctcgagatttgaggagttttggaagttaaacggagtcaaacggtctttcggttgggaagatattgaatttccaagtttattggatttttggtctaaaggaaaaggatttatttaaattcctttttgaaaaagaaaagaaaagaaaagaaggagggagggaaattagactttcctcgggcggctagggcgcagcccgagagaaaggggctgctcggccaaacttaacgggccggccggccagagaaggcggcccaaagcgcgcgcgcgggcggggaggagagaggaagccggtgggccgggtccatctcgcgtggtcccgggtgggacccgcttgtcggcggctcggctcaccgtgagcgaggtgcacacggggcgtgctagggtttggggaggggaggcgcggcgcatgcgcgcggtttgcgtaggacgcggtgcggcgggcccacgcgcagcctcacggctcgcggtggaccgcgcgcgcgagcagggccggagggagcggccgaccggggtcggctcgacccggtcgcggccgaggtggcaccgacgtggcgccttcgtggtagccacgtgggccggcgagaggaagacaaaggcgtcggccgcgaatggacggcgggcggcggcggtttctccgggacgccgtgcgacgacgaggggcgacggggtgtacaccggaatgacgagggagaacgagagggagcgagccaacggcttggattcgccggagggagttcgtcggcggcggattgcggcggcggcaaccggcggcgagaaaagggggaaacggcgacgaggtcacgaggggctgatttccggcggtgagagcatctacgcggctacgggaatccatcccttgcgccggattaggaggaaacacaccgagggagaccggcgacgagatacgcttccgagctcgggcggcgacggcggcgagcacgcggcgagtgacggcagcagtcggggcggtgccagctagctactggggtactacacatgctgctaaccgagtctaaggggaggagatgaatcgaggagggagaacggggagttgcactaccgagacgaggcggagcgctgtgacgagaggccgacggcacgggagtgatctctccggcctcgggccggggaagaggaagaaggcgagcgcccggagtccccttctgtgtcctagcgcgcaccggctccttcggcacacgtggcagcggcggtcagcgagacagaggggacggcaatggcgcggtggagcaagggcaaaagggagagggaaaggaaggggggagcttgggtttatatgggcgacaatgtcggtttgggagaggggaaccgacattggacggtcaagccagcgagctggcgctttggctagcggccaaaacggcgacagggaggaggggaattacgccggcgggagagaaaagggaaaaaggaggagagaaagggggcttgccccttgcctctttgggaaaagaaggagggagagagggcgacgcggcagagggaggaggagctctgcctccgtcccttggaggctagcgcgcggagtggcggggccgggttgtgacgacggcgatgacggcggaggcggtgtggagcggagcggcgatatgggcagcaggcgcggacaggcgcggcagaggctgacggcggcggcgaccaggcggtcggccaccacggcgtgcgcgcgggggaagcaacgggcggcgcggcgatttgggcggcgtcggcgggaagcggcagcgagggcggagggcgctcggctcggcgcggctcacgcgcgcgcgcgcggcgcacgggtagagcgggggagagagggagagagagagatggggagggagggagagatgggccgagaggaattcggcccatcgaacctgaggggtgcaaaatagacttttgtggagggatttgaactcgggatttgaacttgacgatagatcagggatttgagatccggaatggcacggagactgactgcaagcgaagaaacaattttcgcaattagggtttttagaaattacatttttccgctaggcgccacgacggaatgggcgctacacagaagaaaatgcaaaggtgaaaaaaacggcgcaaggaagaagccggcgagagactgccgccaccgctgggtcatggtgtccacctccctgctccccatgtgggcgcacctttgctccatgccgccgcagtagctcggagccagtgccgcctgggagaattaggtgagggccagcctctgcgtgcctcaggcggtgctatcccccgcggaagtcgcggcggtgatgaaatccgcttttgctgctccagatctgctgctatttgcttcttgcttgaaagccttgaaaaggacgaacgagcttgctgttgctagctcaaccctacaacaagctgctgctgctgcttgtttgcttgaggatgaagtgatgaactgaaccaaaagaatagaacgtcacccgctgcttcttgatacaacgctacagatcgatgaggcttgccctgggaagctgagaatggaggctcgaaagcttcagatatgtggagagcaaccacgatgatgacgaggctgcggcctcccctcacggcacgggtggtggagtcatcgtccctcagcccactgtattgaagtcgaatggggaagatgaaggagagagagaaatgggaaaaaagggaaggagtgtgagaatgacatgtgggtcccacaggatgacccagcgagatagacccggtcaaagcgccatgtcagcggacccatcctccaaaactgctgagggagttaaattataccagttgtaatatttgagggggtcaagatatccggtattgttgttacgggatatgaattagattagagatatatttaagatagtcaaagtggacttattccaagcaaaaacatccaaaacctgaacgtttcctctctagaaaaattatagaaaaccaaacctgcacattttctttctgaagaaaagagagaaaattgaagacctgcgaaaataacatcagcagtgttcaagagcatagtgttaggagaaattaatgcgaataataaataatcatgtgaaaactcacgaggttcgataaaccgaaggaaaataattacaagttggagggttttcatggtgagaacgcagaactcaacctcaactgctgtcacgaaacatcaattcacatgcaattacgatcattttgagagtgaaaagttcatgtttgctagctcaactattggcctaatataatgcatatccctcaacccaaaaccagattcaaagggtttcccaacgatcaaagctagatcattttgcctcacaacgtactcaccgtagccacgtgtgctcggcgaggaaggatgagagagctcagggcagcggtagaggcggcactaggtggggtgacaatagtggtagagaaggacagcatggagatggggtaaccatgagggcctgggttgcgggaacggtattgatgatcgattcacccttgccttgtcgaaatcagagtccaccacaacgttactgtttgcttgaccgtctttgggtctgacgatacagttgcagaagcacattgacaaggagcaatggaagaggatcggaggattcaccaacagcttgttgccgatgcacgatgtgttggtggcaccatgacacgaataacaccggcaggtggtcggagtttgcttgttcgagtttccctccggcgctgtcacacatgccgccaacttcctctttggaatagcctccttgccaggatctacaggccgctacctgacggctgatcatgggtgaaagaagagggaaatgagccactagttccctctacggctccgccatgtgctaccaccgcaactgtcaccctcccgctgaaggtgggagcgggagaagaggggagagagtagagagagagagaaggcgtgatgaagaagatgagatgggggaattacgtgtgtatcacatttttgttttatttatttatgagtgaactgcactttgtactagctgacttacgtttgttgcactttgaaccaccgactcatttctctagccatgcctatcctttactccagaaaatgtatggcctgctcataggtggacgatttcgctagcgtgctggagcca

SEQ ID NO: 1716 - DNA, 462 bp, Oryza sativa
aaactgtatgagaaaagcactgcagattaaataatctggggaaataaactttaaataagacagataattaagttttaaaaatataaacgaaagtagtattttatttttaaatatggcatgtggctatacttgctagagaacaccttttagaatccataaaaaaatataatataatctaattaagttgatccatcattgttgcaatgtcagtaatttgacacgacttcctagaacacctttggaaatccactaaaaatatgacagattaagttaggccatcattacaaatgttagtaatttgacacaactatatgaacatttagaatatggaaattaatggttaggtacttaaactagaaaattaagacttaccatatgagcatggcatctgctggagcacaatggagggattatcagacacccatgtatcaggatcctgacacaactttccggataatccat

SEQ ID NO: 1717 - DNA, 552 bp, Oryza sativa
atctccttcacggttttcatagcggcccatacagatgcaattatctagtgagttggcgacaccccctctatagcttggttttataaatgcagctcctctcatcctccatctccatcaccacagggcttccgctcactagagtgagcgagcgagtgaaatctgtttgtagcttgcgagctaggacaatggccggtcctcaggtatgcatcaactaagtgagcagtacgagtattcaccatcccactaggtgtgtgttccaacccactacggtgagcttgtcatcaactacctttaccaatgcgccattcagatgtctctgccctatgacttcatcactgacatcgacatccttcaccataatcccttggacattgtcccaagtgaatatattttgacttgtgttgcctttgttgtcccattgaaattattaagccaaatctttgcaatctttggtttaatttcatcaatctatagcctcacctatgatatattaggtgttttgacggttaatttcttgtctaattctgtgtgtgtcatattttccttatgttg

SEQ ID NO: 1718 - DNA, 5251 bp, Oryza sativa
aacaagtcacttaaccaaatcttggcttaagtgattgttggacatgggatattattatatatttaccatccgtatatcatatctctagtgaaatatagatgtagttgatctcgagcgaaatcatcggcatgcagtgagagaattatttcattattcgtggttgagatgtgctgcacaattattaatattactcagttataacattaggagtatgtgttatgtatagacaatgagatactatcatatttagagtgagtactgagttggcaatgcttgcattctggacatgttttcatggagaaaaaaaatacagataagaggaagaatctgctgccatgtgtacgtatgcaaaaaggtctagcagattaattttatcaaattttgccatgttagaagtacaaaattagtacaaaagatatatatagcatggctatgcagattcaaactgagatcatatagatttccccccagtactgttgttgtaaaacatcttcatattatagcacatgaacataaaaacacctatatatgtatatattgctcactgttaatgagggaaagtttactatttgccaaccaataaatgcattaataattatttgctactacatgcacagatatggctgctgattatttggcatctagctgatcactactcccagtaaaatgacaatttaaccaaactatctgcacattacccaccccactacctaatcatgctaaccttaacttttcgcacagaaaatcgactcctttccccactaactagttgctcttgtctggcaagaagaaaggatttgcagagtggtgcttaacccttcctgtgtctgctccacatcaaatttttttctaattttatgagtatagctagtgctgcgaaaaactatatgcaaccaaagctattttacttttatatcataccatgattaaattcatgttgtgcttttggccatgactagatgtggatagcatttatcgttgcgtattgcattgcctttaaacttggcctaggggttggcgaaatcctaggtttcctgcagtgacagaatccctgtcattgtaaaaatcccagcacacatacatccctactgacatcttgtgcaaggaaatgtatcttaatctcctgcacaagaccactgtgacatgtgtaggggtaaagtcgacatgaattacggtgtcccgtgattatcagtgggtaaagtttggagaaaattatatacaaaaaatgtttcattaggggcacctatggtggcgtgaagctagctttaaactcgatcacatttccagcacaaggccccccaacgtgtgactagcaaacaagaaaaggaaaagtcttaccaaccatccaaatgataatttaattacaagcttgcaaacaaggctcattcaccctttaattccagccttaataggcgcccacagttttcctaatgattactcttgtgcatgtctcgtcactgctgtctcctcccccacaaagcaacaaacaggaagtgaggtagagtgagattaaccggttgggtgaactctcaagggatggaaaagcacaaaaaatcagaagagaaactgacattggggtcatcatctatcccctccccatctcaaattcttcttcttttgggctttgtgtgttagtgcatgcatgcactcatacacaatggacgatagctctatagctgttgcttggagatatatgatagagttgtgtcggagtaagagacaaggattgatacggcacccacagctgcccatccaagtgtcagtgatgagttggagatgcccccctagctgggtgctataaatacagccctttcttggcatccatctccatcaccacagaggctttgagtattcattcatttgagtgaccctatagtgtaactcgagcgagtgagcgagtgatatttgtgtgtaggctgtagctagcgagctaggacgatatggccagggttgtactttccactcccatagtgaatggtgcaacgatgcacctccccgctgtgggcatgtcacaccccaccgagggtgagcttgtcttccactacctctatcgtcgtgccgttaacatgccgctgccctctgaattcatttgtgatgtcaacgttcttcctcataacccatgggacatcgtcccaggtaagtatattttgacttatgctgccatatcatcttgctcccataaaaattgttagcacatccagatacatctcgaattgattaatctatgtctaccaggcttgattgattgcatggcctaatgtccgatttgttgttggttttgtttttgtctttttctctctcttgttccatgatggtgatcatggacataggagcactgacatagagggagaaagggaagtacttctttatgcagaaggagataaagtgccctagtagtcgccgtagcaaccgtatcacaagtaaagggttctggaggtcggcaggctcagaaaagccagtctactacaaccagggaggtggcagcgactgcatgctggtgggaatgaggcgcaccctaacattttactttgggaattcacggaccgcagagcgcacaaaatggggtatgcaagaatttcgccttgctggcaatggtctttcgccttaccctgcgatgaagcatgccaccggggatggctcaaaaccaccctgcaactgtgccgaaacaaccatcgccaaggtaattaagatgttgacttcaaacattttcctgtcatcattttttaatcgtcttgttcgtttcatctgcaaattgaatctaataagtttgttattttcgagcaagtgtactattgtgaggtttagctttgggaaatagggagggggatttaataaatatgatgagccgtcttctagatataactctcatgtcgattttattcatggaaaggaaaaggtagagattgtctttgatgccgcttagggtacatgctattagatctgtagttatggactgctgcgatgcaaggaacgtgggatctatacatgattcaaattttgtcgagacgtagggatttatagttggtaaaatctagatatgtatatgtgtcagtggggagttccatgcatatgtgtcagtgggatcgagtcgatgtattataaattttgtcataaggttagatctggttacgagatctataatcgacttgaatttgacaagaagacaaaagtggtttgttgtcagcttgcgagcaatgaacctatttaatgaacaccatgtgttgttaactcgtttctcccatgatttttggagttttatatcagataatgtatcaaccatttattggtcaaattttctgtgatgttcaaactgaacaatggagaatactcattttccgacatcaggaagaaaactgataacaaataagttaccatgtctttcaaattcagtagctatgttattagcatccgtatataacatatatacaaaatattcctttccaactaatagtacttcatcaattttcccttaggtatacatcttacatataccatgctttgtgcgttcagcagcatccattaacaggcaattcggtgactgttttgcagagaaatgatggtctctctgcagttcttcgtaatgtgctcgccgtcaccccccttgtggaaaccgttgtcgaacctgatggatcatggctgatctgccgcatctacaggacaaggcagcgtgcattgcctgttatcactcctcctgccatagaaaatgcaagggaaatcattatccctcctgccaatggcaatgcaagggaggctcaagtccgctttattgacttcctgcagcagggatcgcacattgagtcatcctccccctgtagttgtatagttggcccctctttggcagagggaagtgatgaatctgctggtagtgttgaccaaaaggattgagcgcaatggagggagcaactaatcgataaaagcatgtcaactagtaaggaataaaaattgtgagtgaggtgacctagtgcaagtatgacctgcaagttatataagtactgttggagactgtgttctgtttaagttggggaactgtatgttctgtttaagttggattgtaagctttgttcaatagtttcaaggaattaaagcgtgtttgggttctaggaggaaaacaaatggtcattccagatgaagaagtctgagtaagcaacttttctaaaaaccgtttggtctgtccttcttcaatatattgtgttctgtattatctcatgcctttgtgtgagactactagctatctattaatatctatatgcttatcttccaccgtatatatagcttcttcagtattcctgttccgttgctgctctgtgcttgacgttgtcgatatccaccatatgagatatgtccacaagtgtaggcgtgtgtgtgtcttttgtgtgtgtgtgttgtttgtgtgtgtgtgtgtgtgcgtgtgcgtgtgtgtatgtgtgtgttgtgtgtgtgtgtgtgtgtgtgtgtgtgtgtgtgtgtgtgtgtgtgtgggcttgaagtgattgtatacacaagggaggtacagagtttccatccatatcatatctaaacttgttgaagtgaggattattacatcttttgttgtagcaccttgcgcgtgctgcaggatcactcgcaggcgacatctccatcattgcaggcgatagattcacccgcctgcaaaaaacatttcagcgaataaaaaaaagacaccacccacgggcgctgccatgggcctccccttccgggctctcctatgtccaccgacgcccgtcgtcgtcaccgttccatcggggaaggcaaggaggcgcggtggatctggagattggcgacgacgtacggcgaggggttggccggcgatgacgctgaggcgggatccgatgccggagagtgccatgatgctagattgcgtcggatggaactgcaagttggcgtccaggcgctgggcctctgcagtggcggagaggaagtcctccgcctcgttgacgacaatcaggcagagcaggtcgggcgagccgccgagtcacgcggcgaggaggcggacgagcaccacccactggttggcgtcacaccgccgctgaggtcgacgacgtggatgacgccccgcttggcatccatcaccttggtgatggacaggttggacacggcagcggcgagccggatgatcgggcacatcgcgtggaacccttggcgcgtggtggagatggttgccgacggtgtggcctgcatgagatggagggaacggcacaccccgacacatggtaggatgaaccgcagtgcaagc

SEQ ID NO: 1719 - DNA, 1235 bp, Oryza sativa
  unsure (1)..(1235): unsure at all n locations
gaatcctccagcactatggccatcggtggcgctggtagccactctccccttctctctgcttcgtcggcgccagacatatgtcactcgtcgtggccagcgacggaggcgacgatgaggggagctagtggtggaggcggcgaggaggggagccagtggcggaggcggcgaggaggagagccggcggcggatccatcggtgtcgtcgtcatcgctcatcgcggctggcgacagaggcggcaaggaggggagccggtggcggttccgtcggcgctgtcgttgtcgctcgtcttggccagcagcggaggcggtggggaggggagccggcgctgttgtcgtcacggtcggcgggggaggcggcaaggaggggagccggcggaggatttgtgcgagtggataaatgtgagagagagagagaggggagggggagggaaatgagtggtggagaggatagagatggcggaggagatgataaggatgagacttagatattttttttgtggcatgatttttgcaaacggacaacataaggttccgcctgcaaaaatcatagttttctaggcggacctcttaagtggttcgcctggaaaaattgatcttcacaggcgaacggcgagcttcactccggtctacattttcgtaggcggccatttagctccgagggtcatatctgtttggaaaaaaaccaagtctgcgaaaatgctttttctagtagtggatataattaatattccctccggttttttttatgttggtaaactcatctttgaactaacgaccaacgtcgttaaaaaaggaagggagtattactgatctatacaattgatgagttgtagataatcatatatattgctagacatgaatgagttaaaattgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1720 - DNA, 714 bp, Oryza sativa
ggaggagaaagcaagaaaccgggtcagatcaaggtagaagatgtggttttcccggtaaattcagaagtgaagaaaggaaagaattgtgtctctgagtttgatgatgacgacgatgatttgttggagtttgatgaggagccgcgagtgattagggacaagaaaggggatgatcaaaagggtggtgcacgggtgaaagtttgctctaggtgcactcaaaagggacatggtgttgctgattgtaaggtggatgtatattgtgatatctgcgactgtagcgtgcatgtctaccacaaatgtccagtcctaaagcttccaaagccggtggtgcagggcggttggctatgcggttgaaggcctaggttttcagcacatcccacatcaaccgcttcaaaggaacaagaagactacgaagaaggctcttgtgcatgtggttggtggtgctctttcggtggaaaggttggtcactcttctccacaagttgtgtccaactaaatggaagtgggagccagtgccacacgggaaggacacttttgttgttcttttcccttcaaagggcgaattgcaatgggccatcaactttgggggtgcagatgtgaaggaaggaggggtagccacgggagtgagggcggagtttgaagagtggtttgaggaagaagagggttttcttctacctaaggtatgcgttaagttttttgggctgaggaagaaactaag

SEQ ID NO: 1721 - DNA, 577 bp, Oryza sativa
ctgacactatccagctagaagaagcacgtgtgttaaggctttccttagccaaacggtgtgccactttatttgccgatctcctcgttcatatgagcttgaaatcctggaatgactggattcccctcttcagctcctggattacaggcccaatttcaaaccgatcaaaacttttattcatgaccaaactcacaacttcaactgagtccgtttcgaagactactctggttgctgcaagtcttgcacccacccgcgtcgcttcgaggcaagccaacgcttcagcatgagttgcacttaacacttccccgaagaaaatcctgttcgcacccataaactcaccccgatcatttctcactatcactcccccacttcccatctgttcatctgcagcaaatcccccatccgatttcagcttaatccatcctgattccggcaacctccagtgcattgtcggactaggacagtatgatcagatttttcaaatagactagcccactcttccagaggaacaaaattctctccaccgtcctgtctgggttatctgggatctgttgatccgtgcatcattccgtgctgacca

SEQ ID NO: 1722 - DNA, 814 bp, Oryza sativa
tgtcttgacaatcctttgtgccgattaatataacttctaaatttgctaaaatattttcatttttcgtatatatgtgcctccttaattttacaatgtcaaaagcattgataaaattataaaaacaactaagggcgatataacaatatcggccattgtacatcggcaaaccacaaccgatttacaatatgaaaaacagctaagggcgatataaccatatcggccatctcaaggcgatgcaaacacatcggctatcatgtatcggcaagcatcagccaatcatgcgttaacccaaacacttgggtaatatttcttcaagtacttgccatttagtgctcttccataaacttccccatcgagtccttgcaacatgtaagctcccttagacacaactttatagatttgcaacggtccttcccagttcggtgaccacttgccgaatttgctatcccgagtcccaatcggcaaaatcaacttccatacaagttcaccttccgaaaaatctttgggcaccactttcttgttgtaatgccgagcaactcgttccttatccttggtaacctttgcaagggctcacaaccgtgattgaaccagatcttctctctcatcggccataaggttataatactcatcgtctgttaaattattttgcaactccgttttccttgagccgattctaacttcccatggcaaaacagcctcatgtccatatacaagcttgtaaggaaggacttggatcgatccatgacaagccattcgataagaccacaatgcttcggctatctagtatgccattgccgaggataatcaaaatctt

SEQ ID NO: 1723 - DNA, 2498 bp, Oryza sativa
ttctattttttgatcaaaatataaaagggactacgaaagaggaaaacaacctccaggttaattttaaaaccatgttttaaaatcataaattggttgcagctcaaataacccatgggtattagtgaggtgattaccgccacgtgaaccctgtgtttagctttacaatgattgtactgcagctgtaagcagtgatgtgttcttgcgcatgcaggagtataatcttgcgtgtggcctaacgactaaagattgactatacaggagtataaaaggaaggattcctgtggaatgaaagtgtcacaaccaccaccactttttatcctctgttgaaatataattaagaaaggaagaaagaaacttatgattaaacagctgactaaagtgtgatctttaaaattggcagaaagcgagcgtgatggtgaacgtcacggtacatcatattgggaggaacgcaatatattaggtgttgtgggtggaagtgtctttgctgtatagaatcgtcatcgatgagtacaatgttattactgaattgaatcgtctcatttcaccaagtgtaagggcaatgcattattattccgttctaaggagagaaggagtaagcaatttaattttctctcgcactctctcgtaagaagagaagcaataaactttaaaaaaaaaatacaataagactgagttagggagagcagcttgccttagtttttttggtggcgcaaaatataagcgattaccaaatgattaatcgagtattaattattaaaggtttcataaataaatttatcttatttttaaaaagaaacctctacatagaaaacttttgcgtgaaacagattgtttattagttcggaaaacgtgctcacgttgaacaaggaatttttttcagcgcaataactcagcctatgggtgggtttgacttgaacatttagctagagcaaattgtttcatgtaaatgagacatgtcattaacgaataattaattaagtaaacatgaaaaattgatttgcttatttttttaaaaaagcttataaatatactacctccgttccaaaataagtgcagccatatatattcgtgtttagcattttgaccgttcgtcttatttgaaaattttatgaaaaaattaaaaaaaatagtcacacataaagtactaccaatgttttatcatgtaataacaataaaaatactaattataaattttttccaaataagacgaacggtcaaacgttagacatgaacagtgctaaaactgtacttattttaggacggagggagtattatgaaacaaaccatttagcaatttaggaaatgtgcttacgagacataagaaaatttgcttggccaagtagctcaatcaaacttggcctaaatttaagtttagcctatgtccttcaactaacatctcaccactttcttgccacacttcgcccccaatatgatatcccaaaaaaaaatgaaatcccatcgtcgtcaacatagtagaatacacttcttccattctaaaataaacaaaatcttggtacatatatgacatattctagcactatgaatctgaactatccaaactatccagactcatagtactgagatgtgccatattctatactagttttatttattttaggatgaaggaagtagagctctaccatggaccgagagttgctcgaacttgatcggagaagctaccgtctattttggtggtcaatcctgagtggaatggggaaatagggttcgagattcgaggatggagaatgtatatatcactagtcttttaactcaagtacctagatgagtcaacgaaatcaccacgtcggtgatcaacgtggtgcaccctaaaacgggtgcccgaacatggatatctattatatttggtgatggacattactagaaaatattttttttacaaaccgtcaaaacggattatttcaggcggccattcaccccgcttgtacttcaaggcttacgaaaatacgtcatttttataggcggccatcggtcccgcctataaaaatgattttcgctggcgatctctccatcttcgcaggcactagatccacctgcctaaaaaacattctcggtgaaaaaaaaaatcccccgccaccactccccacccgccgccgtcctccccttctgactagatctagggttagggttttgggtggaagagagagaaggagagggaggggaggagtggggtggggaatcgtgtagccatcgaccgccggccgctgccgccctccctcctccggtcaaatctaggagggagggaggaaggaaggggaggggagtgctgcctccgtcgccgcctgcagtggctggccaccactgtcgctctcctccttaggccagatctgggagggaggggaggggaccgctgcctgtggtggctgccgccactttcgcccccctcctctagccatatctgtttgcccccctcctctagccaaatttgggagctaggtgattttatagtctatttaaaaaaaataaaatcgtggggggga

SEQ ID NO: 1724 - DNA, 1230 bp, Oryza sativa
atttcagaaataaatttcaaggccaacttgtgggtacaatcattttgtttgcactacctaacacagtagcactcacacacattttattttgttctgaagtatttaggtgtaatgacatccccggatttcataaagcttgtgaaaaacgaaagcacaaaattgcagcataactcaatattctaaaatggcaaaaatttacagttttgtagtgagctatcaatatgcatatcgaaagcctgttgtaatgaagcaagggacaaacttgacaactaacaggtttattttctaaaattgttttggctgtttaatggttacctttgcaagaatataacggggtcgactgccaatccctctcacaatctccactagggctgagctcactttgtaattaatttctaagctttcttcaggagctgcaagataaaaattacaatcttgttaggagatcaaactactttaagaaaaatatataaaataacaaaacatatttttcctggcgtaaaaacaactgttgtcaggtaagtcagataacagtaacatgtcatgaattgtcattgctttaaaagaaggtaaaatagctgtcctcataagtactactccctccgtttcaggttataagactttctagcattgtccacattcatatagatattaatgaatctagacaacatatatgtttagattcattaacatatatataaataagggcaatgctagaaagtcttataatatgaaacggatgaagtattttttaacactgagttaggtacttcattgagcctccagggataccaaaataaaaatttaagtagtaaacatgttttaaaaaactgagctagacatttttactatagcacaaaattttcaggaacaaaaaaaaaactaatttggttaagatttggtcattacaaaggttgcaaataataggtgttagttctaaataagcttatttcttgcacttttagattatccatatccctagattgacaaattctggtctgtcttttggtacagttaatcttggttaatgccaacaacataagaaaaaccgatagtgaagtatctccaacagaatgttgagagaacatgataatatttcttggatcttacgtgcttatcttgataatcaaacctctacactgcacaccttgctcacaaaattcgccaaatggatgtgtctcaaggcattagcgataagtcaagatttaactcagcatttcaatctcgaat

SEQ ID NO: 1725 - DNA, 482 bp, Oryza sativa
gagaaatggaagcaggtatagttcctaccttctaatctttccttgagtttaatcacaaatccaggagaaactgttgaagataggatgatggatgttccagcggccattactgaaaagcaaaggtattcacaaacatataactggagttcaccaaaatagtaaacctaactaaaagacacataattctataaaaacagaacatggcttaattttctagggattacctgatacagcaccagcatttccatatagaacattttcagcttgaacttcatttgcaaccatgataacaagtatttccacatctgaaataacctcgtatttaatatttcaggcagggtatctccataaatactttcaacatggtacagcttttaagtactaataactagttagctcaacattctgtacgtagtatatcgccagcaagtgataagtgacaactagtactacctccgtgccaaaatatagcaacttttgaa

SEQ ID NO: 1726 - DNA, 25042 bp, Oryza sativa
ggaatgtccacaggaggcaacccggttggccgttgtgtgattcgaaaagctaagttccaaaaacttcccaaaagaaagtccacgtgccgcatcagacatcactactctttgtgttgctggagggattccatctttaggtttgcacctgaggcacctgtgccacatccatatcttcccatcattctccccaggtaaccttacagaggcaagatttctaacactgattgtgagactgccttgtcgatgggtgtagcatcgaacatgagattctgcaggttccttgcaagattcacagcacgaaatctgccagcgaagaccatataaattaataaggtaataaaaggtttttttaaaaaaaaagaatagaaggaggaaaaatgctgcacctgattaaataaatcttcgcggaaatatctaccgagtggcttatcaaaattaccgtagaactttatgcgaaagagctgcgattgcttgcatacaacccctctctgaggacatgcgattgacaaggacactaaaatgctttgtggattatcagatgttgggaaatattcaatgtggttttcattatggtcacgtacagctaatcctgcatgttcttcatctgatgtattttgccaaccattatccaagtcactttcaactctatgaaaacgtggtcccattggtgagcttttggatgtctgaacaataatgtctgaaggtggtacacaacccttatcaagggaggatcttggagaacgaggatatataccattagtgacaccgatgtactctgcctgatttaagttaggtcccagaaaagatttatccgcagatagcgggttttcagaatcattaaggcaatttgcaggcatgttgcacccattatctgaagttttctgaccaacaatttgaaaatcgttaaaatcctgaagacagtaacttgaggaacagttcccaccatccacatgattctcaagtggaagagctgaaatatctgaagggatctttggtagtgttgcaccctcatctgcaagatatgaggtctcaagtgataggtgataggctgcaaatagtgcaaactgtagagcaagtttaaccctccttaactcttcgtgggatgtgcctcttagaaggatctagtaaaaaaacaaggtggtttgattatgtaagtcacaaaacaaagcatgaagccttacatgatcatggcaatttacaataggtaatcaatatgtaactttgatgatcattgagtcaacaacgaacagtatgatgcttaccgtgcagcccaaccgtcttggacaaccatcaaaaaacatcagtgtcttggcagacttcttgtttgcattctttggtgatgaagactctgaaactcgttcaatccagaatgtttggcactgtccaagccttaccgaagtaacattttcaatggatgaagcaatttgagcacctgtgcagcgtgatatcctttctagaagtgatctcttgacattcagaactaaagagatatcttttgcaagaagctgttgagcatatagtggcacgcttttttcaacgagcaaaacatgaggtcgttgggcctctatttttgcaactgcaatcttaaggtattccttttcctgtaaaatcataatttagagttcatcatttacatgttgagagcaatcagataatcaccttaactagaaaatgaatgatgtgtaacctgttcaagaatgctgtttatcgatgctagtttgttcgaagccttttggtgttccagtgctccccccaaaagaagcaatctagggttctcatgctttgacaccatgcgtttatgttttacattcttagaacaaactacacctttaatgaaagtactgcaaacagatgaataccatttagccccagcaataaaatggcaaagaaggtcatgcaattcttatatacatgttattcattaaggcatacctatcattgggattccctgatgctacacatttgactttgacatagtccgtgggatccatgctaccacctttacttgtatctggccttacaaaggtagccgcctgccatgctaatgaggatattatgtctgaccatacatccacaggatcaacgccatgaccttggagcagctgggacacaagagccctgaaatgcccatgcaaagcattccttaggaactctttatgggctatattgtgttttccttttattcccagcgaatcatcttcaccaccatgatcatggttaacacgtgtgaaggtattcgtatcaccaacatcattgccatcataatcatcatcatcgtattcaaaaaaaccattttcaaagtcatcaccctcgtcctgaggtggtggtggataccaaatgagtctgttactctcaaaatcaatcggtatcgaggtattgttctgctgttcatcaccgcaaacaggtgaatccacaaagctagaataatcgacatcttcagagccatggacagaattcaaagggtagacaggagagtggcagctcctcctggaggatggacttgtgtctcctagtcccaatcgtctcacgggactatctaccgggctcgaagtccccaatctgaaggtgtacatcctactaatacttgtgctcaccgaatctgtatccgaagtgtcctgagaaaactcactgtgcggagagaaataccgctccgagtcatcaccatcttcataaccaacactcctatacatccagcaaaccttattcagtgagaatacttttttcacgctatatcctcctggctatgcatcaaaaagctaaatttctcaccttgtcgagcatcggagaggaccaggtgacgagaggcgccgccacccggcgtacctcgacgaagacggcgtggggacgcgctccggcggggacaccgacggcccatccgtaccgtcaccacgctgctccatggcagcgcctcggcctccgttaataggccggaagccgaggtcgcagcgctcgccgcctccgccgccgccgcaatccgtcatcgcaaggtccgcagtccaagaatcgtacttctggacgacgggaactcccataaaagcagcaagaaccgcctaaaacgctaccggagtaagcccaaatcaagcacttcttgatctctctctctctctctctctatactctctataacccacaagaagaaaaaatcccacaccaaatcacagcaaaagccaaccaggcgaacgaaaaggctcacgaatcgtcagaggggaactaaaagggaccccagggagcgcctaatcctagcggttcttggcgtcggcgcagccgaggcattccgtcgaacacgtggggcgcagcaacgcagcatcgctcaatactccccaatccagcaccagctgcgcgactcgggaagcgtcggagaaggggaaatcggcggcggcggcgggtttccggcgggtagaggtggaggtgggggagggggagggggaggcaccacccatgggaggaagaaggaagctttttttgctggtgcgacaagaatgaggtagatatagagagaaaaggaaaggcgagcgggtaagacgattaaaaaaataaaattaagtttggtggggtagtagaatttttttttatggttttatccttccttttttaaaaatatatttctttccctttttttatttgtaatttaccttttcctttgctttaattggtcaaagccaatgggcaacggacttgtgttcctctcgctggaaaaatctgtgaaggcatttccttatttcatttgtcttttccatcatttcttgatatatatagaagtattaggtcgcgaatcaatttgtggatttgtgctgggtttgtttttttttctttctgttctgtatatacagattttgtatcatttgacatatcttgttccctattgagacttggctacatgtgtgtgtgttttgctttatcttgtactcttcgagtttgtgtctatggactgctgttgttcacaaataccacccatcctaatcatactgatagttttaattcaacataagaatttcattataatggagaacttttagataatgacactagttcatttttcaaatatcaatcttataagtagtactctttagaaaaaaaaggtagatggattcccttatctcaattgatttgtatattatgcaccgcaataatgcaattttgctgtggtcttatctcaaacattatgtccataataaagttttatcattactacaccatcattgctctagattacactgaattgatttagccgaacatgactaatttgtgtcgcatattagcaagcgtgccattcttccggcgcttcaactcgtgccattctcattatcgtcgtccttttgtctctaacccattttctatccacgtacctgtaaaatccctcggtagtctcattatccaaccatggtcatattgtaaaatcaaagttgaacaattagtattggatattattggttttgatatttgaaatttatttacgaagtggttttggagattattggaatttgcaggtgaataggaactgctgcttgtgatttgggtccggtcagaccggacaggtgctgccagtcagaccggccagcccgcggtctgaccggccaacactgtatcggtttcggtttcgggttgtttatttagatatccgtgattgtttcatatttatggcttctagatagatactatgcgtatgtaatactgttgtttgctactaatgagtcaagttggagatagcttggtctcggaatatagttttttttgtttaattcatgtgtaggtgacttgatgcctcaagagagtattgccggtgatagatcgggagtcggcttaggaataagacaatgtccatgacggtcagatatcatgcgggatacttagtctagagttcaatgcacgtggttgatgaagattttatatggcatacgatggaggtattgtgtgcgtataggatgcggagttgaatttggaaggagtccaaatttggtatgattggttatgcaaagtttgtttcttgtacgagaaggtttcctaggggattaggactttagtatgagtttggttcgtggctttaggctgtctacctcatatataaatagagagggagcgtgaggcttcccggtatcgcttttgagagcaattgagttgatagtttagttagggtttcgagtttagtcgagatttttgtaaggagtgctgttgttgcactttgtaaatacagagagaagcaataaagttgtcattgagagttcttcgatttgtgtttcatcggttttggcggtctaaccggcgacacaccggcggtcggactagcggcaaggcagcggtcagaccggcagcgaacctgcggtcagaccggcggcggcttcaggcgacggcagctgatctcggcggtccaaccgggcgatcaactccggtcagaccgacggctatcaagcggtcagaccgtgatccgtcgaatttcaaggtaacttttatttctgctaaaagtttgagtttttgggtataccaaccattcaccccctctctggttggcttagttctggtgtttcgatcctacacatatgaggataaggttatctagtttttttcatggcaaagtttcttacatgacacttaaagttcatggtatttattgtaggacaataaaaaaatatgtactccctctgtcctcaaatataatcatttttggaacttgacatagtcttcgagattctaccataagcaacaatatctataaaagtaagatattttaaataaaaagagttgcatattatgattgtttgtttaatgataaatctaataacatcaatttaataacatcaaattttacatgattgatcattttttttgcttttaatagtcaaagtaaaaaatatttgatttgacactatactaaaaatgcttatactactcctatgagataccactaaacatggtaattagctgttggacattaaacgtgttatatatttggttcagagagagaaacggtgtggaaagtaccaatttgcctctatgtccattgtcatgcctagaaatttagccaaaaattccagactatttcgtgtattaaatccctatccaggaatcggccagggtacacaaaacgacaaatttatatacaaacccaagcataaataaagcgtaaatacttacagaagaggcacttagtcctcatatcaaaagaaaacggcagcagcggaaaaagacgatcctagcggggcttcagctccactccacaggcaaaactcaactagggtctgaaccttgatcctctaacttcatcttcggctcaggagcactacacttctgaaaaggaggaataatagcaaccaacgtacttagcaagccacaccaatgatacatgtatgcaagggaatacaaggatggtttgtggctatttgcataaaggcagatgtaaaacatttattgttgaaaatagtaaaaacagttgattaattaaggcaagattatatctccactgaacaaagctaccccacgttgaacaagcccaaccaacccacctgaactacactagttcattaggtcaagttattaagggcgtaagattaatcacggtgattctgggcaatcacccataaccgcgggcacggctcttcgaatagatttattttggccagaggtgtacaactgtatctacaaaacacaatccatcggcatgtcaccgtgcctgaccagacacatcaccatgtcgagtgattgtgacaagactcttcgcataactccccctgaccaatcgatgccacacctcaggtttcaccccctctccccagcaggcagcgggcagcaggcagccccccctcatgcctaggtgaatccggaagcagcaaaggctgtcacagggcccatcctaattccatcacgctcacctttgccgcagtacgtcagttagagaaaagctatactacaagtcaacaattacccattaccgcttgtggtaagcgcagtaagtcttccagtgcatcccgcgaaccggtccttaattgccatgggtgcgactagcaaaaccatgcactcatagcccaccattcagtcgcattttagttggataattacgactaatgaaacatggccgggtgtcccgagcacgcagctcgtcatgatactaagtgtctaataatgtaattatcccattatgtgagctagtggtaattaagcatggctaagcatatataattctagctaggtcaacataagtaacacaagctagtcaaattatcccccaagtttgcaaggaatggatatcaagtaatatggcacaagcgaacagataggtaatcccgtaatcccatgtaagcaaaacatgcaattttatttacaaacggtaaagcatttataaagtaggctcaatattttcatggggaatgtgtgacttgtcttgcttcttcaattcaatcctctgaactcttttcctcgcaaccatgatcttccgaaacgacagaaactacgcgctggcacgcaaaacgaggaaaaactctaataaaaaccaagtaaacagtatacataaaaagtaaaccaacatgcagagctcaattttagatgaattttgcaagttgaatggcccaatttggagttcgtaggaattagttatgaattctagaagttttgagccatttatatgaacttctataattattactcgaattattgcgcaattagtacgatttatgacgtcagccgagggaaagaggcggcgtcgacaagcgggccccacccatcggtgactcaaggcagcgggcgcaccacgtggcgaccacgtggcggccacggtggacaagcgggcagagtggcgccgacgtggcgccacaaagacaccaacacgggccagcaccgggaggccacgtggacggcccagattcacctgaagtgaatcgggttgccatgggcgagcgaggtggcaaggctcaccggcatagcggccgggagatggtggcgcctggcccgatggtcgccgacgacgactaccggcacggcggcacgcgcgggaggcagccgagagaggggataagggaggggagacgaaggggtgctcaccgagcgcacaaggcaaggaggcggcgcgggtggacggccaacggcgaggagaggcggcgaccggggaagagcgtggcgcggcgaagccagcgatgcgggcggcgcgtcgcggcggcagccggggtgatggcaaacggcggccggaggcggtaaaaggggcggccggtagggtggtgtggcatggagggggtttcggcgacggattgagggcgcgaaggggaggccggagtgcgacgtcatgcggcgaagccggcggtggtggcggcacaacgcgacggtggctagagcggcgaggagcggtggttggaggcggtaaaaggcggcggtggctcgggtttgtggtggggaggtggttctgatggcggtttggggaaaagaggtaggggccggggtgcggcgtagagcggtgaagccgacggtgagaacggcgcggctcgcggtggctagggcggcggtagcgtgcggccggagggcttcggcgagcggcgaaggtgaggagcggcgtggggagagcgatggaaggcgcggcaagatcggggagttggggaaaaagagagagggaggtgtggtgagcatttttatagctcgagggggagaggagagggccggtgagcggcagatttggagggggagtggggcggtgtcgtggggtggtggcggctcggccggcgccgaatagcgcgggacgagtgggggataagagagtggaggtggaggggatgggcggcgtggtccaggctcgcacgggagatggcgcgaggaaggcggtgacgtgggaaggtggcggccatggcggtttcggccggaggtggaagagagagctgacaggtggggccgccgatcccacctatcggtgaagggagagagagagggaggcaaaacggacttgaggggaaagggggagctgagcgggctgtcgacccaagggaggagaggggaggccggcttgagagagagaggggcgcgcgggccgcgggagggaaagagggcttgggccagaagcgacccaaagacaaagaaggggatttatggttttttattattataattacttattgagctctgaaaattcacgggaaatttcagagaatattaaaaaatattcctagccatgatttttaaaggaaaattttaattctctcattatttcacttgattaaattgcattaatttttaatataatttctagaaatgatttatttaatgatttttaatcccgaacgaaaatcagggcgatacatccatcggcttatagggctattgggtctgactattcacactcccctgattcgatccttctcactcctctagtctgagtctgattcgaattagatctagtcaagttaaaaaaaatgaccccatgtgtaaacttatcttttccaaaaatttctctctatttacagagaatataataaaataatcattatgtatcccgtagctaactaccatattttccttattgtcctttaagtgccctgcagtaaataccgcaaattttgaatgtcctgtagtaaattttctctttctcgttatgaccataccggtctcattctcactcattttcccatgaatggaaaaaataacaaaaaaaaaccttattatatcagataatggggtcaacctagtctaaatgaatccagtttgacatcaaccggcacaaaatcaagggttaaaaccccaactggttgaaaatcatattatgtttgataagtggttggttttgcccaacatatatagtagtttccttgctaaaaattacttaaaaaacatgaatattagggaataacctaatatcaaagccttcgaacccaggtcgactagcacaccaccttgtgaagctaaccggaagactcatgggcatttctcttgctagaaattactaagtaatcgtgtacgtgtatgcacgcagtggcaaatctatactttccatatatagttagtacccactaacaattattagaagctaaatctcaacatgcaagcatgccacatcatcacccactagcaattactattctagcctatttaaaatcccatgcaagcatgccacatagtcactcactaataattactattctagtatattttaaattccatgcaagtattacacatcatctacaatattatacaatattataatatagagatcaacaagtatatgtcaaatcatctttctcacattattttctcaacatttcaactttcatcatttcgataatatttaacatatactcatctatgaatcccgcagcaaagcgtggggtatcacctagtataaactaaaaaccaggtcaagaaacacacctttcatgaattatcctcccgtcctgacaataacagcagcttaattgattgttaattatataggaacaataatatggtatcaataagttatggggataattccgaacagttactttttatagtagtaataataaagatgcattaaaccaatgattcgtacctccaacgtcctaaaatataagatatatacttcctcgtttcacaatgtaaaactttctagcattattcatatttatatagatgctaataaatctatatatataataatgtttagattcattagcatctatataaatgtgggcaatgttagaaagtcttacattgtgaaacagagggagtaattttgttcgatgggatacatcctagtactagcatgcgtactatcgaactaaaatcctttatattttgggacggatggagtattagataatgatcctacaatttagatcgaattatgtatgttttctttggtgcatctagcaaagaataaacttgtttgtttgttttatatagatgtagacatctatatgatactttaaaaaaagcaagtagctatgtttatgaagaaaaaaaagagagcgtatgggtaaaaggcccacctgtcaggcaaaaaaatatatgtaaaattaggagataacaataactagcttgataattatatgacaatgttcatattaaaatttctgttgtaacgagctgacaaatacttaccagtaaaatactagcctataagtcgcacgtttgcgcgactataacctatctattagatgtatttatatgttatttgtgttaatgggcctaaatatataataaaaattaaaaataaatacattttaaacacattttaaagtgtagctataaaattaacaggttctatatcttgatttgtgattaagaatattatctaaagaaataatttgtcacattttacaacattgactccttcagtttctaaatctaataatgtaaatacccacatcctttacacgttgagaagtatatatatagtttttatcgtaaatcttataatcacatgttaaattatcttttcaaaatttactatgtcctccacgcaacatgatttataattttaaggcataatgaataattgatagcattaggttaattagttattcatatatacactaatactcgttatttttgatacaatagaactactataaatatttattggtgattttttatgtggccaatatattttttttcattttaatacctttcttaccacatatctcattggtgttgcatgaacattgttggttatttatttatttttttctcttccgatccagcagtcctctttgttcaaatcgtgcatcgaacggttaatatttgtttgatgatgtagctcatcttgatggtattttggaattccttttcacttatgtgacggtaggaaaaaaatatgagcatttaattttgataaattatctgattacacacaacagactctatagggtacaaagcaggtgattatttacccccactgaaaaacttattcgctaattgcgtgtcaatggaaaacaaggcagatactatcgggaaatgggccggcatatcttttcattgacgtataccaaacattaaaagcatcccgaaagattggaccagtagcacatccgaaatgggccggcatatcttttcattcacaaagtcaccacgcattaagaggctttttctacgtgggtgggataacaacctcgagtaagatgttttgtgaaaatccaaattttcctagcagacacctaaccgcatgcgaaaataattatttttcacaggctagcacgttatgaggaccaactacaagatatttcggctaaaagacttccaaaagacaaaattccagaaatcctagctcgatccaatcctagtggcatagtagtcaccggtgaagccatcatcatcactaccgcagtccatcgtcgacactgcccatgcaaatgagtgccgccggatccgccgttgcagacattgccaatgccatccccaaccttcctggcagcagatctgccgttcatgaggcatgcgtccgatggattcaccgcctcccgggatgtcgcagtcgattcaccgccttccgtgcaaaggatgtgcccttcccgccatcttgccatcggaggaaagggagccgacacatagcttcaccgctagacctccttgccgatcaatccatggtcatcgctaccgccaggcggcccagaccttatctttgcttccgccagacccacctcaatacttatccaccgtcagtctatcgctttgtgagttgtgtgagaaaggatgtgaggatataaggagtgatttcatctgtgaaaattacgattttcatagtcgggcttttaagacggctgccaataaaaataatcatatttttacaagctaggaagcatatccgtaaatattaattttcatatacgggtattgagagaagactctatccattttcacatgcatgtctttatttaggtcacctataaaaatataggggttgtttggaaaaatagtttattaagtagtaacggacgtttcgccatcaacgagtacatcacctaccataaaaattagttataaatatgagtataccagtgtcaagtttagaaaagcagaccgcgccttaagaaacctaaccggcagccacaagctacaaatagtagtttcttaaaaagtaaagtataccgtcagtccttaaagttagagcgttgtgtcacttagatccacgatcttgtaaatttgatatttaggtccatgatcttgttctagtggatcagtacaggtccaaagtccgcttgaccgtattgacctaccagtcaaaactttgcacttagccccctccgcgcccgatcccaacctcactctaacccccacacttgcattgtggcgacgactctgagcgtggtgacggtgatcgtgggcactctatggtggccagagacaagatttggatggcgcgttaagccgtcagacgccagtcgatcagctgaaggcggtggcgctgtcagtagtgttgaggaagaagatggacctaaccttgcgggggaaggtgaagaggtgcctgtccatcctctttctatccccttccatttctctagttgaatctgtagtggtgaagcttggtgttttacgcaatttcaacgtttatctctgtagcagtttctaaggtttcacctagcagatgattagcggatcttgccatgctaaagctaggtatttaattagttggttggtcagttgatcttggtagtaactgacatgtaatctagggtttattatgttgcctgaaattgaatttgtgcactatagatcctacattgaagtatttctcaattgaatatacaggctgcttcacatctgcccgcctcctcttcactgatcaagccagacctctgatgatacttgacatacccctctttccaataccagaagttatatccagatccgtcattctacacataagttatatccagatccatcattctatacacatgcatcaatggcaaccactgttaggttggtcgaccagccgcatctccactgctgttaccaccgcaaccataaatcgaaagagtgaagaagaggggatatttggaggagaagtgggtcgaccggacatgaaaggggttaaatgcaaagttttggctatattggacaaccacgtagccaggtcaacggtcatacgggctttggacctacaatgattcactaaaacaaaatcattgatctaaatgttggatttacaaagatagtggatttaagtgacacgtaccatgccccaattttgaggaccggcattgtaccactactggagaaaccatctttggttgattgcaaaacccacaatggtcccggttgcttaaaaatccggactaaaaagtatttttagtcccagtttaaaaacacaataggactatgtgatctttaaaaatcaaaacgctctgtataattcctaatacttatcatcttcttccgtcctcacaaactcctctctcctctatctctttttcctctaaccttatctcttttctttctcactccttatctcccctatctatttctcagctgagcgagtgcacgaggaggactcacgagggggtgagcacacgaggaggacgccggccggccggcggcagagggtgggctggccgggcgcacgcggaggagaccgggcgcatgaggaggaggccgggcggcggccgggcacgcgaggaggaggtcgggcgaccggcggccaggcggcggccgggcgcacgaggaggtgcaccgcggagggttggtcggctaggctggggcggcgaccaggctagggattttaggatttgtgatgaatttttttgttgagaattcatgatgtattttactgtgatgtgaatatgtgatgttttttcagaatgtgtgatgtagccatctttgagaatttatgatgtatgatatgtgatttggagatgatttggggatttcacgatttggggatgattgatctgtgatatagagatgatttggagatttcacgatgatttaggaatggagtgaattcaatcttagaaacaattaaaaaaactaaaaaaccaatcgggacatgccctcttcctcttaagtcccggttggttaaccgggaacaaagatcttccatctttagtccctgttatttcacccaggactaaagatagctatctttagtattcctacagggggttacgaaccggggttaaaaaccctttctccagcaattgatggctactcctatcaatttttacttcacaagtatttgaatctaaagtttgaataaaaaacaatactggtagagttagtttactttgcagaaaacattgggcataactaaggacgctattttgatagatctaaacacaataaattaatagtatgtgataaacaatcaaaaatagatcaaaacgattataatacaatcatccgtcggaacatgcatcacgaaatataatgtacaacgcatgcaatttcacaattgaatgtgaatcaccttttcttttctaacattggacttttgaaatgaattacagaaaaactactcaacagtatcccgtacacgactattagctggcatcttatcctcttcttcttccttacctcttccccttccctctccccctctctctctgactaccaccctcatgagcacagagacgacggcggcggcttgctgtgcggggtggcgcatcgggcgtggagggcgctcggcccgctctccttcgctagtgccggggaaggcggtgccatgcggagctgctctcgccggctcaggaacgcgcgacggcgaagcggcgtgcgagctctcgtgccgccgcgctcgccgacgaggaccgcgagctcctccgtccctccgcccccacgcgacagtgctgcactgccgctgctcccctccatccatcctcctctccacaccggcggtgctgtgccgctgctcacatccattttttcgataccctgcaggtacccctcgcactccattcaactctggttgattcctccaccccccccctcctctacaccggcaatgcttcatcatcgcttgcatcccttcttcatgtgtgtttttctctttttttgcttgatgatttccttgctgattttttctccggcttatatggatagtatcaattcccctgtcccatcctcttgaatcccttcaattccacaggtaccacacaccatgcagctggtactatactggtaccaggtaccaggtatcaggtatcaggtatcgggtaccaggtatcaggtaccagcctatgctggctgctttggctgtagaggagcgatgccggggacgaggtatcacgcgcatgatatcgaggaggaatcggataggtatcgcacctttgaacgtggtaccaggtcccaggagggagcacacgtggaacctcacttatacaaaaaaaaaaaaaagagaaagggatgagtcacttaaaatatcccatagtaatcggatcccgttgtgtagctgccctcaatgaaataacatattacttacgagagaagatgtactggaataagttcaaataaaagtgcaagattaacttttctttatcatatttctaagtagtaacttattatacggagaaaaactaatgatattttctaagtagaaattaattgtggaagataggaaggagtgtagatcctctgcagtactactggtgtagtagcagtggctgacgtgtgggcctagtactgtaggcaatccctgttgaggaaggagtgctttcatggcctcgccaaggtatgacgagtgtctgaccttgaccatgtcctccaccattgcttaaattggcatcaccaaataaatcatggtgcccttagcactaaaaccggcaccaataatttaattattagcaacccgacaaacaagatgacttttaagatctttgtcgagtatctcgcaaatgatgtacttcctccgtttcacaatctaagactttctagcattgcccacattcatatagatgttaatgaatctaggcatatatatgtgtctagattaattaacatatatatgaatatagataatgctaaaaagtcttatactctgaaacggagggagttggaaaaatacctaagactcactattacatataaacaactttatatggaagaaccctaaaacttacttattacaccaaaattagccactttggtggaactgaagactctctcttattgtgtgtcttctctcgcaactcacaaagcagatcgtacaagacaaataatgccttgatgttcccttctcatctattcgcagacatagtaacatcagcaaaaaggtgccaatatgagtataaaaactgtcatgtacacttttaaccaaatcgtcaacatatatacggttcgacattattatatatacttacatgtacacctgaaagcaacttgttaatttgtttaatttggcgtcagatcgaacatgtttaagagtaatcaaggtcgtgtccatccgtagcgccgctctagggatatcattggacgatgtaggcctattttaacacattttataaatgccagagctcgatacaactagccagcgcaggattaaaaataatgttgtttttaggagtacattttgattctacactcaatacgcgccattctcacgttatcgtagtggttccgggtgtaatcttaacaagtagtattttataatttgaactttatttttaagccttaaaattgttttggtccaattttgaacttgcaactctaaaatggttcacttttcaacctttactattaaaaacagatagaaattgtgttaagcatggtcgatctaacgccaaatcaaacaagagcatttcttatggtggaaacatgtccatccagatttaagttctaaactttacacatatctcatatttacacttagtcattgtttcagtaatatacaatgtagcgccggtatggccgatctcttggaacgctgtggtgacttcgtatataggcgtttgcctttgagttgtgtgttaaaagaaaaaataacagaaattgccatcttcatcttaacccatccggttttggcttacgtggaattttcatatattgtgtgcatggcctccacacatgctgacatgcatgcataccaacaagtaataagtcagcaaattcagtcagagagaattgaaacagccggcatggcccgctcaacagttatgacagtcccttctttccattcatctctttctacaaatgcatgagttttccaaaaaaaaaaaagaaaaaaaagaagagacaaaccgaaacagtgagctcggatcgtgccccattacttaggattagggtatgaacagtagtttataattagttatattttttattatgtcatatatcacatttaataaataagccatctgtttagctatcttgaatatattcatatataactaataatgatataattctctaaacaacatatatagtgttgattgtgttataataacaattaatagctagcccataaaaacgttaactactagactaatctacttgcgtgtagaagagagaaacctctcttagcccaaaataaaatgaaattttgtcgtatagggatggaaagggaaaaaaatatgataaaaatattttggtgagaattaatggttggaaactttatatattgttcaaccatggtaagttgatagcctctataaaacaaagtatcatgctatatatgaatcgacaacaactcattttttcccctccgcactaaaaaaaattatgtcgaattttctcctagacacagacactattatttatgccgttttttacttagttcgaataagattgatggcttagatttttcggaagcatgtgaaatgatacaaaccattgacacataattaatcgaatattaattattataaatttaataaatgcatttatttgattttttaaaaggaacttctaattttttacgaaatgaactgtttagtttagtagttcgagaagtaagctcacgaaaaacgatggagcatcatagtcgagcagctgtttcgaacacaaccttaattttgtttatccacctacatgtaccaaattaagattaaggttgagaattgattttttttcattagaaggtttgtttaaaaatttatgaatttttcgtgtagcctccttacaaaacatacaaatttgtgtatctgttccaagatatctttcatgtattattcaaaaaaaatatttacgtgtcatatatgagagaggaataacttgtgcaaaagataatagaaaaaatattttatgtatagcatactccctcaatccaaaagtcacatatttctgtggtcaccaacaccaaagatcaagaaatcatatcatgcatacaaccaataagtattaagatgactgctcaggttctcgtcaataatttattctagccttatactctctccgtcccattttaagtgcagtcctagttttccgcgtccaactttaaccatccgtcttatttaaattttttttgaaaaaatttaaaaatataagtcaccagtaaagtaatattcatgttttatcattgcataacaacaaaaatactaattataaaaaaatttaaataacaccgtgtttagatcccaaatttttcttcaaacttccaactttttccataacatcaaactttcctactcacataaacttccaacttttccgtcgcatcgttccaatttcaaccaaacttccaatttttgcgtgaactaaacacagcctaagacggactatcaaaattaggcgcgaaaacttatatttacacttaaaatgggatagagggaataaaacaaaaagataatatttttattgaaatcttggatgcatgaaaattaattacaaatatgataatttctttgggaaaaactgaaaaatggaatatgcttaaaacttttgtacggagggagtataaaagatgatttacgataaaaaaaacaactaaaaagtattactccagatagggcgtacattttagcatatatacagatagtgtttccagcaaactccaaatgcactcctgtatatagtctggcttgttcctcgtgtctcgttctccattctccactccccacggctccacccgtccttcctccgagcgtcgctgggactctcactggaacacagggcccatgtagcgtgtcccagctgcacactgcacagcgtttttaggttgaacgttggatgaggtggcccccaggacagagaccggtgacgcctaaaggcgattgtttttcttcttttttatttcttttgaactgttattaaaggcgattgttggtggaagaaggccaccggattaggatagatagaccaacgcaacgaggagagacgtgcaggctggagagattgtgcatgccggagatgattggtccgtttcgagccgatcgcctatcgcgctcttgggcacagaggggccccgggccctcgaggaaggcgggagagacgggcagagacgcatgatggacggcgtcgccgccatgcgtgacgcatctgctgcactgcagtgacaccgtgaggtgagacagtgcgcggtacggtgaaacaaaaacgcgaaaccgacgggcagggagctcatatattctgcacgttgaaaattagaacctactatcatgcagtgaagattcacagataaacttcagcaattatggagccattgtttcgcttattcgtgaaataagtgaaatgtgtatttacaaaaaaaaagtaatttatatatataacttttatatacgtgttcttagtgatctacaatcaaaggctgaaaaataaacttcgatgaaaaaacctcgaaattagctccaaatttaaggttaaaaattcaaattctggcttataagtataagtataagcgaaaagatgatgccattttttctccttatatatgttggttttattgttgtctaagtatctgttttcttgtgagaattttatattaagtgattgtaacttcttcaaaacatatagcgaaatttttactccattatagaaagaaaaaagagtagcatgcggaaacgcgcaacgagccaatgcgaaaacatgcgtggtggacgcggcgtctccccgcgagaaggcaccggtgtcacggtttggtttcttcaggagaaacatgcgcggtataagatttttctgtacggggtttgttgaaagatgcgcggcaatgaattgtacgtcaagtactcgagtttttcttcagcgacttttcatgaataatgatcaactaaccgtagattaactagttgcttttattttatttatgcgtggaaaaaagctagtttcacgttaattaaggccggttttacactgtggttttggcttttgggtgatccggttaccaccacattaactagtataaaattgtttcgcctataaaaaacaattgtattataatcgtattaacaatttgccacaaatagcttatttgacattggtctggcagagtctaacctatcaaaataacaagttattaacgccccataccctctccgattttctctgttttctgaattttttcggctcctcgaagaggttaagcgtgttttgctattttgcaaaaagctcctcatgtttattaaaaatatcgcacataaccgactgacaccctgtcatgttttatccagaaaaccccttgtcttccagtgaaatacaatgtgaagaatatagctaacaacttgatgataatatcttagataagatgttgtgatgtatgggccggaatgaatcacatatgtcagtagttttgcaacttttgttatgtaggagtatatatactcccttcatcctaaaataaataaaactattacgagatgtaactcatcctactactactcaaattcagagtactaaaatatgccatattcccctactaattttatttattttggaacagaggaagtatgtgtcatcactttgtattgtatgtaatgtttttcatcatgtaggtcttttctttctgaacaggatagattataacaaatgatataaaagattacagaacatgtggttacaataactatacataacaatatatcgacctaaaacaaagaggctccacataatgtaatattttaaaaaacatgtaaccataatactgaccaactctgacatacgaaaaagcaaatgaacgaatatcgaccatcatatttgttcctccaacatagcagcaaaccagtgttgccgatcaatttagcgactcggacttaaaggctaaagccaaagccatttattcgatcatcggcaccttccaaaatctttgcataggacctcacaaaccaagttgccaataaaaaaaagaagcaaaatctcccaggcctcagtgttggcgcgatcaatgcacatctggcatgtcaagtggaagatttcgcgtcaacaatttccttctcttcctcttctccttcgcgagcagtgctgataacatgttcagattaaagcgagagcgagagagattgagcgaagaggattagattctcattgatcattggtacaaatatatatagggaatcggttatggacgctatggatggataccaccgcgttggttggaatggagtgccttgagagggcaaggagatgcgaggcactacacaactgcagtgtctaaccaccatcgggcacgagggtgtcaatcccatccaaggtattgatgagatcacccagagtttttataacataatagatctaatctccagagtttattaattaactcctaaaaactaacgagagaagggacgagaaaagtctcccatttccctcaactccggtggcagcaaggatgctcaaggtggagaaggtgggccaaattggagtggcaacaaaggtcctactaggtgtggctattacttgttgttattatatatggctatgcagaaattatatggtgtttaacaaaaggaaattttcatttcctttgcaggttatatgtctagttacatacaggttttgtacttgggctattttttagaagttgggttcacaaaatttggttgcaacggtatgtcagcactttgagtaagtggtcaagacacgttccccccccccccagaaaatagatggcgatttagcctaaggattggtttctcacaacttttcctatattctctaattgtaataaactttacggttaattggatccatgccataaaaaatatgttggtttcaaatttaccactagtattcgcgtatttgggccattataattttacacatgtttcagatatgccattacttaccccttggattcatttatgaaaaaaaaattgaaccaacctgcccctttccccttcttccttctttccctttctccttcctcctctcttccatggcgtgaaagacaggcgatagttcggcaacggcagcggtaagcatgactgacgatggacatggtcactatagccgccatctccttcctctccagcgctccttcggccaggatgtccgcgcctccctccacctcgtgccgctgctggtgtcctcctacgcagagctccacaccgacgacagcgttgccatggggccctcggtccccgccaccgatggcatcttcctccaactaccctgacgatgcggctcctccctcccctagtccctcgttacaaatacacaaagagtaatggtatatttcaaaactgacaaatttttaatggtatagatctaattaaccctaaactttatatgtatgtagggatgaaaacaaatcagaaacggaagaaacccacctctaccatttttgtttcctttttttttcagaactggaaaccccgaatacaaaaacatgatcgaatattatcaactacaaaaatgaagtgaataatgttatgaatatttatcaaaatataaaaaccacttaaactgaacttctaccttttttttctaaaacaatagataaaaaattccaaattttagcaaataacaataccactttatattataagaataacatcacaattcacataccacttcgttaaagtccaatttttcatcttttgaacaacaaatattgcctagagaaaatttcaagttcttttccgagaaattttgcggtaagtttatgacctattccactttctaacaaatagtgcctttattgtattcgttttcgtttgaggcaaaaaaaagtccgaatctgttttgttttctaaaagtttttgaaacaaaaccctaccgttacttcttgttttcaaaaacaggtccagaatctggaaactttctgaaccgttttcaaccctcatacgtgtgtgttggatcgggtgtattctagttatgcataaatcgggagggttctcaatatggttcttttttttatatataaaagactttcaaaatgatttgagttgaacaaaagttcttttatcttttaaaaactcatctcctcttttgactgggaaagcgttttgaattctcgagggggtgcccactcatttgttcaaacactatccaaatagttgttaataattctttaaaaaatttgttaacattcataacatgtacttagactactccagaaaaattaagtcaaaactcaaccccacacattgagaaatgaaatagacatattcagatgtgaatagtgtgaataatattactattcacgtcttaatcggtctttttcatttctcaatgtgtagatagaatttgaatatgatttttagtggagtggtagatgttagtatactctaagctggcaaaaacaaatttagaattttttcacaactatttgcattgaattggagagaaatatttacactaggaggtatcccctcaaggattagaatgttcttcctcttttgactacattatttgcgttggtaacagtttttattttccaattaaaaccagaatagaaaacatgtatagaaaaaaaagaatctatgtgcgcttaaaggaaaacatatgtttttccttttatgattaaacatttggacacaagaataatcgatcagcacatgaataataagtcatacaagatgggtccttttcgatttgtccaatcaattgcaagttgattctggaggaaaagaacattaaatagagtaaagaagacgtctccagtattatttccgcttttgctgaatgtatatattcaccaggataacaaaacaatggtagttaatgaaccggtcagttacaccggactaccggagacggttatatatcccggtaagtcgctgtgtatcaattatctggataatttaat

SEQ ID NO: 1727 - DNA, 1210 bp, Oryza sativa
atagaatttgaatatgatttttagtggagtggtagatgttagtatctctaactggcaaaaaaccccccaaaaaaaaaatttttttttttaaaaagggggaaaaaaaatttttttttttttttttcccaccaaaaccttaattttgcattgaattggagagaaatatttacactaggaggtatcccctcaaggattagaatgttcttcctcttttgactacattatttgcgttggtaacagtttttattttccaattaaaaccagaatagaaaacatgtatagaaaaaaaagaatctatgtgcgcttaaaggaaaacatatgtttttccttttatgattaaacatttggacacaagaataatcgatcagcacatgaataataagtcatacaagatgggtccttttcgatttgtccaatcaattgcaagttgattctggaggaaaagaacattaaatagagtaaagaagacgtctccagtattatttccgcttttgctgaatgtatatattcaccaggataacaaaacaatggtagttaatgaaccggtcagttacaccggactaccggagacggttatatatcacggtaagtcgctgtgtatcaattatctggataatttaattcgaagttaaaataactaagaagcaatttatgagtagctaactattgatagtcaggaaaatctcggggttcattttcctatttattttctgaattctccgtaactaatgtttctgaaaatacgtagccgtcagaaccccaaatagagctagagggataaggtggaacaaagcaaagtcaattgacgtatttaccaatggaattttgtgtattcgttgatattccatcatttctttttaattactgtgctaccgtagtactccctccgtcccatatgtcacatccctccaaaatctcttatattatgggatggagggagtagagtattttttttgttgctccaccgttcccaaatataaatatttaatttttgttccaaaatataaggacttgtgagaataaccgtctacagtgcattaacttgtggttgtgtcttaatgactcaactcgatccatagattgctgctaaattaatactatcacttaccaatcaaaagtcaaatatacagagaaagctacccatcggacgtccgatgcccatcaaaaaatcggatggtcaaatgttgcagttgaccaacaagtgaagcat

SEQ ID NO: 1728 - DNA, 686 bp, Oryza sativa
cagggatgggaactaatccctcctgcacggaaaatggaacgatctattagcacatgattaattaagtattagctaaattttattttaaaaatgaattaatttgatttttttaagcaactttcgtatagaaactttttgcaaaaaacacaccatttagtagtttgaaaagcatgcgcgcggaaaacgagagaggagggttgggaaagttggaggccgaacacaccctaagtattctgtaaaggaacattggacatatcatattactgttggaccagactttagatgagtaattttcttgagaaaaatgcattatgatctttccttgaaataatgacaggaccttcgtgcattgacaatgaagaaaggtgttagcttggttctccatggagcatccggactgcctcatgaacttgtaaaggttcgatatactgtttctgtctttaataagattgattaatgaagttttagcctgtactcgatgagtttccagcaattacagaagtttgtttttaccttttttgggtgaaagagggaaatccatcacctatcactccccatgttttctatgttttgtttaatcagtttgtgcatgtgatcgaacatggtataccatattcaaacctagactttctttgttgaagacttgttaatttggagcatcaacgatggagaaaaataagtccttc

SEQ ID NO: 1729 - DNA, 1350 bp, Oryza sativa
cggagtgattgatgccattctgtcatgtgatcaagttcatgtccatactacatacgtcgtctggtcctttagagcaacatgacttcaggacgttgctatcaacggctattgatgataaactagtaataaaatttgtcgatgaaattacttgccgtgataaatgattccgttgtcgccaggttacagttattcaacgtaagaacttcatattcattctagaaaccaacactattcatcaccattttcctcatccccgaaaaactttgaccagtacctctgtttttgccacccccctccctccccggccacaaggtgtagaatcaagtgccatcgctgaccaatttgagctgctcccaattaaaatacaaactaaaataaaaaagtatagaaaaaatgaaattacctatggataatattatgtcaatggcattaaaatttgtgaattttggcatttggataatagtacctccgccttaaaatatatggatttttcggattaggcacgagtaataagaaagttggtggaattaaatagaaaaatattatgattggttgagaagaggaaaagttcgtgaaattaaacagaaaaatgttatgattgattagaagaaaagaatgtaagtagttcgaatggtgtaaggttgtgattggttgagaagagaatgtaggtagagaaattgttatatgttaggataaaatttgaaggatacaagttgttacgttaaggagagagtattatgtctatgtactatcaaaattcaattatgattttttttcaacttaagctgttttcgtcaattggacgggatcttgctacgaccacgatcggtttggtaaacgacctgccccaatccttcccacgcacctcctctcccttcccgcgatcagtcgtcgcctaccaaccaactacataatgctctaccgacacctcataaagctctctcctcccccaccctacgctaccgtctctcgtgcacgcacttcacgacgacttcgccagcaagggaattgtactccagagcaacagctcaaccgacgacgagagctcacaacattgcctttgcaaaaaaaacaactcgcgtatttcccattctttatacaattcctgttatagtgtggtaaaaaatttacacgtattgatctctaggctgcctggattgatcggcgtcagccctctccagggagctctcgatcctgcccgttgtgacaaaaataacatacacaaggcacaataggatcgactattctaacaaaaaaaaaacgaaaaaagaaagttaagaaaaaaaaaacgaacggcatgttcttctcccatcattccattttgcacttgaaccgtctggatgcgtctga

SEQ ID NO: 1730 - DNA, 444 bp, Oryza sativa
ccctttgaattcagctagctcccaccaaacttacaattataattattaaacaaattttaacagtttgcaaaatgatagccttatggaactggaagctctatttgcgtatgactttgaagaaacatagcatacaacagcagaagtgcaagtgacttaccgccagaaaagaagtatcattccagacagctcgctccaaccttcgttttgctttgcttccgagaaaaatgggctttgtatgaagtgtctctaatagattcagatctaagagaactttgttgtttcctgatgtatcaggattgtaacgggaacgcaaagagcctttcaggtcatatattcttgatatcttcttcttgtaaaaaagattttccatgaccattacatccaactttagttccttgccatctctcaagttcctggcagcaacctagtcaaaaatacgtagcg

SEQ ID NO: 1731 - DNA, 891 bp, Oryza sativa
  unsure (1)..(891): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccgtcatgtgcagcagccatcggattgagcagctggctgccatatttccatgctatgcgcacactttcgttcgatcgtaccacacaggattttccttgtcacgtaactatctgcgtacagtggcagggggccaggcagcatcgcatgcacggctagatgccatgccagagcacgtacaccgagtttaacgcgccgcgcccccaccagctaattggcagtggcaccggcgcaacatgggcaagcatctgctgcagcagaggcgcagagcccctggccgctggcacttgccccccgccccgcgtgccacggcgccatatgcgtagctacgcgcgcggccggcctgatcatcaacgcgcgaggcagcaaattcgcgcggcgaacgtggcgcacggctgccgagcagtgattttcccggttgacgagacgaggacgtgaagcggctcgtgcgcgcgcccgggatctccggatggtttcttcacctcgatcgatctcctgctggctctgtggcaggccgtctttttgcctggatatagcacatggccggtctcacagtgcgagctaggatgcgcgcgtgttgactcgtgcgacacctcggagccttgcatacgtgtcgtcgtgggtcgtctccttatttggtcgctcggctctttggtaggaaactggttcctcacctacgctcgaggcaacacgacgcacacgt

SEQ ID NO: 1732 - DNA, 3213 bp, Oryza sativa
acatgggcccacttgagttcttcgagaggtcacgtgcactgcgtgggagctgtggacaaacgtttcgctgggcctaaacatatgaagtttctcggatgcgtatcatgcactgtgattggcctaagctaggtgagaagtttatcttggcagcaagacgtagctgcgggcgaagcaaaccaattagcctatgataatgtgtgtgttgatgcaaatgtaaagtgcggttgattttttaagaggtaaacggtgccatatcaatccaacaaaactatactagccggtcagtagcttgtgtttttatatatctacttcaatttacagctgacatcataatatggagacatggtgggccagcgtcgacatttcgggttatttttccaagcaataaaaaacagagtaatggatatgacgggataagcaccagaaatggaggagaggcggcagaaaagagctgctaaagttttatgaatatgataaaagatggcagcgggacggggaagaagagcacactgctatgaaaatcatttttcatgcagccaaaacatatttttgcaagaggccaaactccatgcctgcaatcaaaggcatatgaaaatcattgatttttttaagaggacttccatccacattttcatatgcggacaccctaagagacttgcttgcaaaagcaaatttcgtatgcagaacccttaagtcactagcctgcgaaaaggtatttcgggccaaaaaaataaaaattgatttttataggattgaatcatcgatttaaattcacatcagaaacatatccaaaaagcactacgtcgacatgcatctttcaagcattttctcaacatgaataagcacgactcaatcaacaataacagatcagccataatggcaactcatcatcaacaatagtatatcaacaatagaaaatcttggatcaacaataataacatcacaatccaactcagcgcataacacgagacaacgaaggtaagtagtagaagtagatgctactgttggaaatggtcggctagtgcaaaactggcaatatttgtctctgttttctgttaggccatgcccaaagttcctatgtggcatgtggtgacagctcgtctcacctgaatatttgagctagcttggatggatttgtaccactgtacggatgtgtgaactctacatgaatgtgcataccttgcaggcgaggcaatgactttggtgctctaggcctggagagagaaggggaaggagagtaaagtgagcgcacttggagacttcgataagatcgagtcggtatagcacttcggcgagtagatggggtggtcaaacagcatatcagaccactgccaatgaaattgacacgacctcactggagaaatctgaagcaagctcctgtcccatcaaatcaatacagcctcgtcgggccgagctcttgtcccactacctcgatctggccgacatagcaagctctgttcataccatggggagaagtggagaggtagcggcgtgtgggaggatgtatgtgtcggcagcagtagtgaagcatcggaggaagacaagcgggcagcacgacatggcgcttgggagtaagagagtgggcatcgcaaggtggtgatggggacaatgtggaggtgtgaacaacgggaacaggataaggaagataagtttgtgaggataggacaagtgggccatggactaatatgttaattgttctctactttgaggggcttcgttgcatattatgtaattccaatatattttatgacctgaaagtaaaaaagaaacgaagggttgacatcgaaaatggatatgaaaggagcttgatttcacctagacgaagggtgaataggcgttcctgaaaatcactcgcagcgaattcatgtttaccgaaactttaggtccgaggcaccaaacttcaaacagagaaagttgacctgaacttcaggttcactttcgttgtttcaaacggagaaagttgacctgagctttagatacttggtatcggaagttccgacaccataagactgtttcttcgaggagaaattgctcggggctgaggtttcaacagagtaaaagtaaagtaacatgaacacaaggggaaaaaatgcacaactaaggaaggcacgagatttttcaccgaagttcagatttttcaaccctactctccgttgagaagctcctaagagccagatcgctttcaatcccttgcctctccaagctgttaaccaggggaaagctccgatcaccaagcaaacaccaaggatcagtgggtttcctcccaaccacaaaggttcaaggatggacaaccctcagcttccttgggtgaagcttgctctatcaagtaaacacctagaaattagcttggtattgcctaacttacctctttcctggcggtggtgatgcaaaccttacaaactttcctgggcaatccacacaaatttgaattctacggacgatgcctatctggctaggtagagaaccaccaagagtaataagcatgttgacgaagccccgacattgatccaagtgctcaagcaagaaacatagctcccccatctctcaaaagtcaaaatcccatcactcacaagatttttggctcaagaatcaaggtggtagaggctagaaaccctagagaggctatggagagaggtattgaaatgtattccagccaacccctcaaatagggggtggcccggtttaaatactcgcccatccccacaactggtcgttactcacagattcaaacaccggaagttcagtctggagactcggccaatagctaggatggggacttgaacttccgatccaaaggacctgaactttaggtcttggtactctgtcccgaactggaaactgcaactcgctttttcccttcatgagtatggtgcattgtgtctctctctaaatagatcaaggtcactctagagtacttggacacacaattcaagacaacgacacaagcccctcttaatagtgcggattttcctatgactgaaattcaaattaaaataaatttaaattgccttgagtcgaataccactttgttttgtgttgtagggatctccctcttcttgggtcaataatatatgggactaatatatgcacttatcttgataaacttgattagtccccaaatatatgttgtcatttatcaccaaaacccactaggggtccagatgcactttcaggatgttgggcccatttcatggtatgtgcgttgggagggtt

SEQ ID NO: 1733 - DNA, 1478 bp, Oryza sativa
ccaggtggtagtcgtaacccgaccacttaaagtggaagtagtgggagaaacgctacatcgttggccgaggaccaggcagtagtcgtgactcgaccacttaaagtggaagtagtgggagaaatgctacatcgctggtcgaggaccaggcagtagtcgtaactcgaccacttgaagtggaaatagtgggagatacgctacatcgctggtcgaggaccaggcagtagtcgtaactcgaccacttgaagtgaggcgagagagatcactacattttactggttcgagaaccaggagtaggagtctcttaatcacctataggggcgctaaagttggtttattacatgtgcatatcatgtggccagcatgactcacatactcaacttatagcatatccggatgtccgctcgcattcatgtcgggtgatcaagccgacggtgttcgtgaggagttatccgttaacaaccttttctcgagtagtccagcgatggctggcgcaatgagataggtcgtcggtcttctttggtaggttgggcgcgacgactctgcatttgtcgagatcgttctcgataatgcggtgtactcgaccatgacctactcgagtgcttaattgttcctgaaaaatattttctagaaggtaagatatatagcagataatatcgagtatgtactcaaaaaactgcatggatcttctagtattatcaggatataacgagcagatgtaaatatcaggcattatgtaaaccgtaaacaagcatgatttatacagaagataacagagcgagcccctagcgttagaccgtgggtggtttaacgtcggaaacatccgcggaatagatattgtataaaaaatatgctctaggtaaacataataaatcacggatttgacaatgttgtatggtctgaataggcacgataaattgcagataaaatattgcgtacctttgtagatacatgccggatgtatctacgaaattagtagatcagtttaaaaaacaaatctaccaattaccttgttgcgtactctttcgatatcatgcgatctgacatcttttggtacgccgcggagcttgaggcttggatgatctcgatagaccaaattgtcgatgacgatgatggttccgatcttgttaggttggatctccccctcagccgaaatcgtcgagtagtttgttgtctgagaatccatctcttaaacccatctcgtcgaaatcctgaagcaccaaaatccccctacctagcgcgccactagcgacgtttgatgtcgcaattctggtatttgcatagtatgaggatcgtcggtgctaggatatatgcaagactgaggtaaagagatggagacagagatttttatacaggttcgggcccctgaattatcaagtaataaccctacatcctgttggccgaaaccggtattactcttattcatgataatcacaccagtacaatatttggggtagcctatctaactgttgtcgacatgg

SEQ ID NO: 1734 - DNA, 11358 bp, Oryza sativa
aaaagaaaagataaaaaggaaaaaaggattttcccagggattcaatattcgcactttgcttattttaattggttaaaattatttccaaggctctgaaaattccactaaaaatcgtgttagcatattttgacatgtagaatccaagaaaaaaaaaattccacatgtagattccgattattatttgcatttattaattagggattcatctctagttaaattaaacaattacttcggacgatttattttatgaatttagagcaagggaggggaacttcagggcgtgacaagggctggatctgcagagagactgagggagagggagaggaggaatggaggaagagagacgaagtgacttatgggtggtagattaattgttcggtttttaattgcgactggcttttgtaggcggatctcataagactatgcttgtagaaatcgatttatgcaggcacaactttaggaggtctactgtcgacgtttgatgtcgcaattctggtatttgcatagtatggggatcgtcggtgctaggatatatgcaagacttaggtaaagagatggagacagggatttttatacaggttcgggcccctgaattgtcaggtaataaccctacatcctgttggccaaagccggtattgctcttattcatgataatcacaccagtacaatatttggggtagcctatctaactgttgtcgacatggcggtctaacgatctgactcgtagtcgacaacagggtagccttcctcctggaatccgtgcccggcgagatcagagatagcactttcgtctctcctgacagtatccggagacaccgtagggtactagccatgcttatccctgaagtcgatatccggcggcatgtcttggcacatgtaggcttcttctatgttgtggcttctatgtcgattgtgttgggtgttgatcctgttccctctcctcctaggggggcttgtatttatacccataggtgtcctcttgtccaagtagaactagggaaactaatatgatacaatccgaatagtccttgtcgtttcaatgtagaactctggttgtctttccttatccggaactcccttgaggttagtttccgtataagacatggtatatagtggatcctgccgagatttagttaactactattaaatatgtggtatcaataaccatgacagtctataaaaatcttttttttcagacgtaactggttcgccttcgaaaaaatatatatttctcaagcgagacaaccatcgtatcccacgtccacgtgtaggtggctatttggatacgagggatttaccgcttgcatatatctcttaattatcgtgtgtatgttgaagacacattcatgatgcatgtgtgagtgccagtatgatgtgcatgtaactaacaaaattggactgtgatgataacgctggctaatactaagtactctcttcgtccaaaaaaaacaaaccctgaatttccgtgccaacatttgactgtctgtcttatataaaacttttttataattagtattttcattgttgttagatgataaaacataattagtactttatacgtgacttatctttttaattttttttataattttttcaaataagacggacgatcaaacattggacactgaaaccagggtttgtctttttttttaggacggagggagtaggagtattttgaaacgaaatattattggcttcaatttttcaaaccgctccctctcgccatccatcgcctcccgtgatggacggagtgaatggctgcatggattaagccagccgtccgtccgaccggattagttagggggagagagctaagaaaaaaacattaccgaagctagtggggtccgggttgggtataccgctctttatttgtgtgtgtatgccgcgcgcctttgcgtagacgcgtgacgaattcgcgcacacgtattcgctgcggtgaaacaacggaaaatttgtgcgtggagattcatcgtgctccatctgcaaactggagcaaagcacacaatcagcttcggttccaatattatgcagtgtagacttgaatagttcaattccatcgaaagattctttctagacccagtttcttgagtatataacgacactactataatgttgcgtttcatcatcaaataaatgtgcgactttgagttagtagtagtagtaacattttctatgtacgttcctgtattggaatattgaagtcaagtcttcttcaatgggaattaatgttgtgtagtactgttcttcttttcattttggtactaggatcgaagccgaattactatgccaaacagagatgctaaaactacttatattcatgattaagcattaagtagagatgtttagtttgttcacaaagcaacaatatgtgtgcttcagtaatcagtatccatttgatttgactccctttatgggcgtttttttttcagactagactagaggagtgtatttagtcgtcgcatggcatgtgaaattggcgaagagaacggaatctgtggagggaaattgggactacttgagccattttagtatcatggttaggaataactaacatgaggctgtccataatcctgaagattatgtgcagtttatctttaatttattatgtccctaatccctaaccacaagatttctaccattaccaagtgtgtacttggacaccaactcgcatcattccggcgcaagaacaaccacatgcctttactgttcatgtcttagttttgtcttgaaagaaaacaaggacaggtcaaatctaatgctactagttcgtcaattgagaggcattgataaggatttatgatgtcacgggcaagttttcctgaatgctccagctaacctgaatgctgaattgctggcgacgatgatccgggcaaaatagtacaagagaatggtacaaaatttggagggatttcaggcaacctagcagcttgtcaactagccaaggaactgtatagtaaagtgttgctttctttaaaccttgtctcactgctagtattaggcacctgtcatttcgggatttgtatggttgcacggccgctctttacacaacacgcttgcctgtgcggctgtgctatctaacaagaagtcactgtcgagaaggatgcaaagatgcctagtataaattattggtgcaaacaattaaaatccttgcgagacactcaaaacatctgaaattcaatcgtttgattcttttttcaatcaaaaatggctggtgtgtttggacaagcacagccggtacctttttgactgaatgcatatattcagttcaactaaaactgcatcgcagtgggctctgaatcttgatcatgcacatgtgctgtttctttcagagattgcatgcaccaaaccatgcacatttctatccctaattttcctgctggtcttaaatctttaccatgtgagctgattacatctctgcgttgtctgaacacatacacacaggatggcctgaagaccagagcttctagaaatgggggcaatccatggggattgagaactgatcaacagttcaatgcataactatgcagggcatagacaggctcagcggtagatgattcaccaaccagtgtaaattgcttaaaaaactaggttgtctctcttcaatcaggagggaccgttgcagtgtcctttctgcgcaaagtgacatggaagatttgctgcatctcttgttcccttgcaacaacataaaaatggccttatacaaagaaattcttctgcctcttttgtttggtacagtcagtagtactgtagtaggccgcggtttggtggtgccttgcatcggtacaaaaatacaagggggtgtagtatgctctgattgacctttccatggacacatggtttactgatatgactgaaaataataataaaaaaaatgtccacttcttgagttctactctacatattagttacccctcttgctagaataggttggtattgacccttttgttgttgcatacgtgcatctcgtgaaaaaatctttgctgctaagagctatggccatcagaagtgtgtcatgtcacctgacatttaatttggtgaagagaccaattatgggtgtgtttacttccaaagttttttttccaaactttcaactttccatcgcattaaacctttcaaacacacaacttttcaatcacatcgtctccaatttcaaccaaattctaaactttggaccaatctaaacacaacctataccgtcctgatgatgagaaaggtctaaccagctgaattttcagttcttcagcgaagaaaaggaagatgataaacgaaaggaatagaaagatgaatttaagcaagacctggtagtagtaattgacaccaaaagcgctcgtgcttaatgaggtctttcactgatcaacgaaccctaatcaaagtcgtcggcagccgcgcgaccgggctggtggtctcgccggagatcagcgcgcgtgcacgcacgcatgcggtgcagcctgcgggtgaattcgacacgcacgacgaacatttggttacagtggcagagccgcggaacttggagtggcacagcccgcacaaatctaactacgttgagtgatcgctacaaaaattctgttttcaaccactaaaacaacaccaaaattctattacgcccttgtttggtcgatgacttatcaatacataagtgttaaaatataaagtgaactgttcgtttttcgcatcagcttaactttttttggtcaaactgatcaatacatacaacttaataacaattgaagtatgtaaaaagaagaaaaatgtgaagtacctttaagatggtttcctaccatctttttcacgttgttatacgatcatgggttgcttttacgctattttctactaccggcggttattctctaatctggtccattaccgatcggaagtaggagaaatcaattagcaaaagaaacagccactaagccgatatcaaatcacagacggttgatttcacggagggttgcacaaaaagatggcggctcatgattggggcattctgaaaggcacaggttgattggtcggccatcatttacccaatccatacgccgaaacttcctcttatctctgtagcctaaagcaattggaaagtggtaagttgcaagggagattgatggatagttgattggtgatgggagcattagacagccacagcagaatatataccaaagattactaattaaagtgcctggattagtggaagtaacagtgctgtaataatagtggtagaaatgcagtcgtcaggtggtggtcataggcttcgatccagttttcaatctcgagcacttgtgctttttaatttcttctctgagagaaacaacgcaccttctttgcacctgcaaagtgcaaacgctgcaatttctctcccttcggctattctttgaccacaccaactcattcctctcgtcctctcgagctgtaattttcacttccaaaacggtgctgaaattgtgttatctgcagaaaaaaagactgaattttgcaacagcgagagcacttcactggaaatgtgcaccaattctgagcttccttgtcaccaggtcagatcagtatttcagatcattttgacgtacacatacgcatcaggcggcattgacgattcggatgaatgcaacagctaaaacgtttttggtggcttgcgagcgcgtcggcatcactcgccaccgatggggagaaatcgcggacggcatgatgcatgttgacgtccgttttcttcccctcagaacgctgtacaatttgacccatgaagacacttctgacgagcttcttgttctctgcaagtgtcacggtttcgtcagggaacgaaatttgagtcgtcaataattaatgggtgtgaacacatgatctaagcagtcaaatgtcagaagagtttgtttcgttcgtcaatggataacaaacacgagcggatttggtccatagattatcatccccaccatattccttacctaaaacagtgttctgttaggtagttagttaattatcatcctgtgttaattagcacttgtattagcaaagcactggcccgccctatcagtttcagataggatttagtgaatcttgtaaagagactgtcaattagcacaaagatagcattccagtgcaagctaaagtgggcagatcatttttttaatcgagtccaaatgagtatagtggggttcagaatattaggtcagtaggagcaatgtgacaataaaagattaaaatcagcagtgaaagtctccagatcttccaaaagaaaactggcacgctggtaaaggggcttgacgctttcaaaaagagccagaattggaccccatcaggtaaatgtcaaattagcgtgtcatgcaaaaagtcatggcatatgagtgagtagacaatcaaaatatcagagtgtaaaaaactagataaactggataaaaatggcacgtttttcaaactgctaaacggtgtgtttcgtataaaaactttcgttataacatttttcaagtttataataattaaaactcaattaattatacgttatttaccacatcgttttacataaaacacttaatctttatctttatcttcatttttattttcaagagattcaacactaagtgatatggataacagaaatacaatattcaattaatcatgagctgataactgatgccatttgatgtacaagtctaaataatagaatatatgttcagtatttacaggcttgtagcacagaaatgacatgaaaattttacgcagatagtccaagcttatcattgtacgtgccattattatgtaggattaaagccttatcagttatcagcttactgggctggcagaaggaagaagtatcttctgtctgggctcggcccattctagtctttctgaatttggatactgataaatgatgagaaaaagtacactttacgtccctcaactttgggtttaatttcgttcacatccctcaaccgtaaaaccggatataaaatcatccctcaattatcaaaaccagtacatcgagtcacgtatttgaaggacagttttttctacgttgcgcttatgtggcattaccattagtattttcttaaaaaaaactagtaggaccatgtgctagtcacaaaagaaaaacaaaaatagtgggcccacatgtcagcccatctttcttccctccccatctctcttgctcctccctcaaaccaatcgctgccagccggcgctgacgaggaacaacagctggctcaacggctcagaggagttgagttgccggagcatcatgagctcgtggaacgcagtcgatgcagctgtagggtcgtcttcctgaccgagctcagccattgtgccatccacgacatggacgacgatgcgcaggtagcaagggagcacgacgcgacacgcagtgccgctagggtccaagaggaagcggagtcaccagactcgatgtggaatctcgccgcctctccagagcttcgccgcctcgcccgccgccccaaactccgacaccaagccgttcagtcaacaccaacaacgacaatgtcatgctggtgttgctcccaatgcagtagggctggcggatggctaatgttgagcccgtccccatcgtaggcacgcaaccatagtcaagggccactcgcacgacgatgtgggatagatggatggtagtgatgagtttggtggtggcgtggtgtgtggcaggttaattacgtcaccgccggggagaggatgaggtcctgtgctctgtcgtctctccaggtgaggcttcgaagaggacccgacctccccgtcgcttcccaacggcgtcgtagccaccccctccaccttctcgtccttgttctcagtggctcgccaatacgcacacactcgacgactcctttgcctgcttcgcctgtgagctggcttggtcgcagtggttgggctcttgcgctccgcgacgcttcctggggacgacgtgtttggcgacagggatgaggaggcggggattttggtgtgtgtcgatgatgaggcaagggagagaggagaaatggagggaagaggggaaatagagggggtgctggtatgggtcacatggttttttctgttttaagtgctacgtaggcgtcacgtcagctaaaattgttgtctaaaccaccttaggattttatttgtattggttttaaaagttaagagacacagcatttctggtattgttttttaggacgaattttagactcggcgacaaattaagagacataaaatgaacttattacatacatgatgggtcagtgcctcagtgtacgattgagggatgcgcaacaaggcccaatactagcattgccagcgtcattcttgcaaaattacagctgcagatcagaatatcagatcgtatatactacagtacatacactgtcgtctatatataagaatgtggacagccgatagcgtcataccggtagcattccgtgcatactcctacacatgttaaaaactaacaggtctatgactgcattgtttgtatctcagtggcatgggaaaataatttcatccctcgagaggatatcccatcgtttcgtgtataaaaaaaataataaatatagttacgaatgtacgataactattttcagtttaatttgttatttttgttataatctgtagaagttaaatttagtctttgcatatatttcgtattaacctatgttgtaaaaaaaatttatttttttaataactatttaaatgacatgtaaacaatgagagaatgttccctcaaatgataaaaatccacgcccaatgacataaaaagataaatccttcaactctgcaacgtcttaagtagcggtgccattcctgcaccgctgcacgcatatccatttttgttgtaggcgtacgacagcaccaaccggagtgtctgacagagctgccccccgtgaccactcaaatttctagtatatatgctaccgaaattaatcgccattataaggttataactgctcaagattcatgcaccgacctgttccattatccctctctttcctgatccacaatattttggctttttttttctctactaacagtagaattgatctagaaatttctcgtctgtaatattttgaggttagtaaatttcgatagtgttagaatatatttggtttggaatcttatcaaatgttggtagtatttttaaaagcaaaacttctctagaataaccaaattttggagggggcgcacattgattaaggtatatttgatttgttgttttaccaaatataggtattgttgaaagtgggcaataaagtaaacatatccttcatattttcatctaaagaactgaaaaggctagggagtagtcgctattgtctctttaaaacatgtgttggaggtccactcgcatatgtgtgtagatacatcgtatatgtttatttttcttttgaaagaaccacggtaggggaagcccccaccgttaagattttatattaataaaggagaaaaaattacaataaatttaaccactgtaacaatgtatctctctcagaatttttgactctatgaactcaaagggagagatcattcctaaagagaactctccaagagggaacagagggaacaatgttttcaaaaattaaactattcatctgcttccaaatgttccaagcagtataaagtaccttctcaacaaaatgggtagagttatatgaatttctggccgtgaccaacatttcaccaaagcttaaagaaagattccaaaccacaccaaattgcgcccaacattcagtgctaaaaggacactggaaaaataagtggagagttgtttcccttgatcctgttgaacaaagtacacagagcaaggaagcattttgaggggagcaatgccttctgtctaacatgtcataagtatttaaccgatcaatcaagagtagccaaccaaacaccttgactttcatagtacaactgctcttccaaatccatttaatataaacaggcacatggacatgagaaaaattcatggcataaattttctgtgagaaaaagataccgttgccccaaacatatgtccatcgatcactctcatcattaagatgctccaaggtatctgcagctgacattgccaaatattcctgaaaagcttgctctgaaagtggcaaggcaaagagctgaggtagatcagaagtagagaacatcagaactgagagatttgaattcctggcaaaagaatatattctgggataaaccaaggccctgactttattgttccacaaatattcccaaaacaaacaagattttccatcttgcacagtacaggccgagatgcctctaaaaatatccacaaattgcaaaacatccctccaccaaaaagatcctttaggagtaacagcatgaggaggttctgcaatgtagtaagtattccaaattaaactgacccagggaataggatatctattatagaacttatgcagattcttcaagagaagggcattattttacaatgtaaggtctattacacccaaaccacctctatctttcggctgacaaactctttcccagagaaccaaagacttcttattagaattaatatcagatcccctccacaggcaatgtctcctagctctatcaatactttctataactgtctttggaagtgaaagagagcacatgtagtaagtgggaagggaggaaagaactacattcacaatggtcaatctgtccccataagataacaaagcaatggttgctgagagtcttctctctactctatcaactagaggagcaaaatctataactcttggtcttgtggttccaagaggaagacccagataagtaaaaggtaacttaccaatagagcaaccaaacaattttgagagatgatcaaccttttccaaatctacatccagaggaatcatgcatgacttactatagttaatcttaaggccagttgaagaggcaaaagtgttcaaaattgccttgagacagaaaagctctttttgggaaacagtcaaaaaaagtagagtatcatctgattaaaaatatttgatatgtttattttttgaggaaattgcagtggaggagacctccacggtatatattaaaatagagaaaagttatttacaagcatcaaaagaaagaaaacaacagtgttacaaaaggtcaatccataattgaactagagggcgatgaatctccttgagcctagataaatgtagactcaaatcaagcttgaagttccttttccaggtaagaaccccaggctgaattccattaaaaaataggctatttctctccttccaactattccaagcagccaacatcataagctccatgaagcagggattagagataaaaacactctgtgattggatcatataatgaaattcctgggaagtattccatctccaacccaacacattccaacactgctgactgaaactgcaagtaaataaaaatatg

SEQ ID NO: 1735 - DNA, 1328 bp, Oryza sativa
  unsure (1)..(1328): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatacatgtataccaagtttgtgtacatacgtataaaacctaaaaaatatacttatacaaactttatatacacgtatgtaaactttgcatatacgtatataaagtttgcatatgcatcgtttgtatatgcgtatacaaagtttgtatttatacatgtataacgtattaaaaaaaactaataatgatacggaaagaaaaacagaaaagcaacaaaacaaaaacagaaaccgtaaactacggaaagaaaaaacagaaaaagaaaataaaatcgcaaactacagatacggaaagaaaaacaggaaaaaaaaaagaaaccactcccaaaaaaaaataacgtgggggagggcgcgcgcgactggtcgcggattagctttctcgctcgcgacggcagcgccgcggctgcgtcggcacttcttggcaggtagggatgcaagtggatagccccgctacccgtataaaaatccgttagctagtttattttccatataatagtacaaaatttcagagaaaatataaaatagaagtgagataagcgggctaaaagaacccgcttacccaccccgcttgcatccctattgggcaggtcacggcctggcggctggcattcttcgtttcgctggccagcagagaagggagcagggacgcagccagagccacgcacgatatggtgccgacggcggagagacgaacagccggatggttcgtgaaccgaacagcatcaagataacatattagtacttactaatcagtatggggtatttaggtcttgatgggtatttctttttcttttccttgattaagcacatacttaaaagataattaagatcctattttttcagcttaagatttttgtaatcttaattattaaatcagattactctaagctaaattgagtgctgacattgaataagttgcgagttgtttgtttctctggattattggaggcatttaagggtagagagtctttagccactcaataatctggaaaaagctcctctaaaggagattattggattatactaatctgacttatagattataataatctaacttaataatctacttgtttatttcagcttactcctaataatccagattataataattctaagctgaatcaaacagggcttaagatttgggggcccaactttt

SEQ ID NO: 1736 - DNA, 6215 bp, Oryza sativa
  unsure (1)..(6215): unsure at all n locations
agggtgttcgacttcgtaagtttgatttggacatggatgttagatggaatgcaacttatctaatgcttaagcatctcttcccacataaggagcttttttcattgtttattgaaactcattatcctagggaaaatgatagactattgcttactgatttgcattggacaattgctgaaactgtgcttttattccttgaacaattttatgattcaaccgttattttgtctggtgtttattatccaacatctccattaattatgcatcacattcttgagattgctggacatcttaacacttatgagaatgatattaactttagaaatgttgttgttcccatgaaaagtaagttcttggcatactggtctgagattccatttctgtattcatttgcttttatcttggatcctagggctaagatcagaggttttagcaatgttctacaaattatgtcacaaattttgacctctgattactctacttatttaactgaggttagggctgcattgtctgacattttttctaagtatgaaagtaagtttggtgctgtgagattgcaaagaacaaccccaggcaatactgctggtaagaaaaagatagcatggggaaagatttttggtgccagtgatgcacttggacatggtgctggtgccagtccagcttctggacttggtgctggtctattttccaggagaacttctgctactgctttgattcaagctgtttcttctaatgctaactcgaatgcctctgagttgtctgcctatcttgatagtgacactgtcaaccaattcgacgatgacttcaatatcctaaactggtggcatgagcacaaacacacatatcctattctgtccatattagctagagatgtcttgactgtttctgtttctactatatcgtcgaagtctgcttttagcttaactggcaggatcatcgaggagcgacgacgacgtctaggtcttgacatggtgcaagctttggcattgatcaaggactgggagcaggcagacaagaagttgcagcacactgctgagaatgtagagcttataaaatcatttgagaatttgtttcttgatgatgtaaccagaggcaatgccactggaactggatgattgtactggacttggactttaatatgatagttagatgaaagctgtgggctgcactcttttttcctttctagagttttctcacgaggtgtgagtttttacctagaaaggtttttaatgaggcagccattgcactacacagctactattatttttgaaagtgtttgtgacttgatcacttaagtttgaattgtgatttgtgaactgttagacttagtatttgaaaatgtttcgtggatttgtgacttgagttgtgaattgtgagacttagtagttgagttagtgaattgaattgtgatattgcacatactataacttgtgaattgtgatattgtaatctaagacttgtgatattgtgatctgttaacttgtgaattggatggttttgtgctgttttttgtgatggacattgcattttttatatgtatgtgcaaaactgaagtgaacaagtggcagttagtgtttggcgtgtctgggctggcccgggcacgatgggctcatcgtgccgtcgggccagcacggtccggcacgactgctatcgggccttgcctgggcctgaggtacagcccgtgggcaggcatggcacgacacgaagtgccaggcatgccgtgctggcccgatcgcctcgggccgtgcctaggccgggccgtgccgggtgggtcatatggccatctttacacctcgtagtgtcatagtttgctcaatagtttatcagccattaaaaaacttaattttagaattaattttaagatttatttattgtagcttattttttacatttactttataaacaataaacaataaaaaacatataaaaatgttacacacaaattagtttttttcacttcgtttacttttccaggcgtaaggcaaacgatagtacgacataaaaatgccagtagaagttttggttattttttcttaaaaaaagacatactagtaatttttgttattgactttgcatcacgtgagcaccgcatcgagcttgtcttcttctccggatcgccacgtcagctttccgcttatcgcgctaaagctttccgatcttgccgcagcttcaactgccacgtggggtcaccgcctcgggcccgcattgccagtgacacgaggtagatgcataaaagtccaacacagtcgcatccacacgcggggccacggccgtgcgccacttctcttcctcgctcactcttccccccctctcgcttccttcccttctgctctgcttcctccgcctctgcttcgtgtcgccgtcgccgccgcagcagccgccgccggcgagcaccgggtgcggatactgggagcgatggcgtccgggaaggtcgtgtccttcgtcggcgccgacgagctgggcgtgtccctcgccgcctccttcgtccggtccggggccatcgtccgctgcttcgtcgctcccggggttcgatttctcttccttgtttttttttttcttcgcaggaggttgacgagagacgggctcacgtgagggaacgtgtgcgcgcgtgcgtgcgtgcgtgcgtttgcagggtgatggatcggcgacggcgctcgcggagctgggcggcgtccggtgcgcgagccccgcggaagccgcgcgaggtgagcgtctcgactggagctcctgtactggactgctggaccggtcccgatgcgagtagacagatggcctcctcgtgatttgtagcagttgtttgcgtgccagttggtgttcgtggtgtttgttggattgcctcgtgcttgctcacgaggcgtttgttggaatgccgtgctcccgtggagcaagcacgcccccacatgtctgcagcctctatctgatcgattgctatatcttgatacctgcagacgctgagctagtcattgtgctcagtgacacggatggggttgatgagctgttcttcggacctgaggggatagtgaaaggtatgccatgtgcacgtactcaattttcccagttactaaatttgatgcttcatacaacgtctcattgagcatttgtgcaggactgtgctcgggtgctgttgtattgattcgatcaacaatgctgcctagtcatctggagaagttgaatcagaagcttgcaggtaggcattgttgattttaggataaattaatagaagagttttcttggaaaaaaacttgtatgatgtatactgggtaatggttactttattctgttccagcaaagggaatactgatctttgtgatggacaattacgacaatagccacaatactagttaatctatagcctgacttatcctgcagatgagaagaagaatgcccttcttgatggatacatttttagtggtttatctgatgaattaaagcaaaagattgttgtaagtgatgggacaagatgagaatatgaattgcgcgtgctcgtgtcctttattctgttgtcacccatttccttttaaataccaggttgttgcatctgggagacatgatgttacagaaagaaccgggcaattcttctctggtaattccaaatatgtgttaccattttgccaacattttcttcttggcctatgtcttttgatgttgtgatggtgcaatgatgctgattctaggctacatggtgatattttaggtcttgatacagcagtttactttgttgaaggtgaatttggcagtagcaggttgctgtcttctctcatagtaaagattatcttacattatagaatattgagcattattctccttttccaatttatgtaccatagcccattaactgaaatgttactgatcacagttttaactgcaacccacttatttttacagcaaaattaagctggttaatgatttgctggagagcattcattttatagcatctattgaagcaatgtttcttggtgttcgggctgggattcatccatcaattatctatgacataatatcgaatgctgccggaagctcaaggttataagagtaattcagttcttttttattctatctaaatcttccatacttttatgcatttatttaaatcaagatcttaacttattatgctacagaatattcgtggagatcgtaccaaagcttttgagagaggattctttgcttattgattatctagagtcatccaagacaaacgcagtaagctcctttatgtcaggactacttgcatcatcataaaatatagtatccttcattccttaaatactcacactgaaacagctcctgagactttttttccctgtcagacaatcaattcaccttggtgaaatatttttcattcaacatacacatgttcattctctcataatttcactacaacccttctttctttttctacaaccaatgggaggagaggtactggagaggagattagatatatgagatggtgccaggggcaaatatataaatgtgataaagaacaagggaggggggtatgggggcaagggatgaattccatctgactggtccttaaaatagcttgagaagttgtaatgttctaactataattgttgccttccccatggcaaacagtttactctagtcttttactcttgtggatttaatttttaggtatttatatttttgtatatgttgccaggatactctctttcagatattattaattacttaagtgttgctctgatgttgtgaaatgtaaaaggactatggctactgcaaggctgaacgcttctgcttctgaattattatttttttcactcttaaacattatagggctatgtgatggatatggctaaagcagtaatattccctttgccacttgtagctgtttcttatcaacaattaatacatggtatgctgttaaactcctttgcatcagccatttgatggcaaaatgctagttcaaagtcatttatgcttttaataaaaagacttgaatccctacattctttgcttatgtttttttcattcatatgcatttctctgttcttaatttcaggttgttcatcagcaaatggagatgcattagtctcaccgttgaaggtgtgaactgtcgggttattttaattctgattatagatgcttcagtttcgcaaatatattataaaacttcatttgcaggtttgggaacagtcatttggagtaaacatcatagatgctgccagtcaacaaatctacgatgcaagcaaattagctgaccagcttgttatggcatgtaaaacagcaaaaactatcggctttattggtcttggagctatgggctttggaatggcatctcatttgctaaaatcaggtttctccgttattgcttatgatgtaaggagattacttaccatagatatgccagtagatatgagtacatatccaatgtattactggcggaaagttgccagggtagcagaaaaagagtgctgtgcgccatagagcagggcacttgcagtgcagtgtggaggagtgtcgagagtgtgcacagtattgtgtggatgagtgtacgcagagtgccagagtaggagtgtgtcagcaccatatgcagagtaaagagaatagggcctgccaagattgcacgtgtggctacaaaaaaaacacacctatncaacgggagctattcagctcacatagacagttgaagttcacgtgcatggtgcacgtgacaccagtgatctgaatgacaggcagatagtttgtgaacgcctttattcctagagatgagaaaatagaacagcctacatgccattttcaccattttatacatttattcagtaacggacataatgttgcaaactttatttcataaaatttgctcttttttttggttttacatacaataatattttttgtattccatttaggtatacaagccaacactggccaggtttactgatttaggtggattgactaaagattctcctgaggaagtatcaaaaggtaccttgcaaccttctgctacagagtaaagttctcacaaccataagataaaatttgatcaactatagaattatagtcagctaaaatgtgttgcgcaatcaaagtccacatggaaaaaatatatgtatggatatactagctgaatgcctgtgctttgctagggataaaatatatttttcatgaagtgtgctacccatggtttgatatgggaaatattcaccttattttaattttatatgttgctatccatttaggtttgattttttaatatt

SEQ ID NO: 1737 - DNA, 1071 bp, Oryza sativa
ggggttccaccaacatattttagtctattttggattgagtttagcttgatacgggtgtctaagttggaatcgagcaggtgtatatatagtgaaaattgataatctatagctgaaaaaatttctgaaccgggttcctgggcaccccccttgatacacctagctccgcccctggatggtaggagctcgagataaagtgcggtagcgcgagagcttgggctatggcattatcttgtttctcttgaggagcataatatttataataaattggaaaagtgaagaaaagaactcattgcccgtttaggggagcttctaactactgcagcttctaccaaaagcagaaaatctcctaaacagtccagttttttgttcaaattttgaaaagctgtagttgtagtttctgaactagaaaccagaagctgtaaaacccagcttttccagattctcaaaagctgactatcaattagctgcttcgcagaatcttgatctccccaaacgggccctcagccttaatcactaggtggttggtctctctccttttctttgaaaaatatgatacaagagtattctttacctttttcatggtcaaagtagttcaaattgatggtatcatattcctattttctactctctccgtagcgaatataaggacacgcgagaagaatttgggaaaaattaagctagaaagaaaaaaaagactcaattgcccctcattaaagttccggaatcagttagctacatattggcgtaattaattaaagaccgatttgttcagttaacctaggccttaaaatgtatatttgggaaaatgctttatatcgtacgtacgatgaaaccgaaatatcggacgcgtcatctactgcaaatcggtatatggataggatgaaccatatcactgtaacatccatggccaatcgtttccttttgttcttacctcttctctttaaatattttttcttctaaattacttatcccgatctacgaaccgatcacactggtgtattcgctacaattaaatctttacaacaagatatatatgatatatcatgcaaaagaaaaacatatgttcaaacc

SEQ ID NO: 1738 - DNA, 5559 bp, Oryza sativa
ggaggttgtgtttatcggtactactagacgcgataccctgcgctttgctacgagatatctgaataaatgcatgttaattatacgtaaaaaaatggtagatatatgtttaaataatatgaaaatgatgtagagataatgatttgacattacttgcatatttttcagttttaaagttataacaaaattataaatgatatgtcatatttgcatgatatttaaaatactctagataattataattgctagtggtgatgatgtggcacacttccatgttgagttttaggagttagtggatatcaacttaatagtaagataagattaattaatcatgaacttattttgagaataactttaccatgttagaaagtagtatgagtatattttgttcgattacacgaaagacccaaatacatgtgaaccccaaataaacatgtacacctataaatgacaacccctcccctctcccccaacccgaaccaaggttgagtgattttctcaaacctagctttggctggatttgtataattcgctctcatcggttaacctaatattgattataagttgtatggtttattactaataaaaatagtttatgtttcaaacttttatatgtgttcatagcgatggaaaaaccaacattgaaaaataaactacaatgaaagccccttaaaatcaacttcaaaattagttttaaattttattagttgtagggtaaataatttaaatttatataagttcccctttcatcttatactctatgcaatttcaataggtatgcgatattagcccccaggcctaattgccatattcctgtctcagtattgtctataacatactatggaggtcaaagagatacggaaaacactagtggtgtgatggtggagtcgtgggtgcatgactccacccatatggactcaaatcctaatgtccacaaatattacacacatgtaggtgtgttttcaatagaaatttattgagattagggttgtgccgctggttttcatctttaaagcatgtgttgcgtgtgcttcagtcatgtaatgaaaaaaaaaagtcgaagagataggccaggggcaccataccatatgcttctcctcatgctatatcgtttattgccatgccacgttggatatgccaaacaagatatattttagagtaatcttctaaaatttgtatatactttcacgcttgacattattgtcgtcccacgttggatgttaaaaggatttattttacaatagtcttctgaaacctgtatgtagcacatgacataatgataagcattgtgggtgtatttgtttcctcgtatttcttgtcacatttcaagatagtccgcttttttttccgtggcagatgctatatatatatttctttttatgtttgcaataagattataactctttctcttgtatctctatcataaaaatatagctatttctattgttacaaatatgtacatttttaagatgtggtgtacatatatttctagttgctccctcagtttcatattataattcgtcttaagtttttccgtagtcaaatttctttagatttgagtgaatttataggaaaaaattagcaacatctataacaataattagtttcattaaatataacataaatatatttgaatattatgtttgttttgtatttaaaatatcgctatatttctatataaacttgattaaacattagaaaaattaactagaagaaacgtcaaaaacaacgtatctttactacttaaaaaatttaaaatgtttccttcttccgtaaaaaaaatagcgaaaaaaataacaaaaaagagcaaaatttaaaacgtttccttcgtccgtaaaaaaaagcgaaaaaaataaaaaaaagcccgactcctggatccgattcccccttaaaaacgcgtcaaaacaacaaaaaaaagcgaaaaaaagtccaactccctagatccgattctcccttaaaaacggagtccgactcccctaagtagatccgattccccccttaaaaacaaaaaaaagctgagcaaaaatagcaacgtgcaatccttcgtgccaatatgagtcgatcccaggcacctgtcctctcggtttcaatctatacggtgatatcccatacatcttggtgaaaaaatctgtgtgccggatcggagatccgtttgcaaaaacggaacctatagaaagagagcattccattttctttgtatgattttaatttttgggtttgcgcttttgtatttgagtctctattttttttatttatatttgagtcaccgtaatcttgcaataaggtacttgaggttgcttttgttaaaaaaaatcaaaagaaaggagagaaccaaggcagaaaggtgcataaaaagaaaaagaaaagccgcacaagaaaagaaaaataaataaaataataaaaacaacaacaaaaaagtccgtttcccctaagtggcgaaaagaaaccatagatccgaacagaaaaaaatccgattcctatagaaggcaaaaaaaaaacaaaaacaaaagtggtgaaaaaaaaaagctagatccgattcctttaaaaacggaaaaaaatttctaagttcactttaggtcccttcagttgaactttttttgtttcattcattttgatatagagaaatgaatattgcttttgtcttatcacacctgattctgaaaaaaaacaaataaaatgtcattgcattaaccacataaatattgtgaatttttttcttaaagagctcatatcatataaactaaaccttaatcatataatatttttatatttgttataaatttttgcaacgcacgggcattttttctatgtcaaaaaaatattttaatttacagaattagtttgctctatttaagctttttaaaaattcctaaaatttgagaataacttttcttacttcatattaagttatttttagctaatggaattaattatatatttttatcttttgaccaaaggtcactgcaatttcatttcattattattattatgattacgattatcatttttgcgcaaccgtatgtatgattaaaattaccttcacctattacaacgcacaggtattattgctagtaatataaaatggagagagtatttccgtttgtggactgattcgaaaaaaaatattgatgaaaggttgaaaaataggaagcctatgcgtggaaaggcagagagagagaggccgggaaggcgccgtgcgttgcgaggactgtcaggcgccgggtcacctcgatccgacgtagatttggccaagttggtccctatcgcggctcgcctttcggcggcgacggcgagcaacgggcccgccaccgcaagcgggccagggcacagagacgtgcacgccgcggagcttgggctgggctacctggctggctggctggccggcgcgacgaaccatcctcgcgcgtgcgtgcgattgcgaacaaggggctagctagctaggtagagtagtcctctttggtcactgttccgtgcgaccatgcggccggccgtgcagttgattgagggccccccgtcaatgtaactgcaacccgattagcttagtgttaagagtaaattttataaaacttcaccagttatggttttatgaaatttagtctaggattaacgatgtgacattataacaacagttaagtttttttaacatgtatttttttcccataaatttcgtaacttacactgtatcttaccaataaattttaaagcttaaatccatttattttgtattctcgatagacgataactaggacaaaaatggttgtttatatattttaatctgagaaaaaatacgagtccaaattaacgtataagcaaaaaatgtaaaaaaataaaagtagaaaaagatataagggagataaaaaaacagagagctagccatcgcgtaatgaaaaaaaaagtgattgaaaataagcaaaagttatcaattatataaactcctcaaagttaatttacatttaaaaaaaaatctccaaacttcctaaattcacaatcacaagttcataagcacttcaatcgccacctctcttggcaatcgccttctcgagccaccgctattctcactatcattgctcctgagccatgaatgtagctagctaccacggtcgttgccatcgctaagtcgtacccttatcgttaagttctatcgcatgtagtgtttttgttggtccaccattgtcacctgattcagcgctcatgaggagcaccaccacctagattcagagctcccaaagctcacttcagcctcagctgcttccatgacgggtgtcgtatagatggccgcgtagagacatcggatgatatgggtggcacagaggaagagggggagggcagtgcgtggggagggataggaagaaataaaatggagggagacatagaaacgcaggtggtgagctgaaggagaggggaatagagaatggtggattgggtgcagaggccacttgacttaacttttttctcacttgtttgattcggctggcattggctgcctcggtcacttaagctgaccatgtgtccgtgtctcaaaccctatttttagatatgtccgttttaggtaacgtacgtcgaaatcgattttcagacagctcatggccacaggccttcccatttactacataagcagttttttataggccacctgtgcagcaaaataaagctatctttgaaaatagaccttttttcattattactccttcacaattttaacttttttatagtcaaacttatttaaatttaactaaatttattgtaaatcatagaaaattttcaacataaaacaaatatatatctcatattagattgaatgaaactaatttggtttggtgttatatagatatgttcactaaatttctctataaactcggttaattttctttaaaaaaattaccagaaaaaggttcaaaacgtgttataatataaatggagggagtagtgaactagtgatgaacagtggaaattagtgcgttcgagacacgtcgtccgttcttgtggtggttcagtgacactcatccaaaattgtggactcctagctttcgatctgctggaccatttagtcctccgatcacctagtccttcaaccatcttggccatacctatgcccagtttgcccactattaataattctcgctcccacaacttctcacagaatctaacgatagcctgagccccatgcacaaatgacaccgacaccattgacctcagctgtttagacactatgcccactataggtacaaaagcctagctagtactgtcactgctgccatgaggaggaagacattctaaaacattatgagcctcttcttttgcttttacaatctttgtcaacctctcactagtggcggctcatatagttaaggtttaggatttgatgttagcgtccttgacatgataatgagatggagacaatgccattaagaggagtaggaggtagtaacaaacatcaaattaaaagagcatcaagggtgagagcccaaagagtcaaagtcacaactcgcaaaacaagtgtggttggtgatggtgtattggtgtatatcgctttactcgttagatttagtagtgtcagatttt

SEQ ID NO: 1739 - DNA, 15263 bp, Oryza sativa
agattttatataacttttttaaaacatattataaccagtggcgctcaccttctcacaatatgcatacactcatcctatctaactagttgaactatactcactccatggattttgtataatttgatggaaaacagtctgataagcgaaattttctgagaaatcaatggatggaaggatgcatagacatgtgcactcgatctaaacttcacatgcataaaaattttttattattaatttgtgtggatttgcttggcaaaaatcacttttcacatagtagtgcatactgcataatgtagttccattacagagagcaacagatcgttagttagtcctttgctccttgataccaaaaccctcgttctgatatagactaaacggagagtactaattcttgattggaattcctataacctaattataggcctgtaaaaataatgccaaaacctaagtaggttctgaaattaccaaaatttggtaaaatacaatctattatattcagtctttgttttgtttgctattaaagaaaactatttttggcaaaaaaaaagagaaaaagaaaaccaaattttggcaatgtgatattatgcatgggcattagcattactaaagctgggctaaggcccaatggaatagacagggaaaggtgagcaagggccaggcttgacctcctcccccatggtttgagattttttcaatacagattattgtacagcttgtaagcaattttttaaacagaactaacattatcagctctcctaataaataatttataggattcctggctccaaccactgattagggcctaccaaattataataagcaattcaaatcccaatcgaacactattgctgtttcaccaaagctttggtagcaacctaaaccagccattcctaattccttgtcgatgaaaacaacacaaagtgaacttgaaaaaccttgccgttgcacgggctgtgcattgactacttttttcatatggcgaccaagccaaaaaaccaaacaaaattaacccaaactggcacagctccaccgtcctgccgaagaaggggcaggcatgcgtgcgtggagaaagctacgcacgcatggggctgcgctgtactgagccaaattttatggttaagttgtcaacttgttgtttgtacccatatcgcctaacctcccatgacgacgttgattcctcgcttcgatcctactccctccgtcccaaaaataaaaaaacaaaccctggtttccgtgtacaacgtttgaccgttcatcttatttaaaaaaaatattaaaaaaattaaaaagataagtcacgcataaagtattaatcatgttttatcatctaacaacgcataaagtattaatcatgttttatcatctaacaacaaggaaaatactaattataaaaaaatttcatataaaacggacagtcaaacgttgataaaaaaactcaggatttgtctttttttttttgaacggagggagtacatgtaaagtgagccgtcacacgtcatgtgtccgtccacggatccatgctactccctcagttgtttaatacttctagataacatcgtttaatttttttaataagacggatagttaaacatatgcgtcgtatattgttaaaagaataggagggagtacattctggaagtacgagagccctgtcacagctgattggatcggttcagatttggatgacaaggcaccgtgtgatagttttggtacagttcttttggttaatttcatcggccgtcaattctgtgcccacgctttttagtagaccaagcttggaaaacagaggcaggtggccattttcctgctggttttgtggttggtggaattttgcaatacatttttagtcacgtttcttatcatttatataaaaggcatagccaagtgtctaaccactctattcagtttctattttaagtcattctccagatggtcccaaatatcatcactcttcttgtggataaaggttgaagagtaaattattctaacttggacaaataaaaacgattgtcattgttttgcctacaactaataatatatgtatttagcaacttaaaaataaatgttaaaaaataaaccacgattaaaaaaggagtatcttgcatcaactggtaggtgcgggcgatctaatgcaagaacttaaaaaattagcatatatgtgcaataatttggttatgcgtatatattggttaaaatatcaatattccacactatactttttatgccaaataaaaaagaagccactcagtccatctccacaaggatctgcatatatttcttataatttcttagttataataataaaataatttatcgatttgaaactgaaaaatatatgattatcaaaagtaacataattttcgagcgattcgactaatcaacatattcttgggcgacaataatggcaaaacacaaaattgaacccatgagtcaacgatctagcagttaaccttataataccaggattaatcaaaggtatgtatcagagtgtttttgactaaaatacacatgattgccaagttcatgtaccaatttactcattttcaagttcttacactagatcatatccacctatcaagttcttgtatcatgggtgttatttactcaaaataaaaggaaaacatcaagctcagctctaaaattccagatttgatggtaccatgttattcccgcgctagaaaagacgggtagccaagtacaccaactagccgattggtgcaaagcaattaggaaatctgcccgtacatcttccggagttgggcgagcagaagggaacgaggccaccaaatggcccgcaagcccaccggccgaagctcgggctgcatgcaaagcgtgccgggcacagcgcatggtgacagctcacgctggctgtaggtcgtagtgcaccctgacgcgcggccagcgcgatggcccctcaggacccaaacgcaccgagagagaacgcctcggaccgtgatcccaggtcaggcgggactacccgctgagtttaagcatataaataagcgaaggagaagaaatttactaggattcccctaataaccgaattgtagtctggattagagtcctcagcgaaggaccgagcccaactcccatggaaaggggcacctgggagggtgagagccccattcggcatggacccgatcgccccatgaggcgccgtcaacgagattggttgtttgggaatgcagcccaaatcgggcggtaaactccgtccaaggctaaatacagcgagagattgatagcaaacaagcaccacgagggaaagatgaaaatgacattgaaaagagagtcaaaaagtgcttgaaatcgccgggagagaagcagatgagggccgatgatgcgccctggccgtatgcagaacggcttcggctggtctacgaattggctcagggcgtggactgttgttgactgcgccggcggccaaagcctgggggcctcgcgcctccgatagccatcgtcggcgcagccggtcaccgcgcccctcggggcactgcgttgcaacggcctgcaggctccccatccaacctgttttgaaacacggaccacggagtctgacatgcgtgcgagtcgacgggttttgaaacctggaatacgcaaggaatctgacaagtggcaggccctcgcgggccatacctttggccgccctgatcttctgtgaagggttcgaattggagtacgcatgtcgggacccgaaagatggtgaattatgcttgagcggggcgaagtcagaggaaaatctaatggaggctcgaagcgatactgacgtacaaatcgtttgtctgacttgggtatagggatgagaccaatcgaaccatctagtagctggttccctccgaagtttccctcaggatagctagaaagaccaatatccaatgtccattatttctctcctaattcatggagaaatctttctctggtttagactaggaaaacccctaccatcatatgcaggaatttgagcagctttgctcgtcacggtggaaattgtttctgttctctctttatgagagagagagagaaacaatggacattggatattggtctttctagctatcccgagggaaactttggagggaatcacctactagatggttcgattagtctttcggccctatacccaagtcagacaaatgatttgcacgtcagtatcgcttcgagcctccaccagagtttcctttggcttcgcctcgctcaggcttagttaaccatcgttcgggtctcgacaggcgtgctccaactcaaaccctttacagaagattagggtcggccggcggtgcggcccgcgagggcctctcactcgtcagcttccttgcgcatcccaggttccagaacccatcgactcgtaggcatgtcagactccttggtccgtgtctcaagacgggtcggatggttttggtagtagcacctcgatcatcataagaatcggtcttcaggcctctgctgcaaagcactaccgtattatcacatgtctaataggtaaggcttagtttgtacctcagtctaatgggtaatatccacgaattaaatttgaaaatatatattttttcaatattttgcgtttatatacatgcatgaaaaatatttgcacaaatataccacctccgtataacggggatgcgggaccgaggaggtgctgctcttttattccgtgggaccggcagtcgcgcagtacgcccgtgcggcaccgcctcacatggactcgctggagggcggtcccgcaccacggcgctgcgcgacaagcacagtcccgcgcatcagtgccgcgcaactgccctccaccacgctaaacagtgcagctcggttgtgtctggattaattatagacctaacggaggccaaaattaacaatatgactaaccagctagcttgtactttctcgaggaattaggttggaaatgatcgatggatggagctgaggagatcaggatggaataattaataagctaagcaagtgcttatgtattgtgaggtttgactggatcaactgcgtgcgtgcgtgcgtgcatgcttgacaggtgatgcttgcatccgcgacacacgcacgcgcgggacgggacgggaagcacggtcccgcgccatggcgccgcgcgaccggctccgtcccgcttggtgccgccctccgccacgctgccgctctcctaagctgcgggagcgagacggtgccgcacacccgtcctgcgcgatcgccggtcccgtggaataccaagcgcggcaccgtttcgatcccgcgttcccgtcgtgcggaaaaaaatatttgtgcaaatatttcctatgcagtatataaacgaaaaatattaaaaaaaattgtatatttttaaatttaattctactatccacgacctcatgggatgtggttccatggccacggcggagttgctcggcgaaatgttgttcggcccggacaatcagggggccttgtgtttactcggcccaggaggtggtgattggtatagatggccatgtgggccgcccggcacggcacggcccaggcctggccgtgcctgggccgaggcttgtcgggccggcacggcccgaccgacgcaccgggccgtgccgtgccagcccacgtgccgcactcacagcccaggcacggcccaacacgcctcgggccgtgccgggccggcccgaaggcacgatgggccatcgtgcttttcctcagaataagtctaaattttctccctcctattaggctgtgacattgtatagctaaaaaaaagtctattttacctccctcttctttgtgatgtggtatataaatagctaaaataagtctatttaaggtccctattctttagacattgacatttatatgtctatttttagtccctatactttgtgtaccgggtctggcctgccagcccatcgtgccgggccggcccgaccgtgccgggccagcccagcgtgctggtggggaggcccaggcacggcccgacggtcgggccgggccagcacgggcccgacccaagtcgggccgtgccgtgcttgggccgggccaaaaaggcgtgccgtgggccgggccttcgggcctcgggccttatgaccaactatagtgattgggagatgaggcgcacgcggcggcatcacgtaggaaaaagtacaccgaaggtacctcaacttgtcattgagttataaaatcgtccccaaccgtaaaaccagatattcaacgtcccttaactaattaaaaccggtcacaatatatccttcggtgattttaacactggttttatcctacgtagcggctgaatcaatgtgacccacgtgtcaggatgccacgtcagtctccctccctctctctctctcactcttctcttctcttctcttccgttctctttctctgggcaagccggccggcggctggggagaaggccgccggggcgaggcgggagaggcggccggcgccgcaacggcggccggcggcggcgtcgacgccggcgatcaccaccacgtctaaggttgtgttccaggacggctcagctccatggcgcagttcgtggcgccggctagcacggtgagggacgcgcgttgtcggcgtcggcgtccacctgcttcgtctgctgctccgacgagctccgcttcgacgcgccggcgcgcgcgatggcggtgcacgacgcgctccggctgggccagctctacttcgtgctgcccgtctcagcgctccaccggccgttctccgaccaggacatggccgcgctcaccgtcaaggccatcgcggcgctcggggcctctgccactgccgccgccgccggcggcaacagcagcagtatcagcgtgtcgtcgcggggcaagaacgcgagtcccgccagcaaacagcggcagcagacgacggctcgagtggcgccgatacgacgaggatcaacggaggtagcattgctcgccaacgcgcaggattgcagatgcagaggtcgagcgccatctcggaaggcgatgagtgatccaacttattaaattgctatatacaagtttgatcaaagattagttgctaaatgctaattagttaattagatgctcccacatttgtagatagaggagtccatacttgtatagtatgttcagacaatttttatactgattctttgcagcatgccatatcgtctttttttttagatgaaattgttcatatctccgttgatcctcgtcgtatcggcgccactcgagcagtcgtctgctgccgctgcttgccggcgggactcgcgttcttgccccgcgacgacacgctgctgctgccaccgccgccggcggcggtggcggaggccccgagtgccgcgatggccttgacggcgggcgcggccttgtcctgggctcctggccggagagcggccggtggagcgctgagacgggcagcacgaagtagagctggcccggccggagcgcgtcgtgagccgccatcgcgcgcgccgacgcgtcgaagtggagctcgtcggagcagcagacgaagcaggtggacgctgacgccgacgacccgcgtccctcaccgtgctagccggcgccgcgaacatggagccgtcctagaacacaactttagccgtggtggtgatcgccggcgtcgacgccgccactggccgccgtcacggcgccgccctcctcctctcccgcctcgccccggcggccttctccccagccgccggcgggcttgccgaagaagaaaagagaagggtgagagagagaaggaagggagagagacgtagcatcctggcatatggggtccacgtgggtcctacgttgactcagacgccatgtaggataaaaccggtgtcaaaaccaccgaatgacctattgtgaccggttttgtaagttgaaggatgtcatatatctggttttgtggttggggacgattgtataactcgatgacaagttgagggacctacggtgtacttattcccatcacgtatggttgctgctccagttagggcggcccagttaaacgtttcatccgtgagcggtgaggaagatgatcaggcccggcacatatgttccttttcaacgaatttttttgggagtacctatacatctttcgaaagatttttataatcgtatcacacagatttttaatctttagattaaaatccgatagatataataaaaagcaaaaagcaattaagaaacaccataatggacactaaattaccatatcctcaataaaaagaccaaatccaatacaaaatttaaaatttacatgcgaagattcaaaaattacagtgtaacttacaaaagttacagtgtaaatttcataaattacactgtaacttacaagaaaatgcactgtaaatttgagtaagaaaatcgagtgagagataagaaaaaatctttcgagtgagatatagcaaaatcgaatcgaaaaattaaaaattgagtccgacacattaaagaagcgggccaggttggatgagatttgatctagactgatcaatttgcacgaatcttgcaacaaaagatctaacggcaggaaaatcgactgagacataaaaaagaatcacacgacagagaaatagcaaaatcgatttttttttatttatgtttatcttttaaaagatttaaaaaataattaccgttttaatgttttgtaaaaatatattcctcccaccctatgggcatataaatcgccgtacggtagagcgtgctatgtgacgtgatacaagatgggaggacgcgttgtgtcaattcacgccctctcgtagggcgacttattttgatgacattgaccatagtttgataatgcatagagcgtatcatgacaattttgcaagcacccccctcccgatgataaaccaccctcaccggaaggggacaacctacgaaattaccatggcacgccctctcacggggtacatcacatagattgttctaccatagagagatttttatgccttgtcctacaatagggcaagagaagtatatttctattgttataaaaattgaagttgtttttgccggttccgtgtatgagtcggtttttaagttcgttcgcttttggaaatacagatttatatttgagtcgggttttaagtttattcgcttttgaaaatattgtataagaaatcttttttaaaaaaaaaactcgcatgctaacttgatatgattttttaaaaaaatatatatccaagcgaattctcacagtaaacaataataagattaaaatagccttcacccgttgcaatgcacaggtattttttctagtttatgtaaaactttgaaatgtgaatttttttttgaaatatttgaaaaacaaatataagaaatcccttttcaacagcaggggtagttttcgaagaggactacacaattattggtaggcctcaggctgacctaaactttattaatggtatcacatcccaaggaaactatacaggatattgtaatttttctctcgatgtgtgccgaaattgggtttggtcgcatggcgtcattcaatatttgttaagaataagaacaaaaaatccatcaagcaagtaacaaattacaaagccgttttgtcttaccaaatatctacagaacggagccgaacaagagcaacacgagatgatcgattttgttggcactttttctaacactatgcacaaaagtaatgtatctttatacgtagagctactcgtagtactttctcctctaagcatcagctaaactacagcaacagatcatggcgagagcatcacagtttcagcatatacattacacagcagtataacatgtctaccctatctgaaaacatcgtgaaaaacggaaaagaaaaaaaaaactccatgtcgatcgtgtgaaacgagacaggaaaccggcggcggcttcgtcttcgtcttcgtcccaacgaaaacgaccgaagcaaatcgggctcagcagctccagtcttctctggctctggctctggctgaaaccaacatgcttcttccaatatatttatatatatatattgattgattgattcattacacttcatattttcagaaaattctgtcatgctattatctcgtctggcatcgccacgaacctcgttcgcttctgaaacaccacaagaaaagaaaaaagattagttcagaaaccgtcagcaaaagcgacgaatgataaactgataataatcctctttagaccaattgtcattgttaatcggtatacgcatggtcagggagacaacgacaggtcaggattttgagcgtggggagaaattaagcaagaaagcaagtaacaggctaatatcaaagtgcaactgtaatgcattattgtgaaaatgatgaaggaaggaaaaggctaaacgtttcgctcatttcgatcgacctctctttaattatctcgagaaggaaaaagacttggcagagttagataaggatcactgatggtgatgaggttaattgcaaagaaagactagaattatcatatgacggttgcctgcagctgctaataactgagctatagtttaatggttgtggctgtctatttgacttttagctcctaacgaataaatcaaattggcgattttaccacatcactgacggcgactgaaaattttgccggagatatactgatggttatgaaataagaaacttggcatggtttaatccctcaaactttgccagtatgggttttaagccaagacagcgaactggccatagcccatatgacataataattccatgtttcttctgcttctcaatttctcatacctttcactttttctgaaggaatcaatttaagaacattttgctttgtaccaatctcactgtacatggagttatcatttccatgtttgcaagcacagatgaacacaggactagtattaattagtcatttcccgcgaatgcaaagaaaggtatgagaaaaaaaaaacagagaaggaaaatgtagtgccacgtataaaggaaaaaaaataaaacgtcacatttcgatcaagagtattaaagtagatatctgttgacagcagtggaaagcgtacagagaactctttctgaaacttcatcaggaccaaaaacatttttccgctggagatctacgactggactacggataattgtacgctgaattagcagccagaaaaccgagaaaagtcccctgattatccacagatattcaagtgcgagcatgacaagcaactgtattctttactgccactcatcgctcacatcaatccggtcaaaatcttgaaaagttctactactactactgctgcagtacgtactgctccgtgatttgtgatatgggctgtgtttagttcacatcaattgaaagtttagttgaaattgaaacgatgtgatgaaaaagttagaaatttatgtgtataaaagttttgatgtgatggaaagttaaaagttcgaagaaatattttggaactaaacacggcgatgatcgcgtcgtcccgtgcgccacgacaacaaccagcaaaccaacgctggattgggcggtaattgaaattgctaaagcgtgtcagcatcgacataaaacgcctcaagctttgctgatttcacgcgacgagagcaagcagcatcgtctcttttactctcctttttcttttctttttttcactttttctaactggctgtgctcctacagatctacaggcaaagtatgtacgtgctcatggagaaagagacagctttggattgattactactacagcttttgaaagtgtccgttccaaaagtaataacagtattaattaatcaacacactgtgtggatgtactgtgctatcttcttgggtgtactaagcacaaaaaataattgggttaagatgaactgactctgttgagattttgctgaaatagttattttaaccaccccaaatcaaatgcatctcgttgcgtgttgcgtcgtgctcggatgtgcgagtacaaagagaaaatagccatttgttgtctttgtcagagcatgacatgggacccttctaatgacactttctctctgttggatgggccccatcgttaatacgttagcctaacatcatgcttgacacactagtgattagtgaaccatgcagctccagatcgatgctcttcaggacgcgtaatcgtctagtacaagttcttcaaaatcgcgattatccaattcccaattgttgtttttttctcttttcaatttgagcaatgcatacacagcatcattttataacatttgatccaaatcccacagagagttgggttttcgatgattataaactgtttttttgcataaacatctacctgcaaatttatgtagccaacctgaaaattttggtttgctaatttttgacacaattttgcgtgggaggaggttgaggtaaaggtgttgctactcgaaattatgataatttagtaagacattttttgtttgtttgtgagaacgaaatatttttcttgactgaaaaattagattatgaaaaaaatcttagttcacactactattagggcgcaaagaaaaaaaatgccatgaaccataatattatattttctataactaccatcacacttcaattaatcgttctcgtatttacgcgtgcgcttcaccaaaaaagaaaaagttaagatcaagtaaaattttttttattgttcatggatttgtttcccccttttctggataagggttaaaacaggcgctaccgtgcatgagtgtgtatgcgtttttttgtaaccacaaaaaaaataaaacacaataataatcctgaaattaggtaatggagtactccctctgtttcgaaatgtttgacaccgttgactttttagcacatgtttgaccgttcgtcttatttaaaatttttttgtgaaatatgtaaaattatatacctacataaaaatatatttaacaatgaatcaaatgataggaaaagaattaataattacttaaattttttaaataagacaaatagtcaaacatgtacttaaaaaaagtcaacggcgtaaaatatttcgaaagggaggagtattattatatttttcaaataataatcttggagagaagcaatgcattacctccttccgggcggccttgacgtctcgcgacgagtactccggcgtgcgcggcagcgtcggccacctctccggcgtcctcagcagccctgacctctctggcgtcggcatcatgaacccggtgccccactccggcgtcgccgcgaacctcgggctcacctccggcgtccgcgcgaagccaccggcgacgccccagtccggcgtggggatgaaccgcgggctccgctcgggcgtccgcagtatccccctctcgggcgtcgcggcgccgctcgcgccgccgttggcgttggccgcggcgcacagctgcatgatcttggcggccgcctcggcggagtcccggctctcgcccatgagcttctccacctgcgccttggggaggcgcatcctgaggcggacggggccgccgcccggctcggaggcggtggacatcggggacggcggcgcggtgccgaccgccgccgaggccgggagggagaggtcggaggtggaccggcgggtgagcatcagcgactcgagccgctcccgcgcgccgacgtgtagcgcccctgaccacgcccgccgcggcggcgccgtggggcggggcagcgcgacgaggaagtagagccgcccggggcggagcggcgcgtcgtgcgcgagcgggcgcgcgcggacgccgagcagcttgacctcctcggactcgagcagctggaaccccgggtggtcgcgcagcaccgtgccggcgaacgccgggggcttcacccggaacgccgtgccgtccagctgcatcaccttggcgcccttgcgccgcccgccgatgctgttgcccattgccgcgccgcgcctcgcctgatgctccttcctccggcggctgggctgagctgcgtcgcgcttggatttttgcctccgaattggcgaattctcttctctcgcgcgtggccttgggtgtggggcaaagtttggctcgctttgtagtttgcggcgattgcgggtgggcgtgagaatttaaaaggggagggaaaagaaaaaaaggaggggaggtgtgcgggagtcaaagggggggtggtgtgagtattgggcttgagatggaccgaagggagaattctttcttattctttgtataaggtgtggtttgattttcttcctttgcaagggggtttgtaaacaatactctattgcccaccacgcggttaaaaatcattttaactttataattttttaactgcaaccatgatgacacgtttttgactgtcaagttgttaggaggtcaatgggtgatacatgtggtcgtgtttaacatggctctgtgttttcttactttaattttactaaccaaaaaccctgccatattatgaataaccctattattttgtttacttattattgtaagtaaaagtctaagttttaatacttaactttagagctgattttttcatttttttttcattgtaatttattttataatatttatttttaaatcattaagaacacgtatataaaagttttactcgtaaattgcctttaaattgttaataagcgattcacataagcataatcaaaacaataagaccggaagtattttgtttttgggttctgtaccaaccattataacaaggcaacaaagcagtgaaaaaggagtaaattttggtaaaacattgatatttttatataaaaacataaattgagcaaatttgttgcacgactacaaatttaacatatctaaatcaaagcgagcaaatcacaacatatatgtttaattagtgtcacttttatcacaaaattcaggttttagaggctactacaatctaaggaaaatcagaataatccactagctcgatggttaactaaatttatttagggaaaaaggactattaaatcacacggggcatattacaatcgtttttgatcaaccacgaaatagagttggactcaaacctggtctagaagcctgagtaacagtcccttctagctttggttgctcattcatgtctaatcaaattttgttcgcgttggatcttcgtaatgaaaatcgtcctttaacctttcttaaagaagtcgactaaatcttttgttgttacaaccaaaattttctacaatcaccgcatcgttcaggcctgcttgtttgagcatttttttggttgtgactcataccatgcatgtaacatagttttgaggtcagattcttgtacttcgatcttctcttagcggtaaagtcaaagaacaaaaaagaactgaattaattctaaaattcaaaattggttatggccaacctaagagcacccgcaatggtaaagtaaggtgctatctataaaacatgtacatctcagcaatagactagattaatagtaaaccgcctcaatagtatg

SEQ ID NO: 1740 - DNA, 6363 bp, Oryza sativa
tggattagacagctatagatacccatgtagacataccattgaagtagtttactattaatctagtctattgctgagatgtacatgttttatagagagcaccttactttactattgcgggtgctctaaacatgcatttaatccacaatgtaaacacataaatgtatgtgtgaaagagaagcgggtagatgaaatatttagtttagcacaatattgtcatgatgtaatttttaaaattagcacaatttttttgatataaaatttaaaacatgtagttttgggataaaattaacagtagctccatagtttgcatatactaacttaacttaaataagtagttgtgtgatgatgttctcaaaatatgtttagttttatgaaatttagtgtgattacattatgttgaccatttctctaaaaaatgtgaccatttttcacagaagttaatatgatttttacatacttattaaccaagatttgcccattttaattaagaacctgtagccggttctcaatcttgatgttaattaatttattttttacgctttctattgtcagccactcagccttaatcttttgtattgttaatacgtagtagaactatatatataaagatcttgctttgaagattattctattgttattcaacttataaccatagacgtaaaatacgtttcatacaggctgtggagtggcgtaacaaacctcattcactcgaagaatttggtgtgaaaaggaccgttcaaggagtacctcgatattcacaagatcacagcatttactagctagagcaatagcaactagcaagccgtcacgagtaccctctcgtctcgtaggcgtaaaaccccgtctacctcgcgatttcgtgacagaatttacctctcgatcgtactctaagcttctttgaaaactcccaaaaatcaaaaccgcacatgtacgtgccatctgcaaaatttcgaatgacgttcaagcaaggcgcagcacacacgcccgacctgccacggcggcgccaggcgtgtactaatcttaatctcatatgtctgcacccgttttttccccctattcttttagcgcccgtcacggcacggatcgattgattggagaaacgtgcagcgccgagggcgaggggtgcgtggtcagtggcgtcccgttgatgcaggcatgcagggtgcacgcgaggccgtcaatctggccggccagcgcgtttcgaccgccgtcctcatctgcaggaactaagggtgtgttttccatgaaaaaagttaaaagtttgaagaagctgagagtttaaaaaagaaagttggaagtttatgtgtgtaggaaagcttttatgtgttatgatgtgatggaaagttggaaataagggagaaactaaacacggcctaaaagtaagacgtttttcatactaataaatgacgtgttttttataaaaattttctataacaaaattgcttaaaaaaacatattgatctattttttaaaattttggtctaatacttaattaatctcgctttaattgcttgcttcgttttctatgttaggagataagaggttgggaaatttttctcccaaatacagcttaggctatgttctttcacatatgttcccaactcccctcactcgttttccgcagatacgctttttaaactgctaaatggtacgcgttttgtaaaaagtttatataggaaagttgttttaaaaaaatcatattaatctatcttaaaagttttttttagctaatatctaattaatcatgtgataatatatcgctccgttttccttgtggagcccaacccctccaaaagaatacagtcatcgtgattgattattgtatcatgaggatttggctatcaaattttaaagcctcattacacatttcgtaccagggcggcagggcctctaattcttagctgcaaccctgatctactgtttgctcggccgcgcgttggcatgtctaacgcgttttcggtctgatgctgcctcggcacatgcccttcgccgttcccgtttaacatcagtgactagtggatcgcactgttcatagcaaaacattgtaccaaaggttatttatgttattgttgtagcaccagatctcgataacaaaaatagatagataagattatgtctaatgttttaagtgtagtcacagttgtaattgcacctcatctgaatccgtgatcagtatatgtaaccagattaatgtcttcaaaataaactagcatggtggtccgctcagattgcacgggtagcttcattatattttctctcatataatagcatatatgttttcttattatattattaaaatatattacaatgataatataattttaaattttacaataactttacgaaactactaatgtgtaatattcatattgtattttatatacgtgttagttattaattatttttaatatcaaattttagttatttgtaaattatatacattcttatatggactctagactcatcttttaatatttatttttttaatgctgaatttttattatttctaattgtatttctacgtggactctaaactcatctttcaatactctttaatttttaatttcaaattttagttacttctaaattgtattcctatattgactttaaactcttttttttcatgtttttcttaattttttattttagttatttgtaaattgtatttttatacggactctaaacactacttttcattttattatatttattccgaattttagttagttttaaattcctatatggactctatactctacttctaatattccttatttttaattccgaatttcaattattttctaattgtatttctatatggactctatactctacttttaatatttcttatttttaattccgaattttagttatttcctaattgtatttctatatggactctatactctacttctaatattccttattttttaattccgaatttcaactatttctaaattgtatttctatatggactctagtctcctcttctaatatttcttattttttaattctgaatttcaactatttctaaattgtatttctatatggactctagtctcctcttctaatattccttacttttttaattttgaattttaactatttctaaattgtatttctatggattctgccttttctttttctccgattaatgtgacaatttctagacaataagaacgaacgtggaggctcctttttctattcctttaataatataatagattaagaaatacctaattcggactgcaaatattaattttgcgcttacggtaaagagggtacggcttccagataaaagccttgtactgtagtagtacgtcgcaactgatttgatgctcgtgggtcgtggcagttttttcgacagctaatgacattatttgcttgaaccactctacgtacttatccgtatattctcaaaatacatatattctacttacgagtagcataatagtatatcgtacagccctagagtcggttagccacaggtagccaacacacacagtgttatgtgctaattttagcgaagaaactactactactacctgtaaattatatatctgggatccacactgggcagaccaaaccaaaaaatgtgacacaattcgtcagagactcatgacctaacaggtgcaaacgtggaccgaaactgtgttccttcttctgtcttcacctgcatgacaaagctggcacacccttctgaccttcctgcagcaactccaagggcaatggtaagctgacggctgctgatatgtgcaggagctcatgtgcgtgatccgttctctgctacggtcgttgggcatatcgtttcgctcacctgcagggaatctttaaccatataatgcacgcgatcgaacccgttttaatttagttctcgctggcttcgcgatgatgatggtgacgatgctatgatcgatcgaccccgtcgtcgttttcgccggtcgcgcatgccgtggcgtttcccccggatagcatcggtcgcccggccgctcgctccggttgtcgtcgtcgtcgtcgtcatctcctcatatacggactcgatctgcgtgcgtttgccgataaaaccacctgctcgtggtgtgtatgcgcaggagcggagctagagcgaaatggagggtggtgccacttgtttaatttaccctactttagatcgagtttaagctcatacgggtgtctaagtttatattaaggcggatgtatacatagtgaaaatagataagatatagctaaaaaaaatttgaccggatttttaggcacccctaatatataccagctccgcccctgtgtatgcgaacgcggatgtgttgatcccgtgtgccgtcgcgttgctctcgatcgatctcgtccacggtcaagctcgattgggggcagtggtgtcatggcatcacgtgtacgtacggtttttcagtcgcggcacggagctgaagccgtcgggagcgttgcgtgcgtcggccggtcagcagccggatatatatggtgcatggcggcgacggtggcgaccgcctaaccaatcagccgcgcctattagcttatacgaccgggctcgtatacatggtcaggttcgttccaaatatataactacgggttcgatcagctggctatcaaattttaccagataatcaactgacgataaaacaacaaacttgagtttgaacttacaacgttctggctgtttgaacttatcgccggttctttcgagccttatttatggctcggtcgttgttactggaggccgcgacatgcgcgcgaaggatctcgaagtcgcacgaggcgcgaatggtgccgatcatcgtagcgtggcgcgccgcagagcacgcaaaccgcgtgagtcatatgtacgtgtgcgctgccgtgtcccgcgcgcgcgacgatttcgccgcattccgcaccgtgcgcgccgccgatcgatccagcgcgcgagaggcgtcgacgttgcgtgtccctgcgccgcgcgatcgcgaggtacgaagcagtaacaaaaactacagtaacaaccaaaagctagcaaagcttgtgacaaggtttcggagtaaacgttccaaagacaccgaccggcaccgccggccggacgatgtaccggacagatggctggcgagcccgcgagcggttgttagagtcaaaacctacgacttgaacacatgaacagaaacaggatttggttaagtctgaaacccaatccaaaacctcgtcgttttcctttttctttctttctgtttttttttccagtttttcaaacgctgaacggcatttcgcgaaacacgattggcagtttggcaccactcctccgcgcggagagtcaaatataacaattaacaaaccggtcgctctgacagctacagagatacggtacagggacaacgcattgacaatttgggctggagcccaagatcataattccatcttattaatatgcgttcagttctataatgagaagagagaaaaaaaggttagtactggtcgcatcaccacgtactatgtacgggccggggactacggagagagtagcatcatcgtgatcatcatcaggtcgtcacctacggaatcaatggcatctccatctctcgggcacctttctgttgggttcgccgtcgtcgtaccggccgtccgtccacataactacccctgacgtgtgccgatatatgctcgatccgtcgatcgatcagcgtgccgtcgcgtgtcgcgtgaatgaacgatatacccacgtgatgtaagggcgtaaccgtcgatagattcgttcttgcgctcgacgccctctagctaaaaattaagccaggagtatacagtcgtttctcgctgagattaaaggcttgtcacacgtgtaaccaggttggcgcacacgtggcgtcatgactcatgactacacatggctcgggttatttggtcgtgtgtgacggtgacagtgttataggtgttgcacgaaggaagatgggagagaacgtgatagaaaaccacgtaacgtacgcatatatatacgtacgcacgggacaagacaagacctaccgctacttaaaaaaaaaagatttttgcaaacaaccaaaacaaattttcccaggcaaccgcccacccagtatatagtataaaggcctaaaaaatacatgatttttctagattggcctcctagctccatcttcacaagcgctacaaccacatgcttgcaaaaatattcttagtaaaaaaaaattcccccgccacccccaatcccccggttcaaacccctcgctaccataagccaattacaaatcacaaattcttcgtccattcagaaaatccaatcactaacatgcaaacatccatacatcatattcaaatacatagcaccgacttgcagtcaaacatcgatcaaacatggaaacaacaaacaaa

SEQ ID NO: 1741 - DNA, 1151 bp, Oryza sativa
ctttcgccgtcgcatgcctcctccccgcctccttctactgttgtagccgtggccaccatcctccccttcctgccgaatctgggagggagagggagaggaaggggagggaagggccgctccgccaacctcttccgtagccgcaattgctctcgccccagtctacagttggatctgggaggtagggagggaaggggacagctacgctgccaccgtcctcctccctacaatcggatctaggagggagggaggccgctccgcagacttcccccactaatccaaagctattgccaataatcaaagtctatgctttaatgtgatctccttttgtgcactagttgaactaagcatggctaagcatctcctaaaccaacatctagtcattttaatacctaagttatcaatggcgtaagggaaacaacatatagctgagtaataggacccatcccacatgatattgtaaaacaatgcaatatttaatagaaatgcgggacatttgtaaattgggtacaatatgatcaattgcaatgtatgacctgccttgctctcgcactgatggaaccacaacaacgtcttcgagaaaccacgaatcgacgaaacgggcgaaatctacgtgacaaacaaagcacacaagcaaaacgtgctataagactactgaaacaggaaacaaaactatttttaatggattctatacatttttatgaatttacttagacttgaatggacttaatcggagctcggatgaattagttacgatttttagaagattctctgtgtttttactattaaagaaaagccttaatgtatttattgcgcaatattgccccagggatgacgtcagcagggggggaaggcgccggcatgcgggccccatgagtcagcggctcaagagagagagagagggaggggcgccggcacgtggctcgactcggcttcaaagccggcaggccaagcatggcgggcgacggcggcacgcatggtcgccggcgacggcaaccggcggcgcggacggcgacggcagacggcgcgaaaagcggcggcggcgaccgaagacgacggtgcgcgcgcggaggacggcggcgcacacgggagagagggaaagagggaggagggggagtttctcaccgaggttggccggcgcgagtggagacaac

SEQ ID NO: 1742 - DNA, 521 bp, Oryza sativa
cattgtacttaagcatagactgagacaaattactagcagttctaggtttgcatgacttgagatgcctaagcaaatgaccagtgccaccagatgaatgagcagacaaagtttttttttgcggtgattgcatttagcagaaacgcgaacctgcgcgccattaggtgattcaaagagttcttcgaagtcatcccataccttggatgatcttggccgcttgttggtagcactggagtcagtgccggacggcgcgcctgtgccaccatcactgtcactgccactagtaccgtccacgtccggctccgtctccagctgcaacccatcgaagtgaggaggtgacgaagtgattccgaacacctgcacgcgtacctcctccaagtcatccttgtcatcaccccgcatccccatcaacctcaactcgtggttgcaagaggatggatcgtccatcgccggcactccggctcctcaacggcggctaccgctcagcgacctgcaagacacacagaatgagatgagagagcagt

SEQ ID NO: 1743 - DNA, 10594 bp, Oryza sativa
  unsure (1)..(10594): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaaatatgcattaaactcaaagtgagataaagagagaggatgaaaaaaataaagctaaccttatagttaatctattatacatgttagctctaacattgacttataataagtagtgaattgtactattaaacttgctcttagggcaagtactataggcattttaggcatccaagcacagacccaagataccacatagcactaagggcaagtactacgggcatctaagcacaatctcctagtgccacataagcttaaatagtgaggtggaggagagaaaaaatgagagagataaggagccacccctcatgcaagaggcaactactacacaaaattcaagacaaagagagcgagagaggaagagtagatagggcaaacaaatattggggctagtgtattataattagtatagatgtgatatattgtacatgttacctctatatttattagttgatgatgtggtcaagattagatgtaacatccacctcttttataaaacttgccctaaatgatgagatggaggagagaataaagataaaaaagaaatagtcacctctcatgcaaggggcaactcctacacaaacttcaataaatatgtgagattgctagaaatattggggatgtgtggtagagacaatctattacacatgttacctcttaatttaatggtgtatgacatgcataaaattagatgtggtactcacctctaccataaaacttgcccttagagcaagtttaatagtatagccaaatcatctatagtcaatttaatagctcatttatataatatagttaactataaatatactatatcattaataattggtcacacatatcatacacacgtagcgttttagaatccgtgctgcagctggctacaaatatatagtccgcttatcttctctcttttcttatcttccgtaccgcagctggctataaatatatagccgacattatgttagggcctcatcggatggatgtatgggctgaggcttttcagccaaagcctatcgaattgcttattgggctgaggactttaaaccgaattgcttattggactgaggactttaagcctcaataagccaaataagccaattaatggcttttctttagcttaaggagaaaaggtaactttgactattcagccaaagctctaggttaaccgatgagggcattattgtacctgctcttaacgggtcccagcaaggccgactccagagatgggcctacagaaatggtcgactgtacagtgtacacatgtgtctagtggttactcgaaataaagattttgtcgggtggtgataatgatccacttatctgtgctcggctagttgtacaagtaggcatatttttttttcttcaaaacagcacaaatacatgcacttgtataaacatacacacacttattattcttaatacacacactcacacaagagaacacacgcacccatgattcttatgtgagtgtatgaagattgaacttgaatatcctgagatttataaaatcaccatatattacttgatatttgatattgataggtacgttggctatcagtgctataaatacaagatgatttgataggtggcaaagcgatagcgctataacgaccgtgatcaccttaacaaatcatcttagttgccttatataaggcgcttcatcgtgcatgtgaaagtcaaagatgtatgtatgcgttgtgtaaagggccagagaggtatctttggaagctttgtttattaaaaaaaagattcaatggtttaaataataggttcaatggttcgaagggaaactattttttattaaaaaatagtatgttcaccgttttagtttaaattagttaatatagaccataaaatgttaatttattgagtatataatataatggtgtagtacattatttgaaaataatagtccaaagtaattagttccctaatttaaataaaaattatcttatattattattaatttaatgggtaaatatagtggtgaaaactttattaataaacattgtagagctaattaagttacacattttttaaaaagttttatgatgatataatctttataaaagtatgattatttaaaatttagagtaaattgcacccacggtgcaacaacttggtaggtgggtgcaatttagtgcaataacttgagaaatgagggttccagtgcaacaacttggtaggaaggtgcaatttagtataagaactttataagtgatcgtataaatacaacaacttgcaagtaggtacgattttgatacaataaattaagaagttatatgataacttaatttttttggagcattttaattttttgagtatttattttgacaatattctagcatggatttgtataatcatatttatatatttatcctaataactaataactgaaagttaataaaactggatgtagaattattatatttcggttgatatttgagatggtgaagaaagaaaaaaaatcttaaagttaattggatgtaaattgtatgtgcagtataattcttaaagattaaattcaatattataaggtaatatccgtaggaatattgtgtaatggcatattgacatcgtgaaaaaactcacctagcatatgcttagccaagttgatgcaccaaaatactataaattgtagttcttgtactagaatgcacccacttgtcaagttgttgtactcaaacatttaattcgcaagatcttgcattatatcgtacccacctgccgagttattgtaccataggtgtaatttactctaaaatttattatcactattaatacgtgtatccatgaaaaaaaaaggagaaaatgtacgtatgtacctacctatgcaacaggagaagaggtcgaatttttcccatctaaacacatgtggccccctaatttcaaatgtgagcacgtattgttcagaattcttttctaatcgaattagttggtacaaagcaaatgatcgatccatcaacacgtgtagctagtaaattacagtaccgtgttattttttccctccttgctgatgttgtttctatgtaaaacaaattaatatttgttagcacaaattacaattttgatgatccaaacaaatggactagatttgagcttaccgctgccgttctaatttcctaaacgaaaactcgagactgacggcatgatgacagggtgccctatctcgtaatggttgatctaacctattgctaatggtatttgggttttctttttcataacaaacagtgtcaagtaggcctaataaacaagctgctacgagcaagtgatttgtcctaacgatcaacagccctttagtttgttactactccctccgtcccgcaatataagagattttcagtttttgcttgcaacgtttgaccactcgtctttttttgcaaatataaaaaacgaaaagttgtgcttaaagtactgtagataataaagtaagtcacaaataaaataattaataatttcagaaaattttgaataagatgagtgatcaaacgttataagcaaaaactcaaaatcccttatattatgagggagagggagtacattttgttgcacatcaagtccgatgggacgaccactgacacacagtcacacacatgagcttttgatttcaaatagaattccagtcattacatgctcacatttgaaattagacggttgcatgtgcttagatgggaaaaattcagggaatgcctgatcttggtcttcgacacaaacagcaggatccgatccccttttagttatttggtagagccaaaatctggctctaccaattctttggtaggattagacttcatattatattgttggttcgctagcaatatcctcaattggtacatggtgaagaaagtttttgagtgttgccaaattgaacgtttgggcattttccaatgatttggctccaatttaaactaactactgtttaagttgttgaacaactcatttgataaatttcggtttagatccaacgcggtccaaaaaaaagttgaggattgggctttacttgcacgaaaaaagttactccctccattccaaaataagtttattttgcatcccatctgtttatcccaaaataaattcattttctagtaatcattgcatcggagtttgtaaaagtatggataaatgcaatgagagtagatataataggaaataattacattgtgattaaataaagttggggtattctagattttttattgatatatgcaatatgagtaaaaataaacttagggttgtgttcgctgaggtaggttgagaactcattctctccgcacgaaaaacagagtggtccattagcgcgtgattaattaagtattagctttttttttcaaaaatggatcaatatgattttttaaagcaacttttgtatagaaactttttacaaaaaaatacattatttagcaatttgaaaagtgtgcgcgcggaacacgagggagaggggttggaaaccctgagcaaagaacacagcattattttagaactaagggagtacagataaagagatgcttgctcaacaccaaattgatcatctcacgggaccaggagtgcacaaaaagtggaaatttgtattatattgaattcggttgaattaagaaagggcataatcgaaatcatttctttgatatgccatatgctttacgaaactgcatacacatcaagaaatgaaaattgcatacatgcataatacaactaccggctggtaggtatatataaaaagggaccttggaaaaccaacaagaacaagttccccatctgctaagcctggctacgtgatctatgaaccatcaaattcttctagcagattgcattacgcgtactatagttatagaccttttgtattgttttggtgcaaacccgcaagagaaatctcgctcgtatgtaggcacgtagtaagctgccctgccctgccctgtcctgcccatctctagcagagaagacaacgaccgagcagggcagcagccagcatcacccactgattagccgatcgatcagcgtgtcatcccagggtacatctccggcgccatggtcgccgccgggttttgcccttgcttctccatgtttgcgtgccatcctgcacaaaaccaacgaaatcgtcatcgtcacgatcatcaacacgcacgacagccaaccattccattagaaaatcgatggctatgctataaacatattttaacatattttaagaagataaaagagtagagagacgagcagtggactacagatttgtagccagctgcagcacagactcaaatacgcaatgtgtgtataacatgtgggaccaggaattaatagtgcagtagataactattgtatcaattaactattaaattaattataaatgatttggagttggtagttggctgtactgttaaacttcctgttaccgaggctcatgtcgaagccgcgcttcttgagctcgcggtactcctggcagagggcgcagggctcgcaccacaagtggacgaggcagtcggggcagggcgtctcctgcaggccgtactgggaccgcagcttggagcggtagatgcaggagtagatacagctgcagcccgtgacgagaaacaccagcgcgtacagcgacccgctcgtcccgcacgacgacgacccccggtcgacgatctccgcgatctgcccgaacgtgatgcacgggcacaaccacgtcataaaacctgcgcccgacaacaatcgatcagcacacacgtaccacgccaagcagagaacacacaatcgtagcccggcttgcttattttacagttgctgctgtcgtcgaagcagtcaaagaggtcggtggaccatgggacgggggcggcctggtcctgcatggcgaagggtggtggtggtggtggcgcctccaccgtcctcctccggcttctgagtatatatatgctggcccgacgtacggggcgccttcgtcgatccctcactctccggcccgcgagggtgaggctttctctccgacgaggctaatgatgagcgcgcggtgtggtggtacaagtagtagagggtaaccggccgaatcgcggactggtcgtccgcgcgcatttatcgggcgaggccgcgaatgttggcctatcgatcataattttaaggacgtaactacgcatcgggtgctcgatttaacgctaaaaatcgggtgcccacccctacaaaacatcagctaaactggatgcatgcacaaagccatgcgcatatgcaaagagacatgcaacaagcatggaggcactcaatagctgtgcatgcaaagtacataactatatctctcactcctagtattaataaacaacttatttaacatgctctaaactttttttcttataaattacttatctcatctgtgatatgattacaccgttatatttgttacaattaaatatttaaaataagatctcacacgactatattttaaattaaaaattaatatataaatatataactaattgaaacacatttatattatatatgaaacattaagttgcaattgtttaaacatcacaaaaaactccttgaaaaatatctaaaaagaatatcacatgcaacattccaaataatttagtgaaacatcacaaaatacctaccgaaacatcccaaaaaacacaccacgtgcaacattctaaaatacacaatgaaacatcataaaatacctcctcaaactcaaagaacaccaagtgcaacatttcaaataaagtagtgaaacatcaactaaaacatcacaaaaaatacttcttcaaacattcaaagaacgctatgtgcaacattctaaatgacctagtgaaacttcgcgccgtttaagtaatccattgcaacaaaaaaacatttaaaatatttttgtcagaatataatcaagtaagattttattgtgaagaattaattataacaaatacaacagtgtaatcggatctcagattattagataataatctgtgaaagaagattatttgaagttatggaataagaaagtataagtatgtagtaggagcatatggatacagagggtgaacttaattgtacacgttacatgtatcatggcatcaccaatatatatagcaaaagtgattcatatagataggatccacataaataaactttaactataacaatcctcacaatgtatatagataaaaggtagcactaagagaagatagaagtagagacaaataatattatttattttatatgggtagcctatatggttttcttttttactttttagtcctttttttaaattaaaaaaaagacctttacaaaaaatatttctaaaaactgaatcttttggcccgattggctgccacaccagttgcacggtgtgacaaagttatttggctggccaaaaggttcagatttggaaatatttattttggaaggtctatttttaaaatttaaaaataaaaaaatattagtccatatgcatatgggtatcttttgttattttctttaaatggactagttgcataatagtattaggtggttgaataaaatattgtattgcctatagatcacttttgcaccacattgtggatgcccttaagtaggagagaataaaactacactctatatgatttttgatgggtaccggctcaaaagcagtggccttgatcttctttcctggctggaaattgcagtcatgaaggcttatctcccgcttcttattgaaagcaaataataagatcaaaacagattctagggattgcgttcgttggcggactcaacctgacatcttacgacatgaactgctcccaaagagggaggcctaaatatagtttttttggatggaatctttggcgtcagcctataggttttctggtttttctaatttcttctttggcggaatgtgaaagattaccctttgatttaccagaagcggaggaagaattagtagcaggttatcaaaccgaatattctggtatcaaatatgatttattttatcttgtttcttacctaaatttattagtttcctctttatttgtaacagttctctacttaggcgggtggaatttgtctattccctatatatccttttttggatttttccaaatgaataaaatggttggaattttagaaatgacaatgagtatcttatcagaaagataggcggacgacttgaccataaggtcggatgtttccgtgagcagtaagctgcggatctccccttttttgggggaaagctggtggcccttttggcgtgttaattctttcgacggggtggccttcttcgttcggtagatccggtcgaggtggttttcgtttaccagcgcgtaggtggtctaagttcctatgaccgagtctttctggcccctgtgaacatattttcttaatgtattaaagagggcctctctaaccggtgaaaagtggtaggtgtccactaacggctattcctggctcggctccgataacgcaattccgggaggagtcggtagttaggcacttgatcccttcggacctggagaacgtgtgacactgggtcggggtttggtgaaccaacaggtcgctcctttagttgaagtattgggcccctttttcgttgcctaggttacaccttcggaataccccagacggggattgagctctattccccccaatcttcactttacgccatgccgactctccgtcgtggaattagaccaagggtcgaagacccataccataggaccccatcccccgtatcttatctttcgcgcgtaggagatcgagacacagccttagggctatggggaaagtagatcgattgctctagaattacaactacatagagggtctctacaagtctataaagaagtttaaaaaaattgatagacactgtttgatggtgcatgctgcatgcaacacataaccggagtaggaggacgtccgattttttcaaattgggtcgaacacccgaccttaatcgttctcctaatttttcaagtggataattgcatttgtttggactctcgctgaaccaatcatgatgcagtgcgggcctggtcgcgcccacggtgttcacgtgggtggcgcgggctctgcatgcgggatagcacgacgggtggctacggttgtacaagcttcaataaacggtttggagtcagttgcaatacaagcttcaatacaagagagacgagtaaattaaatattaatatattaataattaactattgtataaataggctattaaattgacgaagctagtagttagttatattatattattaagggactaactagctgtcattcgacaaattttagtatagcttaactggttagattctttgtggtggaaccagcccacccaggtttaaatcctagaattgacatgggtgctcgtatttacgggctatttattctttcagtggtaggtaatatacccgtcaatagcgaggcacttacacgcatcaataacttaatgggcttcaacctaactggaccaaccaacggtgctcacacgggctaaaaaaattataacaggcccatggtcaacttcttttttatcacaacttattacaatatatctatagtgtaattatattgtaattataccataattatagtgagttacactataatgataatgtaattttagcttgtaactaaattaaattattcacttgttcgactgacgaagtgcatgttctagcaattagaattcatatgccatcccacaaaggcacttgctggaagattttgtcagcctacagtagcctagtgttggtaacttttttttttttggcaagaagataatcataatcgggacacttaaatgtcttacagtgatataaagtcgccaaccaccccgatatagccaaaggctaaatcaagatgagttttatataaagaaaagctaaaccggctagcggagccgatttagagatcaaaataagcctctaggccgatttagattcgatatgaggataactacccatctcgtgggtgaactgaaggtttacgggacaaacctatagaggggtaatcgcactactctcgcagcgacggcggacgatttacagcgcaaatcgacaaagatgtagtaaaacaagaaagtagaaaacatggctaaaagtaaagataaaagaacaattcgattgtgttcgggggggggggagagatatatcaatcgaaccggtcttgtcccttaaaaaggggttggtcttacctcctacaaatcctcctccacgtccaactcgggatagaaaccaatggaaatccgaaatataccttcccgagtaaggaaatccgagacccgacgaaaacaaactcaggctcggactctaccggtctgaccggccacacactgccggtcagaccgagtcctcaagcaacgatctgaccggccaacatacggtggtcagatcggctctgtagaggaaa

SEQ ID NO: 1744 - DNA, 20100 bp, Oryza sativa
aatttcttaatttgaacctaggtgccaaatttgagtataaacaaaagaaaacttatgttctgatgtggtaggcccaagaaaaaaaggtgtcatttgaagtaagaaatctatcgacaaatttatagtaaaaccgtatgattaaacttgctcttaagcaaaagcgacgtcatcaatgaagtttacggatagtgcacgaacaagactcctctgacttaagtcagatgtacatagccactaacgtgtgagcccataaagatagtctcccctgtcagggaccatgtctctctgattttaagcctgaggagatcgctccggtagtacaccagtgtgcttgtactatgggtcggtactttttttggcgtgagataggattgatctgctggctggtgatgttgatcgaggcgtcgtccgcgtggtggtgctgggtggggtgtggctccgtgtgtgacgggggtcaagtcgtcgcctggaccccagccgccgcccgcgactcggcggcgagctttggtttgactggccaagccttgtttctttgtgatccgcgggtcgagggagtcgcttgccagagtccaaaaggacaccgcgatttttgcgaagcaccgcgcctggtgagtcagacagtcacgcacgacgagagggagttgtccccgggtcagattggcatgggaatcgtcggtcgtcttctctttaccttaacctgatttgagtgttccagtttcactgcgcacggtgcgagaccgaggtccgtcgaaaaacgtcgctagctgtttctgttggccagtcacggtcaccaggggaattcgcccagccatatatggcttggcaagccggatggcaactccgttgtagtgcgtttttttttatttcataattagtaaagtttagcttcaggaatgggatagagagacggttagagttgctgcataaatcccctgtgatactgcaaatatattaatattaacagcgactgacatataggccaaccgaaccctctgggtaactgcacagctgcagcctacaccaccaaaataacattggctgtgtttagatccaaactttcaactttttccatcacatcaacctgtcatacacacacaacttttcagttacatcgtaccaatttcaacccaaacttccaactttgaaaggaactaaacacagccaattatagatcacaacatgcgcatgcgaaacttccatgttgcaggcacgacgtccacttcgcacacggtaaaggcgcataccgatgctgtcatgcctcaccctcactctttttgaacaaggaataattaattatttgccactcttacggatggtgataaatgatttaccactggacccacatgtcatagacacgtaagggctcacatgtcatagacagcgagtggcaaataattaattgccacatcttaaaagtggccaaaagttaaatgtccctttgaacaaaagtagagcacctgaaactatgaaagcaacagtacagttagcaacttggcactcgactgcatgtccacaagaaaccgtaagccgtagagtcacctttcagtgaactacatagctctgtagtagagatcactgattagttcatgacaacgaaactgtacctgtaattcttgcagactgaagaattgacatgaagaaatgtttccattcacgaggctggcagcaggctcagtcagttacaaaagacctaagtcaacaactggactaagattttctttactgttttccctacaaagctgcatacatacagatcaaagaaaggccagcattgcagttctacccaactatgaacatatggctgcttgattggcaacatcgtgttgttttgaaggccaccatgattgctggggcacttcattcttctatatttcagaggctgaaaggttccgtagatcaatatttagaccgcaggaagttccagaacttttttgttctggaaattgcagcagcactttcgatggaccgacaaaaatggtcaaatatttaacatgcaattcaaatactcgaggtatttggcaactgatcaagccggctgttcagtatttggtgagctcgcgcacttcggtattgcagtcgctggtgtagtgcttctgacatttgatcaaaaaaatcaggatcccatctctgaattaaacggggatcctcagcatagcatatgtatatcgatgtaactgcactttcgacaactacaacagttaccccaacctgaaagggggaaaaatcaatcaactcaacatgatccaacaggggtcatagtagagaagtcctgctgtgtgactcctagcaatattctattgaatttgtccagtaagagaaatccttgtttccttgtaaatttcaattagattttgcatgaccataagaacttaccagtatcatgcccatcagcatagaggttgagccaaccataatagctttatcactttgtttaaaatatgtccaaacacccgtacatgttcctgtaattaacccacctaaaatggtgctcatcagaaggacagcacctgaacagtcataagcaacaagtgcttcaacgccagttgattggaacaactcccaagcatccctagctgagcgattgaaactctggccattgatagctatctgaaagtgaaaagtatgtgagacatttgtgcaagcccaataggatatcagtaatttgatatagtaatatccatacagtgatattgattcacaaagcatacaaattggtgtaacatcaatccaggtaaggtatcgggtatccatgtgcactttgacagtttgtatagtaaagttgaacttattaatagcttaaggaaacatttaaagttctatcagttcagaacataaatgataaagtggcaaacacatcgaacagggacagttttggcattggcatgagattatcaaaacttccacaaagataaaacatctgtcactgacctgtacatatgcatatttgttgaagaagcgaacaagagtttccacgatatgaaacaaaaagtcaacacagcacagcaaacactcattgttgcctattttagaacgaattcctcgaatctgaaaattagttaaaaaaataagaaaagggaaaattaatattttattgagagaatgacaataaaacatggtaatctgaaaatttcatgcggcgaaactctgttaaggtaaaggtacaaacctcccaacgtaaagtcctaatagcagccgtaaaaagtgatccatagcaaatgctcccaaatgaagttgttacagcgtactgaagtgattttagaagtggttttgggggcatcgatgcagcagcttgaccaccatgaatgagaacaagaaaaaccatccctgatactatgacatggactgtgttactaaggacagctccagtccaaaataaactgactgagaaaatctacagattacaagtgaaacaatcagaaaatatataaagaataggaaagacgttgaaattcgatatagaataaacaaaacttgcccgctcaccaaaagagcccaccattgccctccattaggtatgtgaaaagcaagaatgccagacactccaaaggaccataatgccatccaacaaagcatgactaacacaaatgcatatgctatcctcatcacatcaggaagttcccataccattcttactgccttctgcaatacaagcattgtgaaggggaacctagcaaaaaccaacccaattaatgccattggagataaacggggtatgtatttttgcagcaaatataatgtttatgagaatagaaggggttatttctcatgattttagcatagaatggaaggaacaattttagcataagaattccttatgaaaccaaaccagatattttcagggcttaaatagttttctttcacagacagccatgacatgcaaaaaggttgccataagacatccatgttaacacctaatgttcacaacaaacttttaccacctacaaagtttgtaaacctagctaaattctgtgagttgaagaaaaaacagttgctgtcaaattttccactgataacatgccggctgatattggatgacaaaatatcaataatcagtgggaacatttacaacctacaaatatagtaataatactgtttgtctgtttgatactggtttgggacataagctgattattgcagagtaatctatagaatagttgttttgttgaagtgacactgtccattaatgtaattttgcctaaagatctggttttactcacaaaagcaattattttcccatatatacaacgttatttgaaaacaggttatcaaactaaatttgcacattgcattgtatgatgtctctggcaaataccaaaaaaggaagcttgaactgtatttaaaaaaaaatgcttgaccagtgggtttaagacagcccgtgacattcaactaagttgagaaaaatcccccagaccgcagttgagcacactcaacttctcgtggggagcacgcttctaccagtgcctgcgaggggggatgttttttgggcaaaacctgggttcaagcctgggccggcatcccctctactggagtctctaccactgcgccgcaagcgcgtttacaaagcttgaaatgtacaaaaaaggattgtggaaaacccattccatttatcacatttcaatgttcagaagttatttagatattcattgtccattggtaagtttcatttccatcatggtgtagagcgcactacatggataaaacagaaatcaatagcatcttgtcctcatgtacaatcctactgggaaatgtacagaatttgtaaacaaatgtacatcaataacaattaactccaacaattcaaacatgtacaatcctactgggtacacagaatagcagagacaatctgcaacacctgcttaaatcttactccctctgcttttttatttgacgttggttagttcaaacaatatcaagaatggagggactactatgtacgcacgcaccaaaagaatggcatgatccctgacattgtagtttcttgtacatctttacagcatttgtaggcactaaagcctaaaagcaacactagcccatgcttaaaccgtgtgctaccatccaaatcaagttaactctaaaagagtgtgaagaaacaaagcactagcattgcacacccatacatatgggtgcacctgttggtaatgggaaccgacatggacacgcgccaacagcctagtaaaattcttataaaagagagctgcgcaattcatcgatttctccagtggcaggaatttagcttctgtcggtgtcagcatcatatgaagtatgaaccctcacctactcaagtctaagtttgcctcgaattgcatacgatttctaattttgtgcaggacatttgagaagacaaaaagggcagttgctgtgcattattattacctatcaagaactgacatgacgtagaggaagtgcagcgctccgccgacggcgaacgccacgccccagaagaagtgcttcccccagaagcagagcacgctgaccaccgcgaggtaggcggtgaggctgtgcacggcggccctcatgaccaccctccccccgtccttcttccccgcggccgccgccagccacgcccacgcgagggcggtccccacggcccccgcggcgccgtagtagggccagtacgactccgtgagctcggacttgggggtgacctcctcggcctcgagcgacggcggcgggggcgcctcccgagcgggctccggcgacccggcgaaacgaggcgcggcggtgaggttggtgaaacggtcgatgttgaagcggtccgcctggccgaagcggttgagccccgtcagcgcgagcgccccgccgaagacgagcaggtggagcaggaacaccaccagccagaacacgtcccggcaccgccgcatcggccacgccgccgcccccacccccacccccgccgccccagccaccgccgccgccgccgcaggccccgcggggcaggggctagggttcgcgctctccccctccgacgacgacatcgctccccgccccgccccgccggagatcagcagcagcggggaccgcaccgcaccgcaccggagcgagggatcagccgcgagcggatcgcggggaggaggccggaagcggaggggatgacttggaggagaagaagaggatggggaggaggagtaactgctcggcagtagtagaagcgaggcagtagtaaccgtttctggtcatcgacgacggcgacgactcgcgctgaaactgtgagaactgggaagcgatgggcgatggcgacgtcgcggcggtgtggggtgtttggggatttgaggggaaagccggggaatttcgggggttttgctgttgggtttggggggccgggcggagcgcgaccggcaccgcccccttcctccgtccgtcgctgcgcctggttggttggctttgtggattctagaagcagcagccagcatctcaaagcaagtggcagttgggattggagaaggcgaggccttggtggtggcgtggtgccagttcggaattctgatgcgccccgctgcacgagaggagattccgcgacggcaactcccaacttcttcgtccgtcgtttcgactccccgattcggcgattcgctaccggggatccaaatccatatccacggcgtttgtgttcgtttaacctgcaacgtttggcaccgttcgaacgtgacaccgtcgatctgtcagttactctcggtgtcaccgtcaagaaactacggtgaagttggaatttttttccatttttaaattttttatttttaatatttatagaaatattgtaccggcgaaaatttttacaaaagtataccctgccgagggcggcagtgtgacatgagggacgaacaagataaaaaaaacctagaaaaatgcatctttggtagggcgaaaattgcatttgcccctttacagcccttgcagaggacggcaagggacctcagtgcaaaatgcgcacaccttgccgtccttcacttgggcgacagaggccatttctgtaaatattttggatggtataatatttttgtaaatattaaaaaataaaaattttaaaatgaaaaaaattcggtgaagttgatgtgacatcgatgggccgaagacgagacggttttctgagccaggcctactactgggcgaattctggagaacggcccactggagtactctctgtctctctcccactggacagaccgggctcaacgcagacacggaacggagccagccatggtgaggtcggggcaggcgtcatgtgcccctgacacctgggcccccccgcgacatcatcctccagtcacgtcgtcctcctccacctcgggtccccaaccttttcaaccacacccacccaacacgccatgatgagggcagcagacaagtgggtcccaccaaacagtgtcgacgggtagatgcggctagcagccgtaacaatccgggcccaccttatcaccaacgcggagtcacccgagcccacatcgcgtgacctcactgacatgtggggcccagacggttaactgccggtgggaccacggaaacagagagggcgggggagaggtggggccaaggctccacctgtgcgtggaaaccttttggactgctttggtgtgcccagctttttatgggggcaggagcgcgtccggaaatagaaacatctcgccgaatttgaactccacctgagcacaggagaagccgcagccactgaggtaaactgctcctcctcgccgatttcccccctcctttttctctaataccaaattactcgagaaattgtgttggttcggtccgcgggtagcgtgattcggccagatctggcgtctgtgtgtgtggagaattcgagggttttgtttgggtttgtggggggagtaaatccggacgaatctgtggtggtttgggggggaattcggtgtgtgtttgagttgatttgagttcgtggatgattccgttggatattgataggtcctagttctgatccagaagtggcggctacgcctttgctgtagcctcaccgatccgccgccgccgccgccatgaagttccgctctgattcgtcaggcggcgacgagccccgcgctccggctgccggcgacggcggcggcggcggcgacgagccggccaagaggcagcggaccgatccgtcctccagttcgagccagggcgaggcctcctcttcctcgcagccgccaccgcagcagcagcaggaggagcagcctccggaggatgcgggagagggcgagcagccgagggttccggatctcggggaggacctggtgttcgaggtgctgcggcgagcggaggcgcggacgctggcggccgcggcgtgcgtgagcagggggtggcggcagctcgcggaggacgagcggctctgggaggccgcgtgcgtgcgggagtgggcgaacctcggcttctccgagcggcagctccgggccgtggtgctctccctcggtggattccgccggctccacgctgtctacatccgccccctgcagtggcgtggcgccggcgtgcccaggcaacaggggaggcggcagccgccggtgaggttgggccgggaccaggttcagctctcgctgtcactgttctccattgggttctttcagaatatgccttgtcctaagaaagacaagggaaatgacagtgataagaatggagggggccaatgcgggtagtcgaatttgtggaataagcttcactccaacaagcatcatcctaagctaccatggcagttgccctattgttcacactggtgatgctagagagtgttggagagacgaacaggaaaatcggcatgcttgatttgggacatgagagaaattaagtggaattgcaagatctgaattggttcggttgtgttccgcacttgtaagatttatgtgatagtgtcacatggattgatggacgttgagtgctatgaggacagttgcgtgaatgctgatgacaagtgatttacttcaagagaagggagaaatggtttgcaattcgttctgctgttgctgatattctagttatcagctattgtgtcaacttgatatatctggcccaagagcagtatggactgtgtgccttcttgcgccggtaccaagctttagagggaaagctgatgcaaatagcttttgtttgcataacctttttcaattagggaaacataatttcccatattaggcatatggagaattatgtgaggtattgattgtttgtacaaaaataaccattttattcttgaatattgcattttcacatgttaactaaggttcttaagttgatctgactgccatgtacaatatggagcccaacaaggggtagtgacacatatttctcaacttcagtatgcaataagtcagtcattttatatgtttttacatgtggagctgcggataatgtgacaaacttatgtaatcgtgaatgatcttttgatgtttctctgtttttctttcatgtagtttgatataggattcctttatctggcactattgaagttttgttgtaaataatgttattcttgcaaagattatcttaaatcaatcatttctggatctgaagaggtattgtaacaatctgaagctttgcacaaccaattgcaactaaacttttgtatttcttagggtgaggacttgaggttggtgtgatgggcatttagctaactgaaatttctctcaaacctcacagatttgaccttctgtttctaccagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcagttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtattacaatagttcctggcatagcagtctttaatttctatttctttatattgtcaagttcatgtgtttgaatgtatgtgtttgataggtacctcgcagagtttaagactggagctgagaggaaggatgctgctgagaacaccatggtggcatacaaagccgctcaggtggtttccttaacagtgaatttgttgttgcggcatcctgtttgtttgtttgtgccattttgcaattttgattcggggtattcagctaaagttatttgtgatgtgttctcctttggtctgttttgtttttctgaatattgttggtgataaaatctttcaggatattgccctggcagagttgcccccaactcatcctatcagacttgggctggccctcaacttctcggtgttttattacgagatcctcaactctcctgaccgtgcttgcaatcttgcaaagcaggtttaatttctactgcattctatttcattatttgtgaattggaggaccatatggagttgagaagatattttgaagtttataccattgttgtgaaatataatgtcttagtaattgggattgaacaaataacatgtatgaattagtaatacacctggaacaggttctacttagttctgttagcaaatagcaaagtgtaggctccttaatgcaagtaagctgaacgggttaggtgcattgtcatgatggattttcttcattaagaatacttgatagaaaatgatgaatcaaataagaggtgtaagaaattatagtttacagttacagatttgcccaccttgaatacttgagtgcttctaaataactgatgaagtccgagcatcactatggccattgtgacgtggaacaagcttgtctcaatatggccatcgttcattcatagaggcctaccagtttgttctgtaatttgttaataatagatatctgatgtatatagaatggtttactgcagacaagtttgctataagttcactgctttgtccatggatataattgatcttggacttggagcacacattatgtgccttactttatgaaacttgcttgtgctagtacttatatttgccatcataatagaatgtgacagtaacctactttatctcaggctttcgatgaggctatctcagagctggacactctgagtgaggaatcctacaaggacagcactttgatcatgcagcttctgcgtgataacctgacgctgtggacttccgatatctcggtattttcttcgccgctagcatatatatttgcacttgcatcatattgtctttggaatcatcttaaatgcgtaaattccatgtgtgcggcttcaggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttatagattgtaatgtctcgtgatttgtcggaaacaggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagccttatctccagagtccacagtcctgccaagtgccctgcttgagtgtttttggtttcttcgatgtaaatcccgttgtgtgcacgatggttcttgattcaccacacattgttgtctacattgccaaaacgtatgcttcaagtgcccaaaaggccgaagcggtccgagaaacattattctgtcaggtatgtgtgataagcggtttcatatgcaacaatgctgtagggacccaaatgttcactggcatcatgtacagatacttgtagtaccaaaattagtttagcagatataagcaccagtggtgtggttatggccttatggattattacgcacacacgattatgccatcactagaaatttagtgactaagatttactaatgacttctgcgtccactcaacgtacaaatattgtagttttctagatgatttttttattttctataagactcatcaaaaaatattatatttgataggatcccttgaaatttttagttgtgtttttcatgagaatgagcaactaaacataactaagcataggggtgccttctgcttgaaaatttttatcattaaaaaaatggggttttcttcttcaagtttgaatatttaatttctttcttttttctacaacattttaaaagttggcactaaagaagacaattattatgcaaagaagataatacatctatttcaatcctaccagaatggaaagctctggaagctgttaaatctttttttccctttttttaccttgcttccagattgtggccccgacgatggtgtcaccttttctattttcttttacatttggagcttaagcatctctattgttttatttgagctccgattctagagacattcttagcatctagaaaatattttttattccaataatgtcattatttatttcatattttattatattttctttattttctttcctaatttttattttgcaatttttcagaaggtgatgtttattttagtagtagtattgttgaaggatctagatgttaccggtttaatttattgagaattagtatagaagtttctggagagactataagctgcaagaaagcttgagctctgtggcatcttttcttgctccatttgtgttttttttttcacaaaagagtctatcatttatcttggaagctagatgcgccaagtgaaccaatcagctggctggatctccaaccagctttagaagtatagctccgttacaggttataagacgttttgactttggttaaagtcaaactatttcaagtttaactaaatttataggcaaatataataatatttataatactaaattagtttcatcaaatcaataattaaatatattttcataataaatttgtcttgggttgaaaatgttactaattttctctataaacttagtcaaagttaaaacagcttggttttgaccttgaaacgtcttatagtagtttttttttatggaaccgaattctggaaggagtaggttgtaaacagccgccgtttgccatatacatatccaaatcgcaagtctcccgccatcgcattgcccgccgaaatagcctccctgcacatcacgcattcacgttcgcacgcagagccaggtaaaacggtcactacccgccacgccggcggccggccgccgcgccaactttgcaccggtttgatgtaatgatgtgtgcagtggtggaggcgccgccgccgccgccgccggacgagacggagggccagcaggcagggggcgacgattcgtcgggcggcggcgaccggcggagaggcgccgccggcgccggccggcgcgtgatcgccgcggtggctttgggcggagcagcctccgtcgccgcgctgcttcacgttttctgatgatctcgcacggcaacaggccgatcaattattattattattatttttcagcttctttagactgtcagtgcctcccagtaatttagcggtagaagatatgcaatgtggcaatgcaaatgaacggttatcgatggttaatttctttcgacgtaaacatgcttatcgatggttaatttcttcatgtaatcaggtttagatgagaccttgaggttgaatatgtcgttcggcttgtgatgcgaacatcccagattcaaaaacatcaagcaaaagagctatagtttcagccaagaagtccaaatgggaagcatcatcagactcgctatatttccctgatttttcaggtaccacaactcgcagctcaggttttctagctctgatcaataagaaccagatacaacatacaaggcacggtcggaagcaaaagctagttttcttcatgctggagaagtgactcaactaaaagcttccagagttcatggattggatgccaaatgtttacatcggctgcagattaatttccatggagagccacgattgttctactcaccttaacattctacggctcttggacgtcagatacatataatacacagcaattttttaccttgtaatgaatcgatttttgatctcattgtggatggcctaatggctcgacagcggttctgaagagaagaacgtagaccttgtcgacggagaagtacaagaagcctcccacagagtgggtgacataggaaccaaagcctgtaccaacaatgcagtgccaagcaggaccatatgttgcgtcgaattcctgcaagaaaatgaaaaaccacattaacaatggctaagacatttcatcctagttggctcagtgaaaaataatgtaaaacgtagtgttcaaaaggaaaaataataatacagtagggaagttgctacaaactttaacctaaggtgcaaccgtgcaagtgcaaccgatattctgagcattagcattctgtagtaaccaaccatccatatgagaaccacttgtacatagccagtttaggagcactgagaatcagagcttacagacatgcactctgaacttttttgtgtgaaccttgaacaagctgaacaacagaattcgatggaaggtgctgggaaatatgattggcaattaggactaaaaaaatgtgccctaattttcatctgcctttcagggatatctaaatttcatatagttttttttttcatgtgatacataaatgcctgatgaaaaaattatttcaagtagcaggtgcctttgggcatgagtatttatttaacataggaggtttgctataaaagtatcattcctacaaaaggtgtaagactgcagaaaatcttgttgggtcaagcggtcttctgacttcagatagggctgcaattttgtaagtaactcttcttcttaatacaatgatgcgcaaatcatttgtgtattctcagaaaaaagactgcagaatatgacgaagtaaacacagaaatattcttttgcaccacatccacaggtaagagttaagatgttgataagttagcacgttgaggttattaagaaggataggcagacctctaagtcgaactgtcaaagtagtcataagtaaaagcaaaatactgttacttcttctagacaaagtattttttttattcaggcttctacacaaggaatgcactttaccatccattattacattgttttagccatatgttgacgaccaatgctaacaaatagcactcattcacaaaattgaaaccttgaatgaaaaccatctaactacaaagcaaaatattgtgtacctagatggcatgcatccattttttaagcaaccaatttgcgtacctctttagaggatgcatttagttaatctaccattgagcacacagaagtctagattgctctcagattcttgtaatcaacaaatttctagaagatctgttccacattttaatgctcaggtaatgagctactccggctaaaatataaaatcagacaaagcaaaaggatcagatggtgtgaacaacaacatatatgaatgggaaattctgttaggggaatggcgaagaatgaatcttacaacacaggggtaaaacaaaagccagcttctgagcttcacgggtcacagctaacaaatgctggatgtcacatgtgttaggctaagctgtcacaattgcatttctggtatatgattctaaagtagcttttcccctatccaatgttgggaccaaatgataacacatctctaacagaaacagaaaattttcaaccatagtcactttcttcaagatatcccttccagttatttataatagagatgctggcattgcacctgtctatctatttttgctaaactagcctcaaagacatcgttttccttttcccattttcctgtttttaaggttcccatcactagccacctccttgcttgagttgtgaggctatatatttcttgagaaaattcccaatatacccctgaaaatttactcaatcccttcaatacccctgaatttgacatcatcccttatatacccctgagttttcattttgatctcctctatacccatctccgttagttgatcattagttgaccgttaaatattttaaaataactatattacccatcctatacaatggtacctacctaataaattttcatatgaaaaaattaacttatacaaaatacaagcaatataatcatttaatgcccaacttaaaaaataaaacttattattttttattttttaaaacttatgattaaatccatacattagtttcaccagaaaattaagagcaaaaactaaatgttatttaggtttaaattttaaatttgttttctaatttgtgataaactaattacatcccctttgttttttcgcaacaaatcttttttcactaaatatttgttgaaaagtaattttgaaattttatgcagaactttttttacaataaatcttttttattttaatgaaataattttttatttttaaaaattcataacaaatatttagtaattttccttattggttttcacaactcaaataatttacacataaaacatttctagcttttaacaatataccaaggacaacaaagtaatttctacaataactaacggtcaaactaatggtcaactacggaatgggtatgtaagggatccaaataaaaactcaggggcatataagagatcaaacaaatctcagggacgtagaagggattgggtgaaattacatgggcacgtagggaattggcccatatttcttgcccaaatttctcaatcccccaaccatattctttactactccctccgtttcgaaatgtttgacaccgttgactttttagcacatgtttggtcgtttgtcttattcaaaaacttttgtgaaatatgtaaaattatatgtctacataaaaatatatttaacaatgaatcaaatgatatgaaaagaattaataattacttaaattttttgaataagacgaacggtcaaacatgtgctagaaagtctaacatgtgctagaaagtcaacggcgtcaaacattttgaaacggagggagtacaaatttaccaccccaatactgcactgtgccactgtctacgtgtactcgaatagcttgaacaaactgtagccaatggcgagacggatggttttaccttcttgagggcgagggcgaggcgcttgctgtcgagccgcggcatggcggcgacggcgtcgaaggcgaggcggaccgcgcgccgctgcatcgccagcggcatgtcggccgcgcgcacccggaccgacaccttcctctcctccttccccttctccatctccttctccttccccttccccttcccagcttggccgccaccgccaccccctcccttgaccttcctcttctccaccacggcggccaccgccgccggcttcttggcggcctcctcgactcgctccggctgcggctccatctccagctgcagcttcgtctcgggctccggggaaggcgtgggcgggggcggggcgagcgccggcgcggcgtggagcttggtgcggcggatgagcgagctgaggtagcggctgcgctgctcgagctcctcggacgccggatccatggcgggcgtgggcgtcggagtcgtcttctgctgctcttccttccagggtgcgggcacgcgcgcggggcgtcgtgctcacctgagacggcggcggcggcgagcgttggtcaccatcgctgcctgcgccgctgcgcggtggtggggggaatggaaatggaagtggccaaatgagaggtcgtggtcaaagcacaggagaagtagtagcgccggttcacgagacgaggcggtgtggggtccgtttcccccggccttttcccgatggtgattggtgacccggcgaatgtggtgagcgagaccggtttgaaactttgaactcctaacgaacgtggtgattcgttgaggccttgaggggattgtcgcagaaatagctacattttgtaactgagagtactccctctatttttcaatagataatattgttgacttttaaatatatatttaattatttatcttatttaaaaattatgtgtaaatatataagatataaatcgtacttaaagtattttaagtgataaaacaactcacaacaaaataaattataattacataattttttaaataaaatgaatggtctaacatagaaaaaaagtcaatagtatcatctattagtatgtcattgtgaactgtggagttgtttcgagctggcatttttactttatgttcagtgctactgtgcgagcaacacgaatggatacagatcaggtatagttgtacttgtatggattcttatcggaattttagctcttaaatttaacttgaagaactagttcgaagtggagttgtgaagtagttgaatcgcgctctatatctttcattttgtgggaacactccagcagtccaactcgagcattatttaggacttgtttagtagagctccaactcttaaatttagctccaagagttgagtctggagtggagttgtggagcttcctaaacccatctccacctttctagttcattttgtgagagcactccacccagcttcgctcccattttaggtggagctggaactggttcattttgtgagagcactccacccagctccgctcttattttagatgaagctagaactgctggaactggttcattttgtgagagcactccacccagctccgctcttattttaggtggagctagaactgtttggctggactctagctcaggaaaggtggacttggagctagagctgtgacaaacagattctcagactctagctccagaaaactgtttgtttcgactctctggatgagatgagactctgctcctttgtctccggaattctcaatttcaaggcttgtttggacatccgagtgtcatcattgcaacagcgctcatattttctaaacaagcacagaaggttaccaaagagatactctctctgtcccaaaatagctctaggattgaatttagtttggaacagaccagtgcaccataaaacaaggtttcgatgccagtatgctccatcagtccatcatcgaacttccatccctcaagagttcccagaataaacattagcaatttaagatcacataaaagccaaatggcttcaaaatgtagactaaactacgatgggtaaagaaaactgggctcttctgacattttgcctaatcttgtgcataaactacataacattgcttaatctcgtacattaattacataaaagaaaatcaacagcaagcaaatcataaaccatacttcttcccccaattaacattaagtacataccagaatcatggctgtgttctccccccccccccctccaacccattttcccaacccacctctctcattttccgcgcacgattttcaaactgctaaatagtgtgatttatgcaaaagctttctatatgaatgctgttttagaaaatcatattaatccatttttcaaaaaaaaagttaatacttaattaatcatgcaataaaatgagcttcattttgcatgccaggagaaggggttcccaacccctcctaccgaacacagccatagccacatccaactccgtgtttttgagtttcagaaacaggctttactatttgttgtgcaatgtgatctaaagcaaaattcgtcacagaaggcaaagcccaataactaactgtaataaacgttctcaaatataaatgctctcaaatcaacaacagtgacagtcttactactgatttagactggaagtttggaagctaacattccggaaaagtttcagatcagtaaactcggctagtaacaatcttactgagtactgaactactgaccatgctaatgccactaagcagcacactacaggatttgaattcaatgccatgctaccataattctattcatcgcatggtcctcaacgatcggagtagtaatatactccctccgtttcgttttatttgacaccgttgactttttaacacatgtttgaccgttcgtcttattcaaaaacttttgtaaaat

SEQ ID NO: 1745 - DNA, 1498 bp, Oryza sativa
taaaacgaaacggagggagtactgatttgatcatattcagatcaacccatcaaaatgggccaacaaagcgcaacaatgatcccagacaaaacagatgtttatgaaaaaaaaaaaaaggttctctatacattgttcagtgtttctagtggttcacttaaccaagaaaatgtaccacagaacagaagaataccaggcaaccctcatgataacggcagattgactatcataacaacaaagaagagggggaaaaacagccacaatatcaacaaggcaatgtagagctttaaccagacaaacccaattagagcaaacaatttcataaacaaagttgctttagtgcaaaatatctgatacctgcattgcaatagtcgaaggatcacaaaattcaacagactaccacaggcgagagtgggcttgccacaatttgtaaagaaatcaggggttatctgttttttttttaactgccgagtacatacagtactgtagttttattgcagttcattaattaactgcataacaaggaaatcaacaaacaaatgataaaatggaagtacacattgccatctccctgcttccaatttttccgaaacagagtttagaatttgctgtgtgaccggaactaattcacatctttgtcgtggaaagcaaaagtgcaaaactaaataactgactgaagaaaatgtttaagtcaacaacgctaacagtcttacaaccttatcccaccatcgactggaagtttggaagcaagataacctcaaaatatttcagaccagagaactctgaggccagtgcgaaggtcacaaactgaacatgttaatcgcactaaagcataaaacacactacaggattccaattcagtgacaattagcataattccattcatcacatactccacaacgttcagacttcagactagtgatttagactaagactaacttcagacaaatcaatcaaaatgggcaaacaaaagctgcaacaaactggttatctgaaaaaacagggggtcttctgttctctttatatacattgttcggttcattattcctaagggcacatagatgcaatcctcgtgataagggcagaaacatgtcaatccaatgctaaaagaattatcatagcacaaaattggataaaacattcacagcatcaacaaagcaatgtagatttctaaatataagattcctgcattgcagtagttgaaggatcacaaaattcaacaaattgccacatattttgggcaagacaaatgcagcaattgttcgacaattcatctccatcagtggaaaatttatgggatccaataataccatgaagtgataataagatctaaaaggtaatgcaactgactaaagggaaagatgatgattcattcaccgagcgccgctgagaccaagcagcatctggctgctgtcgccggccgggatgtacgagacattgggggagcgcgcaagctccccggcgatctccttggcggcctcgatcctcctgagctcgatca

SEQ ID NO: 1746 - DNA, 42145 bp, Oryza sativa
atgtcggggcgcgcaagcaacccgaagggtgaggctgaccatctgcaggtccttggtcccaaaggtggaggaaaacctgtgcgggcgggtccggaatgtcgaagatgaagggcttctggagccaggggacgatgaagtgggtgccctccgacgaggtctccgggagcacgccgcggaaccggtagaagatcacggcgcgctgcccgccgtccaccgtgtacagcgccgtcgacgccgccgacgccgcgatgcccagcccggccgccgcctgcgccagcttcgtaagcagcgacgccgccgcttgcccgccgccggccatggatcccaatggatgggggttcgcctgcttttcccggtgggggattgtttgggaaaggggtttgggtttttttttggggggggggggggggggatttggttgatctggtggggtttggttttaaagccgtgcacgggtttccgcatttcttggaagggaagaagaacgaaacttccagtgcgtgggcgtcgatggttggcaggtggcagggcactcgcattgagattcgtgctcaggcctgatgggccgtgggcctcctccggtcgatgctttgtgacgtccaatttaagtccctcaagatatattccatccgttccaaaatataacaacttttttaccaacattctcttcccaaccaatcacaacatcctcctatttaattctacctactttattaacaacaatgtccaactctaaatcttcttttattatgtaacgggggtggtaagttattttacacgagttcttattgttaagtagctgagggatacaaatcattgaacattttcctcgagtgagaacctcgagcacttctatcgagactcacattcaagatcatgtttgtgtctacttcctccatcttaaaatacttatcattctaaataatttagtataggtcgtgtttgtagtctaccaccgaagaagaggactcgggttccaccagctgaggggttatagtagacggcgacgggacaataatggtgaatccgtgaatagggtggcagcaagcaagcaagaaaatgggagaggaaggtgaccggattctcgacccctctagctcaatcctccaaccgcgtgtcctcgtgcttgtaagttgtacctgtccatccccatacatgtacgggcttagcctggacgagggatgaagctctcaccttgcatttcgagttagtgtagctcggaaggctatgcgggtaaccaaattattaacgctattcgtttgcacttgtgcatgccaatcaggctttatgcaagtaaccagacacgtcttttagccttttcttagcaagagatggttggttagggagatggctaaactttgatcagctagggaagagctagctagcctgataaatccactgaacacttatttttaattacttggttagctatttttagagatggctagtctgatacgtacgtagtatctaggtaggggcctcttacaaatgaatattgtacttatctccaatttaagcaaccagaggaatatatatgcttgtattcgagtagagttctttcatagtagtagatgcttagttaggtaatagtagatgcttaacactaatattagaaaatgccccccacgtgaacgtctaaaatgggaaatgccccgtacgtgaaaacaacaaaacaactcatagttgattcatgctctcgagaaaacattctctcgttatttacatggtatctaaatagttatgaaaaaatatagaaaaaatcaaatagatagattaatatgcagtataacactctacaaatatgtagattaaaatttaacttttacaagttgtaaaaaaaattaaaactatgactagttaacgtatatccacaatattttttttgcaacttatagaagctaaatttgaccttacatatttgtggagtgatttatcatatattaatttattttattcatgtttttcttatttttttacaatcatttagataacttacaaacaacaagatttataacaactcttgtactccaccgaaacaagaacaatggtcccccacacgacagttccacacatatcgcacgcttccccttccctccgtcccttgagccatggcgcgcgtttaggctttgcaaagagccaaagccgcgcaaaaagcctacacagctcatccatgcagctgtgacgctgacgcagatcaaccaaccactactaccgcccgcaagctcacgcagctccagcactggcctcgtgttcgatcgatggacatggcggcctgcgtcgacgacgtcggcaagccgcgggcgtcgaggaaggtgtgcgtgatcggcgccgggatggccgggctggcggcggcgcgggagctgcggcgggaggggcaccccgtgacggtgctggagcaggccggcgacgtgggcgggcagtggctgtacgacgaccccggggccgacgacgacgacgaagacccgctcgccgccgccgccgccgccggaagccggtgagggtgcacaacagcatgtacgcctcgctccggctgctcggcccccgcgaggtcatgggattctccgacttccagttcgtgccggccaggaagagccgctgcggcggcggcgacaaccccggcggccgcgacccgcgccgcttcccggggcaccgcgaggtgtacctctacctcagggacttttaccgcggggcggggctcaccgactccgtcaggtttaacaccagggtggtgcgcgtcgccgtggcgccgccgccatgccgaggtggccccggcgacgcgctgagatgggtggtgagatccatggacgccggcctctgaaagcgatgcaccgatgaccagatgccggaggcgcactgcgtcgaggaggtgttcgacgccgtcgtcgtggccaccggccactactcgcaaccaaagctgcctagcatccaaggtgcgtagcgccgacgagcgaccaaatcagcaaacctgctcttgtctcaggcagaaatcgaaatgctaatctcgccggtaattaccctggtcgaaatctcttaattaatcaggaatgggggattggaaacggaggcagatgcacagccactggtaccgggtcccggactccttccgcgacgaggttaattaactaatttgctgccacggctgtgatttgtgactaatcacaaccacagtgcccgttaatcttggattaatcctggcgtgcgtgcaacgctgcaggtggtggtgctggtgggctgcggcgacagcggcatggacatcgcgctggacctcctcgccgtcgcgagggaggtgcacctctccgccaagtctgtggaggcggccgcgacgccggcgatgtccaagatgctggcgaggcacgccaacctccacctgcacccgcagatcgagcgcctgtgcgacgacggccgcgtggtgttcgccgacggcggcgggggcgtcgtcgccgccgacaccgtcatgtactgcaccgggtaccgctactcgttcccgttcctggacaccgaggggaaggtcgccgtcgacgacgacgacaaccgcatcgggcctctgttcgagcacacgttcccgccgtcgctcgcgccgtcgctgtcgttcgtcggcatcccgaggaaggtgatggtgccgtggttcttcgaggcgcaggggaggtggatcgccggcgtgctgtccggccggcgggcgctgccgtccgaggaggagatgacgcggtccgtggaggagttctaccgcgccagggagctcgccggcgtgcccaaggcgcacacccacgacgtcgagcctcacgtaagcacatcccatggcggtctaatctgttcacttcttgatcgaatatttgaatgatcgctcgttttggtggtcagaaaatgtatgagcttggggagaagtactgcgatttcccgcgcacggaggagtggaagagggagctgatggcgatcatcagccggaacacgagcgacgacatggagacgttccgcgaccgcgacgacgacagcgacaacgtccgcaggtgcctgcaggagtggtacgccctggctgagcaccaggctcaagacgaagaagacccagctgccgctgctgcacaagcacccgtgcacagctcgctctgaagcctgtacagctgtgtgttctgtgctctgcacaatcataattttcttctacagagcatgaaaatttctgaaataaaacagagcatgcagaaatttcgaaatttcgctgcatgatttgggtctctgcaaggccattgcccaatgatacggccgttggatgagatagtgtgtattcgtttggaataagtttacattaggttcctcatcttgaaagtcaagtttgaatcacgtccttcaatcgcaataacaatacataatgcgtctctcaacttcaaaatcaatacaaacgtggtctcaaggtggtttggacaattgtttagctgacgtggcgccaatgtgactggtttaacttagtcctcatcccacttgacgaaaaagtgacactagaaacacgattaataattttaaaattaagacaaaatatgtatggcttataagtcagtaaaaaaagataaacaatatagtggggcccatatcttctacctctctatatcgtcatgtctttatccttctctcctttgcaagcggacgtgctctcctatctagccgccaccttttgatccaactcgctgttcgtggtttcggctcccgcacttccacaacgtcattgtgcgctttgccccagtgcctcgttcttcttctccgcatcatcaccagtttgccacaactcgctggcacaaccatgcaatgcaaggattggattgagttggattggagagagaatggcaatgtatttgtccctcgcgccctcccacctctcttgccttatgacctccgccacggcgccatcgtcgcaacagtctcataccccgcgccctaacaacttcacctcaacgtacgttgataatcgctatagccagatttggcaaggtacgatatcgttttgcttacactgggggtgattggccttggtctatgtcgtctttttgctcattggctaattagttactttccgttgccttgtggtgatgccgtcgccgtatcctcgtgctgcccagcctcgctggccgccacattgttgaaaagacctggtcagactaccacgtggacatcacataagataaaactggtgttgaaaccgttaaaggactcgatttgtgccatttttaatagctgagtaacgttcaatatgcggttttttgcggttgagggatgtgaatgaaactcgatgtattgttgagggataaagtagacttatttctattcgttttcctcccggaaaccggccagctacatgggctaatacaactatacaagcccaccagacctgggcccatcacatacattacggtcccagatttgccacggtcacacgcacaacctgcccgcgccgcttttaccgcgcggtcgaccaaacgctgacctccagggtccacccccaattgggcaattcggcgccagctgggggaggggccctcacgtacgcacgcctactcacgcgcgggtggtagcctctctcgctgccacgttgggccccaccgttgataaagctggactccagtgtagtaccacccgctaccgccactgccagcgtgggccttcaccttgacccgagccaagcgaaaccaaccgcggtcaaagggtgggcccacagccgcctgtttttctatacctcccctgctgctggccgtccgatccgttctcatctcaaatttttgagccgtcggatgtagtaatggggccttcgcgtaaccaccgccgtagcggaatgggagcgaggcgaggggcgcgcgcacacacagcgcgaggcaactgaaacgaaacggcggaaaaaaaaatcagcccaacaaatccagacgttttacccggagggaccttgcatttcctcgtaattacaagttcgtatccgttggttggacctagtaataacgacttgacagtagcatgccatcctgtttctttcctctctttcgagtgttgaaatgggggatttaaatgggttgccatatacattgatgctaagtttagcatcttgacaacaaaggatagttcttatttagtacttcaaatttctttaaccctaaacgtgagccgtcaacagtcttttcattttctcactataataaaagaacatcacttgttaacagcgtgataatttatttttatcgtcctcgtttgatattatgaaaacttattttatttttccacgtaacacctgtatgtagattcttaagtattgtttgtaataaaatgcaacacacaaaaaactattaatctaaagctaataacatccttctcgtatcggtctcttttcggtttttttaattgtttggatccttctagaaattggcgcgtgttagactactttgtaaaaaactcctcaggtatatataaaatcttatataggctctctaccacctaacgtgtatatagtataggtaatagatacacccgcacaacaacgcttgttcattggagagcaatgaaatagtagcaagttagcaacgttgataacaatgttagctttttaagattcacatatagcagtgtcaccacatatgtgcctatcaattcatccgtctgtcatgaatgatagaaatgttatgagtacgatgacacattaaaacacagtcattcaactacacttctcttcatgaatcgtttacttgtagatggtggtacggcatatttctcttggttcataaaaaaaatgctacatcttatctaaatctaaagttatcattgcatttaaaccaacactttcaattacaggattttaaatctacgttataccgaaatctcaagcactacaactcataacgttcacagagctagcgacattatcgagcataagcgactaatagtgtttcttcatgacctaccacttctttatacgccaaagacaatatgtagtgaaggtggcgacgatggagccagacgatctcccgacctacctgagagctgtctccgccactacatatcacccaaccaacttccattgatacacacacaatatctgaacctgggtgattaatgatgtttttatatgacctaccaatttgtttatacaccgacgataatctgtagtgaagatgctagcgatggaacccgactggtcgcccgacctgctaaacatctgtcgatatatgcacgctgcacgctgcacgcaatatctccaaaccacagggtcctctccgcgacgcggagaaacattagggaagttgggcttccgctttccacttccgccctcccgagactcgaagccgcagcagcagcagcggaggaggaggaaaaaacggaaacgagccccccttcaccccaccccaagtccccaacggacgcgagtagtgaaaaagccaagagggaagacggttgagacaaccctccctccctccctcggcctccacccccattcgattcccccccttcccttctcttcttccctccccaaccgccactctcccccccaaatcccccacctctcctcgagaatggcggagtcgcaggtgagtggggtggaattcccaggcctccctcttccgttctactccgccgccgccgcgggtggtggtgtaatctggttttgggcgcgctgattgattgattgattgtggttgtgtggggggtttttgggtgggtgggtgggtgtttgtttgcaggtggaggggatgaggaaggcgtacgcggagatcatgctgaacatggcgcaggagtcggcggcgcgggtgctggcggcggagcggcgggcggcggcgctcgcggggggtttgtcgacggcgagggaggacggcgtccccgcgctcgtcaggctcaaggccatcatggaggccagggtacgccacgcccctcctcctccccttccgctccttaggtttttttttcgcttgctcctttcgttggttagttggttggttggttgggtgtttccttcgggtttggttgttcgtaggtgtggttgcgatttcggccccctttcggggattgcgagtttccgcgatttagggaggtttttgggtggtggtatttctcggaattctggtggatgcagattttgcgtttgaatgcggggatttggagttcgaattagagggggtttcgcggttccgtactctgcccaaatgttggttgggaaagctggtgctagtgctttttcatgcttctgcattttggtttatgcagtggtgttgattttgcacagccttcaaagtagaaattttcccttttcggtatctatttcggcagcctcgagggcaactaggctaggctcctttgagtgggtggtagaggggggaatggaagcacaagtttgtgtttgtgctctaactcaaattggtagattttgggttcctcagttccccaaagcatgcaaatagtaagattgttacaatgagttttgagacactagctttggtgataactgataataggtacataacgttcccattttaatgtagtgatgaatcacatttcacttctctctacttatttgtgcttttttcccctgtggtagggtgatgcatgctatttctatttgctgttatacattgaagtgtagtgaactatctagatggcactggtatttttgtgtgtggccaaatttttgagtcctgagagcaacaataggatactatatattttacatttttgtttataacctgctgataaaccatgctcctgcaaagagtgttataatacaaaaagaacactagtgcaatataggctaccatgttgtttatgcaattatgccaatttatggggtaatctcttagtacataataatataattccgatagctgattgaaatttaattgagcaattctctcaactttagtaaaccctcatttgtaaattacattaccatattttgttctcggttgatttctgcagtgcacaatttcttattgggaaatcatatgttgtagcgtcttgcctgaactttttactttttaagtcaatttttcattatccagtccatgtttaggtcatatatgtgtatatggtcaaggtttatgattgttccataattgttccaaccagtcattgtgaccttgatactttattgtattttaaaatgtagtccgtgtttactttgcgtacaaggcatcaaattgatagtgttattggccaagtctgtaccagacatggtctcctgctgctttttagtaccttcagtctattggtgcagttctgctaacaaataataactgtagagtttctttcagtttgtgtaaagcccagggtttttgttggatagcaatggcagaaagtctgccatctttacaaaagttagttaactgtgataagctaactgccctgttgagacctttatttgttatgatggttctaagaggaatgcttcaaagttattttaaatcttgtgatttgaggcaaatttggatatttgtaacaccactattgtgcctcatattggctagctatttgttaagacaacacatttgtgatatgtatattaattacaataactccatgttctgaagtagtggttcttctacctatattggagtacttacttagggtgagtgcagctgccccataggtactctttggccactctagactaaatgaactagattccattcatgaagttttcaaaaattaaatgtagttcacttagttgaactagagtgggtcaagaagtaatcgtgagttggtccttgctcatccgtactatactaatttgtatcattttcagtctttctaaactgttttctgtctgcctcgtgctgtgttcaacattgtgttgaagacaatagatgaaaagaatgcttatccgttaatgtacttgatctgtttgaatggtgaaatgttatacatgtggtggcgcttgtattttgtgatatattttaccatggcctgtgacctttgttccatttgttcggaacaacctttttcaattaaattatagtttttaaatctttttttggtaggtagaaccattgactatgtattagggctatccatattatttgggaaatgcaaatcatggttgtaaaattcattatggattctaggcctataacctggatgattgccgattcctgtaatctattctagtactggtggtaggcccagtcactgcgtataaacatatgcatatgggcatgtacgtgttaaagattagaggacaatcatcactctctgtttctgtaggccccttcttttaccagcaaacgtagcatgtctaaataaacttgatttgtttcccattaactaagcattaagggcctgtttggttggtgccctgaaggatatttgcctgaccagacgtaagcctgagaccagccgggaccttgtttggttggtgccctgaccttagtttctccttccctggcctgagctcttttggagcctcattagcctgagtcaggcgaccgttttcggtcgcctgagctccagggcggcgcagctacgctcattaatcctaattaccgcttataataatgtagtataggtactgtagattgtagaagcagccgaccatacaaatatattttatttgtgctttcaaggagggatacagcccatccaaatattttattttttttctaacactttataacaaccgtaataattaaaagcttaatcacgtttagttttcacaggcgcggaagaacaaccaaacagacaagtgttcaggctgcctgagcaggcaaaatttatcatcctatcaggtagctctcaggcacccaaatttttcaggcatgtaggtgtgggcatcaaccaaacaggccctaagtcataaaacagccttttgcctggttattgtggcccagtgttattaaatataaatgcatgtatactcaaatttgattggccggtctaagtctgtgattgcctggattgtcgcctgaaattttcttatctcaccattttaaaggcatacaaacgaatcataatatttaagagggatagactatggattcacaaataaaatgagaaacgcagtaaagcaacatcacagccaccggttaagcgtacaaggttgccaaaccttgtcaagaattgtaagcagttgatttacatggttaagcatgagcatatgcggataagcggcccacttacccggttaccccacatacaaggctgattaataggcccatgtatgactttcatttattaaaaggcccatgtacttctgtatgacttttattctttaaacctatgtttattgttcataaagaaagatgtgcctcgcatgttagactaaagaaatttaaaatctcttacacggccactttccgcataagatctacaaggtggggtgaccacactgcacagctcactgtcttagaacattgaagaaatttaaatagttaacctaaaaagaattgaatacacatggtatcatttgaaaaggtcaatgctgattacatatggtagaaatccttgtagtttattcaatggcatataagtacttacaaaaatcatttggtaaaaatctggtgattttgatcctcttttgtcctgcatcatatcctgccaaaaaaatcaagttgagttcccttgcagttatctgccatttataacatatcgctaatcattctttcgttgtttaatgtgtaagtaatcagggagagatggaaaagaccgccttccatttgaaactctctagatcttatatattttccagcaatctatgtcaaaagagcgtgatggattgggtcagtttgctgggccctagccaggtggactcgctaccgtgccaagggctgggcgtgctagttacaagggttccgtgcatgctctttattttatacccaaaaaattaaagacactgagaaggggctagggtaaaatgcgttggtcagcaggattcacatgctggcaacagctcatgccaatttgatttaaaaaaagttacttttttgtacataaagcagcttagttatttctcttttgaacttgctttgcaatcatttgttccaaatgtttacaactttaaatagatgtgtcctttctctcatgtggaactgatgcgtgtcaaaacttgtttgtacatgtgcagataaaagaagcagagtcacaatctttggcaaacattaataagattaaggaactacaagagcaattacatggtgctcaagatacagtggcctcccttcaaattgaactgcagagatcaaatactgaactggagcaagcaaggagcactttggctgaggaaagaagaaataaccttcgctcctgcaataagatcaattctaataaaaatagcagctcttcttctagaaagcatctacaaggcagagtatcctcaaagagtaaaaatacggcaaaggaaagtggagctgttgaaaacttggagacactgtaccgttgtgattctgatctgggttcattcatggctagaactaagaatcctgagctgtatcgcaatgggtgtacacaacgtatccgtgcaatcaagcagcgaagtccaaattcggatacatccctggtagaaaacagcaagcaaactagtgcactgaatagccgttctaagactggaaaaactgataccaacagaaacccacagagcacaaggtccatcatggaacagatacttcaaacaaaatttctggccaactgcaagagaaagagaggtaggcgaagcaggccaagttacatgcatgataattctggtgagcatgggcaaacagagtacaagtcgtctgatacatctgatggaaatgggtgtttgctgctacttcaggctcttgaacaagatctttcacctctaaaggcgtcttctggaagtgttggtgagggattagctgaccagaaggatgaattgctcaaggatgaaaaggatgctgacttgaatcttcaccctgcttcccctggaccaaatgatgtactttcagtaaacaacatgcagatgaaaaggaggaaaaggtctaagactatgagagtctttgaatctgattttgaggcaaaagctgcccctgaatttgggaacaccctgccaaaatcaagtaataataatagcatgctaaatagtgaacagagctctgatccacctgctggaaacaatggtcctgttttgcaatgtactgctgaaaacttgatgcacgtgactgatgctgcaaatgctgatcaattaaagtctgagaacagctccccgctagtccctcagtcaacagagagtgaaattggagatgaaggtaccatttagaaactttgtttttttaatttacaacatatgcctctgttattactttctgaatatgtattgagccctgagcatggttaatatgatgcaggtaactcgcgagtggatcacaaagagtgtagaacaccagataataatgcaatagtcttggaagaagtgaatgtggataaaagctgcattattttagcttcagatggagctgattcttcgatagtcagctccctggacaaagaagaaaatgcaaaagaagcaacttctggagttgccgtgcaagctgaaggtgccagatatatcaaatacacattcaatcgcaggaaacgcaaggccgcgcctttagacagcactcctcaaggggctgtccctgagaaaagcagtagtgtggtttgcccatctgagaatcatgagcctcatgcaaagcctgagacgcaagatctcgtcatagagtcacctccaggtgacaatcaactaatccatgttgcccagcaggtatgtgctcctctttacatttggcaccatgtgtgaacttgttcaacatctctgcactcgcttctgaaaaatattctcaccgtccaaaaccgtattgtttttcagctcatattgctgtcagcgcaaaaatgatgaaaattttgtgatacatcaaagcggaaagagggattggttcgaaagaataatgcttaagggacggctccaataagtggatcatggatcgtttgataatatgctaaatgcagttgagttcttcaacggagggggagagacttgtggtggtagcggcagagaaatcaagaaagctagcttcatagtgtagttatacctctacctaagaggtgttattatagtagtgtataaattaggcaggagttactatttattttgtagatgataaattttgaactattggtttaagaaggttataaattttgaagtggtactcagttattaagtcggttcaaattcagaggtgaaacatctgctcatgtaaagcaacttacttttctctagttttggggaaaattttggtcatttgatgggaatattcgcgcagatcgttgcacagtatgtgtgctacgttggaacagtacaagatgcgggggttcaatcaccaacgcgcgtgcattccatcagaagtactctgctactttatggccatacaattacaatcgatcttccgcgcctatgtaacatggggaggtgacgagttagtagcagtaaccgtagtttttttagtccatcacatttatgcatttacagtctatgaccgtattaatacttttgaaaggtatgttattcctcgaaatttcttcagtgtaggccagtatgctttatcagcccatacagatcggaaacagtacagttggacatcttaatacaactaaaatagttgaagtatctagatacagctatggcattataacctgaacccaaatgataaatggtatttcgtccgtttcactgtagttgccataattcctctttatagcgatcgcagagggtaaagctgaaatagccgactcgtaggtcgacttgagacgatatatatatatatatgcttagatcgttgatgcgtttgtcaatcgatcgcgttgtagcgagtgcgactgattgattgcactaatgaacaactccatccatggtgaaaaaaaaaaacaatttctaactttgaatctatacaccctctatattcaaatttatagtcaggaattgatttaattttttttaaggatggagggtgtgctcaagtacatatctttctgtgccgctagctgaaaagcagcctgaactgaaaacattcaccatatcatgcataacatcagagtcagacacatcaccatgctctagcctactcgatttacttcaacctaaacatgagatatacctccgggtcgtactttgattcaagatctgcagtcaagtacacttctacaatactcactccgttgaaagatacaaggcagggtttcacttatcgcatgataatcacacgattatcgcgggggtacggtaggagaaatcgacgatatggtttggatgaattttgaccaaattcaaaattccggaaaaaataaaaaaaaattgaaaaaaaatcatggatatggttcttgatttgtaattgtcaatggtgaagaatttttttgaaatagagtaagctatattcaaatttgagggcaaaaccgagaatagtttacaaattagaaaagggaagataatattgggccttaagtatcctacatattcttccaattattcttaatttctagttttctacacatattcaaccgtattttttatttttttcccctatttattttgtatttacataatttcagctacacagcccgcgataatcgtgcgaataccgtggttatcgcggtaaaccatgcgattatcgtggtgaaaccgcgaaaccaccgagttttgaattcgaatttttggatgtgatttttgtgtgattttagacgattatcacgcgattatcgtgtttatcgcgctaccgcagggtggtggttatctcggcccaaacgataaggtaaaccctgatacaaggtctatcagttttaaatagacttcaatactgaactttgacagttattttctttcaccatgtttcatcaatagtacaaaattaacatgataagaaagcatttatataaatataaatccaatggtatcacttgtgtcactaaacatattgtattgcctttttttttccaaatacataacacaccttctatttgattcaacaaatgaagtagccttgaaaagggcaggggaggtccttaactagtaaactctgacattgtgtgcaccacgatatcacattagagcacccttggtttcaatctgtaaatattaactgtaaatagatttgcataatttcactgtcctacaatatggaaagggaaagcataaatcttaaagcacaatttatgcacatggaagtacctaggttattctgttgatcatttgctacccaaaatttcagaaaagagggtaaattagctcaacagaagcaattgtgcatgagatacgcaaaggaatgtagtaccattcctatgtggtcacctaattagttaagtactcacaatgaaaagacaacaacttcatcatatgacggagataatttaagtagcaaatccagcccaacaaataatgaaccgtattttagagagaaatagaattttaaaacaaaaacgaaaatatcttgtaaaaacagcaatatcaaatcctttatcaatacatttatacactgtccaaagtggtaaacaaacatattttcttcataatccagaacaatatgaaacccaaagcgaagaaaaagaatgcaccatatgagaagtaaacaaacatctttaccaagaaaaaaaagtccattttacttccccgaactatttcgcctgaccacttagccccctaaacaatttttcagctcattaaaatggacctttttctttcaatgaaatgaacttttttctttcaacaaaggctgatcttacaatataacccatatgatcgatttaggaattcaaggtttatcaccgtggttacatgttaacccattcacccattcactttactaggattttcaacaaaggttgatcttacaatataacctatttgattgatttaggagttcaaggtttatcaccatgattgcatgtggcttactgctacctgatggtgcttgtgcattctatgaaagtaaaaactaaataccaagagggaaggagcaaggtaccatactcaattcgaatgactgagatttaattccttgggtagatatcttgaaaagatggagggaaagaattactgatgagcagcctgaaacatgagccaagcgatatctaatagaaaataatagcaaataacaaaacaagtaaatgttgcacgctggaacagaaaatgacctggaaagagatgcatttgtccctagataacatactactagctccgtcccaaaatacttgttgctttattatcaaaagtactttaagtatcacttatccttttttatatttgcactaatttttcaaataagaggaatggtcaaacgttacaagaaaaaagacaaagtgaccactaatttaggacggaggtagtactagataaatccaatttaagtacacccatagacaaaggcatgcataattcgtcaatgataagattacctattaagaaagaccagaaaaatgtaactagaaagtgcagaagattgaaagaaccataaagggtttacaagctaatacaacatagttactgagtagataatgtggattgtggagaacaaatagcagatttcacaagtcgacaacaaacaccctgtatagctattatttatagactcccacaccatgaataacaaagggtcctctcagcaacatattcaccatacacaaagcaaactcatcaaaagtcaacaaattactggggaactttctattacgattaaacagcctatgccgatattcacatttctttatatgaaaaggcaaacgtaggtaacataccaaacagtaccatgcatagagaagaactgtgatgattaactaggtcataaccctgccatcttagtatcttggacccatactacaagaacgggacagacgtaaattccccatctcacgttcacttccaaccgtttctccacctgaagaagctgagatgtactgcttcctgcaggcaggacagcgcccatctgcctcaagaattctcttgtggcagaacagacacagatgaaaaccgcaggggcaagggaggaagcttgaatctgttggatcaaggtcctcgtagcatatagggcaggatgtcggctttgaggggactcccttttgtgcagatcctatccccattgccacccaacagttacccatgctagctggaaagctgacttgtttggagaggctgggtaaactctgtggacggaatgcatcatctgggctccaagctcttgtactactcttgattggttcttgccttgttgctgcattagcgggcactggacaagatgcaggtacaactggtggatctgccggcactggatcctggtgattatggttgtcatccactgagagtgcatcggcaacagcttcccaatcatccaaaactccatcatcatcattctcggggctaccaccagtgtcatcgtcagaatcagtcacactccgagagctggaccaagcactgctgccgctgctgaagctacggccaccaccattgcccgagcagtgcttctgctgcaagcagccaataggagggttgtaggagacagggctgtgcaacggagactcatgatcactgctaccaacatcctggctagcgccaactgaatcctccttgaaatcctctggatccccttccctcgtccgaatctctgcacgccggcgagggagtggagggtgcggggatgcgaggatcggcgacccggagttggctcctgccgctgctccaggggataccacagccttcacctccttcccatccttcactagaccaatccaaacagaagatggatcagattctgagcaaatggccaaatgatcaactaatgattgaagctttctcaccccagatcccaaatcaagcaaaacacatcaaaatgggaccaaaagaccgaaacaaagattccaactttctcacccgacagcgcagaattcatcaaaagcatcgcctaaaaacccatcaaagcaaaaaaagaatagctctctttaggcagactccaccaatacaatgaaccgaatttgagggcaaattgaaacccaagatcccaatttccccccccccccccccccacccagatcacctgggccgacccaacaacatccaaaatcaaacatgattgggaaaacaaaaaaaaaaaacagattaggagcgcgagagatcagaccctgggaaagccactgctcccgccgcacgttgagcttgctctgcttcagcttcgccgaccgattcccctgcaaaaacagaaacacccaccaccaccaccaccacccaaaaaaaaaaatccccacggatcagcacccccatctcatccaatcgaaaacatccgaactcgaatcggagagaaccccccacccttatccgctttttcttcgcgtcgcgcgcggtcgacggtgaggacgcgtcgtgggccatggcgttgtatcccatcccctccccttcccttctcccttctttacacactgccgcagcacacacgcgctcgcaacctcgccgccgctggagccggaggaggaggaagaggaggaaggagaggaggagtaaaccctagcgcgagccgagacgaggcggaggaggaaagaggagcggaagctgcagctgatgaggataatacggcgtggagaaaaacgagtcgatgagctgacgcaaaaataaataataataataataaataataattaaaacaaaacgttttctgcttccgcacgacgagctggacgacgacgacggcggcggcaacgggagaaatgacggaaatgccctcctccgccgcggcggagcgcgaagcggtgtggggatgcatctgggccgtcggattgatacggtcggtgccaatacgtgtggccgggcagcatgccacgtcgtcagcattagtaagtgagagggaggatggatgtgctggggagaaaatagaagtgtttttgttttgtcccgtttagattctaacttttttttttcaaactttcaacttttccatcacatcaaaattttctacatacataaactttcaacttttttgtcacatcgttctaatttctttaaacttctaattttgatgtgaacaacacaatccttgttgaaggaaaaagattggaagtggttgcgtattctgtaggattttctatcacacttttcttttcaagagttgcagggttgacctacaggagatatgattagagtatttggtagtacgtcgaatgagttttatgcgtctcgaaatttaagtaaccattcaatgcaatgtcctaacataaaaaaaagggtgaatagccaaagtggttctccaagtttcatctgagactcagtttagtccttgatgtttcaatatatccatattagtccttcaagttttcactttagttcaaacttatccttgaaccaacaactctcttcataaatgacacttatacccctcatcattcacatgtataagagagaaattgcatgcttgaatttttttatagataatgcatagtatattatgtaaaacgaaaaaaattatgtactagcaagtgtatacaatagcaattgcttaagtttcatgtgcatatgttgaaataatgggaagtacatctgtaatattgtttattcaggttggctttctcttttctattctagtatatagatgtatacaaattaagggcaaaaatgacattttctaatagaaatattgactagaaatagccatatggcatattaagtggacccaaggatgatttcaaaccaaaacaaatatttgaaggatctatgtggacaaaatgaaacgtgaaggaccaaattgagccttcgctgaaacttgagggactaaattagctattcacccaaaaaaaacttaaaatatgccggacggatatgatttagtagtgcatgcgtaactgtgtagatataaatgaagatgcaatcctcactgacttatacaacgatagtggtatattcttaaaaaaaataaaagaagcattttcaatcctagcaaaaagaaaacgaaatttaagtagttattatagtgttattacattcttttataaactacattctgatacctatagcttctctaagaatcactctaaaactacattcttttataaacaaatgttttatggtctatttacgggagtttctgatacctatagcttctctaagaattacaaacttccataaacaaatccatttttctttgttgtacaaagaaaatgaacaagaagtcacaagctagttgcttaagttttaatttttttttcaccatctagattctcacgaggtgcttctcgtaatataaaactctacaaacaagcccttaagtaaaactacactcttctatagatctttgagagagagagagagtgtgtgtaattttatcacaatcaaatacatacattttccatgtacacttattatactatattcctcgtcataactatttggcgtgcatttagaattcacctaagattttataattaaccattaattttatattaaataagttataaatctaatacatttatgatattatgatagtacttttcaaaataattgtgcacatattgtttttatttttaaattaattatcaagaagttatcgaggataaatgtcctaaaagtttaaacatgccttgtcataaatgtactaaacaaagttttgaatctacaatttacaaccaactaaacctacaactcaacgtacaaacatgtcacgtcatcatccactagctataattgcatatcaaactcacaagcatgtaaaatcatcgacaatttattgagttctacaggtcatacatgtatatctaatcatcacccctcatatcattttcacaatatttcaatatatctattcattatttttacaatacttaacaaatatttatcaacatattctacatcaaagtgcgaggtactatttagtttgtttcataattagagcatgtttggtagagctcgtctggagtggagttgtggagctgcctaaatctaactccatctctctagtttattttgtgagagtgctccacctagctccgctcgtttaggtggagctaaaactgtttagttggactctaactccaaaaaggatggagctggagttgaagctatgccaaacaaaaatactaataaaaactgatcgtatttaacaaaccgatctccgacagttaaaaaaaagcgagctgttttagtgaaaaccgatcagttttattaacattgacaatgtgttttcatagaagtagttctgaaagcaaaattgaaagctctgggaaatttacaacacttttttttttcaaaatatcttcacttggcaaacattacctcagctcatctatctccattaacatttttcaggagattgaagctagcatcatatcatatcatacactgcactctgcacgaaaactgctacgcacactacctcaaaaacccaaacctctatactacgattgcacactaacattcgtacacactacacgtctacacatccatcccttctacggcctccttgaccacgacgaagtcgtccatctccttctcctcgccggcgccgccgtccttggcagcggcgggcgccaccaccacggcggccgtgccggcgggctgcttgtactcgtggcgcctcgcgaacacgaggaacacggcgaagttggccaccccgagcacggccagcatccagtagaagaggtccagcctgccggcgtcgaggtcgttccgtatccacgccccccgcgtggcggcgtcgacggcgaagacgaggaagctgctgaggaagaatcccatggacagcgtcaccaggaagagccccgtgctcatcgacttcatccgctccggcgcctcgcggatgaagaactccagctgcccgacgtacgcgaacgcctcgccggcgcccaccaggaagaactgcggcaccagccagaacgcgctgatcatgccgccgccgccgccgtcgttggcggcgtcgcgccgcttcttctcgacgagcgcggaggtggccatggcgacggtggcgaggacgaggcccgcgccgacgcgctggagcgaggtgaggccctgggggcggcgggtgaggcggcgggccgccggcacgaggacgcgctcgttgagggaggtgaagaggaggatggagaggaagaggaagacggagagggagcccgccgggatggcgaacccgccgggggcggcgcccgggcggaggtggcggtccatgcgggtggcctgctcgacggagaaggtggtcatctgggagtacaccgtccagaagaggatgcaggtcgaccagatgggcagcagcttcaccaccattttcacctcctccacctccgtcaccgtcgccgccggcgccgccgatgtctggttcgtcttcgccggcgacgctgccaggtccgcctccatgatggccgccctgtccaggcacctgcatggcaaaaacccagtcagcaacgtatgtacggatccaagtatctaacaagctaggtagcaagtaaaaaaaaattgacacgtgtgtacatatatatacgacagagatcatcagatgattttcagttgtgttcgtgttagcaaaacgcagatgccagatggatgtgaataagtgattttcagatggagatttaacaatagaatcgttcttttgataagtgtctctctcttcttcgatggtggccggattttatccattatacaaaaaaagatggatgtgaatgattgggcatcttttgtgatcaaaatgaagcgaattctttaaggatctgaacttctctagcaatgcacgtataggccggccggtgcaccaatctgactgtttcagatatgcatctcgagcctcagttaatgcaatttgtgttgtgtacacaacacatccctgtgtcaccaccccacatatgctcgcgggcacaatgtcaaatttattctttttatttgcatatatgaaatttggtttacatgcttattaagtgaatatatcatactaatacatcttgtattttttttatatatttttacttttaggtgacggaaataaacgacaaaaaatccacctctagactactgaattcacggctcgtcactctacttgtgatctgcttcgtccatcagccggccgcccaatttggtgaatgttatctctaattaattgggtgtctcacatactaattgggtgttctaatcaattcgatgtctcactcactttgaccactcattcatttcatctagtaccatgcatgatttgctcttgcgtgctgtgttagcaagagggcgaactgagttgtcgtcctcagcttcttctctatagctcgtgtccatctcagccttgacagtgacctaaccggtgaagccaattaagtaccgtgctaataatagattatagacttgtgatcgatagctagattaaccctcatgcctaggtagaagtacatactactagctagcaagctctaccagttcacatcctattggcaccagttgatactaaccatggaaaggctatgtggctagagctgaaaaaacggagtgttttgaaagctcagttctgccatgtattttcaaacgatacgatcgattgatagaatttaaatagcaagcaaatgttttggcaaaatcagcagccacaagaatccaatcctgaaatctgaaccctgatctcctatatgcaccggttgacagcagcagtattgtactatcagcagagcacatcgtgtcacgtaaactctgaagaaataacattcatccatgtctacttagcaatataatgcattttgcatcccaaccaaaacatgtttcttccagctatatattaatcaatcaacaaagctaggacagcaacgagttaactactaacggatgatgcctgatgacaaccacgagtgtatgatctgaagctaattttctatagtcgaggagatcatatatctaactgaactttgtatattattaggagaaaagagaaccacgtggcgattatacattctacggtttgagactgaggtggtattcttttcttctgaagatgaatattaagttttttttacgtaaaacgagatgatattaacatataattgattttgagttttaattatttcaaatttaaaaaataaattaatatgatattttaaagcaactttcatatagaaagttttcacacagaacacaccatttagcagtttgaaaaacgtgtcacgaaaatattaatctccattcaactcttgtgggagaaaagagcgggatctcccctcatgaaagattgtgcgttgattacctgaggcggtcggtgtaggcaaccttggatgtgtggtagccgtggagctcgccggcgtcggcggggagcggcaggcggcgctttctccacgccgttgccagcacccgcccgatcacggtgagcgggctcccctcggggcggcggtaccggtacttgggcgtgccggcgacgaggacggcgacggcgaggaccatggcgacggcggagacgccgtagccccagccccggccgacgttgtcctggacgtacaccagcacggtgaccgcgaagagggagccgaggctgatgcagaagtagaagcggttgaagaagaacaccatggcgcgctcctcccgcgggtcgccgccgtcgaactggtcggagccgaacccggacacgttcgccttgagcccccccgcgcccgccgcgaccgtgtacagcgccgcgtacagcatcgccagctgccccccgcgcgccggctcgcaccgcaggtgcgccccggcgccgcgcgcgtccgcgcacggcggcggccgcatccccggcaccatcgtgtccaccgtcagcaagctcaccccctgcatggcagcagatcgtagtgagattcctgcaccgcgcgaggatgatcgaagatgtgttgttctgtgtgtgcgagagcgagagcgtacggtggcggcgatggtggcggagatggcgatggtgaggtagcggccgagcttggcgtcggcgaggaagccgccgacgagggcgaggaggttgagggtgcccatgaagttggtgacgatgttggcggacttggcgttggagaggtgcaggtcgccgacgaggtacgtcaccaggttcatcgagatgcccatcacgcacacccgctccgccagctccgtccctgcaaattaacaaccaccgccgccgccatggcatgtcatctcgagctcaaatcaaccaaactttttcccacgatcgaactcgcgagtcgcgaccagcagtgaagacgacgcgtacctaggataagcccggcgccgagccatcccccggtcttggacttgtccaccgggttaccccggtagtcgacaaccatgccgtcgtcggcgccaccaccatgacctcctccggcagcaacctgcacaaacatacatccagcttaacaactcaatcaccaaaccaaaccaccaatgaaaacatgcatgcactgtcggtgtgtgcgtggtggtatatattttttttctagttacggctttataggcttacaggattgtaatcttgttatttttttcctgctctaatagaacttcgtataaaaaaaatacatgcatcctgctgcatgcacagatacagcacaagcaagcattgtttatgttaccattttcttctgctgctgagatgcactgtctaccgctgctgcaagcagatgagaagagaaggcagcaggcacaggatagtgaggagagaaaacgtttgtgcagtgaggatgaggaggccggcctgatcgatcggaggatttatagagtggaggcgtgcagaggtggagaggttttgatcgcgagattttctctcgcaacttttttccttttccgcttgttggtttcgggtaaggtgaggtggacgagatgattgctgcacgtacgtacgtacgtacgcacgctgcctgcccccgcctttggcgcggaaaggacaagtaggtgatgacctgctggcgagttgtgtcgtgtggagggtggcctggcaaaatctctgggtgagggggattttgggccacggattgcagggctgggatcctctgcatgtgcggccccggtgaattgaatggaggtgtttggtttccgtgtcttttattatctacagtaaattggattcatgtcattgcaaatatacttatttagatgaatactttataactcatctatttgtagccatgtcactatcatcacgtttttcatccatctatttttttttccgttttcttctgtcttcttcccttgagcgatggcgatgaggtggcaacacggagaagaagcacagtggtgttgtccttgccgcacgacttgcatgaccaccaggccgtggtggtggtgtcgtcattgggtactgcagcggcgtccgccttcatctcgaaacagtaggactgggcattgtcgggcacggcggtgggcagtgttgagctcaacttccttctcaccacaaccgtcgcgctgttgacgccacgtgcaccaacgcctggcactactgcttccaggcctgctctacaccaccacgtcgacctctgtattcgctccaccaagtggctcaccgacgtagcttctccagcctggcgtgcatccactcgttctccatccgcaccaccgcgtcaatctctgctctttgcaggcacaactccgacactagtgcatctcccaccgctgtagctgaggcgggcgaccaccctactcatcgacgtcatcgtcgactccaccagtgcagccgacacaaccagctttatcattctcgagatcgatagcagcaccgtaaacgataatgctattgttatagcaaccacctgctgccaagaacattgctcaaggaaaaaggacgggagaaagaaggaacaaaacagaaaagaaaaagaaaagatggatggaaaacgtgacggccatgatactattttttttataaaattttatgaaagggtatgtagcctagtggttacaagagcatttaacggtatcgcactttcagtggtaggcgatgtatacatcgacagacgagtcttgttaatgaattactgatgttggactgtttagctaggtgaattaatgcacagaaacagcatctattttgcttaagctggcttgtttacaaaaaccgagattaggagacggcgtcgcaactcggcacagccaccgcggggactccgtcgtcgccgtccgtcctacgtgtgcgcgcgcggcaggtgccgccccgcccagcggcccacacgtgcgccagccgcgtacggcaccccggccttcaccacccacgtgccagcctcgggttggccgagagaggcgccggacgacgtggacaggtccgtcctccgtcaagcagggagccgagccgaggactgcggagatggacagcccgtctgctgtatgtacgcgcgcgcaggcaggtccatgtggctgtggcctgtggcacgctgaaaatctcgccggtgaacgcgagcagccaaacagcccaaccaagtaaccaaactgcatgcggtgggtggcatatggctagggtgcgcagaaaaagatcgaaccaaaagactgaaccgaaaagaccgagaccgagaaattcggtcctaggtagtgaaagaccgaattttgttcggtcaattcggttagtctcatcggataaccaatagaccgaaaagaccaaattataaaaaaaagtctaaatgcaacctacaatctactatgtttaataggattaaactctaattttcacatccctacttcttctaggcatgcagcttaataggagtctttactcataagtgcttacgaatttttttaaagatttttatgttaaaaatttccattatttctttgcatatatgaaaatattgttgaatttcggtcaggactgagaccgaatttgtcggttctgacatttttgcgctgaaattcggtcttcactttttaaagaccgaagactgagaccgaaattttcagttagaccgaatgcccacccctgcatatggcacgcaggcgcagcgttctttttgtcgcgtgttgcatggctgaaatgtttttttttttctcatctgcgtggtgtgttttttttcctcttcggcgtagggttgaaaagtcaccggcacgcaggcatgtggaggcagagccgtataagcgtacaaccacatggtattttaatttctttcgaaaacgagccaccacatgatcttttgctcaaaaccggcaggggctctgctccgccgctgcgacgtgcgtgcgtatgccatcttcttttgtctcttctccttttgtggccgtgcacgcatcggcgcgcgtctctgtctccgtggcgagaacgcgtcttctgaaccgcacgatcgccggctaattccacgccgtgtactggtgtgtaactactcctacgtggtaatgcatgatgcaaactacagaacttcatttgttccaaaataaataaatttaatataaaatatgatacattctaataccataaattcagcatctgtaatactataccaatcttaatatcttatactccctccgtattttaatgtataacgtcgttgactttttgacaaacgtttgacatttcgtcttatttaaaaaatttatgtaattataatttattttattgtgacttgatttatcatcaaatgttctttaaacatgacataagtatttttatatttgtataaaatttttaaataagacgagtggtcaaacgttggttaaaaagtcaacggcgtcatacattaaaatatggaggcagtattaaatttgtttactttaatatgacttaatatagaagaaaaaactccactaggcatgattatgccatgtgtcacttgatgctgcctagtcgtgaccatttttgaaaggatccatttgtcgtattgaagtaggagcaactgaggaaggcacaacggcagattttttctgtctccttttttgctgatatttttgttctcataagcagcatatgcgagctttatgattaggcccggtcgattcacgataagtagataagaacacacaccaaaacatttatcttcattttattacaaagagacggcacagcagcacaacgcacaaagagatgaaacgatagctcgtggaacacttgtaagcaaaccgatcgaccgatcatcgatcgttagcactgcagcacggtcactcgtttataccttccaacatctcttgtcccaatctttatcacgatatctttgttttatgctttcccctttgggtcatcctaaaagaagaaaatatagatatggcctaatcatgatatgttcttgaatattctcaaaatggacacattaccccatctagaattctagatgatcaggtcggcacatgcctatggattaaagcatatgctttgattttggaatatgatatgcatggatgcttcaattaaccagcctatcacaggggtgaacagtagtggacgataaaaatgaaaaaacttcaccccagaacaaatagcaaagaaattccacttgattatttgactcacacaacctgattgaccgtccggatgtttattagttattactttctccgttctagaatataaaaaattttagagttggacacgaataaagtaggtagagttaaatgaaaaaagttgtgatggttgagaaatggatgtagatgaaaaaagtgaatagtggagggttatgattggttgggaagagaatattggtagagaagttattatattttaggataatttttaagtgttagaagttgttatattttgggacggagagagtacctctaatccttgattcttttaaccacgactacgatttcacaaaatgtcacacctaatgacctatcattagtttagctctgggttctttttttttttcttttcataaatattacaacacgacatcccatccaaacgatagctcatatatccttttttccctagctccctcttcctctcccactccctcctgcctttccccacttcctcctgccttttctcctcttatgcagggaggccgtcgaggaggacatcacctaatgtgggctcctcctcccgggtgcgttgtcgaaggtgattgaagggagaggccagtgaaagctactagatttggagcttggtcagcaacaatgtagtggtgatgacatcatgctccttgctagtattgtgtgcgggtacatcatgtagcgcagtagtgttaatgtcaaaatttgataagcccgaaatcatcattagcttagagtcaatattagctttagagtacaggaatcagccgatggaagtcgtcaagtcaccagtagttgtgttcttgatggagtcggatcaattaaaagaagcttatctagaagagtccgagttcaaggataatgcggcatggcaagttatctattaattaggaatagtttattagttttcttttatctttaagaaagtgtgtttagtgtctgataaggactttatgttttccttttatctttgggaaaatttatttcttgtcctacaaggaatattatctccccatgggtataaatatgtacacccggggtcattgtaatatatctctccatcaatacaactgctctcggcgcatcgccaccttctttaccgaggtttttacttatcatccgacggaacttggcacctgacgcggggctgcattggtttgcgatctccggcgaaggggtaagtcctacgttctgccggccctggtgaatctattgactacattagtgttgttcaaggctgcatcgcttcgatctcttggatcgctctggtttggttgatatatttgcttacctgatatctcaattctatctctaattgcattgtgtttagagacgcatcggtttagttggaactgtcttggttaggtctgatcttctgtcttagccgatatatctctacaatcacaatgctgttgtaaatagatttgttatatccatcacattagacagatctatcggctcatcgagtattagattatcatatacaatctcgtgatgcatcggttaggttcgacctactagattgttgttgataatataaatcttgttaagctgataggttcatgctaatgttttatcggggtgctagccgataagttatctggacgttgcatcggcttgtaaggattgcatgtatatataagttggatttagccgatcgcaacaaaggttttactgtttaatctaatcttgtggattttatgacatcagacatccagccgatgtatgctttaacctttggatcagtgcttattctactatatcatattgttagctgattggtttctactggattatattatcatcagccgattgcctttatatcattatctacattggacatatagccgatctctcaaaaccctatcgctatcggctggcatcggctatcagctggaattactccatcggcttgttagccgatcggctatttgattttcaatttatatcttgtcatttacagggtcaaactggctggcacgcccgcatctcatcaacctttggtcctgcactggagctaagcagatctcccaggccagtgtgtgtttttcgcgtcaacaagtagaggtcgggttgctcctttgtaggaagtaccaagtctaccagtggtggcggtggcggcaacagtgacaagagggcgaaagagagataagggcaactacacacgtcggttgtgctggtagttgccactgtcctcatcgtcggcaggttgcagttgtcgcttgcggggaggacggggaatgccaaattggcatggaggacaacagggaaggcgatgatgaacgacgacggcgaatgggaaggccatggcaagagatatgtaggagagagggggacggggagaaatccgttgtgggacccacaaatggttagccaaaatagcatggggctagtgcataagagagtttggctagtcgaatggcttatccgttcgattggtatggctgttaaagttgatcttaattgacatataaaatcgacccgccagatttttgtgggtgagctgaacccgaatatcagtggaatattaccttttgagccaacccatcccacctagtcataaccaaaaccaaacatctataaaaatataggtttgacccaacccgaccccttcaaccaaatacatgcaaacatatctatgtaaaattgttaatagtactttgggctccgaagaaatgaatggtgtaactattttttttttttacgaaagagtaactaaaaagttattagtaatacatcgaacaagagacatgctctaaattaacctagaaactaaggctgtgtttagttcagcgtaaagtttggattttagttgaaattagaaatgatatgactgaaaaattatgtgtgtgacaggttaatgtgatggaaaatgactgaagttttggatctaaacacaacctaatttaaaacctgctaaaacttgcgagaagcaaacagagtccaaacctgccccaactgtcagactgtcagtccaacacccccattcccgctcctccggtgatctcccagatccaccaccgcgacggcagcgtcggcgcctaccgcgcaacgcaagcaatggccggccgcgcccgcccgcagccgcagccgcagccgcactcgccgtcggcctccacgcggcggcgcgagcggtggctggtcgtcctcggcgtcgccctccacgccgtctacatgctcagcatcttcgacatctacttcaagtcccccatcgtccacggcatggcccccgagccgccccgcttctccgctccccccgccaagcgcctcgtcctcctcgtcggtgcgtcccccctctactcatccccgacgattgtgaccccccgatttggttgcgatgtttgattttggtgaggattttttggttgcgtgcgtgcagcggacgggctcagggcggacaagttcttcgagccggacgagcgggggaggtacagggcgccgtttctgcgcggggtgatcgaggagaagggcaggtggggggtcagccacgcgcggccgccaacggagtccaggccaggccacgtcgccatcatcgccggcttctatgaagaccccagtgctgtcaccaaaggtgtgccatcccatctcagctctaattctggccatttcttcatgttcaatgcaaactaggatgtcagttggtaagaattcaaatgtaggggttattactagcttgttcatgtcatagctggtagacacagatatggtggtccaaactccaaactatttaggaaaaccatcaaacatggtatcttcggtgctagctagactgctacagtaagttcagtaggactagaatgcaatgcggtggcatggtactcagagaagtttcagctctagttctagcgtgccgctactggttatttttcatgtttgatgcaactaggatgtcagtcggtaagaattcaaatatatgggttactacctagttcatatcataaatggtatacatagattatggtggtccaaaccatagaggaaaaaacaccaaagatggtatctgcagtgctagctagactgctagagcaagttcagtaggactagaatgcagtccggtggcatggtgctcagagtagccgaaacctttaattggctctgatttagcgaatccttgttagtagctatgcttcttctagaaaagttaaatataatttgcttataggttaacttctattttgcagtattgtacttagcggctgattttcttagcctttttctgtggtgttcagagaaaaaggctaagaaaataatcattcccttaccagttacatattcattttttctttgaatttctaaatattctggtaaagttcaattaaacttgctgtaactgaactttaccataatatttacaaccattcccgctgatacctgtggtcagtgtacaactatagtattagtgctactagttttccgctgacatggcatgtcaaaactcatgtactggtatttgttcagttgtagaaactgtgagcattgttctacccattgatatcctaggttatcttgtgctggctgtggcctgtgggctactttacttgagatttattaaggacctattttgtgttgaaaatttgggatacacggtccgttcagacataatttagaaattgatgatatgttttaagagaatcatgttttaattccatatcaaatgtctgtaatgttcacaaaattttcttattacttttttgcaggatggaaggccaatcctgttgagtttgattctgtattcaatcaaagtagacacattatctcgtttggcagtccagatattgttcccatattctgcagcagcctacctcacagtacctggggtacttatccccatgaatatgaagactttgcgacaggtcagatttaatgcagtacatttaggttgctgaattatatatttttttatttccattcggtttttgtgatttccagagaatcatcttctgtttttattgacataattagaaattttttgtacctactcattacttgtaagttgtaacacacaccttttcggagtattccaatgactctaaaagtttatcggcagacttaatgatgataatgtgtaataaatggaaaaagggctctatagctcttctcttagttttggttagagttttttttttaaaaaaaatgaaaactcacaactattattgatgaatccagcaagcttttgtacaagtcatgggtccaaacttgtaaaaattcacaagaagggatttacacgtccaccagaaaaataacaagggatttacctgtccacaagaaaaataaaagtatttttaccaaacatcgcagagtatgaagcatcaaggctctaccttttgaatttggtttgctttggaaccttgtgtttacttgttctgagaccttgattgcagatgcatcattcctggatcattggtcatttgaccagtttcaaggtcttctcaacaggtcttttgaggatgctaaattgagacaattgctcctacaggataaattggtcatatttctgcacttactgggttgtgatactaacggccatgcacatcgaccctattcaaacatctatcttaacaacgttaaggttgtagatcaaatagctgaaagtatgtacaatctcatggaaagctacttcaacgataaccagactgcttacgtgtttacagcggatcatggaatgagtgacaaaggtacgcatactcacaatggtttcatcaattaatttcaatgacccagccttatatggtttgacaattcatgacatgagatctaaatactttctaatgcacttatttttgttgaactttccctgagacagcctcatcagaatggtgactgtcttttacctgctactaatagcaatgccttattcttttcatattaggttacaccatgttatacattatttatgatgtcaatataactcaaagttctactgataggaagccatggagatggacacccatcaaacactgatactcctcttgtagcgtggggggctggaattagaagcccaaagttcttggcctatacagacaaacctgatgatggctttcggtttgttgatgaccacaaacatgatatgcccacaccacaggattgggccctcgaaggatttgaaagagtggatgttaaccaggctgatatatctcctctaatggtttaaaattttccctaggcaaacatattatcatttttccttcagcataattgcttttatcctcaattgtttacaaaaactgcaggctacacttgtgggtctgccatgcccgctgaattctgttggaagcttacctacgcattatttgaaattaagcaaggtcagataataaacactgaaatattatgaaaaaaaatatgtttatgcttccgttgttttctgctcttttggattttctgtttatttccccattatttctgttcaggctgacgaagttgaagcggttctagccaacacaaagcaaattcttaatcagtttcttcgaaagtcacgtatcctttcagaacatgatttaaattttgcttactccaattgtctaaggtccttggatattcttttcttgatggtctcctgctgtcctgctgaagtgagttattgatgagactatataattattaatctgctgttgaagcccacagtttactagctgtgagcctgtgaatatcatgtcaattactttctatatttttatgcaacattatactgcctccgaaatggatatggtggatcatattcatactcgtgaacatgttttccctaacctgtctcagagatgaaacaatcaagttcactctacttcaagccttttaagccactggcaaactattctttagtccttgatcaaattgaagatcttatatctgcaaaggactatgaaaatgccatgaagcattctgaagaactccgaagtatggctcttgctggtctccattattttcaaacatatgactggttcatgttgatgacaacaattacccttggatatattggatggatggtgaacctcattctacatgtgctacagtcttatacatcatttcctgctaatcttcaaaaaaggactcaagtgtatgctaagaacacctctgtgaaagtaagatagccaacctacctgaccttcagttcttcacttaatgagtttatgtctaaaattgatgtgttatgcatgtatttttatgttgctatcttttccagattactcaatctggagtgtagtcaacattttttttccaacttcagtatgtttgtttctatccatttttccaagaaccttttctttaaaaaatatatcagaatttaggttctgttaaacttcttattgtatttaagaggtttgctgctgtctagagctacaggcatttggtagaactctgtgcacagtataggcttgatactagttcattgttgtgaactgttcaaagttgctgttcgatattgcagaattttattggtgtgtgtttcttattaatcctgatgtgtttttcttacactattttggtctatctcatctctcctggttgcaggtatacatagttggatgcttcattatgggtttttcatccattatactacttttagagaaatctccacttctttatcatgcttatttatttatgacaatattcctttggacaagaattgttcaaaattttgaattcatcaaggcagtatggagagaattatctaatatgccattcaagtacaccatgaatcttctgaacatttcagtcattgcgctgttcatattggagtttctggtatgtaccttttgttattggcacccgaagcgtttgaggactacctagatttggcatgaatttcgatgctttctgtgcaggttatgagcttctttgataggaagctttatacttggtgctttttgatccttgggatacttgcttcatcttgtgttgcaatatttatacaagctagctctgcacttgcagtctatgtgtggctttcatgctggttcctatctttattcacattgatgccagctgaaattccagaaaacaacaacttggtgtatgcttctttggccgacaaccccccacccccttccttttttttttccattttgtcaatattagttgcgtgttcattctgtcatataaaattctcttttctagagttaatgcagctggtagcccttattttttttataattattacgagcgtttggttgaaactttggtctgatgaatttttatatgcagaatttttagtggggccttgataatactgactgcaatggcatcgagatggatggccacaaataataacaacttttggctatatcttactcgagcaaataaacgggatcctcaattctctaagctattttttgttcaggtgaaaaatgcaggcaattctttcttgatgttggtatttgttttgtggaagtaatattttggaacaatgttgactgctgttacaatgctttaggttgtatttgttgcgatatcttctataatggtgtggatatcgacctcgcaccggtctcagaacaaacagctgcacccattgcaccagatgatcaactggttaatagctggtaagtgatgatcaactgcaccctctcatctctgctgctaatttctccaatgtttccctggttgacttgtccatgtcccttttcagtttttcagggccatatctgatatgttaacttacaagtgaaaatggctctttaacagataatcttctctagtagttcaatttcctaacatgcgtgcacattgcgccaagcttgaatatggtttgttcagagcattgacaactataaatattccctcagattacatagcattgttgtaacagaagtacctctgattccaaactaagccgttctagatttatcaattctttcccaaatataagacatccaagaacctcaaggcagttttcactcctttttttccccttctttgccctagctaaataatcgttattattctcatcaataaacgatacaccttttccaatgtggtataaatggaaggcaacagtcatttaatttcttaatcttatgcacatgtcttggaattaaaagggagcgcaaacttatttatgcatcaacgatccatttaatcaggataattatatcacagaattgagaacttccccagacgatgttcagtaaccaccttctttcagggtaacagcaggggagagtcataccaatatacacggtacacagaaagaagcaaaacttaatttatcccaacctattggaagttgccgtgaccttagtcagagtcattttatcttctaaaaagtatatatcagttaacaaagattttttcatctaaataaagttatctggcagcttaaatatgaattgatttgtctgaaatcacaggccaactttactctttagttaatgttatggcctggtctattgctcttgctaaaattctaagagttttggttgtactgattttgtgctttaactgattatgttttgacaggttttgctatggtgctaccacttttttcaccatcaagtgttctatctcgccttacatctatcttcttgggatttgctcctccatttctattgctctctattgggtatgctgttaacttctcttatagtgtccacatatatcaagttctggttgccgtaatgttcatatattcatatatcatcaaatcttgacatctgcagctatgaagcggttttctatagtgcttttgcaatggtacttatgggatggatatttgtggaatctgccaacttgtattgctcagaacaaaatggttctgcacgccgtagtagcattgtggagggctcaattttcggctatgatgaaagatgcttacaactatctgatctacgaatccctctgttatttgtaagatgacattctctttcccttgttatattgtgggttgctatgatttatgtaaaatactcaatacattctgtatcttaccgcctttgcagacgatcttatttaatgttgcgttctttggaactgggaattttgcgagtattgcaagctttgaaatttcatctgtgtaccggttcattacaatatttagtgtaagtgtttgtgtcttatgatttcctctttctctataatattaggttttcttttctattattctattactgatcgtctttcatcctctttccttggcagccgttcctgatggcagcacttcttatcttcaaattgttcattccatttatgcttgtcatgtaagttttctcagtgtttactatgatattggaccatcctgcggtgcagtggcggaggcaagatttttgtcatgggtgtacaaaaccgattaaatactccataaaaacatgaattttttttagcaaaaaatatgaaaaagtagttctacatgtgatatgatgagctgaaaattgttgtttctagtgaaaagacaggtatttagccaaaattatattatgtatacccaacaaaaatatcatagttttgacttgaagtaaaggaacttgggtgtacatctgtacactcatgaccctatacagcctccggccctgttgcggtgaatggctgataaaataagttgatacgttgaacatattttgtacttctgtacatccgcttcacaaaatataacgttgaatcattttttgttgcaaaataggtgatgttttaagattcaaaaataagaaaagaatacatacttttagcgaaactaaaaaatgtatccacactctacgtttgtttgttttgtgcgcgataagctatctgaagaacaatatttagagtttggagaagattaattgttgtagcgacaacatatatatttgcctttattccttcatcatgcttttgttccgcagttcataatataccgtgtttgattttaccttcgttttgatatcctaatgggatttaatataagatgcgtaatcttcaaattagttattagtggactgtttaagattgttttagagttcctttttattccttactctgaactctgaagcataatagtaaaggaaaacataaacaaagatgagccaccagattagatgcaatttgtgattaagctgattcatatgttgcgacttattgcagatgtacatttagtgccataaccaaggttgtacgtataccacggctgggctgttatttccttgtaatactgctgtctgatgtaatgacgattcatttctttttcctggtatgtgttcttttcccctgtgtactttgaattatcctttatagtactttgtgctgtagctcttgcttgtacagaaaattgtaagccaaatgttcttcattttacccacaggttcgaaatacggggagttggatggaaattggcaatagcatcagccatttcggaatcgtgagtgcccaagtagtttttgtgttgctgcttttcgccctcacaaatatattcacaaaagatattgaggtctcatctcggcaactaagctcaaggaaagttatgtaattgttccatttgtttggagatcgacattatactttcagttttgttagagtttaacttttgggcgtggtttcgatttttctgcccaagttttgtaacttagctagtagatggtgaactttgtattagatggttccagttatcatcttctttacatgtaagagcattaggagcatagaaaattttctcgtcgagaatttagttcaggtttgtcttcatgggctcacggttaccgtagtcgtcaacacgcatttttttcctccgatatatttcacggctcgctcagtttgtaaacatgcagtagtgtagtgttgggaagacaagcacagattggcctcctgcattgattcaaaatttccaaatggtaattgctgtaacttgagtga

SEQ ID NO: 1747 - DNA, 3754 bp, Oryza sativa
tgtggttagaggaaataggggctatgaatgcagtaaatacatgatcggttttttaatctcctgtccattaaaaattcgagctctgattagactgtcgccatggatggcatcgaaatcaagttgttgtaatatgatgatcattgcgaattcgaggtgaaaccgtacgttctcttgtttcgttcgttgcgttggcgttgcacatgcattcacgcatgtatcgtaggacatgcattggctgacgcattcacgcataaatcgcagtaaaaacagacattgtttgtcacatttatgccttgaaataagtctattttacctccctcatctcttgccccctgtttgaattgtctccctcaattgcaaaaccggatataacgtttcccccatcttacaaaactagttgaattgtctccctcaattacaaatccggatataacgtttcccccattttacaaaacttgtgtaaattaaccctttaggtaatttggaaagtagtttttctgacgtgtcgaacccacatgtcatagactctcctcttccctctctctctcttcctctctcttctctttttatctctctcgtcggccaccggtggaaggaggacgcgggagctcggggaggccgtggtggtggcatcccagctccgtcctcgttctctgagacgggggactcgacaaggtcgtggcggagcaggagctcgtggaagctgcggtggcaagagaggacgcacgagctcaaggaagggggagcggatcatcgatcgcgaggtcgcggccgccgcagacgaaccccgtgttcgcggcgttggcgccgctgctcgcgtcgaccacgccgagctcacactaccgtagcgtcgccttctgtgcgagcggctcgtgcacgtgaagcgtcgcgccgaagcatactgtgcctacccccgttccgccgccggagtccatgacgaccccgtcgctcttgttcgcgtctcgcttgaccaatgcgacgcacgcgcgctgggctgctcctcgatgcgctccccctcaatcgaaaggggtcacgaaccttgcgatcctagctgcggccaatcgaaagggtgcgacgagaaatcccggtgactcctctcgcatggtctcgattacgacgaactgcggattattggcgagcaaagaactgaacccatggcaacaaatttggtcaagccaaacgagaaaaatcttttgctgctaatgggcaggggcggatccagaacaagatttaagggggactcatctccttcttccttcttcagtccccctactcttcattttcttcctattttttccctttcatctccacttctatcaatggtgatccagcggggtaggggggactcgagtccccctagcacccacgctgaatcctcccctgctaatgcggtaagattcctttcgagagaatccactcagcaccactgagtttttgttcttggcgagagcgagaagggggaagggacacaaaatattagaatgactgccatgtggagttgttaatttttatttttttctcacggacaggtatgggtcccatgagcaccacttaggataaaaccatttctgaaatcaccgaaagagacgatttacaccagattttaaagatgagaaaatattatatccgattttacagttgagggggccattcaacctgggcaagaagtaagggatgtcaaatagacttatttcttatgcctaacagggcctcaaggagcccatcgatcaagctctaagccttgtttgtattacataacatatatctcttctagattctactcgaaatgaatacgtactccctccgtttctaaaaaacaaacctaatacgagatgtacatctagtactataaatctagatagatttatagtattagaatgtatatcatattttatactagattttcttttatacgacggagagagtacaagttacacacttgaccattgtttggttgaggccttgagagaccatggcaacatttgccaatcttgtggccaccaactttgttgctactccctccacgtacaaatatatatacaacactattgacatggtctttaatatactactttaacaaataatatctataaaataaattattttaagaataaagagttacatatttaatagtaaaaatattcttacgaaattaatctatgtttccttttttttcaccgatagtaaaacttgaaaaatgtttaactctacactgttccaaaagtccttataactagacatagggagggaacgttcgataaaaaacaaatctagggccggatgtgacatattctagtacaatgaatctagacagatgtatatctagattcgtagtactagtatgtgtcacatccagtattatgttgttttttatgggacagagtgagtatgcaatatgcccaattgaacatcgctatcctagtttaggctttaatgagatttattgtagagggctaaatagttccactttctctgtccgaaaagtatgctactagaagggaaatgctacaagatgtacggtatccggttaagactagatgatacctcagaggcatcgcctaatacctgatagatgtcagctgataccccgttcgaacgggatggtacctctgaggtattgtctggtacctaataggtatcggatgatacccaggtatagaagatacctctgaggtatcatcccgtctgaacgtaataccattatgtactagaattgaactcgatcaaacaccaaacaactctcaatgacaaatcatcaatttttcccccaatctatctcactaccttcggagttcagacacataaattttctgaattttcatgtaaatcagttcaatcttcacacaacaaaaaatcatacatttaaaaggatgcatgaccactatactacccgtatcagtatggcatgcacatccaaacaaacgggccctagcatccacatacgttagcctaattaacggcctaacagtacgacacgtttgacctgttgaacgattagtttactacgactgtgtcagctgtgtctcaacaagtagcgtgtatacctaacaagttcacttcacgtacggcgccgaacattcttccagctacatatattcaaagttgcagcgttgctttgcaggccagggcaggatttagaattaattaggcaatgcaaagttcttagaaaaaagtacgcattcagctggagccgatcgatgaaacgatccatcgatgggattccaacaaagcatatgcacgccggacaaatttgtactgaccttcctatacgggacattgtgtacatgtgttattccaagagtattctcgagcactcttgagtctaatacttgccattttgttttctctgaatacctttacgtctgatgactgacggccagctgcatatatgtacctatacagcatgcacatatcttagttcttcgatctgcaccctctgttctgtttacacacaggaaaaacgctagctacgcaacaattgcaaatatcttggttctttttccaaagactcgcacgagacggtgcgaagttttattgatagagcaggaaaaaattacaagattacaaccctagagggtcgtaaccaggcgaaaggaaaaaaatccaccacccacataccgacatcgccaacacacaagcccaggagaaggttagcaccggaccgaccgccgctaagcgtgaccgacctccactaaaccaacaaagggacacagatgagatcgtcccctaggggatgccaaaacaacgtcttcaa

SEQ ID NO: 1748 - DNA, 24427 bp, Oryza sativa
  unsure (1)..(24427): unsure at all n locations
tgagacagcaacaacgccctcaggaggggaaatgaaccatcattgtcggtccggccaaggccggactgggttttcacccgccgctcaccacctgcgaatgcacggctgacgcaccgatgctccaccaccacacaagctctgccaacatgtgggacccctgcaccggcatcccctgccggccagccttcgtgtgtccaagaccgcgccacccactggcagctcctcctcacacctaggtcgcctcctccactgccggccgtgcctctcgcgccaagccagcctccatctccgccgcccgcgcctctcgcatcgagccggcctccgttgccatcggctgcgcctctctgtgccaagccgatctccgacttgattgacaaagcaagagtggtgaccttgcagattgcacggctagcacattacaaaatttctcatacataatagatatacttacacattttattgtgaaaggaaaatactaaaagatgacaatataactttaaactctggtccaacttgatcatatatatattttatgcctgatgttccaattaacatgtaatttatttattccctatgtttatttattcatgtttaacatgcattattcattaatatatttaatctatattcagattataacattcaacaaattttatgaaatttgcatggcaattcaattgctaattttcatattaaagattcagctatattctccattgaatggtatcggtatggactcttttgttcaaatttgtaatgtttgcaatttttttataccaattcttagtgttttagacattttctatgaacttctcagtggaatcaattaatgttttattttttcaatttatagttaaaataactctaatatttttacatggactatacttttggtattttaattgtaacttcagatatttatataaaaactgtcaatgcaaaatttacattttctttcatatttatttatttatttatctatttattttgtttctaatgttggtgattttaatttggaattcatattgaaataaaattgatggctttattttttaattttgaattgcaattagtaccatattgtgttgtacattgacttttcttttttcttttaatttaactttatttgattatcatatattttaaattgtatttctttatgaactctttgctttaatctatactgccataatttagacccacaatttaatcatcggcttaatattcttcctttacctcaaatgctgttgtgtttttatgctgaattgtttaataccaacataaccacactatcttatcacaaatctgaaatctccagctccaatgcatctcgagatgacctgttgacacatgattaatttggaagcttcacgatcaggttggtgagatatataacacactatccaaagttcccctgttgcgtttcaagccggtcgatatgatgcagcgcaaacgacgacagagacgcacctaattaagccaaagccccaaaaatcaagataacgcctttagattgctttatgcgatgccatacggatcgatgcatgcacaaaacagcagctaagcatactgtttgccagtacacacatgtagctttatagtacttgtgtagctatacttaatttggagagatgggatctgccttgatctagcatatgcttagagcttaaggatatgaacattatgtatatatacatgtatccatacaggcgtacatggtatagatgcatgtaaagtagtaaaactgtatctagctggttaattaagctgtcactgaattttacatatgtccttggcaagctctagctgacagatggaggaaaagcatacaggtatatatgcacgcagcatcagagcaaattaaaagggggattatatatttgatgatcgacggtgtgatctgatctgatgagatgtacgttcctcgttctttccagtggctgagatgcgttccccagaaagactatcactagaaaattagtttaaagataagactacattaattattgctccttatattccttaatagtttgctcattatttgtatattaatgcttcttcttcttcctggtggcttcgtggctcaagggaagggtggcgggagagtatttcttttcggcctactcagctgctgcctgcagcacacagatcgatcgccggtttgccagctactttggaggcagaaaaaaaatgcattaatcattatgtacgcgtacagagcctgatactggaaaaggaggctgatcacccttgatcagtactgatcaccgctgaacaaactaatcaatctagcttctgttccgcttaaatgccttaatcagtacttatatataagtagagtgattttaggtgtataatttgatatctctttataccattcggtactaatagataccaaaattcgtattaaaaattttgagaaattttactatcattgggaggtaataagaggccggtactaatttttttttatactaacattggtaccttttaaaattagaggtagcgagaggtatcaaattttacactaaaatgttgtaccttccagtcgaggtattgtaataaatcacttaaaaaatttagtacctcttagtattaaaaattataaaatttctcatataaattaattccatggctgatctaatctagacatatgacagtataatagtatatactcccttcgtacatcccgaaaaaagccaatattgtatgtccagattcgttgtattacgatgtgtcacatcctagtacgagattatatgtctgccctaaattaataagggatagattacgtgtacccgtctgttaatgttataaataagtcatacccaataatcttgggttagtctctgcgggacccaccatatacccagttctatacggaatcatacattatatacggaagatattttggataaggaaggggaagtaaagttctactcgggcactataaggactactcggatcatattcatactttgtctctctagttctatttggacaagggggcacctgagggtataaatacatgaccccctagaaggagatgagagatggcaagccagaagatagatctagaacaaatctacacaagccaatacagatttagagaatccaagacaagccaacatatatacaccagaacaagcctagacaaatccaatctgaagctacaaaggcaaacatgagggatctagagctacctccaatctcaccgagttcacattcgaagaaaaagactacactagctgttggctgcatgtaagggtgcaatgccgctatgctaacaaggattggattaagtcatccaattattgtactaatgagatattgatatataaaggtaactctggatttggctaatatgagtagggctattacttgtcagttaagggggccgaaactatatataaattcttgcctattgtctcttttaccctaatatcgcgtacaccctgataccgacgaacaccataccctacaaataccgtagtcacgatatagcctatcgacatcgtcaaaattgttacttccttcatcttaaaatataaacttttagttatctaaacaactatatatctaaatttataactaaaagttgcttataatattataggacggcagtaatactaccaacaaaagcacccatgcgctagtctatgactagggatcatcggttggcctaataagccaaagccaaatttaaattttttatcttaattttgaagctaattttaagatatttttaattttttatattggtatttaaattttatatataaattaatttttattttttaataaaccgttttgatttattagaaaatgtggacaaccggccgtagaaccccgtggtatgtcgcttcgtccagaactatccagacctcccatatgcatgatcatggagctagttaaacgcatacacagaatacaaaaagaagcgacacacactacgtacataattaaattggatttacgaatccaccaggggccgcaaaacggaaggttcgaagctaggcagcgcgcctaactatttatggttgcaatttgcaacatagtttatccttaactttaatcctacattgtaaaagagctgtcctacgtgcatggtggcatctataaaatgttcgacattttgtgtaaagaaattgagaagtggaagtggcgatcgaatttggataccccactttgatctcttctcatatcattggacaacggtatgtacgtacaccgatcatatcgaaccactgcacaaaacagaatggaagctcgatcgaggctgcagtgctccccaaaatactcgacaacttgggccaccagtaaattatcacatgcttaatttaagaataatatatattggttatgtccctaaaaagacttgacttacaccattaattggttgatactccctccattctaaattgatctacatatagttttttttaggttatttctaaatgatctactgtacatatttgtgttcatttattaaatatattcgttatttgtgcattggagtaaatggacattgatgcatgcatccatgcacacaagtatttataatccacatgcaatatcttgatttgctattggctaggaaatagtggggatgttgcatgcatcgagtttgttgctagggtaaatatagtattagagagttattagtttttcttggtcttggtgtaccttacaaaatatgtaaatcaatttagaaaattatgtagatcaatttagaatggaggaagtaaattacaagcgaggagaaaaaaatgcatgcatgggtgctccttgttaataagaaagtagtgttatcaagtgattacaaggtatgtgaggggtgttgaaagaataaaacttcttgctttatgactcgagagtaggtaaaaggacaagtgataacaaggtatgtgaggggtgttgaaaggataaaacttcttgctctatgactcgagagtaggtaaaaggacaaaatgaactatttttgacaaattttaaacgtaagaaaatttgaggatattcataatttattggtcttgaaaaaagaatctaacctattcttgtttaaatgtaaaatatttaggcaaattttgctatgcggttcaaagtttgggtaatttgctgatggatatcgaaaaacgtgtcacggttggagaacacccaaaaactggtaatttgctaaagaattaatatttttgtcaaattggagagagaaattcttttagaaaaagagagaatgcccctggggccataagtttcgaacctaactgagatgcagctctcaatttgccttcaccccaactacatattgctaatatatatcatattttatttttattccagcgtcaggttagaaacttgtacctctagagatactttttttaaaagaatttctctcttcaattggaccgaaacttttctctaacaagttattagttttctgggttctctagccgtgacatgtttttgcggtatccaacaacaaattacacaaaaatttgtatgtcatgtattacaatttgctaaatatttatgactggagcaacttatgtaaaatggtactactcgagactgtaggattgttcaaggaaggctaaacgagaccaacttgcagtaacccttaaatcaagtgcttccttagcagctgcatgcctgcatgtaaggtacagattcaaagggtaacctaattaagttaactaaagcagattgttaaattgaattttgaccccctttgccttttcaaaggaagagcattccacttttgtgttaattaggagagagcatgcacgcagctagcacgcagctgcaagctaaactatagtacaactttttacactgcatgttatgtacctaattaaactgcaaattaagcttatttcatgctatgtttaactgcaagttgcgaaatgcaaacaaagccagcccagtacacggtaccacacacagcttaattagcaacgcacatgagatgatgagatattcttttcttggatatttttcatatgccctttctgcatagtgctctccaaagctctctttgagagtgagagagatagtgatgtatatatgctgccaatgatcatcatcgatcatcgattcatcctgcaattcaattaagcatcagttgaatcaagctgtgcagcagcaaggacggcccagagagagatagccagtgagagagagagagagagagagagagagagatcagttcatccatgcatgctttgcctagcttttttccaagttcttttttctccttggtctctagcttagctatagcctagcttagcgaaaactaaagcagaggactggaaaccgcgctgccctgcccttttccgccatagctaatctagctatcgccggtttcgtcatcaataatcttctctgcctcttcctctctaatccaatagagagaattaaacatacatgcattcgctttagcatcttgccccttttcttaattggcatcgtttttcgcgcgctcgcgatcgatctggtccgtccaatacctgcctcctccctaccccgatccccctgccgcgtatacgtacgcgtgctccttaattttttttagagccctagcttaattaatcagcttagctagcttgcatccaccatagtacatgtacagttccatccatcagcctctataaattgggggtttgtgctccaagccgagcacctcagcctcagctcaccttgtgattagcatagccactgcagatatcgaatattgcattaagctagctagcttaattggcatcataagcagcagaagaagaagagaagagaagagaggaagctagaagatataggagaggaagaggggatgggagggaagtcgtcgttcctgtgcccgatcttcagcttcctgtcgtgcaagtcgaggaggtacgaggacgacgacgacgacggcgagctgagcggcgagtggccggcgaggtacgggagcaaggtgaggtcgagcgacgaggactacggcgcgtggtgggtcggcgagcgcgacgtcgaccgcaaggcctccgactacatcaacagcttccaccagaggaagcaggtcgccgccgcctagctagctcgatctacacatctcgatctccaaccacacccacagctcaacgataccaatctttcattggatcgagggggactagcgtacgcgcgacggcgacggcggacgacggccgccggcgcggccatatatatgtactgcatctgttgtctcaaccggccatttgtgtaccgcaccgcatgtacgtacgtaggtctccgtttacataattaaattcttctcatatatgtatatgttaaattgttatgtatgtttgttgtggattattatgttatatatgtttatttagaccacgaataattgtaatgccggttcacagatcgagatcttgccatgtgtatatgtatgtggagcatgtgaactcttttaatcctactgtcctatggtactttgcatatcgtttaaatagttatatttttttaacaaaataataagataagtagtatgtgatacatctcactatatatataaaatatagggttaaattaatttgacttatataagttgaaaaatcaaatatgactatgagcatatgtatactagattgacttaaatttattatttttgtcacatgtgagcatatgtacaacttatatagagattgaattttaacatgcatataatttcgccttttattaattcgttgcaattttcagaaaggagctagctatgatatacctccaacttttttaataatagaatagaaatctcaaacgactctacatcatatatatgacacacagccgacttcggccccgtatacctaaaattaagaaacacaaacaagaatgtggaaattaattaagcagcaacacatattaattatatataagtaattctcaaaaatatatatataaagataataaacatattttagcatcacacttttgcatgcatggaccatctttaatggaaaatatttatgaatttgatgtttctagatcatatcggagtgtatgtcatgcagactagaaatacctgttttaattttccatgttttttttttacgatggacctgctgccttctgatctcccttatatatttactgctccctccgttccaaaatataagcatttttaacatagtaacaagttaaacatttttaactttgactattaatagaaaaaaataaaaaacatcaatcatgtaaaattgatgttactagatttatcattgaacaactattaaaatatgtaactatttttatttaaaacatcttactttgatagatattgttggtcaaaatagcatttcgaagaccgtatcagagtaaaaaatgcttatatttttagatgaagggaatatgtgtttttgtccgctctgtgttattgtactgactgatactactaatcattagttcgatcatattgttaaaagggagtcaatatataccaccaatacttcagtcactcatgtcagtccgatccgatcgacttgaatagtgtctttttcgagatatacgtagctttaacatagctatatatcttcttttctaaccatccatatatatcagtgatgctaaatagccgaatccctcaaaaaagcctcaaccagaagacactctttaatttgtactcccctttgactccaaatactatatatgaatatatcattttagagctgtacatagaaaataagagaactgttaaaatgatcttgttgtcatatacagttatcgtatacttgaaaggatacttcatttatatatttctaatttctatactactaaaaaataatagtgatgatggtgattcgccaacaccactactacttttgcaattttacaagaaaaaaaatcacctatgacatattattatatattttatttaattaccaatagtaaagcatgggcattttgctagatttttaaaacactccattgatatatgagagtggtacgtagcatttaattaacaagagtatgaaagaatattatactaccttcgtactcacaaggatgttttgaacatttgacacaatctcgaatttacgtggttaattactttctcaaactatatgtctataagaaaactaaaaataaaactacatgacacaatctttcatgacaaatatgttgaaaatctaatcataattcagtatattttaattcagaaaattattatactaaacatgacataaaagtaatagatgattcaatgatagtgctaataatattaatatcatcatagtaacatgtttaacactaaaataaaaagggtgcgtaatgtacagaagaataatctgaatccagagacggtggtgttggtgtagtcgccccagtggtcattgccgccattgtctctgtttccggtactaatcaacatggtccggaggttgatgcagaggaagtagagatggctcggtgtagatgaagtagcgtcagtttgacgcagagcagtcgcatgaaggatgcgctccccaaaaatttaatcaccacctgcccttgcaggtactctggtggatggagttaagacctgctcgtccgaatacttgtgtgcgcaagtgctcaggatcggggagaacctaagtgcagcttagaaccatatgaatggaggtgtctaacggaggagagccaaaatcaagggagatagaatccacgcctcgcccggctcggtgcgcgttcccaccaccattttaaccgctcaacagacgctctcaattagcatcatacttttaatttgatacactactaattagaaaggtctagaaaattctgaaagacattttaagctgcaaatagcctttgcaaagctagccgcaaatgcatggggagcgtctcctccggttgattccgcggcatcgtcacgcgcagacacgtacggcaaagcgggagcgaacctgccagaaagctctgtagctatgcatgaagagaccaaagcggtgggtagtttccatgcatcgctttggtgagcaacggcctgcacatagcgcccagaaggaagctaggctagcctcaaaagccgcgatgctatcactttctgcctcgggcgattcattaattaattgctctccccgtttgaaaatatacctcggtgacatttcctaaaatttatattcgttgtacatgaaaatatcttagtttttttttattttttttaatgagagaagtaagtagtactgtacccatctcaatataaatgtaatctaatatgacccagttcttttctccaacaagagttgaatgaagattaaaattttggtggcacgtttttcaaactgctaaacggtccgtttcgtatgaaaactttctatataaaagttgctctaaaatatcatattaatctatttttaaaatttgtaataattaaaactcaatcaatcatacgttaataccacctcgttttgcgtaaaaaaacttaatcttcatcttcatctccatcttctggagattcaaacaccacctatatatgtgatatatctcaacatagggttgttcatcgacggtttttagcggtttggtcagaaaaggcaaaccaacccagaaatactagtaccggtttatacggtttgttttgaacggttttgacaggttaaaccgggattaagcagaagaacagcaacacaaccatggatgtccttccaagctcaacagcgggcgattgcaccatggctcttagcctttccatgcgatggaggcaggcaggcaggaagccagcggcggcggcgagctagcgattgtttcctccttggatgggagccgccgtttggctgcctcggcatcctcgccggcatcggcgccgccggcaccaacgtctacggggttgttcacttacgtgcgtgctaaatagccgatgcttgcttggtttcctcgatcacgcagatgccttcgccatggcgtcttgctgccgcggaagctatcaggtaatggcagcgcaggtcctgaaggacgagacatggccgggttcaatgggttaagctggtcccaaaccagcccgtgaataaatggaaaaacggtttgggttggtttggtttcacgggttgaacggtttgagcccaaaccgtgaacaggctgatctgaacacatatcgcacgttcttttctcctgaagatgaagatgaaatgaaaatgaggatttaagttttttacgcaaaacgatgtggtattaacgtatgattgattgagttttaattttcacaaacttgaaaaatagattaatatgatattatagagcaactttcatatagaaagtttttttacacgaaacacaccatttagtagtttgaaaagcgtgtaatcttcatctaactttggttggagataaagaaaggaccatatactgcacacggacgtacacagtccaaaatcttgctgagaatgctgctcctctcctgtacacttgtcatgtcgtaggtgtaggggaagaaataccgggtgaatatggcccagctgcccgcggtgccgtggtggggggcatgtgggcgagacggtgtgtggcccggtggtggtgggcgcgcggtgcgtgaccggccggccatcagcggagctaggctggcaggctgcctgcctgtgcctctggctcgcttgctttccatcgccgcgcgcgtgagctagcggcgtgtcgatcgatcgatcgtccatgggaagattgaatttgcgctgctccctagctacccttccgacgtcacggtcgtggattccctctccgagaccatatttctcgggggaatcttggcctcttggggttaggagtagtcccctactccgagcaaatatcggccagctttgctttcgcgatttgggtgaaaggagagagagggagagatgcagcggcgcgcacacaggttcatcgattctccatctgcttttctgcacaagcttacaacgttagcgcctcccttcggaggtaggcccgtccggaaatcgcgagacgtttttttcagcttagttatcgaattatgaactattattgttaccacggttctcaaactacaatttctctgtcaaaattttctgcaacagcgttgcttatataacctgttctaaactacccctattattctaaactagaaatgtagctcacacattctcacggacaccttattgaaattgtcataattttttgctattggcattttgaccattatgatattgtattattttgaatatttttttgataattttaatatttgtattaaaattattttgaataatttggataatatttgaatattatatatttttaataatattgtaaacgtgcgcacagtcatctttatgaacgcacaacatgcacattgtaccctcttaataatctgttagacatttttctagacaaacgaagtctactttctttttagagatgacgaagaagatagtagataattaaaggatgctacctccattctaaaataagttaatctagaagagaataatgtgacacatactactgctatgaagaagctatgtggctgcttgaaatccttttggagaagattaatggacttttagtatatacgtgacagtttgggagtgttttgagaaagccacgtgataacataagagcgttttgaggaagtttaaagtacttttagtatataaaatagatattgacgatatttctcttagttcatatcgacttctctctaagttaataatatttgtcgttttatataaggacagtctccaagaaacaacaaatggtcactattttataatatatatatataaatatcaataatttattgaagtatttttttaagacttatctataaatatggtttccatatttctaagataaatattttagatgttataaagatcttaaaatttgacaatagtcttattcaaatcagagtattatcgaccagagggagtagctcgtgtgctttactatacaaatccatgtggcttcattcttcacataagactggttacaatatggaacctgggaagtgaaataattatcgcttcacacttcacgattcgcagttcatctcgcaagatgcaaactgcacctcccagcatacaaagtgatcgtgggcagctgtaatgtagtttaatactgatagaacgatagtaatagtacacaatttcatataatggtcatatggtatacgtatcttacacaaatgaccaagaaagggttttagtatatgtagactgcatttctggaattatatactacattttcgctactggtacacctttcggtacatttcaatctctacaagaactgagaagtcaaagaatatcttctgtgatgatcagccagagggaaggttcggagtgcgacctctcgtgcatacaatgcatcaacacacaaatatcctaccgggacagaggaaatgattgctcggctctgtagcgaattcgcatgaacaataatactcatatccaaacaatctgcacatgttccctcatccaggaaaagaattcatcataagctgagatattggcgttcctagcatcatgagaagatagaaaccagatggttcagcaatcaatcttcatgctcgtcttcaccttcagagtctgcacataaagcagaacagttttagatggtagcaaactcaaaataattttcaactcacaatggtggttggagtaatgcatgttataagcagactttgtcttgtcccaatgcagatgggactgaaaataagaccatgcaattttgcatgctcatcctgtgcaaaaacaagattctaagggggcagagcttaccagatcgaacatcatctccaacatttcttgtcttgatttgtctcacaagcatccgatatatcagaacccaccaatatatgtgaagaacaagtagtgaaaataggagagaattgaacacatagtaatatataggaccatcaaaattgtgcttcttcttgtccaaggtcaacaagacttcatagctgaagcaatcgggacttagtcagctcatgtaacttctaataaataaggaatgaaaacaccattttgttacatgctgggacaatgggacagcaagatactattgtacatagtattctagtctgctatcacacatatattttgtacaatataagtatgattatcatggcatagaaaggatcggaaataaaatccaaaattaatttcagcatgcggtggcatgatctagataagtttgttttcaagaggcataagatactgtgctatgttcaaaggtctttttcctactggatacaattactgttttctaactgaattacttgttggcttgggtttcttttctccccttaaaatgaaggcattggcaagaacagcagaattcaccatccaaagttcatatggtacaaatttcgcatagtaaataatatgcttgcttttgacaattcacaacatctatagtacttaaaatgttagaagtggtggtgtccatccccacaccacccctaccactaacatctgaaccccacaactattacaccacctttcaacaagtcatcccccatttcactattggctcccctaaatttcaaaatcacttgttcaataagaaaaatcatagtattacttagaacaaataagtgcttattgattgatttaataagctaaaaactcaatttgttttccattgcaatgcacgggttctaggctagttttcaaaaaaacttctttctcacaaaattctggctgacttttctaggcatatctcaacaaggtcagtacatcacatttaccttgtacttctgagaatccagaacggaaaatatgtgagacggagaagaacccatgaaacgacgaaaagaagaaatgcaacattggcaagcaaatcacaatggctatatttggccattttccctacttccaggaacacatcacttgcatcatgaattgccaatactactgagccaactctagcaaacctggttcatgaagaaaaatttcagaaataaattagttaagtgttaataaaaatgagtgaaataaactcagtgaagataaaatattaaggccctgtgctactaactcatagagtaatgcttgaatcaaggtaaaaaaagttcatattcaagaaacaacaaaaattaaaagttagacaaaaagagacctgaacacataagataaaactatcagcgcaacagttgcaacatgatgtgacattgacacgccaaaatctgaacgccttgtttcccaaaacataagtgcaaatatggaatatgtgtagaatccagcagcatacatatagacagccttaagtttccatctgtagataaggggaaaattgttagatatacaccagcctgagaactagtaagaacatgaagcaataaaggaccaattcgtattactttatcttttggtcaggccaaacctggtcaccaggtccaacccagaaatatttagtgtttgtgaaccaaggctcattatatgtaactgacaaagataaaatctctccagataggaaatagacacatttccaagctgattccttaaattttcttatcttctttcttgtttcctccttctcataatcaaccttttcctttccaaatataagttttcttccaatccactgaaacgaaaataaaagaaaaacaatgaaagtgtcaacattaagctttagaattacattaacaattgaaaatgttaattatttaaagtaaaaatatctatgatacaacgtggagcctgagagaatctattagaactatacaggaacaagagtaattttctggtgggttcggaatacagaattaaagtagctgttgtgctcaacctttcaccaatcatgtatttaagaagcataaattactttagaatcataataaccctcatagtgaagcaaatgatctcatctagcaaacaaaaaaaatgtctcaaacaaatacagaacaaatggtaaccagatggccatgtgccataattgcagtaccctgtgatgtctgtatattgtagtcatgcatctgtctaaataattttcttgtgaaaaaagctatatgtaatcaacttaggtatcgcactccaacctagactttgagttagtaaatgttcataaagaaggcatcattgtgtgcttgtgcttaagtccatccatattagaagtgaaagaactctccctcactagtgtcttagttctccgtcctgatgacttgtaatgatcagaattaccttttaaataacataatggtatgtaacataaagatgaatagcatgctaacatatacctcaacatacatatcaagattatctaaaaaaaatctcaagaaaacatcacgacacaaatgttttcctggttacagatagcccagtggaaaggtatactactcatacaataaatgtggcggttgcaactattcttactgcaatgagatggttgcaatttgcaaatttataaccgcgaggtatttctagtttttgagggatataaattacattaaccttgctcaagatgctcacacgagagaaatactgctctctttatgccagaaaccactcagatctactcgtggtctgttgctgcactgagctgctgacaacctcaaattcgcagcacatcgctgccttatgccactgataaacagtaaattgtatagtcgtgtgataggttatgagagatatcaactcaacttgcaatccatttctctgctcgcaaaacccttctccttgcatgaacttttaccttaataaacttgtgttcaggctggcccagtaagtccgtcattgttcgcctcgaaaaatacattatatatgtattttcttaatggaagacaaactaacccagggaatcatatatggatcttgatagctaaatcactaaattcttattgtttaagatgttgaaactgtataccattattgttatagttgatgcgcctatgcctcagagatcacactattcatcaccaaagaacaaaccttaaatcttaaaccattatactccctgactaaccactgcagcgcaacacaacaggggcccctccgtaacaaaaaatcagattcagagtaccagataatcattagacaagagaagaggacgactctccaatacagcaatgccatgatgtaccagcacatctctcctgagaatccgagcgtttgatctctccccccacaattccaggaaacgcgaaacgcatgccaagctagcccgacaagcaatcattaaaacgctaaaaagctagcagcgcctttgtttccccccacacacataaactaaacccagctagctagctatccaacgcgatcggattggttggtgattcctccaacgcgaaatccagcccggagaagaagaagggaaaacacacacacaccagcaaaacaaaagcttcgctgctttccgcacccaacaggtcaacagtaacagattcacctcgaagacgaagcagtcgaggaggtagcggacgacgaggaagaagacggcgaacaaggggagcgcgaagaagtcgcggtacgccgggtaggcctcccgctcccagtccaccgccgccaggagccggcccgccgccgccgcgacccccatccgccgccggaggccgaatcgagtaggagcaagaaatcgatctctcctccgccgcgccggccgcgaagctggatgaagaaggatcgagaggggaggggaggcgaccccggttggggccggggtggattccgattggacttccctcctctgttcctcttcgccctctgactcagccgacgcctctgttttaccactacgagtctactactactccccacttgtttatttttattttatatttttcctttttttattattagtctcgcagtggttgcacggagtggtacaatagaaagcgcgtaatgaaccgtgttttataaggggtgtctagatagggctaaaactttttagcccatgttacatcggatgtttggacgctaatttggagtattaaatatagactaataaaaaaactaatttcataaatgagagctaatccgcgagacgaattttttaagcctaattaatctataattataaaaagtttactgtagcatcacattgtcaaaatcatgacataattagactcaaaagattcgtctcgtgaattagtccaaggatatggaatatgttttataattaatgtatgtttaatactccaaattagtattcaaacatctggtgtgacatggacttggaataagtccgtggaaaccaaacaggcccctaatcccaggaagctgggaattgtattgcatctaccgttgaaaagaagagatgggaattgtagccaggttgacttttcaaccatttttgacattttttttttgacttggtgtactatgattaataatccgaaaatggttatgataacttgtttagcgagttttgtgggttttttatcctatgggtaggattcatcgagattcaaaaataattgtatatttcttgtgtgtttgtaaataatcaataggtgaattatttgtaacttattcatacagctgaatataaatgttatcatacaaaggaaatgcatttggagaaaaaataagatcagaaaaatattagaccacaaggcaatgtcggtgttttttttttggtgtaaccttaacatgtatcccataaataattgatcattgttaaagcaattctcacaattctatagataggatttggtcacaagatagacccacatgagataaaaaaatgctttggctctgattaatgaggtgaatgcgagaggaaaataatgatttctttttcttgtggtagaccttaagcataagcataaggtataccataaggtaatactactttccacaatgtatatgactcactttataacttcaatcgttattttaaggttatcttttcatacattgtggttgtcctaagggtttataattattgttccttaacagcactgatacatcttttgttagagatattcttaaaagattcattttaaaagtattcctacaaagttagtttaacttctaaatcatgaatattgcacatctaggaattgtgagtgtattaatctactatataacaagatttagatcatagtgcccataagcatgactatgtgtagagtattggttaatacattcacccgaagttatacttctattgtaaaaaaaattaaagtactcaagtacaaaagtcaataagtgcatcacatatgaggattacgatgtaaatagaacattgcaaaagaacaatacatgatgtgtgagaatatatagtcgttttcccccttaagtatgttattttaagtttctaaaataaagtatttaaagatataacttgtacagtaaagtttccccttatgctatagtaattttttttcttatgttttgtaggcataggaactgttcgagtgttgaactattgtctttatactcaattctaagtagtagagagtcatatcaatccaaaataataaaggtctcgactaaagacgcacaagaataaaagagttaaaccttagcacatcttgatattgtcccttttagttagaggcttagagctatatcgtcaacatgatcaccatttgtttatggtcttagcaatgttgaagatggaggagcttgagttgtatggagtggttgctccttctactatgatgtgacaaggctaccgacatcaagttagatcaaccctaataacccatggataatatagatcaacctagaaagcgatgtttatctatggattagttttggttccactaaaaagttaagtttagttttggttccactcaaaagtttaagttcagtatgaaacctaccaggcatggatgcaagtaaatcaaaccataaattcacttaatagattaatcaagtggattgaccctgtaaattacccatctatttagtccaagttgatggatcaacccatctctaaccctattataaccagaattaaatttgaaaatacattgttcgttcaattttttctcaggaatattcgggatacaaatttttttgcagaaatataccgtcggtttcgcacaaccgttgcgtgaaaatgacgtggaatgacgtcgcggacggtattgcgcaaagaaaatgtgagaccgtgcggtctcgcgtagcgacgcgacgcgagaccgcgcggtctcgcggattataagtgcgacactgttcggtctcgctcaagcaaggagcgataccggtgccattatgatttaattagcgattaattatcctaattagtgattaattaattattaattaattgctaactaggataattaatcactaattattactagttgattgttaattgattaattaattactaatcaaatggagatattggacaatttcgctgtttgatttcacgagagcgtttggtctcgctctttcattccgcgagaccgcgcggtctcgcgttatctcgtactttcatcgtgcgataccgtccacgacgtcaccatgttattttcgcgtaacggttgtacgatatcgataatatatttctgcaaaaaaaattgtataacgaatatttctgaggaaaaattgaatgaacattatatttggcatggacgatttgagatattttgattgggccgatctctagcccatatatacgtgtaggccggaaatctgaaaattctgtccacgtgggcccagaaaccttatcccctcacattaaaaattgcttaaaaatttcgaacactacacctgccgtctcctcctattcactccacccacctcgccggaatgctcgccgtcgtcttctcctccggtcaccgcctcctccccctccccgtcctccccggcacattcaccacccctcctcctcctcctcctcctcctctcctatcccctcgccgtcctctgctcgcccctcgccggcgccgctgcctatgcggcggcggcggtggcggcctcctcctccttcgcgccgtcgccgcgaggcgcgcgggcatcgtgatcgacgtcgacgaggtgggcgaggtcggcgaccgcgacctccccgtggacgtgtcgttcacccggaggctgccgccggtgctcaccctcggggacggcctcgccgcgctgcggcgggccggggaggaggtgaaggcctgcccgcctgccgccgccgcgagcggcgtcatccggttcgaggtgagccgcccagcgaggctgtgtgggaggggatatgtcgtgttttacagatttgcagttggtttcgttgtgagcagccgctgcaatatttgctgcgcggcggcgaggcgacatgctcccccccctcccttacgaattttaatccagcactgtgaaattattgaataatccactcagctccttgacgcaataggcgtaaatcgagctcgcgtctagctcattgtttatgctttgcgatgcatttggatttgtttatcccttacggtctaagcaacaagtgaaacaatgatgattaattctcagttctgacaatgcaacggtgcaggtgcttgttccacccagtacgaaggcgctcaaatggctgtgcacacagtttaagagatcatcattgtttcctcagttttatttgtcgaggaagcaaaccactgattcatcaattcagcttgaaatctctggcgctggctctgcaatttgctttcatggttcctctcgagtagataatgggtttgatttgatatcaaggtgcctcctctctattgctttccgtagcgtacgtgtgatgcagggtgtttctaactaaattaggacctgtttgtccctgcagatatctttcgtttaattcacacttgattagagcctatggatcagtaggtgttaaatatgacaaggaactattgtctttagaggagagaattggttcattttacttctttattcctcaggtaacaactttcagtattctgtggtgctactctagctacctgaatatttatcaagttggtgcgagatacagactatgtgtacaagccattttgaatttagcaaggaaaatcctcgaagttctgtgatatgacattccctgtataaatttggttacatggtttaatatcatattgtcagacaacagaaacagttttacacctgaatttttcttgttagcctttttatgattgtggtggggtcctcaaagtaatccgttggtgcaaagaaagtcctattctgaacatgcatgagtggcacaagtactgcacttatatctagaaaaatgacatagaagttagcctattagaacatttttttaatgtattaaaaagatctacataaacaatttacaagaggatcacaacgctttatgacctactttgactggtaagttattgcacagaaagtaatgcaaatgcaaagggttaaaagtggaggtcaacttggttgaggatttttcttgcattcttgcatacaagtcacataggaggcagtaagaatttacagaattctttcttggttatcttctgcaggcataatgtagatatttgatcttatagcattcgtgatgatcagcaaaattgaatttacaggttgagctgagtgaatttgatggctattccatgttatcgtcaactattgtttgggatgactccgtgtctcacacatttgaggattctgtttgtttatttgaatcttgtttcagtcaggtatgtggaactaactagattaagaaaaaaatatatttaattctgtttaactttctttcatattaatatagcatttccatgttcttttaaaacaattaattttctgttttgtattttcccctgtaagatatggagtagctatgattcttcagctactatctgttatgaaaacatggtaacaagttacattggagaatcgcgtatgtcagagagcaggaatactcagttggtacatatttctatcaatcttaatcactttgttaatttcatgaatttacgcttgtgccatttgttctccactctgcaaagtccatctgtgatgaagcttcagttgtatcaggccttcacatgaacactcatattcactattccgatgttcttacttctatgccttaattagttcacagggttttgagtctgaaacattatttagttatattacggaggattataatagcagagttttgtgatgtgctctactgaagtttgcaacaattgcttctccaatctctaatggccattcttcccaccattttgtttttggttgaatgataaaaaaaatcctctttttcaacaaaaatagataaatgaaacgtctatgccttttaacatatagaacatgctggcttccaaaaaaattagctatggctaatgatatagattgggtgctcatattgtattccatacagagttttggctattcatcgttaaccagtttgtgagttatggaacatagttctagtttgcacgcaaacactctttatagctgtttatgtatttcgacagttatctgctattcctattatcatcagacatcaaagtgctcaatttgattttgttgaatccactgttccaggtatacttggatgctgaatttctcgctgtaatagatggcaaagctgtcacggaaaaggtatcctcttaaccctggtaagcttctttaagctatttcattactttgcaattgagattaatccctggttttaatataagaaatgccccttgcaaaaaggaatattatgtttctttctttgcggtttatggatattttgtctgtatcttgctggaaggcacattcacacctatcacatttataatagtaattcaagattattttttttacgtccctgctgccctgcattacctggtaactaacaagtttgcctacctgttagttagttgaattgcttttgaccaactccacaaattcatggaccaaaaagttaaagtcaagaagttcatgggtacacatagacctcgccacaattattaggacagacataattttcctattatttcctttttaaactttttgttgttcatgttctcttataagactagacacaataaacttgaatttatatccctgatcggatatggaacttattcttttgtctgtaggagaattgcccaacttctgatcagtcatttgttcggttttcgccgcagttcttgttttgtgcaaacatggtaatggtttctacctgagtttctttttttcataaataaccattaaattattttgttaaatacttcctccgtttcacaatataagtcattctagcatttcccacgtttatattgatgttaatgaatctggacatatgcctatctagattcattaacatcaatatgaatgtgggaaatgctagaatgacttacattgtgaaacggagggagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1749 - DNA, 434 bp, Oryza sativa
cgccgcgtgcacgctcgtgcacccaccccgtaggaagcactcgacgccgcagcccatcctcatccggcgcggcgcggcgggcgacgccggcgaggctggcatgactcacgagcgccagcgcgcggcgacgagggaagcgggagagagggaaagaattataaaataataaaataaaaatctaagcgcgactcgagcactgcacgaatctcgaggcgcacgtggcccgtgctgcggcggccacgtgggcgcccgaggactcggaagagttttgtgtggccgtggtatcctcttccctccactccactctccaacttctcccgcagcatcgccgccgtcgtcgtcgccgccgccgccgcgaggtgagggctcgtagcaccgtccgggagggcggaggaggaggagagatgagctgctgcgccgcctcgtcttcctct

SEQ ID NO: 1750 - DNA, 48136 bp, Oryza sativa
  unsure (1)..(48136): unsure at all n locations
cccccccccttaaaacccaccccgatccccggccgctattaagccaaaggcgcgcttccgccgctgcagccgatacgggagattggatcggaagcttctagaagtttccgtgggcgatggcgatccgcgcgaggtcctcctcctacgccgccgcggcggtcgcgctggcgctcgcgctggcgtccgtcgccgctgtcgccggcgaggtcttcttccaggagaagttcgaaggtgaatggctgacctgctcccgatcccgtctcgatcgatctgatccggttcgctgcgcgttgcgggtctcggctttggatgtagtggaggcgtcgcgtgggggtgtttggtggtgggtttgtttggatctctggggttttcgggatttctctggggtttatacgactaggaggcgtgctggttgttagggatctggagtgttaggcgctaaattgggtgctgatcgtggtttgtctcgccatttttggatggttgctgctgcggtatggtgggatctgattgatctgacgtgcatttgctcgtgggaatgggatctagttgcgtcgtctagtaagcgtgcgctgtgacgctgtgtcgatctgctttatgtgaattggttatggttttttgttagattgtgggaaaaaaaacgtggttgggttgattcggatcgaanaatgttaggtttgtntggtatatgatccgcaggtttggatacttcattgtagggagtagttggtattctgctgtataatgtggtgaattttactttactttatactgcgaaatgggaaaatttagagcccagacttggtgatgttttgtgattgaaccttatgctttatgtatgttgtttaattctgatgtttcatatgtttaacctgaatatgaataaatgtttaagatctgcctatgctagtgctacatttgaagcatactagtgagaattggcagcttatgatggttgtcacctgtccgtgtccattagaatgtgatttgccacttatctgcatatgggatatggcattatgaaccaggtgcattttacacttcaggttttggcgtatagtttattagttctatacggtatgtctggagatccataattcgaatgtgttgatctgtattgctaatgtcgcctgttaaaattttgtctgtactactatttaaggaaatctccgggcagataatgaatttgcgtgatcatttgctggttctgcacatgatgcactgaacatggagttctgtgttatctaaatgtattctattgtgtgcacagatggatgggaaagtcggtgggtcaagtcagaatggaagaaggatgagaacatggctggtgaatggaaccacacatctgggaagtggaatggagatcctgaggacaaaggtaaattggaagatcaatacacctcattcagacactaacagatgatttttactgaattatttttcttgttgcaggtatccaaacctctgaggactacaggttctacgctatttcagcggagtacccagaattcagcaacaaggataaaaccctggtgctgcagttctctgtaaagcatgagcaaaagcttgactgtggtggtggatatgtcaagttgcttggtggtgatgttgaccagaagaaatttggtggggacacaccgtacaggtaatgattttcttctattgtagctctgattctcacttttctcaagattagtactagttatctaacttggtacttttgaatgcagcattatgtttggaccagacatctgtgggtacagcaccaagaaggtccatactatctttactaagaatgacaagaaccatttgatcaagaaggatgtcccctgcgagactgatcagctgtcccatgtgtacactttgatcatccatcctgatgctacatacaccatacttattgacaatgttgagaagcaatctggcagcatctacgagcactgggatattctgcctccgaagcaaatcaaggacccagaagctaagaaggtatttcgcatattcctagctttcttggaatgccttgcttttgtgtctcttgaatgttaagatattaccttatgattacagccagaggactgggatgacaaggagtacattcctgaccctgaggacaagaagcctgaggtacttttcctttgttctgacttccgatatatcttgtaaaaatgactaacttcgtatcttgcatgaatgagaaacgggaaccttagctgacctgaattagaaaagttcacactatattgtactcttgtaatactatatgtcttaatagatttaaacgtgatgctagaaactaggaagaagctacatgtttttgttgtgtaatgacttgtggtatgctgtttccagggatacgatgatattcccaaggaaatccctgaccctgatgctaagaaggtacttaattgttataccattttatggtttatgttatatatgatgagcgtcattctaggttttaaaatttctttgatgtgatttctgtagcctgaggactgggatgatgaggaagatggtgagtggactgcaccaaccattcctaaccctgagtacaagggaccatggaagcaaaaggtgtgaatatctgtttactgatgcagatgcacttgaaacacttgcatatttctggtttctgacataaacatgtttctttttccagaaaatcaagaaccctaactaccaaggcaaatggaaggcaccgatgatcgacaacccaggtataattgcctttaattgaacaacttggtattacacatttttcagatgttgaactctgcattctgaactgtttcctttgtggttcacagacttcaaggatgatccatacatctatgcttttgacagcctgaagtacattggcattgagttgtggcaggttagttaagcaaagtacagtacgcctttagttctgatttattttgctgggtcaggaagacagacataaatagttatgaacttatcccttctctcttctatcaacaggtcaaatcaggtactctgtttgacaacttccttattactgacgaccctgagttggccaagacattcgcagaggagacatggggcaagcacaaggatgtatgtcgttcttcacctagcttttaccgtgtaatagtttcgttatcgacccaacattctctaacattagtgaatcttgtaggctgagaaggctgcttttgacgaggcagagaaaaagaaggaagaggaggtaaattccttcaccttacaatgttctaatatgaggatgatggatgtacaactgtccttgtcattgcatttcagtctgtgctccatttcactgtctttgctatacgttttgatttttgttggcatgaacaccagttccttgatgatcagtgggccattgcttccacttaattatactatggtgtgatcaaaaccttttaactcactggcatggttctgttatttgtagttttacgtattatcttctgattgttacaccagcatagctttaagcaactgaaatattctccttttgtgagctgccatcactcgtggttattgtggatgtaatttgcttaccattgattatcaatgtccttgttaacaggaagctgccaaggccggtgaggacgatgatgatttggatgtaagatttgcatccgttcttcctccatgttctatattttccttttgggcttgatctaaacctcaacaacatttatatttcacaggacgaggatgctgaggatgaggacaaggccgatgagaaggctgactctgatgcagaggatggcaaggattctgatgatgagaagcatgtatgtaacactcctgcgttttcttgataccttctggattctggtgatgcatttcctgttaacctccatgtgtcctgatcaccgtccttcctttccaggatgagctctaagatggtgaggatgaagaatggaggccgccttcgcgacgatgccaggatttgctagttctcccattgttatgaagttccctttttcgtgatcagaaacttgacaagaaagtactctgtagatgagcattgctgaggaactttaatttggtctttgtagctctctctgtagtgtcatttttcccaccacaagaaaaagaactgataacttattgaacaagagaaatcttttgcacaatcgctctgcatcctgctgtgattgtatatgtgcttgtgccatttcccattgttttgccatagggaaagcgtcttcagtcgttactcgttaggcacctggtcacctatggcatggagtcgaatcgatgagaaggccgagatagaaatgctgggcaagtttgcgttccaaacttccaatgccaagtctttctggttaatcaaagaaatccctcacattgcctgtttattgataccatcagaaatagtttgtttgcattccgctattgtggcaatattctcccacgaccgcaaataactaaatatgggttgatcaattgagcaagatccaaagcaatggtggaatatgcttgtccgaagagtggtattgctttttttgaaaaccaagggggttaaccacaaaattagccaaaacaacctaatggggatataaagttaactgatactccatccgtttcacaatgtaagtcattctagtattttccacatttatatattgatgctaatgaatctatccacatttatatattgatgctaatgaatctagacctttaaaatgtaagtcattctagtatttctcacattcatattgatgctaatgaatctaggtctagaatgacttacattgtgaaacgaagggagtaggagataagattagggcagacagcgcttggatcaggcttgtagttcgtcggtacatgatatcgctatatccgcatatatttagtccttaactagtgcatagtattttaattatatcaaaattattcgtatttactgagttttttatttagtgtttcttattatactaattatgattaaatagtaaatttaaaattattaatatgatataaatgagatataacaactagtgcttagtattttaattatatcaaaattattagtatttaatgagtttttttggttatttagtgtttattatttatactaatatatgataaaatagtagatttaaattattaatatgatatgagatatagctcgttgacgagattgctatctcgttaagataatgagctcaaacgagtcttagccttaacaacccgagctagctctttatccatctcggataagatacctactagttaggtcataacctcagtggcttagagtaagtgttagtagctataccttttttgactgataatacttatcattttgtactatgacgaggttaattttaaaatctttgactataaatattttctaaagtatttattctaaaaatatagagaccatattaataaattggtcttaaaaggtacttcaataaaataatatatttgttgatatttctatatattataaataaaaagtggtcaatgttgcttttgagaccgtgtaattgttcaaaacgataagtattatcatcctgaagagagtaagggtttaacttttcgatttggaagtgaaaacgctcatcaccggtttaccaaaatttaaccgaaaaccattaaaaactgatgactttcggtcaaagccgtacgaaaaccggctaaggctgtgtttggcagcccctcttcccaacccatctccctcgtttttcgcgcgcacgcttttcaaactgctaaacggtgtattttttgtaaaaagtttctatacgaaagttgcttaaaaaaatcaaattaatccatttttcaaaaaaaagcaaataattaatcacccgctaatcgctgctccgttttccgtgcgggcacttactgttgggaaccaggggttccgaacacaccctaataccgaccggttttcataaaccgagatctagcagtttcaccacagcccaccaatttttgtgaaattccatcagttacgtgatccctgaagagagtactaagtagagcataaataatgatgtgatgtcagcatctcatagtaaatgccacgttagattttataatgggttcaggagagagaaataggttagaatgaccgttgtttgagtaaatgccacattggatttacaatgtgtcaaattttacaactttttacatcctactccctccgtcccaataaaccctccgtcccaataaaaaataaatctagagtgtatgttggtttttttatagaacggaggaagtatgttttattttggatcactctttaaccaggccgagccgacccatcagctggcctagcaggccgaggcaaactaacctcgccccgcgctctgcaactgcaaaggattattttctgctttcgtgttcactgaatttctgctggtctaatgaccaccactttatgcacatctcaaatgaaaattgaagctccttccaaatcagcatcaccatcgtataccctttttataaaaaagaaaaatcataaatgtttcagaactacgcttatgcactgcctcgagatttcgccttgacctcctcgtgctcggcaacacaagaacaaaacaccccacactgcacagcagctcttgagccatcaaggttgacaaaaacacgcatgctgcatactaaccacatcacgatgaaaatcagaggaacaccaaatcgttttccagtacatgataacacttgtaatagctgtgatgttcgacaatgatcaaaacaaagcccaaagatatacagaaacaaataggtacaacaatcagaaaagcgttgcattctaaatcacaacccatccaaagtagaaatgcagctgatgtaaagatactaagtactaaacaataggtgattgaatgttctgttggtttgcttgcaaaaaaaagaataggtatggcagaatcttatcaaaatgtgaatatgccaaaaaactgaagccgtcacacaatcttcctactgctcagccttcttcacctcttccgatgactcgggttttgttggctcaaccttcatcacctcttcccattgcccatctgatgcttgcttccacagagttatgttgttctcaccagcagctacagataatatgtttccagtcaaggaccaggaaaccctccaaacaggggacccgaagtcgtgcatgacctttccctcccacttatcaccaactttccctctactccaaatgacaaccttcccatcttgagaagcgctggcgatggtcgccttagctaagcccaacactggtgcccatgcaacatctctcacacagtctgtgtgaacatctgaaggaagagcactctccagtttccagccaccattgacaaatccccagaccttaacaactgagtcaaaaccaccagagacaagcttataaacaagctctcctgaaccagccagagaaccaagtgctgttgctggagcccaggagattgctgtcacaccaacagggtgagctcgctcaatccttgcagtgtcccatcccccatcagctcgcatagtcatgacagaaatggttccatcagaagacccacaggcgagacaaagaccaacctcatatggggcccaagcaatggagttgacagaggacttgtggtcagtaaatacatgggcttgagaccagtggcctccagcaccctccttccaaatgatcacacgcccatcatagctgcaggatgcgaggatagtaccatacttaggatgggcccatgcgacacgccacacagggccatagtgcccgctgagtgttgcaaggagctgggatggggcagatttgccgcctatgctggagatcttgacagtggagtctgaggaggcagttgcaaggcgcttgccatagtagtcgatagctgaatcatggaccatgtccttgtggtccaactctattttcttcgatgacatggttcaaagctgtagtgtgccacaacctctaagtcctccacaattctgcacatgattaaataaaagtttcagcaccaattcatgggcatagcagcctaaatttgcgaaactagataatagaatcccacccgaagtgccctaaacggttaacaaggaccaagaaatagtcacctcacaaacttaatattaacaatctaaacaccattttttgtcatactcccaaagagacagaagggggatgcaatagaacaatgctggtgtatcatcgcctcataaaatcaaccatggaattaaacacaacgagactgtaaataagtatgtagacgaggctcaagggtcaccattggcaaatggtactaattcacaaactttgttagacttgtggcaaaccactatagtaaatgttggtggcttcaaaataataacagaaccacttacatgctaacctcatgaatgagtataacaaggcattggattaattcgatgaattgacttaacaggatgtaacaatttcacagctcaaaacacgttcaaacatggatttgaattcctcaggcatgagaagaacagaagtttcgatagactataatctaaaaaatgaaaacaaaattaattatacccctcattatttcacagctcccaaatctatacaattctgattcttctctatcatgtcaaaaaataaaagaaagatagctgatctggtgtgacctacacccattccctcattccacgagatcttgcgccccccagagggcggatccaacttgggacatgggggttcagttgaacccccaaacttttgggtgaacaaagaaactgttacttgtattaaggttaaggctctgaaattaagagaagagctccttccagatctagaagagaagctagggtaaacgaacggaacgcaagcgaattccagacaaaagtagtcccggtgggagagagatgaatcagaaagaggatgtggatgctcaccaggatcccctcccctgccctgctctgctcgccggatggagatcggcgcccctcccctgttcagccgcgactcgtcttggcgcaaggagcggaggagacgggagattttcttttttgacgcctaagggaaggggaagatactcgagttaagacgtggcagttactgggaatatttaactattagccactttttagacgtggcaattaaggatttgacactaaaatactaaggctgagttcgtatgggggagatgggtacccaacttctgcgtacggaaaacggagcagtccattaacgcgtgattaattaagtattagctattttttttcaaaaagggattaatttgatttttttaagcaacttttgtatagaaactttttacaaaaaatgcaccgtttagcagtttgaaaagcgtgcacgcggaaaacgaggggaagaggatgggaaaaggtgcatgcgaacacagcctaagtgtgtgtttagttcagcgtaaattttgtattttggttaaaattagagatgatgtgactgaaaagttgtgtatgtatgacatattgatgtgatggaaaaggactgaagtttggatctaaacacagcataaacccatatatcgcagatagagaagggtatagactatgagtggtaaatagttaaatgctatattttaaaagtgacgaatagtcaaatatcctgaattagatggatgaaaacagttcggaaatggaaagcgtccgtccgaattttttcgaaaataaattcggaatttttttctcagaaacggaaacaaatatgatgatgctactatccgtcgaaaacgaatttgtggacttttcgaaaacaaattcagaattttcttttctcggaatcggaaacgaaatatttctcatatacagctgattatcttcagacttttctactccaaatatttagatttatactatgtgccatagtacttataattggagttatggatgaatatagttatttttctccaagaaattaaactgtataactagttgtgttattattaattgataaaaattagaaatattgatttattgttttacaaaagatattgaggtatatctcttcatcgatttgagaagtttagcttaaggggtttttatattctaataaatatcattaccgtattagcttcgattcgtattcgctccatttttatattcaataatattctattcctttttttttgtatctgtggttttcgatttcgaaaagaatatggaagcggaaactataaaagtggtttccgaaccgtttccatccaatcgagtactctacctttatatctttttcttactactttaaaactagctttatctttatgatgactagtggcccacagatcagcagtactcagagaaaaaagtacaacaaactccgttggggattgtgttgacagcaacctcatcagaccactagcaaccactagctgatgcttcacgaatgtcacaccctgaagttcttcccctaagcctaaatggaattaataattggtctcgagaaaatacctgtgtaaaagcaagagtgaaaccctaattaattaatgtaaataataatcggaattggcatgtggaatttttcttgagttctacatgtcgaaatatgctaacaagatttttagtggaattttcagaactctagggataattttaaccaattaaaaatgagcataagcattatttaaatccctggaaattcttttccctttttctttttccctttttcccctccttttttcctaatgggccgccggcccatttcctcctccctcccgtaccgtgctgagccggccgaaggccacggcccagctgagccgcgcctcctccctcctcccgtcgggtcgccgacaggtggggcccacctgtcgggcccgtccccaacctccggccacccgccgtccgcagccgccacctcgcaaccgcccgcgccagccttccccgcgccacgtcggccacgcccgcgtgtgcgcccgcctttcccgtgcccctcaactccctctcccgctcgcccgcgcccccgagatggccgggatccgcctctctctccacctccacctccccatgtcggccggcgaaatcgggccgctcccggccacgtccgagccccctctcccctatttaagcatcaccgctctcctctctctctttttctccatttcgccgagctcccccgtgccctccactgccctagcgccggtgccctcctctccgccgccgccgccgccgctccggtcgccgctagccgctgcgccaagccgcgccatcgccgccgtcgggttcacgagcccgggggccatgccgtccacccctccgccgccaatttggacatcttggtacatcttggtacatttttctttgagatcttagtacatcttggtactgcctggatgaatggagtactgagtctgatgagcctcggtgagtatcagatctttcagctctttgtcatcaggtacgcacaatctttctcccaaccagattgtgccgtgctcatcttcaaggaaatcctgggattttccaaccctcatattctttttcagctctgctatttcaggatcatttacctgagctgctcggacttggtccacgagcgtaggccgtgcctctagggcagccatgtacccgtgttctacaattcccaagttgagatgttcaagttcctgctacaattctttacacatgtcttcggtgcacgaagcgttgcagtagcttttcctgcttaaggcatctgccaccacattggctttgcctggatggtagtgaatgctcatatcataatctttgattagctccaaccatcttcgctgacggagatttagatcaggttgggtgaagatatatttcaaactcttgtgatccgtatagacttcgcagcggttgccaatcagatagtgcctccagattttcaaagcgtgaaccaccgctgccaattccaggtcatgtgttggatagtttccttcatgtggacacaactgtcgcgaggcataagcgaccactctgccttcttgcattaagacacatccaagcccgtgacgggacgcgtcacaataaacctggaagtctttcgtctgatcgggcagaatcagaactggagcagacaccaatttcttcttgagctcctcaaaactcttatcatactcggctgtccatttgaatttctcatctttcttaagcaactgagtcataggtctggcgatcctggagaaattttcaatgaaccgacggtaataacccacaagtccaaggaaactccgaatctgtgacactgtcttaggtggggtccacttggtaaccgactccacattcgatggatcaactgccacaccctgagctgtaatgacgtggcccaagaatttaacctctgataaccaaaagtcgcatttgctaaacttggcataaagctagtgctcttgcaacttctcgagtaccagacgaagatgtcgttcatgctcttcttccgacttggaatagataagaatgtcgtcaatgaataccatgacaaacttatacagaaattccatgaacactttgttcatcaggttcatgaagaatgcaggtgcattggtgagtccaaaagacatatccgtgcactcatacaacccataccgagtggtgaaggctgtcttgggaatatcctcttcccgaattctcaactggtgatagcctgatcgcaggtctattttggaaaacaccttggctccttttggctgatcaaacagatcatcaatctgtggcaaaggatatttgttcttgatggtgacctcattgagtgcgcgataatcgacacacattctcttcgtcttgtccttcttctccacaaaaatgactggagcatcccaaggtgaagtactcggtcgaatgtaccctttctgcagctactcatcaacctgcttcttgacctctgctagctcgttggctgccatcttgtacggtctcttgtaaattggagcagttcccggtgccaaatcaatgcggaattcgatctctcccttgggtggcatggtagtgaggtcttcggggaacacttctggatactcgcagatgatgggaatatcttccaatttcctcgaactcttctcctcggtgaccaccggaatttccacctcaatctgattcaaggaaacccccagctttggtggggctggagatttgtacaccactgtttctcccttctcattgatcaaggtgaccgtgcggttcgcacaatcaatgacgcccttgaacttggtcaaccaatccatcccaagaatgacatctaggtctttggattcgagaaggatgaggttggctagaaatggtgatctttggatttctattgttacagaaggcctgaattgaaccgaggtggagctatttgtggggctgtgtcttgtgggtacagttgtacatctctgattagagtagaactattcgaatagccgtgcccgcggttatgggcggtcaaccagattcaccgtgattagtctcaccctagtttagtctaatggaattgattagttcaggtagatggttgggcctattgcaacgtggagtagcgttggacagtggatggttaacattgattaattattacaaatgttttactgctttcaactattgtttataactgctcgctttatgcaaatgtaccgctctacctatcctttggttatatcctgcatcataccccctgttccggtatgacttgctgagtacggtggttgtactcagtcttgctctacttttccccaaccccagagtttgagtatgcgtcagatggtggcttttctgaggagtaggcttcgtccgtgccgttaaggatgcctgtggagtggtgttcccgctgcagtcccagtcaaggattagctccagttatcttttattttccaatgcatttatgtaagacttttataatgtttgtaagacgtggatctgtatgtcaactttgtcgcttgtgtaccccggccggtcctggacaggggttttaatgcacattctgcttggaattctactcgggaatttctgggcgtgacaacgcaccgccaccactgctctttctctttgagccaccatcgttcctcatctccacctttgcatgcgcagccgcaccctctagtcactgacatgactttcctcctcccccgtcatcatgcacactattgtcgtggtcatcattgaggtcaggggtgttgggcttacagggattcagaggggcagccatgcaggagttgacccgacaaagagcagagacactagatccgagctcctccttggtggatctgacggtttcccaacggtcaaagggaaaaagaaaaaggagaaagggaattagtgtgcgaaatggctgtagagtcaccgaacttggagatggatagaatagggtggtctaaattgaaatgtaaagtttgatgttgtgtaaatgaaaagaatggttaattgatgatataatatgaaaacttttaaaaatacatagtacaaactacccgatagtctcgtgatatgctaagcccagtacagttttatcgtctctgcacattatggttgggttggtgtatttagctattactaataatctcataatatattgatacatgacgatacgaacttctactaacatgagttgattaattatggttagatagatctggctaaaaaaagataaaaataataccaacaattttgcccaatagtaaagcattcgattgtggtcttcttttctcattgcatgattgttgacggtcgttagcgactagtttcgaccatcaatactacccaaataaaggagaactagtcatgcttgcaatgcatatttatgttcaataataaaatattccactagcactaggattactaacctcttgcagagaatggccataaaatagaggataatcgacatcaaaacaggcgatcaatcaatcggacgatgttgagaatcagacttatcaatgaatgggccaagaaagcaaaaatgacacgaccaattggaccaaaatttacaagtctgcatttgggagcaaaagaggaggccacctgccgaaattgggccaggccggaccagcccatggttcggccaaatccaccgcagctccgttcgatccaggttttggttggacggctgggattgatccccaatgatggttggagggtactaccgacctttccaaccgtcattaccagcctatataaacccttcactctctccatttcaagacacacctcaagcaagaagctttatacatttctcaagtttagtatagtctctagagtatagtggaatagaaatagaatataatattcagtcctcggagtcttcggaagaattcgggtatggctctagtagcttttccttcttttgtaagacttgtacttttattaaaatattcttctttatacaattttggtattgtattactttccgagtatatgaataccaactttattataggtccaagttatatttattatgatgctagcttatctgagagatgcaatggtgtgggtataatgatcgtattaacgatgactctatgtcatgacgatgatattagagtagtatatggtaatttaagcgtggtgtttggattgctggatatcattatttggggttatatgctgcggaagcgatgtgggccgctgatggtgatagctcagtgcgggtattcctccgcgcgtttatatagtcctaagttaatttcctggggagggtactcctccgtatttatccccagttggatggtcatgacgggttgtcgtaagaaactcggcagtcaggggtggcttctcgaagcaccaggagggcatcggaaagagggtattagtaagtaagtatataactaggatgcatgtataacatgaagtataggaatatgatctttctatattctttccacttagcttagataattgtgaatgaaagtatgaatgcttctgcttagtgtcactctaccctctgaattagattaacccctgcttagactttggttgttacaagtaatatataaattattagtacggttctctctattataatctttccacgggattaaacaaatgcgatacccttggaatactctcgggtgaaatgctacaatggtatatccgtgcgcttgcggatgaactctgtaaccataatatactagaagtatttctgcgtcattgctgggaattatatttctagtaatgtgtaactatattggtattttcctaattctttcatattgttttttgtttttttcatacatgttaatttggactaatattttttctcataattaaacagataataaatcatttttcatatttctcctacaaaatgtgaatagtgcattgtataatttgaaaattgcattataagtgtatgtaatttaatgtgtaagatatggatttatagtataagatttgattttttttctaaaaataccgcactatagaagataggtggttaattagtgaacaaccataaaatatagtgagaatctattgcaagtcactgattttgtctctattttatgatatgccactaggtttgtcaagttctaatatgccatagtgttttgcttaacttctactacgtataatataccattgccgcctagttagccgtcgtcaatattgtacaattttgtcctaatgaccaaactagtactcctagacgaaaacttccaaattttggtcaaaaattctgaaatatcatattgtagaacttccaaagtttgagatgggtaactataagttcaagtgccctattttggttttggtgattaatggcaaatctaattatatgagactaacgtttttatgagctttttttaactagtctcatttggatatgaaaataaaaatgataatatgtatgcattaaacttcatatattctaacttggtctctcctgtggatccaagatatagtgtgagctccctcgttgatcttaattgattatgtgcatatgtgttcctttatatccatatatatgcacatcttgagggggagcttattatatatatttttattataagatctctaccttgatttgaaatatatttcatctcatctctctatattgtttatatcgggttattattcaacaccaaagagagaaaagattgaaagatcttggattaaacaatttgtgtaattgttgctttggtgatagttgataaatcgatgtttatgggttaacatctctattacataagttgtcaacttaaataattcctgataatgagatgtggtaggtatgcattctttggtgatggaccttaatcatgataaatgaaattcatgtagataaagttatattctcctttacattgagaacatagagatcatgaaggaataggtcccttcccaccgtgatgaggctaatggatgacaccatgtgttgatggtcaccaatccaaggacatcgccatgttgataagaatgaagtcaagcttgtgataagaataaagtcttgacaaaggatggttaagacctcggcataaacatggttcaaccgaatgatcacaagtgttgatcatggctcaatcattgaccccaaattggatagcgcaaggcaaaggtataatggagctaagaatgttttcttagtattttggtgtagaacgaatttgctagataggcgtcgtactatcaagaggggtctatgaagcgagcatgtcgatgatcttgggccatattagttcatatgcatgtaggtgcatttggtaggcttgtctagccaagtgtagtgagttttctcaagtctcaaacaaagagacaagtggacacattttgggtagccttaagtggttttgtccggtggaatatcctttggagtgtgagccaaagtcggtctgactggaaggtgctcgatctgacgcagccgaaggaggtatgaccgtgttgacgaaaaatccgcgcttggccaatggtgccagaactgtgttggcacgaactaagtcgacgaacacaacggcatgggagatcttcttagctccagtggcggtccaaatcttggtgagatgtgggcgtgccagtcagtttgatcctgcaactgacaagatatgtaaacaatagatcaaatagccgatcggctgataagctaatggagtaattccagccgatgccgacactagccgatgtcgatagggttttgagcaatcgactatatgtccaatgtagataatgatataaagacaatcggttgatgataatgtaatataacaatagtatactccagtagaaaccaatcggctaacaatgatatgatagaataaacactgatccgaaggttaaagcatacatcggctggaggttcgatgtcataaaatccataggattagataaacagtgaaatctttgttgcgatcggctaaaactaacttgtacgtaatccttataagccgatgcaacgtccatataactcatcggctaaaactccgatgaaacccttattataatcaaagatataaattccttatcggacactaaacacacattcctaaagataaaaggaaactaacaaactattcctaattaatagataaacttgccatgactcatcctccttgaactcggtctcttctggataagcttccttgaatagattaatttcattaactgaatcctccaagaatacaactagtggcgacttgataattcacatcgggcgataccaggactctaaagccgatactttctctaggctgatgatgacttcggggtttgccaaatttcactgttaacaaacctttgatggtcataccagctagccattgctcgtgcattaaatgcactataacaaactagttttctagccattacaatgaaggtcggtctgaccggccactccaaggcggtctgaccggccaacacctgtgagttgggatttcgcccccaccgactagttttggttgttgtgggtatatatacccactccctagtagcaatggtaaggttttagcactccattgcattatattgaatccttgcaagagctctcatgcccttgtgcactttatctagtgagttaagataacccaagtgggcaagtagttactttgcatgagcataaagcctctcttttctaccaaagcttcaaaagcagaatgggagtgtcaacctttcccacaatggtttcaaaaaagacatctcatgagacagtgaatgatttcagacccatttctctcatggggatcagtttaaaggttataacaaagttaatggatgatagattgcagtgtgtgattttgaagttaataagtgaaaatcagtatggtttcatcaaaggaaggataatccaggactgtcttgcttggtcctttgaatatattcatcagtgccagccgtccaaaagggagatcattatattgaagttggactttgagaaagcatttaatacaatagagcattctgttatcatctctgtcatgcaactcatggatttcccagtgaaatggcttgaatgggttaagatggttttttcttcaactcaatctacagtgctcctgaatggagttcctggtaagcccttcagttgcaaaagaggggtcaaacaaggacatcctttgtctcctttgttgtttgttttgggtgctaagctgcttaaagagtggtgaataaagcttttaatctggggttgttgtcaaaaccaattaatgaagctgatggtacatgcttcccaataattcagtatgctgatgacacccttgttctgctcaaggcttcacagaaagaaatcttttgcttcaaagctttgctcaattcttttgctcagtcaactggtctcaaggtcaatttcagtaaatccagcatatatcctcttaatctttcttctaaaaaagctgaacttctggctgaattgttgggatgtcctattggtactttaccttttcacatatttaggactgcccatgggcactaccagacctagagtggttgattttgcccctttggttgatagagtggaaataagactcacatcaagctcaatgtttcttcctcaggggggggggggggggtaggccgaccttgattaattcagtgttgtcctcaatcccaacctattatatgtgtcccttgcagttgcctgttactgtggttaaggccattgatactgcaagaaaaaactgcctttggaagggtaataaccaaggttctacaagaaaatcactagcatcctgggatatggtttgcaggccccaaaggacaaaggaggactgggcatagttaacctgagagtacagaacacaactctcctaatgaagcactcggtgaagttatataaaagtgccaatctgccttgggtgaacctagtttagaattcatattacgcagcaaaggtcccatactcaataaaggttctttttggctgagagacatcttggttttgttagacattttcagaggcattgcttagtgcaccattcagtctggtaattcagccctcttctgggaatatctatggaatgatgaactcctaagtgataaatatccaaatttatgtcatctagctttgcagaaggaggaatcaataagcaatatgtgttcaaggtctttggaggactcttttcttctgcctctgtctacacaggcctatgtggagtttttgcagctggaggagcagctcaattctctgaacttgaatgaggtgcagggggatagctggagttttatttggatttcagatgtctacactgcaaagcacttttacaagcttaatttcttggctttgaatccaccaagaccttttgtatggctatggaaaacgaagtgtgttatgaaagtaaaggtctttgcttggctgctttttagtgataggcttaatacaagaggcatgctgaaccgaagacattacgcaaaggaagatgatgatctcacatgtgtcttatgtgatggaggacataaggaaactcggttgcatgtcccttcagtgctaggtgctggcaatacttgggcattatttggaatctgaatttggagttctttcaaatggtcacttttgcaaggtggagatttggttctctgggtgggaagggcttcctggaaatctttttcatagttgcttggcacatatggaagcagaggaatggacttgtatttgaaaatgtggccccctcctttcagtcctggaagtttctttttacgaaagaaattcttctacatatgtgtagaatgaaggaaccactgaagcaaattggttacaaacattatagatttcaaggtttgttgtaattaaactcttgtaaatattctcttttaatgaaatcacactgctaggcaaagccttggcagtattcaaggtcaaaaaaaagaaaacccaagtgcattgcttctttttttttaccagaagtgcattgcttcattgttagagctagtgtggcacttgatcatacttggcaaacattttagacttgttactcttggaggttgccaccttctagacggtttgaaggagttgtccggtgacctctccaaaagagttgtagaggaggcctggtgttgattgtgagtggctcggtgttcgccatctccgcagtggagtaagaacaaccatagtgatagagtcttgggagaccacttcggtaccggctcccaccttgcccaccccttgacaaagaggacttgtggtggcttcgtggtttgagcggtgaagttgggctcgccccaatggtgatgtaggaagttggcaagcttccgaacatcgatagaaaaatcctttgtcatttgtctcttttattttgtgcaagtttactttgagcaactttacatagtagattttatttgtgccaatatcaacataggctagcttctttgtgcacttagttgacactagttgtttaggttttgaattgtgcaaaaccattttgatttacgcctccacatacaaaacttggttttagccaaaagttttaaaaccgcccattcacccccctctggtcggtctccttatctcattttgtgtatttcttatctttttttttctttatctcaaacataccctgaggcaattcggatcctctgctgtggaggagaaaattcagaggtagctacagtgcctggcattaggagtactgtgaagcgtccgatagaagatggatggatcagatgagacgctacagcaattcggatcctctgctgtagaggagaaaattaaaacactgttcccctcacatattactgtagctacagtgaccctctgcagtaatgcagaggatccgaatccgaggataaggaagagctaattacgatgaatggagaaaattaggcaccaactaaatattattctcactactagactactagaaaaaccatttttctaaatgatggtatttttttaggcgggtaagcctctcggagctaaatggccacctgcgaaaatgacaaccatgggatagggatgaaaacggagtggatacggacggataatactcatgccatattcgttttagtatttttttttaccggatataaaaacgaatacggatagctcgaatacagaaacaaatacggattatctcgaatatgaataagacgaatatgattggacacgaatacggaaacaattttttctcggaacacgaaaaccaactcaacttctaatagaaacaaatatcaacatatataattaactcattttatataaaatgaagtataatttataaatattttttaaaatttaaataatattaatagtatggactagtgttaagagataaactactattaaaatatataaatctatattgaaggttctagaattagaaagaaatagggtatgtctcatggcttctgcgaatatctgaatagcactattcaccggatatctgaattattatccgtatccgacggaaaccctgagaccatatctgtattcgtatccgtatccgaactatccgagaattatccgattcgaaaggtatccgtatccgtttttgttcgaagcggacggaaactatccgctctattttcatccctaccataggacaagatcgttgtccgcctacgaaaatagattttcgcattacgaaaatagattttcacaggccgaaatttaggtcctccacctgcaaaaatccattcggcctcatatatccgccacccaccccttatctctatccactcccttcccctcctttcccctcttcactctctcactcctccctcccagatccactctcttcccctcccctcccctcccccttcactccttcactacttcggcacggagggcactcccctccctccctctcctagatccgaccggtggcgcagagggcggaggcggcggccatggctgacaacgtgcggcgactagaaggagagacagcgccaccgaccctcccgtccctctcagatccggccggcggcggaggtgcgtggcgactgggaggagagccggtggcactcccctccctcctagatccggccggaggaggggagccggctgccgccgccggcagcaatggacagaggggctagagggggagggggaggagagccagcggccaagggagggtagcagcaggtcggggggatgtttttaattcagtgaggtggtctttgtaggcgggtggatgttgcgtttgctaatgaagtacagacaagatgaagatcgcctagaaaattttttttggtccgtttgcaaaaaccccgtttttctagtaatgtctctcaagttagacccattaaaagatcaagtgatttagccgaaataagaagcatagctccaaaaagaactggtacaacacaccatacgtcaaaacagtcaacatacacaagttcttttttttttcttttcaaatctaaacaacaaaaatttgcagaagctagtttcctttgttctacatttctccactatgatatttattcttcctcacaaaagtttacctacaacacaaggtttactggagaagttacaaattagctgtctggcgataagccgatgactgatacagaagttcagtagtgcaaacgttacgtcacacgactgtacgtcaaacatatagtgttacaggtagcccggctcagccgacaacagaaaaaacgctcacaaccatttacaaagaaaggggtaagcaccttgttatctccatacggtgttgtagtgcgtaaggaagaaccggaagtctggatgatgcacttgacggtcccggagccagtcgtccgctgcctgcatcaatgaggctgcgagctgctgctcatgaggcccattcgacgaccaaacagaactccgcaacttgtacggtgccagtccaaagacgggcaatgttagcttaccagctgcattcatgcagctgttaaagcccccagaaggggggcaggctggtgtactggggtcagcatctgcatgagacacatgaattattattgagaagaaaagatgaagctacaaagaaatgaactgagaccacaagaaatgacattgtattaatgtattcggtatgccgactggcataagatggtacttacccctggaacgtgtcgctgttgataggtagtgaaatgtcaagaaacatgcatcgagatccttgagcgttggtccagtagggattctatatatagggtacctgcaattgtaaggcccaggatgaaaccaacatgtagaatcatagcaatacttcatttccagtattgctcttctacacaagtttattaactgatatttaggccctgctcggcttagctagctgcggtagtgcagccacagctagcaccaccgagcaagaccttagcttagtgagtgcccttttgtatcagctgatacaccagcacaaaagcggggtatgcatcctctgtttgggccagcacagaaagtgttatgaatctggctattgcaaaatcagcattctatttcattcaaatatataggagaagtagatcgagcactaatatggggctaaatcttgtgaaaatattgatggtgctaataaaacaaaaaggtcagcttggtgcagtttacacaaggtatatgattgtctgcacatactataatgatataatgtggaaattatccttcaaaagaatacaaaatctctaaagcataccaagaccacagatgctactgataaaatgacgctgtaaattatatgaatctgaagtataagagatataccatgcaacagacatccagctagttggcagaagatcacagcttctgattgacattaactccggaaatttacttgcaagaattgatacctgatgggacatttataataagcataaaagcagtacatacatatggcaaattttcttttgtcaaatgagggaggggcccttgccttgtctgtcaaaggttctctaccataaggaggatccttctcaagatactcgaataatggacgagtagatggaaaatgcgattcactgtcctccctttgaaagccaccattctccaaacctcttaattggtcagcatcagtcccactgctactttcgctgctagtatccatagattcctcatcactttcctcccaaggatgccttaagtaagcgagaaaattaactaagagaagttctggactatgaaaatcgcagaagaaaaaaaatgataaatccacactggaatgtgtaccaatgctctcttcgtcatttttttcatctccatataactctttgatagtgtctttatttggaacaatgttatacagcagttatcaccaccagcgtttcttttgtttttttccttgaatgcaggtttacagttctacaagttgtagtaagattcagattttgtactggttctaacaaatactacgcaaatcaatcaataatactgacagtgtggtagctatagttcccccacaatccaacaagaaaactggcaaacaactggaacttcagatactaatcaatagacataattgaaaataatgtattgttgatagagtatacaccagtgacagctcaaaatcacacaggtaaataaaaactaagtttcttggaataactacggtagcctacaaacatatgactgtcaactcaatgctgattgtagtcaaacatataatcctgtagagagaattacaaattaacaagccactggtgattattaggcaatgacgaaagtccttaactagttcatttctattctagcagatgtaataagataagatcctgatgaccacaattacctcaatgaggaaaacaatctctaaacaaaagacaaaattgtgtgaactcaagaggaaatattttggttgagcaattcaaataatgaacagaaaaggtggcagcaagcagccatgcctacaggctacagctagcaatcacatttctctacaaggatattcaaagcactagctttctgtacgcaaatgagttgtgacttgcatccccaacacaaaagaagaaccaatagacttgcatagtcaaaggaaggcaaaataataataatgaatccataagtacatcctctcaactctcagttctattggttgtttaaccaaatcaaaaccttttttttctttagcagtcccatattaaataaccagagacagaagaatgataaaaaaaaaagaacctccagtgcttactgcactagcttactttgcagcttttataattcctggcaatgcacaaagcagaatggagaaaaataagtaatctaagggccaagagaaactagaataaatttctacctgattcttgttgaatgctttgatgggtctgcatagagttgtatggcagagagatacggcacataatactgtatgacggaatctttgccatttaacacaacggggacgccggccccataaaaactccactcattgaaagcttcccagagatctccaaggcagaaatatggtgatgaattcatagcatcaccactcctccaccctctcatgcttgtctgcacaacagtacataatccttcagtatgaccaaactaaggcagaaattgacaaccatcattgatgtgtttttctttttcatattttttatagcaatgtaacagcattttgtcctcataacaccaactatgcctctcccaaaaccataagtggcaaactgaatacaacaaataggctggttattttggtaacatgaatcaccacaattgagagctcaacctgatcccttagaatctgattcagaagggttgcccatcttttgtataatatgacaaaaactgaaattttgcccttacagttgttaccagtttccagcaaatttgttctacaaaaagtcacccaagacaagcacatttctacagtgttgaaagctccagaaatgatgtatcatcaataaataatgtggggttacaatgcaccaccgatttaccattatgataacagtacaagaaccttacatatctgaagcaggtgaataacataaccaaactatcttaaattaaccgtacgttctctcaactttacttgaaactaggtaaagatagtcgagaactatctttgtaaccacgattcacaaactttccccaatcataacgaaataaaatacagccgaaccgatgggcgaaaatttaacaatccgaacctactctgctagaactgattatcgaaacatctcctaatgcagtaaaattaaacgggcatcgcactgttccagtccgcgaccatttttttcgccaatgactgagaaaaaaaaaagtcagaggagagcctctcaccttgggcaagtactggacgggcacggatggcgtagtggagctgaggaacctctccagattccccgccgcctcctcctccgccgcccgcgctggctccggcgccgattccgccgccggcggcctcttcacgtccgcggaggacggcaacggcgacaccgacggctttgactgaacaaccgcgtccacccgcctctctacctccttctgcctcgccgcctccgccggtgcgggaggcggcggcggcggcgacggcgacggcagcggcttctgcctcgccgccctgggcgccgtcgccggcgagggggagagcgaaggcggccgttgcccctgcagcagctgctgctgttgcagcagcagcatctgctggcggcggacgtgaggcgggctgtagaaccggtcgctcagcatgtagcctccacgagtcgacgacgactgcgacgaggacgacgtcgtcgaggaggtggacgacgacgacgaggacgccgcggcggcgccagacgggccgaccatggcggcggcgggtgggggggctaaggttttggggggatctgaaccggaagtgggggggaggcggcggcgaggcggcgcgggggcggaggaattaggaaagggagggaggggaggtgaggcgaggtttgttttgccgttgggttaattaaattaattaatcactcgcttaattactccggggcttggggtttctttcctttgctagtcttgacctcacgacactctgctagaatgctagatgcaccaaacaccactcgagtgataaaaaaaaaatcttcctctctatgacggatcacgttggagttcttttcttttttgccttttttggtacgatatattcctggcagaaatgatgtcttgttttactgatatcctctttgcttcgtcccacagctattcctttgtctttctgttttcggctaggctttttccctagcattccctcccttttagattataagatattttaactttagttaaagttaaactgcttcaagtttgatcaaacttatagaaaaaatgtaacattttcaatccaagataaatttattataaaaatatatttaattattaatttaataaaactaatttggtaatatagatattattatatttatctataaacttagttaaacttgaagcagtttgactttgatcaaaatcaaaacattttataacctgaaacggagagagtaacttctttaacgcatactccctctattacacttctgaaaataaatctatatgtatgtcgagatttatcttcataaattctttttgatacagaaagagtattttttaaaaaaaaatagacagagagtttttttaaaaaaaataaggaacacaggaggggagaataaaaaaacaaaacaatccgagattacaccaacataattcaattcttgactacatcttatctctctcattcaatctaaacaacgaagaacgaagtctctcttaagaagcacaaattgcacatgtagatttgtcttgaaaagtaccataataaaatcataggcttactaggtactataattttattcgatgtaaactggtagtcagagtttcaatcctaaacataagtctaagtatataccgaggatgaagtttctcatgtttaccatgcatagttctaccacctactaatttgctgggatgtagaagcgcaatagaatatatagtttgtcattgtgccaaggagaagctaccacatggttaagatataatgcagaaccatgttacatgtgttttctctaggttttggaaggtcatacaatatgattgtgtttatgatcttacaatatatgtgccaacttgttgttttactcaaaaatatttcatctgctcacaatctctatgtatgttgagtgagatgtgcatccttctcgagtttaatttatcactgtatccttgtggccattaaacaaatcaacatcatttaacatgtccacgttgtttcttattctgcttttctagagagagagtgtttttttttctttgacctaccatggtaaatcctagcctgtataaactggaaatagtattatcttagataaaaaaagagtgggactagtgaagtgggcgtagcgcaactgattaagtttttatcttgtggtgaaatttgtccacctaaatttaaattttacacttagcataggttcacgtattaattattttttcaatggaggtaggcgggtaggatgtgcttataggagtaaatgaatgaggctaaagagtacagttcccatcgattcacgtcttaaattttgttagctatatgcctagtcaaagtaactaaaatgatggatatatagttaattcaagtgtcggcatttttagataaccaagcatgagtaaataatagtgtcgataaaaaaaacaaaaagataagactcctactacatcctagtcatacaatatggttacattactatatatctgccatccatgcactatgtgccaatttgatgttttgctaaaaaattaatcaaagtaattacaatctacttgcattgcattccctgtcgaagggtgatcgataagggctgaattagatccttgtggacttctaaaaaatccacacagaccattagcatatctttgatctaccacttcaaaatatacttaaatgcaaacaagcgttggtaagatgttgacaagatatcaatgagcatgttaagtacagctcggatccattgacacacatctttaaattcactatgcctggtcaaagcagctatggaacgatgcgtggtcaagcaagtattaagcatttcgtgttaaattaaacaaacaaaaatatataactctttgttgatcacaaatctcccaaataaaataaaagaaaaagaaatgaaaaatggcaccgtactagatactcgtacttgaggttatccatgagaaatctaatgggtgaacgtttcctgctaaacagtgctcagttcagcccacctcctagatgtctccagcacagcacctcgagctgtctcagaaattttatacagcacatgtattacctgggtatcaaaatatacgataactttgtacaccaaaagattatatgttcgacaccaacatagaaaaagttttcctaagtagaatatctctacattaaaaggttatatatctataccctttaaagaaggtattggtgatgacagtaaatctgtcaccccatctacttacattataaattttgcagttagcccttaaacttcttaatattaaaaatatcaaatctaaatggaaagccacatacaaaattagattaagattaatattccctatagcacaaagatggggaacacacttctactttttttttaccatagtaaagcacatgcatttagctcatatatatagtactaattatgtcctaaaatataagagatttaatttgtctatgtacttatatgtgtaaaatcaaagaaaagaaaaaaatacgtgaagaaggaaagcgcagggtactcaagcaagttcgtcacatgaacgtttgcgagatagccctttcaaagagggagagcacgcacatggatattctagtctttcttaaaaaaaaacttagggaatattatgattaaggccaaaatcaaccttatgccaaattattggcaagttgacaggattgccaaattttggtaggatggaataaatatgttgtgtcaaaattccctatgcgttatcaaaatttggtaacaaactaaatgcagccatatatttgtcaattttaccaaacaatggtatcgtttaaaatggcaccaatctaaacgggcccttaaatctctatatacttgtaaaagaaaagaaagatctctctcctaaaaaagatccctacgaaaatggtggcaacaatacataatgtgtacatgcttaaatcttgttgttccacatatgagagcgagcgaatacatattcatttaggataagtgtaatgggtgaaagtttagttgtcgcgcgaaacatatctagtctattgtccggggttgtctgaggaagttttttaatataaattttatatatagaaattaagctaagcttatgacagagtgacattcttttgttttccatgttgaaatccatatctaaattaagatttatcagcgagttgtcagcgaacgcttggctacttggcccctcttggttatccggataagatgctccaattttccgactattccctccccatcccccaccacgctggagaccgcaagcaaaaaggtccacgctactacagtctccctaatctcagccgtccaccaccgatccgacggctccgctccccccgcgtgggatcttttctttctggaaggatcatgcgacgtggagaatattcgcagtgagctcctctggactctggtaagcctctcgcgctccggcccttttcagccacttacactgacaaatggggcctacgtcgcttggtccacgtggggtccacctgtcagcgagaagaaggtcgctgcgggcctgtcactagcagctcgcgcgtgttgtgtcccacgtgacagacaacgcgcggctcgcggacgggccaacgacctgctaaacggtggggcccacaggtgacgtggtgtctcgctggtaggtgggtcccacctgacccggaacagatctgggcctgtcagagccacgcgcacgagctactactgctagtgactggccacagtactggctggtgccattggtcacgtggcgtggaaattgcaaggtccacgcgactggcacgagcactttgtgctcttttccccccttttttttagagtatttgattatttatgctttattttttgaaattttcacattaatcttatgatattctttccaaatatatcaaataatagaagatattacaaccttcttgttaaaaaaaaatcagaaacccaaagaaacaaaataaagaggctctatatcttatattgtcataagagaaatgagtatacgagagcagtataacgctgaaaaacaccggcataagcaaaacgatatgaaagagtatcaatcaccatttttcattcttccaacagctaagtaaactgacattaccgaacaaatcagtacctcggattctaaagcatacacagctaattagatcatcctcaatccaacaaacaacttcttctagatctctaatgaggtagccattgaaagaaagatagagaagaaaatactccaaacaaatcttactctatagataaaaataaaatctaggatggatataaaaccctaaagactatattcgagcaaaaacctaacttagggcctgtttgggggagcttttagtctctagctgctgcagcttctcgcataatcagaagctcccctaaacagtccagtttttggtctagattctaagaatctgttgttgtagaaaccagaaaatgaactagaagctagaagctaagaaacccagtttttttagattctcataagctgccttctaaccagctgcttctcagaatcttaagttccccaaacaggcccttagaccctgtttaaataggactaaaacttttaagtcctatcacattgcatgtttggacactaattataaatattaaatgtagactattaataaaacacatccataatcttggactaattcacgagacgaatctattgagcttaattaatccatgattagcaaatgtgatgctacagtaaacattctctaattatagattaattaggcttaaaaaattgtttcgcaaattagctttcatttgtgtaattagttttgtaagtagtctatatttaatactctaaattagtgtctaaatatagagactaaagttaagtctctgaatccaaacacccccttagttgctaacggaagaaattgattctcttttcccgtggtgatgaggacgttagagacgaaggaaggagttcggaagaccctctcgctaggttgacaggggctacaagcctgagacccacaaatatgcttgcattatccttaacgaatattgcgatattttttatttatacaaaatgttagatgttttttcattgatccaaaaaaaatgtttttaattaaaggcaagactttatctttcttgaaacgaaggataatccccattattcttttttctttagagcacccatttttcatcgattttccacaaaatctcatcgattacagttgattcttcgaccctccgatttgctttagattagtgctgaatattatgatttgagtatgtgtggtttgcgatccgcgctagctacctgcaatctatcatcgatgtattattgatcgagagcagataatcgctcaaacatcaaatgagagagaaagaggcccctaaaactaacactacagacctatatgtgcacatcttttctagctaggtaatgtgttaattaagtgtaattattagagatgactaacaaagttaattacacaccacttacatcccacttacgtaacacttacatatgtaattttaggacttacattataaatacactaaatttacatactccctccgtccaaaaaaaaaagacaaaccctgaatttccgtgtccaactttgactgtccgtcttatatgaaattgttttataattcgtattttcatgttgttagatgataaaacatgattaatattttatgcgtgacttgtctttttaatttttttcataattttttcaaataagacggacggtcaaacgttagacacggaaatcaggatttgtcttttttaggacggagggagtatgtaatttatggacttacaatgtaaatacacgctgactatttttttgctgaaaaatatggcgccataaatatagctactcccttttgaaatccgatagtcatttaggggttgtttgggctatttgggcctttctttgtgctaataccccagcccagatgaaagtttcagccttgcactattgggctcaactgcatatggcacagtccaatcggctaaacttcagttatttcacgcgcaaaaatttgacaaagcctgatgctccatttcaattacagaaataaatatggtttcattccagttggcatcctccttttcttgtggctatagtttccattggctatagcctgggtgtggagattatgggtacgccatacccacacggcacggttatccgattagttataggggataacctatatctatggaatatgtaacgaatcatgacttgtgtattatgtttccttgtatatattatagaacggcctaaaatcatagtttgataatattgtaaattagatttaggaaaccgataccgtattggttgggttggttaaggtttttatcttgtaatcctgccccccatcctatataaggtgggcaggaggtcctctaggggacatgagcacatatgatcgtcagatctatactacacccggaggattcaaatccccaaacaggagtagggtattacctctcattgagagggtctgaacctgtctaaatccttgtcttcgcatctatccacttttaggtctcgtgcgctaaccccttttattattgccgaattcttgtttcaacagttggcgcgccaggtaggggttcgccaagtttccggcaacgagtacgatggaatcaacttcatgagtcatcggcttcgtcttcgcttcgggatttttacttcctcgctgccgataacttgaacatgctctatctctctgacttggattcaaaccggtcggaagagattcaatctatagaagagaacaaacactcaaccatgtcaggagattcagatcagccgtgttgatcgcatgcatctactgatcactgccacatatgcatctatgcatggctgcctacgagaccatctaatcagaaggagttcgtctaactaccaggttgattcttcccgagtcagcaaggtcgagcaaagcatcaggatattaatccacgaaccagatcagatcatcgagtctgttggctccaatctttgacatggatcggtttgttattcttgttcaatttaattagattaatctccaattatgatttgctcttctggtgttttcctgcaggtcggcttagatcaagacggagccgtttgcagcgccctcgtacatagaggttttatccatgagcgatccaaatactggagcagcgccgacggacatcttgtggccaccacgggcacatgggagcagtcgcctacggcttacccggaaaaaatacatccatgaattgatccaactgataatgcattactaagcatcacgcttctataaggaaatattaatttccgaattctaactagattttctatctattttcatgcatgtatctctggagctaccatgtcacattgtggcagttggattttcggagttgtgatctccactgccaaccggtgtcatttcatcgtagaccgctttcgtcgtcgccgaccggtttcttcatcaccatggttggttgattccaccgctgttgcagatggcgacatcattttcaccaccggccgcctacgtcgccgtcgacgggtgtcctcgcctatacggttggttggtcacaccaccgttcataggcgtccatgtcttcaccgaccggcttgccttcgccgccgctgaccggtgtctctgcctacacgactggcctattatgctgccgttgttgggcatctatcgttttcaccgaccggccgcctcgtccaccgccaactggtgttttcgcctgcacggctggcctattacaccgccgttgttgggcgtctacgtctttaccgaccggccgtttcgtctgctgccgactagtgtctctgcctgcatggctagctattatgtggtcgttgatgggcgtctacatcttcactgaccggccgcctcatctgccgccgactggtgtctccgcctacacggctagcctattatgccaccgttgttgggcgtctatgacttcaccgccggcttgcctccgtcgccgccgactggtgtctccgcctacacggctggccgattatgctaccattgttgggcgtctacgacttcactgccggcttgcctccgtcgctgccgactggtgtctccgcctacacggctggcctcccgttgttgggcgtctacgactttaccgccggcttgcctccgtcgccgccgactggtgacctcgcctatacggttggttggtcacaccaccgttgttgggcatctacaccttcacggaccggcttgccttcgccgccgccgactggtgtctccgcctacacggctggtctattatgccgccattgttgggcatttatttacctacaccgtcggtcgcctcagctgcttacacggttggtgttttcatcaccattgatagactacttcgttcctatatcgatcacctttatcgtcaccgagggaaatatcaaaaagctaagtcatcattattttattttatttatatgatattgtccttttcctctgcctcaatacatcaacttgctcgccgttgactagtgagtcgggggctacagatgttatatcatatttttcaacatttttcataatgtctatcttgattgcttgcgacataatctaagtacaaaagtgcctatcgagttatggagttctatcttcctatgctttccgtttggtttgtcgatacatagttgcctttgggccgattcctagcacccgggggctcgttggatggaccgagtaatgcaaggtgctaagttcggaataaatcaaaagcatagagataagataaatttattttctgctcttaacaattgcaaaagtactcgagtagtaaactctgatccatgaaactttgttccattaatgacgaactcatgtcactcgtatgcatgtttgggaagtgcctaggctgactcctggtgcttgggggctatgactagtcgggcagagtgttcaaacgtaaggagtcatccgctcggggaaatcaaaattgacaagaggagaaatacatatttataaacattttaaaatacttgaatttttctcaagtattgtatttacatcagatactactcatcctatatgtttgttctgcaggatccagatccagatatgcacaatagggattcatggctttaagcttatctcctacgctttaggaatggatcagtcagaacatcaccgccggcttgccttcgccgtcgccgactggtgtctccgccaacatggctggcctattatgccgctgttgttaggtgtccacgccttcactgaccggttgcctcgtccgtcgccggctggtgttttcgcctatacggttggttggtcacaccaccgttgttgggcgtctacgtcttcaccgactggcttgcctttgccaccatcgactggtgtctccgcctgcatggctggcctatcatgccgctgttgttgggcgtctacaccttcaccgaccggccgcctcgtccgccgccgactggtgttttcgatatacggttggttggtcacaccaccgttgttaggcgtctatgtcttcaccgccggtttgccttcgccgccgccgactggtgtctccgcctacacagttggcctattatgccgccgttgatgggcatctacatcttcaccgccggctcgcctctgtcgtcgccgactcgtgtttccaccaacacagttggttggtcacaccaccgttgttgggcgtctacgtcttcaccgaccggcttgccttcgccgccgttgattggtgtctccgcctgcacagctggcctattatgccgccgttgttggacgtctacatcttcctcgaccagccgtctcgtatgacgccaactggtgctatcgtcttcacggctggccacgtcgccgcaaccgctaataggcgtcatcatcttcaacgcaagctgtctacgtctgctgccgactggtttctacatttccgtggctgcatgattctgccagtgttgattggccttatcgtcttccccgccggtcgtctcgtctgctgctgactagtgccctcgcctctacggctggtttataccgctaccactactaatggacgtcatcgtcttcattgctggccgccttgtctgatgccgactggcttgttcgcctccacggctgcatgtcttcgtcatcattgactggcgtcaacgtaatcaccggcttgcctttgtcgccgctcatggtgtcttcactttcacggctggcctattttgccgccgttcaaggacgtcttcgttttcgtcatcattctacttcttccatcgccgactggttatatcgccgctggctggtgtttttatcttcacaactacgcgtcttcgctaccggtttgcttctgttgctgccgactcatgttcacttcatcacggctatgcaactttgtcgccatggtggagcgacttcatcttcattgtcttcggtaccggcaaactctattgcccctactttgcaaactttgctacttcaccaaccacaacgcttacaagagcctcgacatctcggcattcactaccaaatttgacgtcatgctaatctactacaagtggttcttcaattttcaagacttctactcggacatcttcaacacatattttcactcaagcaatggctactcgacgacaagaagctacagttctcgactctatgttcagttgtttcccaactaaccaaagagtcgggggctatacaaatacaatactctcaaaattcaacaagcagaagcaatcaattatcagccaacgagtcaactccaagagtcattatcttcgtctttacttcggagcagaagttctacttcagcaacttcaattatttcaccggcaattttggcttttccatgccgccacaatctactccaaatttctcaagtatcaagtttgagatttaatctacatgtccaggagtttagagttatcaaccaatcagcttagtttcgacgagttggacaacaatatttatttaccttcgagtgaagcaccttctacggctataacaataagttctacaatcatctttataaatcaaggggcgtcgcatcagtcttcgttatgcacacgctcgcatcaaggaaactactcaagcttcgatattattgtcactcacatcataaccgacacctctacttcatcggccctgacatctccgtcgttgctaaggggtgactatgtcttcgccttcggtttgcttctgtcatgaccgactttcatcgccgacttgttattttgtcttcacggttggcctactacacaactgccaatgggagacatcgtcattatcatcggctgcgacactgctattgactggattaatgatatcatcatcttcatcaacatcctaccatgcctcttcggctatgcctactctgctgttgttgatgggctacttcatcatcatacccggttatctctgttgctgccaattgtcattatcgccgattgcatttgtcgtcaccgattgttttcttcttttgcatgattgatggatttcgccattgctattgatgagcgtctacgtctttaccaccggcttgcctccgccgccatccatggtgtcttcgctttcacggttggcttattatgcctctactgatgggcgtcttcgtcttcttcaccgggcacctcgtctgttattgactgattattttgctgccatggctacacaactctgtcgccattgctgggcgccttcatcttcactgctagttgatctgactgctgccgactggtttcttcgcttccatgccgattgcatcagctatcaccaatggacaattttaactactccaaaaggataagctatatgctcaagggcttacgagctcaagcacaagggtcataccttcaagttggattttgttctagatacagacaacatgcactcgtagtcctgagattattttctatgctcgaagactagaccaatcattattccccgtaagggctatcaaccgaatacttgcgccagtcgggattcaatttttatatctattttggagtatcccataagggataatcactagatcagaagctattcatgtgagctacacttggtctatatcacccggaagatttattactcgggagcatgttacatgcgtcatcctttaaagggtgtcgaaggcatattttttggcctaggcctaatatgtctgcagcccatattttcaggtgtggcctgtcacgttcgtttagggacttaggcactttttgcttaggccaaaatgcacgtgatcaagtgtccaataccttaaaatccttttataccgcagttactcaactttttaggagttgatacaatgcatcttaaaaggtgtcaaatagtaaagttttatatagctgccccgctgacttttttatataagtcatggcgttgtttgggtttaaaaagcaattgattagatacaatatcgttgtttttttgccatgtaagtgtgcatttcttattgaccaatattatggcttaggctgattatatatttcggtcattttctaagcggttggtaaatcttttatgactttatttactcggatttcatactacatatgtcatatatttccaggtgtggtgaaaccacgtgtcttttagggacttaagcacaattgttaaagcaatgtgcgcatggtgtatgcccgatactttggaaatttctttattcacagcattcaagcttttttatagctgttttgctatgtgaattttcaatgatgtagtcaactttagattgcacgcatcatattttataaagcagtcggtatatcacttggatcatattattcagggattcacaagtcacttggttgactatagttatcaaaaaccacttggttggttggattatttattccttgactatatgcttagtttgttcaactgaccacatagtcgggggctacacttattaggtgcatctagtcgatgcacctgactttattttttcagccctccacagtcttctgatttggaaaaagtactcgggagatcatggcgaagatgattgaagcactcggctttggagtaatctagttcgagagaagattatcttttcgactgcgaaggtctcaggggctactgtggagactatgggtaccctatacccacacggcacggttatccgactagttataggggataacttatatctatggaatatgtaaggaatcatgacttgggtattacgtttccttgtatattatggaacggcataaagtcctggtttgataatattgtaaattagatttaggaaaccgataccgtattggttaaggtttctatcttgtaatcctgcccccatcctatataaggtgggcaggaggccctctatggggcatgagcagatatgatcgtcagatctatactacatcaagcggatttaaatccccaaacagtagtagggtattacctctcattgagatggcctgaacctgtctaaatcctcgtctccgcatccatccacttttaggtttcgtgcgctacccccttttattattgccgaattcttgtttcgacactaggcaatcacaatgtattaaaaaggtaaccttaagataattattacacttgcaaaaggaaccacgtacattatgggaaataacttcagcttagaaatgcaccttatgcttaagttctactacaagaaaaaaaattatctatctcatccatctcatgaacatgagttaagcaagtttttctatttcatgtgtgtgtctcatcttgtggttaattaggtcttagctataccatcgtgaaaattgctttaacaattagtatcaactactccgtattcatgtacccactctcaaggttaagacactgtattcattgagcttacccttaaagccgtgcgtgcgtgtgtgcgcgatcgaaaagcgccgccctcgcgcgcgcgcgacgggtcaacccgcgcgcgctcttgatccaccgccaccaccccacctacgcaatccgatcgatcgccacgaaccctagcttagccagatccaatataggagtatgagtatacagctacccatccttataaatcccgaatcccgaggccacacatcttcccatgtcagatcatgtcgaccatccatccaaaatatatatagcagcagctagcagcgatgatcgatctccatttcacacgctcgctgctgggcatggcgctcatcatgtcgccgtcgccgccgctgcgagcccccctcctcgcgtcgccgccgccatcgtggccggattgctcctgctggcgcccgccgcggcgcagcagccgcccccgctggtgcagcagttctactactactcgcccccgccgccgtcgtcgcccgtgggaggcggaggtaccggcgggggcgggccctcgccgccgaccaaccccgcgccgccggcggtgccgtgcaactgcgggacgacgacggcgccggcggcgccctcgccgccgggtgtctacaactacagcgcgcctagcggcggaggcggcggtgggggccagctcgcgttcttgtccgggtcggcgaggtcgacgtcccacctgccgggcggcggagggtggcgccatgcgcggctgcttgcttctgctgctgctcctctactactaatagtatggtggtaattgatatattagtcgcttgcattattcatgatccatatgtgtaagtgttctctgtaattttagctacaaaagtcaagatacagtcacagatggctgaggactgatcagatcgaggagttaattaattagtcaaggcacatgtatgagtaaagtcgtcgactgatatacggaatctcttttgttgcgaaatggaggactcaaacttgatcttaaagctgaatgcaagataatggtactccattattaatcaagtcataggtgacaacttctaaattcctgataagagtttgtatatttcatcggaatttggtaaacagaacacgtgagtgttgcgttttcttttattgctatagtaagtgaacgacccgataggtcggcttctaatagttaaatgcgaaaacgttcccaaagtaatgcaccaaaggccgcaacctagctgaatgcaacttaggttgccaatgagctgagctcgagcgagctcacctaccttaggctcaagctggacacaaactcaaatcaaactcgtgtaatcttcgagctttcagataagcttggttcaaactcgatcaaactcaagctccactagcaagcttggcttaggccccattctaaagtggcaggttaatgtgttgctacctactattcagagcgccaattcagctcagcccagctaagtctgcactttagaatggagtcttctaagtagaagtatgcatattttaagaatataatctcttaaaaataattaatttttagttaatcacattaataaaagagaaaagtatatatggtactaatacaagctacttccttgtgtgggtcacatacaaatgatatatttgatgttctagtttattaataaacaataaaaatcatatattgttaggcacgttaagagatcgagctcagctcgataaagttagtaggctttggtataagctcgagctcggtttttatagaactcgagcggagctcgaatccagcctagggcgagccgagctcaagtagcttgtgaacctcaagccattttaatagccctagtgcaaccaacagtaatacatcaaaggcgcgcaactatacgaatattggaaattttgaccagacgaaaagttccatgttatgggttgtgaatctgtcgaacgcttattcgggagaaagagactcattagagcaagtccgtgctagtgtgccggcctacatcagcctccgaaggctctaggccattgttttacaccgtattgacaaaagacaaacaattaataataggggcaattgcgcatctgaccctctttttttaagcctaactaccatttaactctcttttttttaacttggctcgtttgacccttctttttaaaattgaagattcaatgtgaccatattctgttaagggcatgtaacggtgttaattggagcaaaaaaataccccttctacccttggtcagttgaccctattttatcaaaagtataaataaaatattaaaaaaattggatagcataagaaaacatgcagcttgtgaataaaaaaaacagaatccacagcaatcgtcgtggccaaccaggcggcggcggcgcgcgtggaggaagacggacgccagcacgcacgcggaagaagacgaaggccggcgcgcacgctgagggaggaagcggcgccctgtgcagagctcgagctcgtcggcgtgcggagggcgggcggcggcaacacgcgagcggaggcgagaggcgcggaggacgagtggtgacggcgcgcgcgcggggagagaggcgcggaggacggcggcgagcggcggcgagcgctggagagcttgccggagtggagaaggtgtcgcgcgtcgttgccgacctgcagtctctgagaccactgccgcaccgccatcatcaacccgccgccaccagatacgcaacccgcatgccttgacgccgccggattcgcggcttgcacgcccagccgctgacggatcatccaccgccacaacccgagctctaccgccgttgctcctcctcgtcgtcatcgagccgctgctgctccttccgctcgccacagccgccgtcaccgccgctcctttctccgtgcacgtgccgtcggcaccgcggcgccatgcctctgcgcgcgcgccccgccttctcctacgccgcatgcacccagatagatggggttgggaccgaatgaatggatagggttgagttgtcaccatgggtattttggtcaatttgactagtaaatagcactattttctttttttctaaatgaaaccctaacagtgtggtgaaagtagggtcaaacggtgacttcgattttgaaaaatggggtcaaataagcaaactaaaaaaatctaggtcatattagtagttaggtttcaaaatagagtcaaataagcaattgtctcttaataatatgtggttagaagggtacgttaaggcaaatggataaaaaaagggttagcacttgaactttactttaagtttatttttgagtaaattgcattggtggcatacaaacttaacatttggatgcaatctagtacacgaatttacaaaatgcttatttcagtacacaaacttgtttaatgagtgcgaaacaaggccaaaatggcagacaatgacaaagaatttctgagttggagcctacttagaatggcatgagcatacataaggggtcatgatacacgctacatgtgcgaatagcctctacttggtaatacctccgtttctaaatatttgacaccgttgacttttttaaatatgtttgaccgttcgtgttattcaaaaaaatttaagtaattattaattcttttcctatcattttattcattgttaaatatacttatatgtatacatatagttttacatatttcacaaaagtttttaaataagacgaacggtcaaacatgtgctaaaaagacaactgtgtcaaatatttagaaacggagtatttatttttgttatttctttgttttcaattcattgcattctttagctatatttcatattatgtccgtataatcggtatctcttattatatatttggttgagcacatatatacatgtcaagatgacatcatcctgatgtgtgcctgtatgacatcctaataaacacaactaagtaggtagtaggattaactagggcatgctcatttgaaggttctcatgcaccaaataagtttgtgcatcgaaataagcgttttgcaagcttttgtgtatcgggttgcacccacttcacaagtttctgtactgtcagtgcaatttacacttcattttttaccctaagctacagaacctatacatgtttgtcattggttttgtttgaaatggagatgattttcctatttcatacttttatgttcctgatgcaatgtcatttaatttggttcacaaagttcatgctagcaaaaaaatcactatcatgtcaatcaaaaccaccatacaaatgttctttagaaaatatgtatccgattttgaaagacatgggtgaaataactagttttgtatttgaggataaaaaatggactttcacataaacaaaaaaggtaaaatttataggttgattgtgttaactaggtgacgtttcaaacagccattgtccccctatattaatggcaggggtcaaaacccttcaattggactcaaatataacataaaatcaactcaaatccttttcaaaagtcacaaactgacttggaccagaagttcctatactgaagaagcgtgcgctttctatctgtttgattaaaataaggccatatttgtttaggcttataagccaaaaagtctctaaacaaacaatcagttttttcgtttggcttttttgaagccataagccactctaacactaagggcctctttgtttaagcttataagccaacttataagtcgaaaagtctaagcctaaacaaacaagcagcttttccgtttggctttttttgaagccataagccactctaacactattaagccaaaagctaggttggagaagcttttttggcttatgtgaggtagatgtatgactcaactactaaacttaggacattaaatccaccggcttataaatcatataagccaataagctgacttaaaagtctaggccaataagcctaagcctaaacaaagagggcctaagccaaaagctaggttataaaagcatttttttttacttatgtgaggtagatctatgacttcaccactaaacttaaaacattaaatccatcgacttaatgttcagataagccattgattgaaaagtctaaaccaataagcctaagtctaaacaaagagtacctaaatcagccaaaaggtccgattcataaccggaagtttcagaatggaactattgtgtccaaaaggtctgatttttcagcaaatcaaattccgtctcgaactatgtccatatacctaatatatattccgattgatatagccacattgcacagtgccaaacgttggtgtaaataatgcgcttaatgaatatttggtgcctttttctgtggaagaaatgatcgggacgattgaatatgtgtatgcacaaagagaaacagagcatgctcactatgggttaattgggtatatcagaatccaattgtgcaactgttggttatatcttagaggagaaaaaagaattacaatatcctatttggcgagtctgttagtaagaggtaagctctcaactagcttgatatttaatcatgttttagagagggtaaaatctaaatcgagagagctctctatttagttttaatgggagacaccacatacatgtcttctttgctacacatgcatgccatgtttgctattatgtcatatatattttttccttcttataaaaaaatttctcttacattacttatctgatctacaatccaattacatcattgagttcgttacaattaaatctttataacaagatcttacatgattatattatgataaaaaatatttatgtttataattacttttattatatttttaagttacttttattacgtattgactccgatgttgggctcaactacaaaggtctgataaggacataatgctaatgaataatgcatgccataaacttgagtcaacggtcatgcaaccctttgccaacatgggtgaagattcacaaataggatccaataattatgttttctttatcttgtgttggttttcattagcgtgtgc

SEQ ID NO: 1751 - DNA, 25370 bp, Oryza sativa
  unsure (1)..(25370): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcactcctattgcacctcattttaaattatcagttttacaatgtgctagtactgatgaggatgtagaatacatgtctagagttccatattctagtgctgttggttctttgatgtatgccatggtttgctccctgccagatttatctcatgctatgagtttggttagtagatacatggctaatcctggtaaagaacattggaaagctattcagtggattttcaggtacctcagaggcacagctgatgcttgcttgaagtttggcaggactgataaggggcttgttggatatgtggattcccattggtagttgtgctatgagttggaaggcaacattgcagcctgttgttgcccagtctaccactgaagcagaatacatggctattgctgaagcatgaaaagaatcagtttggctgaaaggattgtttgctgagctttgtggagttgattcttgcattaacttgttttgtgacagtcaaagtgctatatgcctcaccaaagatcagatgtttcatgagaggacaaagcacattgatatcaagtaccattatgttcgcgatgtagtcgcgcaaggtaagctaaaggtatgcaagataagtactcatgataatcctgctgatatgatgacaaagcctgttcctgttgctaaggttgagctttgctcaagcttagttggtatagtggtttagcctgagaggctatttggcgccgaaagtgtttttttttgtctttgttgtgttcagggtgaaggattgattcatgctacaagaagggatttgtctcaaggtggagtctgttgagttgtgatccaaattcatttgcacttaatatcttcactatatctgggctgtgcgcctggggacgcccggaggggcgggggcagagcccccgcggtacggatcatcatcccttttagggttccactatatatatacctcttgtaagcccccgtgcggcgatgtaaccttacctcagatatagtgaagatattttgctggctggcgcctgtggttttttctctcctgttttgggagggttttccacgttaaatctcgtgtcttttgtgattgatctattgttctttatcgtttgttcgcctatcgtttcctaacagggagtggatctatgtcagaacctggtctcgcacagcttcacagtggaggtggtggtgcgagctgaataggcaaaaccagcccgtcgtccttgccggcgttgtccactggctaatggatgcctcccgcagtagccactacatcctgacgtacgacattgcgacggcggaggaggggaagatggatctccccaccgattattgtggttgcaaggaaatacggttgggatcgtcgccggaggggaggctgaggctgctcgtccttcatcagcacctctcgttgtccgtgtggctgttctccggctccggctccggctggacaaggcacatcatgatcgagacggagagtaggctacggtgtgtgtacccgtcgtggagcgtggacttggagttgccgtggtcgtgcaagtgggagaggagcgacacggtgttgctgcgtcccatggactactccgggtccgggtggacaagatgcccactagggttgctggtcttggacgtcaccatgggggaaatgcgtactgttaataatcggagcgaccaacttgttctctacgcagtcgatctcccctctcgcatctcagcaatgaaaacctactagctctttttttcttttcgagtatacatgcatgtcggacacaccctcatatacttgcaactagcgagtattatcttctcatgcatcaaataataatccagatacatgattaattaaagcatttatacttgaaagacatagccccacgacatgtttctgtgggctggtataccaccacggtaccccggaaaggtactgtaacaggacccttcacataaccctctctaaccaatcgcaccacacctcaggtttcgcccccactcctcaaccagacaccccatggacagcccccctctcgtgccatggtgaattcggcggccgatcaaccagacaccccagccgacccaactccatcacgcccaccctagcctgggtacgtcagctagaggaaagatccactacaagcccagttgttgcccacgctggctcgtggtatgcatggtaattcttctagggtttcccgtgaaccagtccttaattgccatgggtacgactagcaaaaccattcacacacagcccaccattaagccatattttagttgaataattacgaccaataaaacatggccagatgtctcgagctcgtatagctcaacaatatactaaagtaaaataatgtaattatcccattatgtgagctagtggtaattaagcacggctaagcatatcatgattctagcaagatcaacagaagtgacacaaggtagttagattatcacccaaagtttcacaaatgacggaccacaactaagtataactaagtatagcacaagcgagcagaaaggtaatcccataatccagtgtagttagtaaaacatgcaatttatttgtaaacggtaaaaaaattgtaaattaggttcaacatgctcaaggggaatgtgtgagtgccttggttcttcaatcaatctttaaactcttttccttgtgatcgcgatcttctgaaacgatggattttatgcgccggcacgcaaaatgaggaaaaatcctaataaaaatcaaatggacagtacatgaaaagtaaacaaacatgtagatcttaattttagatgaattttgcaagttgaatggctcaatttggagttgtatgaattagttatgaattttagaagttttgagccatttaaatcaatttatgaaattaatatcgatttattgcgcaatttattatttattttctcaaagaaaaagttaagcgctgatgtcatcaaaggagaccagcgcctacaggtgggccccacatgtcagtggcacaagggaggcggcccaccatggaccgggatcaccgaggtggtccaccgccgacccatatcagcctaagccgaccaggcggccacgtggtggcgtggccgaggcacgacgacgcccgagactggcctggccgaccatggtgcagcggcggcgcggggccaccggtggccacagccgacggcgccaaacggcggtgagcggccggaagacagtggcactcacgggtgacaacggctcaccatatgaggcggcggccggcaaggaagggggaggggagaatgagaggagggaggaggggccgagggagcgggatgccatggggaatgtggtagaggggttacgatgagcaagaggacgcttgcagcggcgtgaatcgctggccggaggcgagaaagagcggcggatgctcaactcaagcaaacgagagggagttccggtagcgattggagccggcggagcggtggccgaggggctgcgcggtacagcagagctgatggaggtggtgcgcggcttgaggtggtaagggacggcggcaagaggcgactagaggcggcaggcggtggtggagctcggatcggcggtggaagcggcgctccggtggtggtagagaagaaaagagcggtggccggggtgcggcaaggcgcggtgaagccaatggtggtggtggcacagcgcagcggtggctagagtggcgagaagcggcggccggagcactccggcgagtggcggggagagaaagcaacacggggagctcggacggaaagggaaaaaaatggagagggaggtgcggggatggtttttattggctcgggacagcgggatcgtgccaggggcgaagccaggataaatgatcgccggggtcattactaaccagggtctatgttttcaaccaaaacggactgaaaacaacgtaattttgatgttttgacttaggatgaaagtagattctgagagaaattttgaatagttttcaagaattcaaatttgaaatggtaaaattgaatcaattaataaaaaaaatcaaattttggttaaaaaaagtcatatcgctatgtttggaatccaatattaaatcaaagaggtggaccccgaatctgggtgtgttcggaccgctacgggttctgaacccttccctcccagcacgcaaaatgaaacgaggattaacgcataattaattaattattagcttatagaaaatttgaaagtagattaatatggtttttaaagccattttcctatagaaattattttgctagggaattcaagaagttgtaggtcgctggttttatgtatggtctcaaatctcaaaagctcaaatgtatatgcatattcagctgacgaataatcgtaagtgctagctaattttcttttcgctgctgctagtgtcgtttcaagttgtcaattgggatttaacacagcaatcaacaattaatgttaccggggtctaacatttatttttaccggggtcatagctagtaagataaagaggatacgagagattaaaagaaaatcatcgggtcgactaaccccggtaaatgactgtagctttgccccgggatcgtgcccggggagaggtggcacacgtcagggaagtgagatggcagcgcgggctcgtggcggggtcaaaacggcaccaatttttgggggaaaccgggggaagagatggaggagtgagtggtaggcgcatctgaacgtaggcacgaaggcacgatcaggcagggcgtgttgtgcttgggccaagacaaacttcatgtcgttggtcgatcgggccgttgggctgcggtcattttgaccaactataggttgctgcattctctagccaattgtatttatttagtcatgtatgcatttgtttaaaacaagaaaagcaagcgaataaaaggttgttggctgtgagagcctagctagccaccaaaagcctcgtgtattattgttcttgtacactctgtttatgtgtgtttagattagtgtgtttgagtgaaacaccaaacaatgagctaagggatttggctcccaacaagatccagggatctacttccaaaatcgaatacttccatgatcaaaaagtcccaagttaagaggaaacaacgttcaacatgatcaggtgttcgaaaaaaaatagaaaacaatcggtatgcaaaaagtattaggtagaacggaagcagagtttagagtttatcttggttgctcgatctacttcgtttgtaccatgcaaacaatgcacggaccatgcgtaagctgtgaaaacccagctagacacccatattgatctacaaaagcacagcatcacgatgtgtgatggacgaagagaagagaccggctaaactagaacttccacgaaggataaacgggcactgcagagacgggcgacggatagaaacactctatatttattaagtagataaaggtttattctttatgattgacacatgggccccaataatatggaggtttccatcgtgatatgccacgtcagcacatgaagtgggttaattaaagtctgtttggatcgacaaatttttcttggatccccctattacatggtcctatgagactatttatagcccctattacaggttcttactactagggttttggttatataggggaatttatatggttacccttatgaaagggatatttacatgggtacatagtataatagaggttcatggactcctgatgggccgttaggcgatcgtcggcccaatggcccctaggcttgatgggccggaaaaggcttcttcggccctcgtgggagggggggttcgccccgactaactttgacgtcttgggcttagatccccactcctcgcatagccttcggcatattttggtcgtagggcctcatgccataccgctaacaagcccctcacgggcaagggtgaatttggagcttcggccgagaccgtgcaaaccatgtggtatgtggtatggtatgtggcgccccctttcgaccgatgctcctgccgaaacctacattgttcctgcaaataaagtttgttgtctgtgcggctggtattgatttgccgctcttcgcctcctgcggatggtgatatatatttattattattatttttttatttttaccgggccgaaagaaatagtaatgggccttccctttgtgggctttttactgtgcagctcggtcgatgggaatttaccgtttcgcctaccctcgcaacacgtggcgctttatcactgctgggtagacgaaccgtcgccgtgttgggctatatatgctcccccgttatcttgtcaccgccaggcttgccactttcaccgctcgcgctctcttcctccgttcttgctctcacggcaccccttggccctttagatttctcgctcactccccttgttcgccactacacacacccttcgctacttcacacatccttcgtcatggctccccgcaagcctgacccctcttcggtgaaagggcccgaccccgaccggattgtcgacgacaccaccgcctatttagggatttctctcatagacgacggcgagctggcaaagttggtcagctctggggcgttagtcgagggacaggctttcgccccggggaaagccgttgtaccgaagcccgttgataaccggacagtgagtgttcgccgtattttttgagacggggctccggtttccgtgcaacgcgttgttgccggagattcttcgccttttccaggtggagctcccgcagttgagcccatcggcgctggtccggatcgctatcttcaactgggcgtgccggacatccgggtttgagccaagcgccgaactcttcggcgccatattcttctccaccgtgaattcgaagacggtgattaccccagctagaacgaagaagacagtgttcgggagcgtaaactttaatgttcgccccgagcggtccgatttctggccggtgaacgccgccatgccgaagtgggaccgccattggatggcgaggtggttttaccacaccatccccttcgaggctggttctgactccacaaaagcccttcggtgccggcgcagggcgattgcgccgaaccgaaagcccaagatcgccgtggacagcgctatggaggcgtggttcgctctactgcgtaagttctgctcccgccttagttgccgcgacttggtggaggaattctgcatgcttcgcatctttcccctctcctagtcgtgccaagtcgcagttgagcaaggcgaagaggttgatggtttgccgaagttggttctccctgatgggacgaacggtaagactgccctttcgcaatacactcctgcgctttgttatttttctttgttcgacgcttaatgtggctacaccctttatttttgtagtgttgaccctcgaccaggctgacaccgaagcccgtaggatgatcggcgacgtgtcggtcgtcaagtatagccagctgctaacgcgacaagcggttggccgggcgaaccgggtttacaacggcgaattgcctccccgggcgaacccccacaaggccgacgacgatgcaggaccttcgcgaaagcgaacgcgcgaacaagtaaagcttgcgccttggaagcgaagggttcctgtttcgtccgattccgacgccgacgacgaggacaacgtcgaagatcgtgacggcgaggagaaaggggaggaagaggaggaggttgaggtcttggtcgaaaaggccgcggacgagacggtcgaaaaccacgtcgacacccctggctatactcctactccaagcctgggtcacaatgagactggggtggagtcgaacagctccccccttcgtcgaaaggagttggttggggcgaaggtgctaattgcgttttcggcaggcaaggcagcgaagggaggtccggtcaaaaagatttccaagaagaaaggactcgtcgatgtcgctcgcgtcttcagcgacgacgagtcttttgacgagactccgacttctcccactggctgcagcctggacctttcgactgcccccgttctttcacttggcgttgatggagcaggtggtagcgccgccgccggggcttcagcctccgcggaacggattgtgacagctgtggtgagggtcttcggtagccctctgcgtcagccggttgtttcgccgctagtcaaggcgaaggggaagggtgcagccgtcgaaacatctacttcggagtattcccttgcggcgccccatttcgcccctggcgatttcgagacccgggcagaccttattccctttgtggagggagtaagcaatcttgtcttacctgctagcaccccgagcctattcaccgaactgaatgagttcgatgaggggtgttctgctattaaaagcttggcggttcgggtatgcttttcctctattcttggttttcctcttcttttttacatgtcccataattaacatttgctctcttcgccgttcctattttgcatccagattcttgcagctcactgttcgacagagcgaaccatgcgggctcgtcttgacagatttaagaaccgtcttcgggccaaggatgacgaaataggccgcaagaacttggagatggaggccctcgccaacaccctgaaagaggcgaaagccgaaaacaagcggctccaatccgagttggagaaaggaagagaggttatggccgaggtcgatcgcctcaaggccgaactggagaaagggagagaagccatagctgaggttgatcgcctccaggccgaattaaggaaagaaaaggctcattccgccgtgctgatggattattataaccttactgagccgaagatggaggctcttcgcctggaggtcagcaaggccgaagcgagcgctgtggaggagtcgcagcagttttcgcgggagatggcgaaaactaccgaatctgcaagaacggcgtgccaaacgcttcgcctcgcccttactgacatgggtgcaaaagtgcgaggggtctctgctgaagatgcctcggccttcgacttcttcgagtggacccagcaggctggtggttcggtttcggactgcgccactgcatacggcgattgctatgcacgtgtatcagcggcctttactatgggtctcctgcaacagttcggctgtgagcacgtcgccgagttccctaactatgtgaaggaagggggactgggagattagcgcgcaggacatttcgcccgcacatcgtgcatggcggaaacagttctggtagaaggacagccggtccaccgccaaggcacgccttttggagcaactagcgaaggcagaggcggcagacttttgcgaagaagaggacgcggcggctgaagggggtggaggtgatgcccaggatcacccagaggtgtgaggccctccgccctttccttagatttttgtagttttccttctttttgtgttcgccaggagtggcgaacgatgtgtattcggctagctgccgctaaccctccttattgtagccgaaaaagaggcccttggatattttgaatatatatgactcactcttagccactttttgatggtcgaagtctttggcgtatttatgaatacgcccatttcacattatgcaatacttttttcttttttcgcctattcttactatgcaattcgccttttgccctttttgcactgtctactagggtgttcgccgaaagttgtgtattcggcccccttctgggagtttgcgaaaccaaaacgagaaatttgtggcattaaaggatttgccaaaggtgcgatgcccatttcggcctgtttatcatgaaatggtgataaacggacgcagctataaggtttttaaggttgccgggtggcttcgggcacaccctgggtgaaccttagaagactatgatcttgttcattcaagacatttggaggacatggctcgcttttggcaaaatgtcacatcctgatttttgtttcaggatttataaattatttaataaattattattagaatttatattaaatgttcattaatttacaagtgaagttaaatgtgggaaataaaatttcctaaatataaaacatggatggatttaattttgattaaattctccatgattaattacactctctgaaattttctcagatttttcggagctcaattcttaattttttaatcatacaaagagcatttcagtaattacccacatattaaattaattattaaatggtctggttttaatattgttaaatactttgggtgtccaagtatgttcaagatttttcttggaattatttgagcataggaagtatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctcggcactgtttatcttctacctctagcagccgaactgagaccgatttggctcggtttttctcctccaaatctgacctttccccttgtgtttttctaaaattagttgaggggaaatattcctcttatcctcctctatctttacccccaaaaatcggagctaatcgttgagtatcttatccgaatcgaactcgttttcgagtttatctccaaaaccgagtttttgattttccggatcgatttcttgcgggaggagtccgatctcttcaatccaaggctataaataggaccccctagtcctcctctttcgttttccccctctcccgtgatctcccgtgcctcgtagcgccgccgccacgtgctccaccccgccgtcgtcgccggccgagctccatccgcgtcgcgccgccgcctccgtcgtcgccgccggtggccgtcaccaccgttaggtgcgcgggagggtggagaagcccggccgctctctccccgaagccgccgaccaccgcagccccgtcgccgccgtcgaccgaagccgggccgccgctagacctcgtcgccggccgtcgtcgttcgtcgtttggttcgagggtgagtaccgttgggttcgtctcgtcgtcctctacgtgttcttgtcctccaaagtcgcagccgaccatctaatctccggcgaggtcgccatcttggttcggccattgatgaggtcatcatcatgacgtcatcatcgttttttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttctttgttttgcgtgttagcttgtcgtttccgtcgttgcgaaggttcgtgagtgcgccggaagtattcaagaagattaattgaagaccgattattgcaaggcaagtcacacagaccctaaacacaatcctttgagcatgttgatcctatatttaaattctctatttatttcaactgtgcatttattttcgaatgtcactaggtggtgtgaacttattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatggtagctcacgatggttaatcgtgttatgataattaattgataactaaaacttgacaatggtgggttgtgagcacatggttttgaaggtcgtgctcatgacaattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgatgaggctgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctagtttggagttagatctgtacagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcagtttgtgtacctcggctgatttctggacgaggattttatgcacaaataagttcggaaattactagtgaatttccgggcgtgacacaaaaccatcagaagactgatcggcaggaggtgatctcccagcgttgttacagtctagtctgtatttcgtccccttctcctcttagggttgtgtatgatattagtagtgatgacgaacctagttcgcccgatcactccttagagagagagagatagcgggggctaagatgtaatttatctgtaagccgggctataacgccattgctcctttctcttcatttgtaccattgtgatgtattcttcgacacatttttatttaaaatcaataaaggtgcgttttattttctttttgctatttttgcattgtcacttcgcgtgcttttcgttgggtcggaacgtgtcgacccctttgtatatattagcgaaataggttttgacttttcagctttcagcttccgttttcgatccgttttgttctacgttacaaaaagcactcgtgctttcctttcgatcaagtgtaacggtgttcggctaattgttctccgaaacaagctgttgcggtttcaatcgttcggcgagcaatgcttcggccgattcgtttcacccccctgcctttttcgctgatcaggcgtttgccttggggtttttccgcaaattatcaatcgcacaaacaaataaaaagaaggcagaggacacaaattttatactggttcgggcctccgtggtggataatagccctacatccagttttttttttgtcttttttcattttcctctttttttccttttttgttctcttttttttctctttttttttcttgccgaaaggcttacatagtgccgaagggcttgcatagtgtcgaagggcttacataacgatatatacatttttacaagttggcgatttgggtgccacccgttctagacatagaaacgcttgagagaggcagcgttccaggaatggtcgaactcttcgccttccagtgtcgccagtcgaaaggatcccgtcctggatttgtacttgatgaggtacggtccttcccacttcgattcaagcttgccaacggctattgggttcgcttttttccttaggacaagatgaccaggcaacaactccgtcggtcgaacttttttgttgtaagttgccgaagtgcccgtggcatacttttgcatgtgctcgagtgctttgactcttaccccctccaagagttcgagcgacaactcgcgcccctcttcgcccccagagaacgtcacccttggtgagttagcccctagctctgttggggtcattgcctcatcgccatagagaagcatgaacgggctgaacttgattggtcttgtgggggtcgtccgaagggcctagagaacagatagcatttcctctggccatttgcccttcactgccccctcaagccttttctttagtgcttctaggattttaccatttgtacgttcggccgctccgtttgactgccggtgcgcgaccgatgcgaacctgatttccaggttaagcccttcgcacatttctctgaacatgtcagagtcgaattgcttgccgttgtcagtgatgaactcttttggcactccaaaacggcaaacaatgtttttccatacaaatttctgtactgctgccgaagtgatcgcaccaaggggttcggcctcaatccatcgagagaagtattcaacggccacaattgcgaacttgtgccagttttgcgccgccgggaacggcccaataatgtccagtccccatctagcgaagagccaaattggtgcgatgggctataactcatactggggcgcggtttggcttcggccatgacgctggcaactttcgcacttcttgatttgctcaacacatactttcaacacagtgggccagtaaactccttgtctaaatactttggaggcaactgttcttgcggcttggtgcgcgccccatagcccctggtgtatttccttcgccatttcctcgccttcggtgaaagaaatacaacgaagcaacggttgaagtatcccggagcgatagagctggcccgagaccatcttatacttcgtggctctgaattgcaaacgctttgcctctgcttcgtctaccggaagccagccagtttcaaggtgcttcacaaacggggttcgccagtcgtatgggtcttcgcccaatttgacctggtagatttccaggacctccaagctgtccatgggcacgcttggtgcatacaggacctcaaaaaggatgctaggcgaatgtgggccaccacaagcggcagatttcgccagggcgtctacttcctcgttctggcctctaggtaaatgtttgaccgttatgccggtgaagcacttttccatagaccgaacggcatccaaataccttttcatcccttcttttgcctcaaaagacttgtcgacatggcccaccaccagcttggagacggttcggattagcaggcgccgaatccccaatgctttcgcctttcttaggcccaaaagaatggcttcgtattctgccgcattgttggttgtgtcgaactgtagccttgcagcataccgaattggcacaccatttggcaaagtgagtactgccgcaacgcccgcccccttgtgcgaccacgaaccgtcggagtacatcacccagggctgttcgatgggctcgggttcaggggcgaatgctggtgtccattcggccacaaagtcggctagcacttgggacttgacagcagtgcgggcaacaaaatgtaagtcgaaaggggatagctctgcttcccacttgctaagccggccagtaacttctttatcccgtattatttcgcccaaagggtactgtgatggcactatgactttgtgggcctaaaagtaatgcttaagcttgcgtgaagccatcaccagggcgtaagcgagcttttccatttcaatgtatcttgtcttcgctccttgcaatgcttcggagacgacatagaccggtttttggcctgaatctgtttcttggacgagagcagcactgactgccattggcgaagctgccaggtatagtagcagtttgcttcctgatgctgggctgatcagagctggcgggctttgcaggtattgttttagctcgtcgaacgctgcttggcattcgggagtccagttgaattttcccgcaccccggagggttttgaagaagggcaaacctctatcggctgcctttgagaggaatcaactgagtgccgcaattcggcccgcgagcttttgtacttcacatacgctcgacggaggcttcatttgctgaatggtatcgattttcttgggattcgcctcgatgcctctttcagaaacaaggaaacccaacagcttgcctgcgcgaacgccgaaaacacacttctcgggattcagtttcatacccgctgcgcgcaagttgtcgaaggtctcctgtaggtcggacgcgtggtcgaaagccttgctgctttttaggacgatgtcgtcgacataagcttccacatttcgccccaactgcttgtaaaggaccttgtacaccagcctggcgaaggttgctccggcattcctcagaccgaaaggcatcctgaggtgacaaaaggtgccgaatggtgtgatgaaggctgtcttggggatgtcggccgggttcatgcgaatctgatgatagccggaatatgcatctaggaagctcatgagttcgcagtcggctgtcgaatccacgagctggtcgatccgtggcaagaggaaatcatccttcggacatgctttgtttaagtctgtgaaatcgacacacatgcgccatttgccatttgacttccgcaccagcactggattcgccagccactcaggatgatcgatctctcgaatgacgcctgccttgagcaatttttggacttcggcttttgctgcctcctggcgatcagcgggcatcttgcgtagcttctgtttccttggcttggcatctggcttgactgccaggtgatgcatgatgagatctttaggatgttcttagcttcttcttcgcccatgtcgccccccagtgatacgagctttgtggggtcggcatcatcaatctgcatcttgactatcttgccgtgagggacgggctttggcgcgtgcttcgcccggtcatgcggttcggcctcaacattatgcactattctgttgattatggccaaatcaccttttgaagcagccgaaggctgaagccccttgaccacgatcactcctgccgggccgggcatcttagcttgagataattatgatgggaaatggcttcgaacttgttcaaggttgcatggccgaagatggcgttgtagttgtatgggatgtcgacaatgtcaaacaatacttgctcttcgcgtctgttttcccccgcgccgaaggctactatcaactgtgcttggccaagaacttgaactgcttctccgccgaatcctcggagcgatgtcggtgctagggtaagggcttggatagtcaatcccatcttggcatatgcttcggcaaagatgacatcggccgaacttcctccgtcgaccaggattcgccggacctcgaaaccagctatctcggctaagatcaccagaggatcttgatgcgggaacattactccttcggcatcttctggcccaaaaaagatttgctggttcagatactgcggagccccttcgcctgtcgaagtgatattgtggaccgttcgcaaatgcatcttcttttgtcgcttcgacagttggatcggcgggtcggcccttgtaatcacttggatcactctgcgttgcgcatcttggcgttgttcggctgggggtgcttgttcttgagctacttcacgagttgcttcggtcgctgctccctgctgcgtccttggatcttgcgcattgccacgtttctgaatgtttcggcattgctccgtggtacacgaagagcgtccgtggaaggcgcagtagaggttttttcggaccttcttgcggacaggctactaatggttgcttgcttgctgagcgttgaactctttgcggagggcttgcacttcttcgacagccatcacagccttgcccgcacggtcggttctgaacttcctccaggtcatgggggcttgaccttgccttggcggttgtgtttggatcgccggctggggctggtgaacaacgagaggaggtggttcgacaacttgaaattgttgttgggtttgagcagcggcgacggaagtcttatcgtactcagcttgtattgcttgccgtcgcttggaatcctcttcgccccttgtgaacccatcaatgatgcgaagtaggtgttcaagcgtttgcggctccttgttggcgatttttcttgagagttcgccctcgagtaaaccggccgaagcggcgtttatgactgatgcctcaattatgtcttgaacttggcagcgggcttgtgagaagcgacgcatgtactcccttatcgactcctccggcctctagcaaattgaaataccaagagcgtgcgatgccgtctagggtgagatgtattacctttgccttggtattttcgtcgccatgagccgcttcgatcgcggattcataaatggagaggaattcctttgggtcagtttcgcctaagtagcgtgggacgggtgggaacttgcactggggtgggattggacgggtcttgattcccccactcagcggtagccccttttcgccccctgccctgttcacggcaccttgctgcgggtacggcgtggcgaagggcgaaatcacggcttgtgcgtgaggttgggccatggcatccggctgcccggccccgattggtgatgcttgctgagccgccatgaatgggtcgaaagttggctgtgaccatgtcatggcgacctgatttggtgcttggtttgctctgaagcctggcgttggtgcttgcggccgaacggttggcgcctgagcagcattgatagagtcgaactgcggtccttgacttcacggcgaagcccacagacctggctgattcgaaggcaaccaactaggcgcaccttgacttgtattcccctccgggcgggccgaaggggctgtacttgaaatgttgtggggttggctgagctgctgaaggaaagcttggagctgcgcctgcagagccgaagccccttctgccattgttggtggcacttggccaggcggctgaggatgtacttgggcagtgaccagttgagcttgcagttgcacgtgagggaccggatacgctgctgcggtcaatggctgcccggcaaagtacatcggcgcttgcgcaacttgtggcggaaggggctgggtcggcacttgtggatagacttggggtgggacatagcctgctgaatactggaggattggtgccgaagcgaccttggaccgccttgccgcctcgtacgcttgctgctgttcttgcatttggcgaagcatgtcttggagtcgtgtcatgttctgtcgcatggcttccatgtcggcttcggtttgtgtctcggggtcagggttgacttgggcttgcacagcggcgagcgcagtttgggccgctgccggctgcgacggagcagcttggggcaccagtagttggcttgtcgaaaggatctccgccctggtctggagtgccctcgtcgccgcagccgccctcgccatgtcagccgcgttcggcacctgcacagaggtagcaggggccgaaggcggtagtgatggcgcaggtgcggaagcagatgacgctcctccatcttcggcaacaggcgccgaaggctctgctccctcttcggcggccatatccgcccctgtgtcgctttcctttcgccttgtaaccttctcctttacgaccttcttcggtggcattcgctcttagtggtttcgctcggaggtccccacggtcagcgccagctgttgtcgaaacgcaattgcatacgtcgaaagacgtggttactcaacagtggttgaaagagcagggctgtaaatggaggtttcatgcctctacaagtaagaaatactatggctgcaaggtaaatttgtgctgaaatgttcagttaattattttatcatttcatggttaaatttgatgcataaaaagctgataattacattgttatatgtgcaggtcaaggtaaataggcctgcccacagttgttgttccataaataagactggggctgccatggcaacaaatagctgggttgctgaaagagttatagattggctgaaggagattccaactctaggagctagtgcattgaaggtcaagctagagaagaagtacaaatttacaataggatatgacaaagtttttagaggcaaagagaaggcccttgagaagatatttgggaagtgggaagacagctttgcattgctgcccacttttagagaggagcttttgaaggcacaacctggaagtattgtcgatattgataccgagattcatgaagaccaagtatgcttcaggcggctgttcatagctctaaaaccttgcattgatggattcctacaaggttgtaggccatatattgcaatggactcaacacacttgacagggaagcatagaggacagctggcagctgctgttgcaatagatggaaacaactggctttttcctgttgcatttggtgtgatagaagctaagacgacggagagttggacatggttcgtgcagaacttgaagaatgctattggtaatcctcctgggctagccatcagcacagatgctgggaaaggactagagagagctgttagtgatgtctatccaactgctgagcaccgggagtgcatgcgacacctgtggaagaacttcaagaagcagtaccatggaccactttttggtgaaaacatgtggcatgctgctaagtgctacaccagccagcagtacaactatcacatgaacaagattgctgagaaatctcctgaagctattgcatatttaaaaaccaatcacccatttttttggagtaggagcaaattctcagagctttcaaaggtggactacatcaacaacaatctttctgagtcattcaacaattgggtgatgaagatcaaggaattacacatagtggacttatttgacacacttaggcaaatgataattgacaaatttcacttgagccaacttgcaagcaaaatggaaggaagaataattccatctattattaagacactgaatgaacagagcaagaatctaaaagattacaatgtggtaaggagtaattgcgatgatttagctgaagtttctatggtgtccaacaagggagtggtatggaggcatgcagtgaacctgaaggctcatacatgctcttgtagagcctggcaagtaagtgggaaaccttgtaaccatgcattggcattcataggctctctaaggttttctgacatgaatggctatgtggatgagtgttattcagtgcaaagattgaggcaaacatatgctgggatatggaacccaatgacatcaaagaatatgtggacatttgtagatcctggtttcaaattgatgaggccaaagttgaggagaaagcctggaaggcctaggacacataggattaaagcttcagatgagcctggctgtagaaagaagaggacatgccctgaatgtggtgacaaaggccactttgcaaagacatgtcagggaggacctatagctagcaaaagttacttgtcatccatttttttccctttcatttgtaaattggctgctcactctagattttatacaggaaaaggtcatcttcatcaacaccatcctcagatcaaggaagcaatactcctggtgcagcacctaggtcaaagaaaaaattactactggatcatccatgtaattagtatttcttactagttaattccatcctcatttgcaatctatttgcatcttgtattcagatttaggtactaacttatagaattgttgttacagtggcaatgcaaatgatgtgtcaacaagaccaccaagagcaagagagaaggggaaggagaagaaagggtttgttgcggcatccatttgatgcggttgtcttttgggaaggttctaatggtctggaccatgttgtcctatcaaattgatatgatgtagaacactgctatcagatgtagttgtcttttggatgtgaggatgaatcatatgatgtaaacctctaactgtgttggttgaattagtcatatgtagttgtcttttggatgtgaggatgaatcatatgatgtgaacctcaactattgtcatttaatttgtttatgttactgtgttcatgccagaatgacgctagttgactatgttctcttgcttgttgtctcaaatggtgttttattgatgccaaaatgctgtcaatattacaatttcatgggcaggggcattcttgtcctaattttcatgaaaatcagccatataacggtgttagtctaagctgtgagtccagtggcagttatgttgggttcaaagttcaaactgtttttaatggcaaatttgcaattacatttttttatgggtagatccacaatacctgttcaatccagtggcaaatatgcaattgaccccttttgttaacaccactccttgacgtagataccaaaaaagatatttactttaagaggcattttaaactttcaaatagttttgttaatattgggagctttcgtatgagccaaagcaagataatgagatttaatcgagaatctttcatctagtgttaaattatatttaaaatcatcttgctcacgtgacaaaactatattataggatcttgtcttcaagattttgaaaatctcggcattcgcccactcctcgtgaccattgctgcttgggtgagtagagtaagcaaagcagagcagcttgatcccgaggtcaggtcccggcaatatttgctaaacaaggaaatggtggattgcacccctttgttagtgattattcgattcgggccaccaaaacgacatgtgatgccgtggatgaacttgaccgtgccgtgtactgcttataactttaatgctccgaattaccttgaaccactttgatgaacttgttgatggcgacctagaggtgttcgtatccttcatctgctcattgaagagcccaaggatatccagttctcagattgcaaacaaccattttgttgcaaaataattaggcaataaatacgtgcacgtgttaagttaagtttagtaagataataatagtctcatgataatacagatcgttggaagttagatcgtaaagaattcatagatgtgtttctgggactcagatatggaatataaatgaattttcatttaattgcatcaacctgaatttataatcagcctcaaatattcggaattcatattgggcgggtgaatcgctactccatccacccagcgatcaccccccccccccttctctctcctatactatatactcctccctcctctcccccttcctcctacccttcttctctttctactacagtacaccccacaaatttttttaaaaaacaaaagttagaaaaatttatgtataaaaatactatatataaaaaatttgaattcaaattcaaatttgaatcgggtatgtaaacttttgacttgtaaactttgtatctataaattttaggtgtataaactttagatgtatagaaatactatatatagaaaatatttggattcaaattcaatttgaatataattcaaattcaatttgaatataattcaaatttaaatttgaatcgggtatataaactttaggtctataaactttagatgtatagaaatactatatatgaaaaatatttgaattcaaattcaaatttgaatcggatatttgaattcaaattcaaatttaaatcggatataattcaaatttaaatttgaatcggatatataaacttttgacttataaactttaggtatataaactttaggtgtataaactttagatgtatagaaatactatataaaaaaatatttgaattcaaattcaaatttgaatcggatatataaacttttgacttataaacttttggtctctaaactttagatgtgtaaatttgaggtgtataaactttagatgcataaatttattaaaataggaaagtaatgcggtgccaaaaaaaaaaccaggtggagggagggaggggggctacaggtatggcgatcgatcgcccattagaactaccctcgaatattactcctacatcaagtggcaaaaaaaggttactgacaaaagcaaagtcgctgggaattactcctctacggcactacccctatatggcggccgcctccctccggctggccacctagctatcaatttccaccgccgcgtcgccgcccactaaccgctgaccatcacactgcggcggcggtggcggcggcgacggcgacggtgcaggctgcagcagctgctccgtcgccggcagcatcacggcttctagtggataggtgcgcgtgtgggccttagtcgccttcttgacggcgatggcgaggacggccaggaaggcgatcggcagcgccatgatcaacgttcaccggcaggccgctatcgatcgatctatcggtcgaattctccggcggtggtcgtgagcgcgggcatggtgagttagttggttaccggcgtggtggaagatatagaggccggccggcgtgatggagtccggctcggagttggcaggcacagccacgtacacttcgatttgctgcgtactcgcatcggcatcggagtaacgacgaggaatccagtaatccgagtccgtgaaagaaagcagtggatttttgttcttgtgctgttatagttaatttgtaaaaatatttgtattttgaaacctttcataaatccgttgtagtctagctggttaggatactcggctctcacccgagagacccgggttcgagtcccggcaacggaaatttttttatgttgttttgtttttccataagtactaaaactgtagaagtgcccggctgctggacattggccatcggtccacggaaatggctaatcagcgatcgctcgcgtgcgggagcatcacgcgatcagtgcaaatccatttttcggcccacttgagtgctgagaatgcttagttgctttattgctcaagatttttacacagctgatgttagcgattgtttagacctttatttatgtataaaaatactatatataaaaaatatttgaatttaaattcaaatttgaaacgggtatgtgaacttttgacttataaactttgggtctataaactaatatttgaattcaaattcaaatttgaatcgggtatgcaaacttttgacttataaactttggatctataaactttagaggtatagaaatactatatataaaaaaatatttgaatacaaattcaaatttgaatcgggtatgtaaacttttgatttataaactttgggtgtataaactttagatgtatagaaatactatatataaaaaatatttgaattcaaatttaaatttgagtcgaatatataaacttttgatttataaattttagatctctcaacttcagatgtgtaaatttgaggtgtacaaactttaggtgtataaatttactaaaataggaaagtaatgcggtgccaaaaaaggaaaccatgtgggggagaggagaggagaggagaggggaggggaggggaatgtgg

SEQ ID NO: 1752 - DNA, 12811 bp, Oryza sativa
  unsure (1)..(12811): unsure at all n locations
ctattttagtaaatttatgcacctaaagtttgtacacctcaagtttacacatctccacaattgttttaaaaaaacaaaaagttagaaaaatttatgtatagaaatactataaaaaaatttgaattcaaattcaaatttgaatcgagtatgtaaagttttgacttataaactttgggtctataaactttaggtttatatactttagatgtatagaaatactatatatagaaaatatttgaattcaaattcaaatttgaatcggatataattcaaattcaaatttgaaacgggtctataaacttgaggtgtataaactttagatgtatagaaataatatatatagaaaatatttgaattcaaatttaaatttgaatcggatataactcaaattcaaatttgaaatgggtatataaactttatgtctataaattttaggtgtataaactttagatgtatagaaatactatatataaaaaatatatgaattcaaattcaaatttgaatcggatataaaaacttttgacttatgaacttttggtctataaactttagatgtgtaaacttgaggtgtataaactttaggtgcataaatttactaaaatagaaaagtaatgcggtgccaaaaaagaaaaccaggtggagggagagagggggaagggggatcgatcgctacccccatcgtcaggcgatcgatcgcccattaggcgtacctgaggaggggtagggggggcgacctgattgtgggtcacaagatctcgcgatcaatcgcgaactaggtcaaccctctatccacatgggagtatagtagtgcacgagacatcaatagcaattagtaccttgatcatattttttttctaccttgcccatttgagtgacatccaggcttttacaaagaaagtcggtgacatcttttcttttctttttttttatctgaagtcggtgatattttagtttgtcttgatggtggaggcatagaactgaaaaagaaaacgctcaagtcgttcatttcagctatacttcacccccactcaattataccgcgtttataagatataagggtgtggtcaattcatttaaagaaaagatacaaggatgtggttaactcgagatgagcatccaagagtaagccggtctaacatcccattaactcgaaagagctaattggcgacctgttgcgcgcgctctccctcgtgcgactgaacatgtgtcgcgtgcggaggggggcggcggactgcgcccgcgctctttttcggtttttctgttttggttttttttctcttccgttttttcggttctttttctgttttggtttattttcggtttctcttcccttttttttgggttcctttctgttttggtttttcccttttttctctctttcttttttcggttttttaagatgtacgtatgcaaagtttatatttgtatgtatactaaattttatatttgtacacatacaaagtttgtattcgtgtttttttctcttagtttttaatatatacctatacaaagtttgtatacgcgtattcaaagtttgtatacacgtatacaaaatttatatacatgtatatttttatataaaattatatatacgtatatatatactctgtatacacatgtataaactttatattttatcagtacaaagtttatatatgtgtatacaaagtatatatacacataatagtattgttgtagtagtactactagtgtagcagcagcagcagcagcgcgctagtagtagtagcaggagcagagcagcagcagtagtaggagcagtaggagtaggagtagtgctactactaaaagagcagtagcagcagcagcagtagagacggactggtcgcgcgcccacgctcccgcacaaccagtcactcattaggggcggccccattaactctccctataacacaaccaaactattctttgtaagaaatttgattcataaatatgtggcaatcacagatatctgagacatcccagtaaacatatagccatataaatggtgacagaaaaacatgccgattattacatgtttccatacggaaactttctgctcgcaagaatctaatgcatacatctgttttgaagaatacaatctaatgcatacatttacaggctctctctttccagggtatattcccaatcccacacaagtcaaaaacattctcaagtttcaagtacatcgagcatcatttttcaagagccatcaagcatcatagattggactaaagttcctcgaatccgtcttcatcggcatcatcctctattctttcaaaatgcatccggaagctctccatctatcaagccagagatcaaataaacaaaattgcactataagatctcaactaattgagggttcatggctatatgattaacaatggggcgcatcaacaaatatgagcaactgtggactagcaaatgataattgttttagtaaatcatacaccagaggtatctttctctgaaggacattaataagactccaacaccaataacaactgattaccttaaatttaaggtgtagtaatagataaattacttgcaaaactctcatgggaaaattgtaagtaatgaaggacctcgatgaacaaaatcagacagttgagaggctcatatcaacaaaaccaaatgtagaaggctaaacgttacatatgaacagttgaagctttaaagggcttacatcaaaagattttgactttgggcaatttattataagtgaaatagttgggtgcttacacattagttttggcaaaagaagaaaaataaaatcatacatgtactgtcagtagaatattaccaatatgcactgaatcaattaaggtgtgcttttaacagctagattttctttatataaacctggaaagtttcttcaatatgtaacttgacaatttattcagaacaaaattaaattaagggttacaaaaaaagctaagagtactctataagtgatgaaaataacaaatgcagatgttcctacctcctacataacatgggaaaggtgattggttggctgatttgcaatttctgagtcaaagttttgtatggatgtttcatgaagttcaccgctctaactcgtgtgtcatgtttttcttcatgagggcccaccaacctcgttttccgaaaagaaaaaggaaaggaaaagaacaaactgatatcttggctcttcaatctctcaagatattgcaatcaaaaggttatgggcaatttccagatgtgagagtgatatttttttagagctcacgccaacccccagaatcattgaagttagaatccatgtcgaaggaatagagttggtttcattacctgagcatctgagaaacgcagctgttctgcaataaaaatagctctaccatgtatttccggtggagagtctagacctaagccaacatcctttgccacttcttcatagtgaacaaagctgacacgaaaaccctgagtaaagaaaaggttttccagcctgtcttgctctgaggcctgtgcaatgtagaagggaactgttacttgatgagccaaattaaaataatatatgcaaattttctagtatgtacttagccaaccatgtctgttgctgctccccactgcgtaaaacgtggcacctcccctataaagatactccctttcattgctaaattgccaatgacaagcaaaaggtcctccaagcttttaaaagtgaacaaaggtaaaccctgcaatgccagaacaaattcatgacacaaaaatacaaaatgcagttagctttcctatttgagtgatgccataaggacttggatgtactcaaatggatggcaaaaaataacatcagtgcacattttagtgtcagcatacaaaaccaggtagctagtcaagctaaagcaaataaaactccatcaagccataggagaaaaaaaaaattatcgtctactctagagagatatatagcacagaccccctttgcactcttccactcacatttcctctcttgcagatcaaatttatcaatgacatgcgctgcataatctaccaaaagagtgtggaatttcccccatccataacaataacatatatttatccatcatcatgttaaatcattcaaatgcaatatcactttatgacctactcatcccatcatctgattagtttcatgtgtacaatgcaaaataagttataaaccatgaaacattaatattggcctacttcaaatactgtccactagctggtgccaataagctcatgaacaccaggtatcataagaggtactggaattgccctctcagcagagctaagggttctgtaattgctgttaaaatagctaattgtgaatatacatagcaagtcagtaaacaccaggtttaacaaaaccatactttcagaanattctccaaccttggcatgatacctcactaattaaaaccagaaccaagagacaaaaccagataggggcagtttccagttcttcctaaaatactcaggaagacctgctcattttgcctgttgaaatattgtttttcttttgcaagaatgctgctttctggttaatttccaatctaacatattagtacctttttcctatgtttctgaaaacctaacatttcaccctgctgtgtggatattcagtgtaaaacaacagagaaataactcgattccagaacttactgcagcaccctgagccaaccctaaaacaagacactacacagttcctaccagtttgcaaccatttctgaacacatggatgcaatggctggtatgaacatgtagaaagtgataattttgcataatatgtcacaaccaatatgctggtgatttacatattaacgggagcaccaggagtttttaagttaggtgcatatgtaagtgttgctttgcataaaaagagtgccctttattggttttgaggatttgtgctagcacataatccttaaatctaaaaacacatcaattgatttaattcttgtaagttgattttgcttatttgatcaataacacttgaaaaaaaaaacaaatgtagctccactgccctgctgcagcattattgcactagagctaccaatgttaagtgtatttttgttttatatttattctagcctagggtttgggtatgtccttgagtccttgtactccaaaacctagactagagtgcagtatttgattaattgcaaaggggaatataacaataaatttaatgattagtatcgaaattttgtgcggaaggacatagtggagtaagttacctgcagtacccacaagctcggcctattcccattgaagccatttttattcaagcccgcttgcaagtcaggagactctgaagaagtatgaagtacaacacagttccgtgatatttttgctccggctcctatcatatcacaagattttttttttttaaaaaagaaaaggttagctaactacatacgtgtttgctacggatgaaaatgaatcatacatattttatctataatactattgaaacgaaataaatgatgattcttgcatcaaacatgtccttcacttttttgagttacaagaatcattccaaagtatattaaattttgatttttttagaagaaagaagcatatagaaggtctactatgtaacaaccaaagaaattcagagagcaactcataaaagtacagtgtgcaggttgtgtgttggcagattcactaacaccattaccttgttttcaaagaagtatagatgtacatcaaaaactcatgtacatctatacttcttttttcattaaaaaagaagtatagatgtacatgagtttgtggcaacccttgaatcatcagatttcttttgagaaatgtaaaagatagatagcatggggggctctaattgctatatcattgctattgtaatgtgcttatacagcttggccagccaggtgacacacacagtagcagatgttcccacagaacttgaacaaacaacggctggctgagtaacatagaggataagttacttatcttggttcacccacccaaaagggaaaaaaaaaaaacaagagtttattatcatggttggcagcagagtacccttaactttaagttaggactaaatcttcagaacatgtaaagcttagtttgagttgttagggccagcccaatacaaggcaaaccgaagatttattggagacaagcaatgaataaaaattatgtttttttccaatgcccctctccctcctttatgtctctccccctatgatcagatcaccagatgttgcatatttctcccatgctaaggtttcatacagctattatccatttatcctcctctgtacaaaatacacatggagcagtagagaagaataaaagataaatgaatcaaggataaatattgcctttaatctcaattgagagatcttgctgtttcagatttctggatagtcagaactcgcatgttagtccctcaaaagaaaaaggacttgcatcttacaaatgacagtcgaaaatgcaccagttccttaaaaacaatttgtgatagcataaaacatgactatacctctgagttgctgtgatgcagtaatgaagactcttctaggtgatacatcatacacaacagacaaccttggccagcttagcctgtaaggacgagtgtccattccatctgtcaacagaacaatctattaggaataagccagcaaattctccacagattatgcggacagattcatcgtaacaagttaaatttcagtacctgtctaagatcatctgaattgcttatgaaatgttgcaatttgtcatcaatatatctggtcactagcctataatgttctgcacttggcattaaatgtaaagctagaagatctttatcttcacttgccacatcaagtgaaagtagaacagctgcatatgggtcaataaaaagaggatctgcaacaaaaataatactgagaaacattagaattttgatatacaatcatatatagccatgtgtggccttctcctaaaaaatcagatgatactctacagggattatcatctgaattctgaactttgcgaagaaagagcaattcatgattcaaagttctaaacaactgcgttaaatctgtctcatgtgggactgagacaaaactctgttctagttaattcagaaaaataaatgaacaagcaactaaagcacgtcactgtaaaaacatgtaatttgcataaaaagtttgtatatggtgctgaaatagtactaatgtcatactttaataaataaagatttccaatattaggtaatcaatatgcacattgctgttggtttttttttaaaaaaagtgcacgctgcttaagattggcagacttgaaaacaggtgttaccaaataatttacaacaactaatctataagcacattgctgttgaaattatgactttgcatgcgccgccggggggggggggggggggtaacaaaaccattcccctcaattcgtcgaacaggtagcgcgcactgccagttccgacggaatcggcggcacaagcaaaagatgagcagcagcaaagccagcaacacaaaagatgcaccccccatcgctgacctgggcggcgggactcctcgtcgcggaatcgtgcggcccggagcgcgccgtcgaggagcgtgtcgcgctcctcctcgggctcagggagcgaacccccgaggggggtgtcagcggcggtggcgaatggcccccgcggcgggagcccgctcttcgcgcagttgctccagggagggaaggaagaggccggcagtcggagcagggcacgcggagtagcggggagcggcggcgaccggcgcacgggcgtcgtcgccgccgccgcgagccatggcaggacgggcatgtgtgtggacagttgctctccatcggtgtttcgctgccttcccctctatccagtatgcgcgatgtttacgcctccgtgaaggggaaacgtacttctgtgctttgtaaaggcgcattttactacaacgtgtataagcggaggggcacataccatgaaagtttattcgaacatcacaggtatcaaaacgtgtaagctcaagaactttactagtactactctctgtccggtcatcaaaacgcgatgtttttaacattaaaatttgaaacaagaccaaaaccactatttactactccctccgtcccaaaatatagcaatattgtatcgtgtaaaatatcacacgatacaatgttgctatattttgggatggagggagtactcttggtactacttagaaatttcgatagatgatgacacggtgatgtacggtaacggtttattaggttgggaggaattcacccaataagaatacaaaatataaaggtcctaaaaattaataagatcctcagaaaacagttacctgatcaatgggggcattgccaagtgccaaccaagatattttagtacaccgaaataaatataattcatacggaaaatagttttcaaaatatggatgaaactattttttatcgaacaactattacaatagtttctatatgcctaatttgattaggtttcaaaaactccatactactccttccgccccaaaagaaaaaaaaaacctagaattagatgtggtgtagtctagtacaatgaatctgaacaatctcctatccagatttattgttttaggatatgttacatccaattctagatgtgtactccctccgtcctaaaatataagcatttttagcatagtgttaagtcgatcatttttaactttgactattaataacaaaaaaaaataaaaagatcaattatgtaaaattgatgttactagatttattattaaacaaattatcataatatgcaagtctttttatttaaaatatcttatttttatagatattattggtcaaattagcatctcgaagactgtatcgaagtctaaaaatgcttatattttgggacgaatggaatattttatgggacagagggagtgtgcaattgcaactttttccaaattgtttaaagtaatttagcaacttaacaaagtcaaatacatatatgcagttgaatattcagatttaggaatgaaaaaagtttcaaaaaaatatgcacattataggattataacctagataaattttgtctcaatcagaatacaagtacttgttttcataaaagtttatttgtttatgagcttgctggggtaatttactaattttcaaaattcaaaactatttttagcataatgcaacactaccatgccaacgccgatgtcataattagaatcaccctatgtttgagccaagtttgaacaccgagaaaaatcagatgaaaaaaaaaaggagtcatggagctagcacttagaacagatataatttcatcaaagaaaaccaatacaacatataacaatattacaataataataaaaaaaatctccttttcccaaaaaaataaaataaaataaaaatctcccatttggggccacatgccatctctcctatatgggcctcatttcttgatccgaaataatcctcataaaccatactaatatttttccccttttccccatacaccattgtaataattatgtcaatggattttctacgtaggcttaatgatcaacccatcataatcttcgctagtgtcaacggattattcaaagaagactggagaaaaagaaatggtgatatgaagaaggaaaaatctgtgtagccatgcatgcgccgtacgtcgctcagtactcctcggaatccggtgcgctggcgccgggtcccggcgcgtcggcggagccggacgacgacggcgatggagacggcccttcggtggagccgtacgacgagggcccttcggcggggccggcggcgccggacggcgacggcccttcggcggggccagaggcggcgccggacgacgacggcccttcggcggggccagaggcggcgccgtacgacgacggtccagatgcagggccgccggcggtggggccgccggcggggctgccggcggggctgccggaggggctgccggaggggctgctggaggggctgccggaggggctgctggaggggctgctggatgggctgctggatgggctgccggaggagccgccgtagccggtgtcgtcggatgggctcgggcccggcgcgctggcggcggagcctgagccggagccgacgtcggagtcggactcggaaggcgccggcgcggcggcggcgctgctggattcatagccatagccgccgccgccgccgccggtggcgggcgggagggcgacgtcggcggacatggagccggaggcctcggtgatgaggtcgagcgtgacgcggaggagcttctcgaactcgaggctcttggtgacgacggcgttcttgatctcgctgatgggggcgtccttgcaggtgtcctcgcaggtggaggacccgccgagcgtggcggagagccaggccttgacctcgaggaacttggcgtcggtgagctcgcgggtgagcgcgctgaggtgcgccaccgcctcctcgatgtcgtcggagcagctgtccacgcacttgaacagggcgtcctccttcacgccgttcagctcgtggtgcgcgaacgccgccaccgccgtgcccacctccgccgccacgtacaccgacagctccgccagccgccgcgcgttcgccgtccggctctccgggttcgtcgtcagcgcctggatgcacaccttggggaacagcgtccggttgcacgcgtcctggaggttgtccgccgcgccggcgagcggcgccaccgagacgaggacggcgaggaacacggcggcaagctgggagcgagccatcgccatggtcgtcttcgtgtcgcggtggaccggatcgagctcgggagagatctctctcgctttttgtgttgtagtggttgaggcagaaatggggaggggttggatggggttttatactacgcttctcaccgctgcatgcatatggtgtccatgagtggtcagggacttgttctttccctgccctgcattagcatgggctgaccttggttttaggagaggggagtgtgccctgtgtgacaaatgttgcatttctatcttcctgtctcgttttggtgtttacttttagttccatttgtttttttttcaaaaaaaggtaattgtatttgttttggtcacaaatataagatcattggtgtcctctctattatatataccatcgatcgtcaccacttataaacaagatgtaaacagtgatttgcagtagaaattacagcgcgtctatggtttcccgtgacaccaatgcactggtctatgggttaactcaccagagtaatttattattttcatgtttatgttgtgaataaaaatgtaagcattcgtattgaaaatactctctccgtgcagaaatgtacaacatttgaggaactatacaaccaattttcttcttactttaccggtgatgtataaaagaacaatggtacaaatttttttatgaaatatctcccttctataatagtttgtttttattttcatatgcatataccatgaaatatatgggcgatcaatatatcaaaaccatgtattggcatagtacccatgtccagggcatcctactttcaaaaaaaaaaaggatggaccactattcagtattaccccgagccatatcctatatcctatagtcgatggttttgtgcatcttcataggttacatttccaattaaatataacaagcaaaaatcagaccaaaggcaaccatgggacttgtgtgacaaatgttgcatttggtgtttagtgttgcatttgttttggttgcagatctgtgtcaccgggttaatcccttggggcaattatttttcctgtatgttgctgttgttgtgaaaaaaaaatataagtagagaaccgatattgaaaatactgctaacacagaaatgtactccgtttactttttaaatttaatcaagtttattaaaaattaaatataacaccaattttgtattattaaatcgagcattggatagattttaataatatatttgttttatcttaaaaatgttaccattttttatgaacttattcaaacttaaaaagaaagtcaaaatactttatagtatgaaatgaagggagtatactaattgggataccatgaacccagttttcctcttaattttgaccctattaatttttcatgaaaagtttcattgatatagtagttgtcttctttttcatatccatattttgtaaaagaaatatagtggtcaatctgtcaaaatcgtgtactgtacacatgtcactccagaacatcctactttctaaaaaaagatggagtacgcttaagtggattctaatctctcgagggaataccccatcgtgtatatttttcttcaaatttaatgcaaatggttgttaagaaatctaaaaaacccaacacggtagagtatagtaaagagtatagtaatgtcttatcactccaccaaaatcatgcatcttactcaatatgtacgttgaaaaaaaaggagacaaattcgggatgaattgtactatctaattttcatatgttgaattttcctttttatttttcaatatgtgatttgtgtttagaattaagattttctggagatatctatatcgtatgaatgcttcctttttagttttgtgtgtgagtcttacaagaaaaagtccaagatgtgagctcttctcctccgaaagctaatttgctgacaatatagctaactaagcccatgcctattttgcaagaagagggagaagaagacgacgaccaaaaaagtcaagcatggaacagaagcttgcgtgtgatagttttacactttaatgggaagtaaaaagttcgaattaccccaaaaactactatatggccagtacgaatttatcctatgaacaacaaaactagacatccttcactctcaacttttcataccgacaaattatcctct

SEQ ID NO: 1753 - DNA, 1018 bp, Oryza sativa
cgctccagagtgagggaagtaattcgtctggtatgaaaagctaaggatgaagaatgtctagttttgtgatttagggggtaattcgtactgtccctatagtttaggggtgtaattccgactttttcctagtgggaatgggaacttataaaacatataaaatgattctgtaaaagtaaatctgaaagcacctcaccctatcacaaatatggatgtatacacaattgtgttcgatttcacattatttccttttttttattcaatgtgcggatatcaaaactttaaaacctcccaaaatatccatcctacctcctcccgcacacagatacacatagaaacaagaaagccaggctgtgctcaagatcctgtgctctctccaatggaacctgagtcctccctccacaaggtaacttaaggatcggaagcttagattgtactcaatttcttcctgctataattatcacaaactcatatgaccatcttggtgttttggcgttgaaggttgttgttcctttagatctaaactatccgaggatttgttcccactgccaaaccagcaaaacatcggtatggcgcaacggcccctttggccccaaggtaaagaatagatctataaatcatctagatatagcacctatatgttgctcagagcttgttgatttgaggccaattctttttttaattacgatatgtttatgtagtctttgtgcaatgcttgtgggatccgatatcacagaaagggaattgatgctcttgagttagaaggtaagaggagcaaagacaagaagaggaagacgagtagaaacgaggttccactccggaggggattgaggaaaaataataagaatgcaaaggaggtagattttggagtgaggatgatgatggagggatgccaatcagaaccgatgctaacacagggccaacaatacgaagatgatgtgaagaaggctgctatccaactaatgtacctttcaagggccgcaaacacttaatcaagcacaagcaatagagctctctatgt

SEQ ID NO: 1754 - DNA, 4335 bp, Oryza sativa
  unsure (1)..(4335): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaacccctacctggcgcaccaattgtcgaaacaagatttcggcaatacaaaaagggggtggctatcaagcaggaaaagtggatgggtttggagacaaggaattttatacaggttcaggccttctcaatgtgaagtaataccctactcctgtccggggattgattcgccgagtgtgttatagatagtatgatctgggagaaaagttatgccccaagaggcacccggacccctccttatatagtgggaggaatccgtattacaaggtacagcccatattcctaacggaataggcaaataaagataaaatacaatcgtaaccgactagaaccccatgtatttccttgatacacaagtaaggaatttaacccgagtcccttaaaggtattatatctgtatatggtacccctatacctagtcggatatacatgttgtgtgggtatgggtatccataatctccacagtcgagcacgtgcttgggaaatatccatctcactttcacccctagtgctaacgaaaaatttgaagttgaagaaaaacggggccttggtcatagaaaaatttagcccgacggttgtccaagatgatgtctctaacataaacactgaagtataaagtgggacatggctttgggccaagtgcacttcttgtgctagctgagccaacctagtcaagataaaagaagggaccgagagggtatacatgtgaaaggaataagtctattttacctccctcatctcttgctcgtaattgaaacgcttccttcaaacatcgatttgtacccatttcgaaaataagggagttgtagttgagggatgtgattgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaatttttaatcatacaaagagaatttcagtaattacccacatattaaattaatcattaaatggtctgtttttaatattgttaaatactttgggtgtccaagtatgttcaagatttttcttggaattatttgagcataggaagtatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctatttgcctccctcgacactgtttatcttctacctctagcagccgaactgagaccgatttggctcggtttttctcctccaaatctgacctttccccttgtgtttttctaaaattagttgaggggaaatattcctcttatcctcctctatctttatccccaaaaatcggagctaatcgttgagtatcttatccgaatcgaactcgttttcgagtttatctccaaaatcgagtttttgatttcccggatcgatttcttgcgggaggagtccgatctcttcaatccaaggctataaataggaccccctagtcctcctctttcgtttgccccctctcccgtggtctcccgtgcctcatagcgccgccgccacgtgctccaccccgccgtcgtcgccggccgagctccatccgcgtcgcgccgccgcctccgtcgtcgtcgccggccgtcgtcgttcgtcgtttggttcgagggtgagtaccattgggttcgtctcgtcgtcctctacgtgttcttgtcctccaaagtcgcagccgaccatccaatctccggcgaggtcgccatcttggtccggccattgatgaggtcatcatcatgacgtcatcatcgttttttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttggttttgcgtgttagcttgtcgtttccgtcgttgcgaaggttcgtgagtgcgtcaggagtgttcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattattttattcctggataccttgggttattataacttgactagttgggctttatatattggttcagctagatattagttatgattgcttagccatgcttagaaacattatcacataattgggataactaatgttacactatcacttatgattatatttaatggtagctcacgatggttaatcgtgttatgataattaattgataactaaaacttgacaatggtgggttgtgagcacatggttttgaaggtcgtgctcatgcaattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgatgaggctgtgtcttgtgggtacagtggtacacctctggccagagtaaaactattcgaatagccgtgcccgcggtcatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgtcatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgcagttttcttttcttttgaaagtatgtaacactattattgatgattctgtatattaaattgtcagtttgtgtacctcggctgattcctggacgaggattttatgcataaataagttcggaaattactagtgaatttctgggcgtgacagtgatttaatcagaagcaagaaatgagagagaaaatatagacttattcccacatgtgatgtggaagaagagagagtgaaatatgggctgggttgctccaaagttcagcccaacattgatgtgttttttttggaataggttcacatcaggtccctaaaccaagttgtcgccgagtctaaaatttgtcctaaaccgcaataccaaatatgacacatccctcagctttcaaaaccagtgcaaataaggtgccaaggcggtttgggtggtggtttcagctgacatggcacctatgtggcattgatgtggcacttaagtaaaaaaatgtgggacccgcatgtaagtgactgttcggttaaaataaataaaatattacagtgggaccctgtcacaccctgaagttctcctcccaagcctaaaattttatttaataatgaccctaagaaaatgccggtgtacatcaa

SEQ ID NO: 1755 - DNA, 785 bp, Oryza sativa
ggcccattttccttcctgctctccactccgctgggccggccgaaggccaaagcccagttaggccggccgcctccctcctcccacccgggatgccgacaggtgggccccacctgtcgggctcgtctcctacctcgcgcccgcaccgccgtaaccgcaaccgccgccgcgcccacgccaccgcctcctccgggccacgtcggtcacgcccgcgcatgcgccgcacctcccgcgcccactcccctctctctcccgcccgcgcccgcgcccgagatggccgggattcgatttttcgaatcccgcctctctctcttctctcccactcccccacgttggccggcggaatctcgcccctaccggccacgtccgagccgagccgggtcgccgccgcccgtccgatcagccccgggggtgatctgggccgttggtcccgtggaccggcggtggaccacccgcgtggtcccggtccacggtggaccgcccccccttgagccgctgccgagtggggcccgcgtgccggcgccccttttccctctctcccgagccgctgaccggtggaccccgcatgtcggcgccgcactcccttgatgacgtcagccctgggaattattgcgcaataaattatttaaggtctttttgttatagtaataaacacagtgaatcttctaaaattcataactaattcatccgagctccgtttaagcccattcaagtctcagtaaatcaagaaaaatgcgtagaatccattaaaaatggttttttttctgtttcagtagttttgtagcctg

SEQ ID NO: 1756 - DNA, 2423 bp, Oryza sativa
  unsure (1)..(2423): unsure at all n locations
attttagatggataggtagtgagctgtccttgtgagactgagcaacaaaattatcccttgtatatgagcaacaactatagaaatttcgaaaagataaattactgagtgctaagaagcctgcacaaacaagaaggaattatccatgttttatttggcattgcatgtctgcaccagcataaaactatcattgatccttttcacttgttagtcatgatccagcattccagttgctaaggacttacaattagctgataagaaaacatgacaaagccatactattggatcacacgttcaacacataacccgtgttaaccaaacaaatcaagattgactcacttctatgaaaacattatattaacgcaaattatctcaaccaaaaagaaggaatagaaacaaccagtaatctctttgatgcatagtagacaacatcagatgccatggtgtcctcctgatggatttgcttcgacagcctaaacgtttttcctgcatttttttaacctaaaaagaaaagttagataagttcgctagatatgaaaaagtgacatgaattgtgatagttaatctacatattgactaagtttgctaaacatttcagaatctagaacacaccatgtatatttaaggtaacatagttgattaactatagaacatctacaaatagtgcaattcatgcaatagtgttctatgtaaaaatatatggaacatgatcctgacctcagattgtaagtacagaacctctatgctctcattgcaagtgcaagcagctaaccaacatattaccgtttttgctttgagtatcttgtaatgaacgtgtgatacaatgcaattacctgctacaagttggaagtcatgatccaatttcaaagaactgtcattgattgataaaatatgtgacaaacggaatacaaaacatgcattgaggtgtaaaaatcaatttgagaagtagaccattagcaatatatggatttgagatctatcacacaaatatgaatgtggtacttgttattatttagtttattacgactttgtaaatgaaggaaaatatggtgtgtattatctgtatttgcatacgattatgatgtagagcatcntctgttgtttattgaagtaggtagaggcaagcagatgatttttttttgaaacacggcaagcagatgattgactcgaatacttctagccacacaagtcaaatagctcccacctgacaatatcggtggattatttggagcaacaaataacatcagttctaaaacctgaaaccaaaataaaaaaattctgctactgctgctaacatgtggcattagtttagtcaaaataaaaagattagccactaagtgtgattggaattttggcactacaaaatcaaacaatgattctttgacaacttattgcttgtattattaagaacctttgataccatcaattttcaatctgttgcagttcctgctacagtatgcaacaaagtttctccaagccaagagtttcagcctagaagaaatcatatatatatatatatatatatatatatatatatatatatatatatatatatatatatatatcaatctgaccaggaaaacacatttttttactactgaaatgatttaccaggttggccaaaggattaggcctaccaaatttattaagatttagggagaaacaaagtacaaagtactatgatgtcgaacaaaggtatgaggcaaagcatcagaccacaataaacaactaacactaataaataatcactgcaggataaaaaatgctagccgacttccaaatcgtgatctccttgatgtctccaaataattgctctgtaggtcaagacctctgctcaaatacccaagtgttccgtctttccagatcaaccaacagatcatcatgaatagcaagaatcgaaattatgcagttcactatataaacatttggtctttgccatgaagaagaggttgtaagccgatgagaaagtaaactggccatcacctgttagctagcaccgaatggagtcggggctattcctggttgaagctgcaccatctaaatttcatcccacaactgaaagaactcagccattgctctgttggacaaggaactctgtaggtctctcacccatcagtgattcaccaaagcctgtgccagcatcaattggatctgcctacatatgatagaaattagtgttagtgctatagccacgtgctgcaccgtggttggaaaaattgcttgacctttctgttccaagcttggcatgccattttagccatagtgcttggccaaagaagtctaaatccagagttgatctgttatagagtgagcgataattaattgagcaagaaagagcctgcagagaatctactacagagttcatcagtgtatgcaaagaaattaacccctcagaaaactactgattgtggtgaaaggataacaat

SEQ ID NO: 1757 - DNA, 17493 bp, Oryza sativa
gtggtgaaaggataacaataggatttgttaacgaccaaatttggtaatatcagcatcggaaaggaggattagattgaagtggagtcgaagacggagatcgattcgagaacagagcaagaatcggctggagtctggatcggctacgattggatcggctaagtctgagtcagactgggttaagtgatacagccgattccgacaatatgacttggtgtacaacatcaggttgagttgatatgtttcaagatgatcgccgcacatggatagagtcctgagaaggcaattgtatctattaattaggatgttttatgtaatttccttagagatatgtttagggcaaaagtctgccgcaaagacttatggtatcttagagtttcttagggataagagtcgtgtccgacatggacatagtttgtaattttcgggtataaatagaccccgaaccccatgtaataaattaacacacacattcaatacaattttggcgcatcgccacccttttgctttagttttatttcgacgagttcttactttcgggttgagctgcatcagtttcgatcttcaacaagaggtaaaacttgttatgacggcttgcgttttcgggattagtgcttccatctttatgacactttaatcttgtttatgtaattcgtcgagttatcatatgtcatgcccggaatttctatccaaaactccaaacacttacatgtgtgtaaaaccctcatccaggaatcagccgaggcacacaataacaaattgataatagagtgcaattattaatctaattaataggcgaatataaattcattacagaggtagatagttcctctcaaacaataaagatctaagcagcggaaaataaaataaacagcgcagacgacttcatcccacaagcagcttgaccagggctacgcctaatcctccacaccttcaacgtccggcggcggcgatggaaggtttagggttagaggagagaaatcaaatccgaatcaagctcgaatccgatgatttcaaaacaaaattagatgaagtttctataggggaaaagatagaggagatcaaggggatcatttcccctttaccaatttgatcggatcgggaaagatgcaaccgaatttggaaggggtggcggcggcttgcgcgcggctagggcgtggctgcggtgggaggtagacgacaaccctgataggtgggctccacctgtcagcgggtgagaggagggagagcgagcggctcggcttggtgggctgacttgggccgaacgcgagcaggccgaaggagagagagtgacttgggccgactttcggcccaaagccaacagaggacttttaaaacctttttctttttaaattattcatgaaatgcaattccatttattaaaaatacttccttggctcaaataaatcccagaaaaatctaggaactatagaatcaagagaagtatttaataaaattttatatagcccatttttatattggaatttattatttaaaattggatcttttcttctaggcttttaaaatcatttcttataattccatttaaacaacaatttataaatttagaatttttagggtgtgacatcatatatcttgcataatctctggcaatatctttatctaacctacaatcggctaatatctatcagtagagggtagccgattaggttagacaccgacgttgacttggattatatgagatatctaccaccctatgaaactttcagcggcttgattgtctagatattgttcttcttttcatacttaatgctgcatcagttgagtttgatctattaagttgtgcttagaatatcaatctctagcctgccttctggttgccgattagggtagtatcggagtttcagccgatcttatctgatttaactatatttgctctatatgcttcattgacatgttaagtccgccatttatgtcaagatcctattacacttaagtatattaggcttttgtttgatatattgtacttgttttaatatcttgatatagagtagtatcggagtattagccgatacatgctagatctatctgatcagctatgctataaacatatatagtcctgtcattaatatatatttcgatctaagtgatttatactgtctccgcatggcgaccgatctatcccaatcacttgatttaagtatatatcgatataagaattatatattgttaatatctacagccgatcgagtagatttagtttttcattatctatttacgaccaccgatcgatttacatatgacattggctcgaggataaatgatatgtcatcggcacttagccgatcggctatcatttatggatttaaccacggtttctttgtctttatttcttgttgattgcaggatcaaatcaactggcacgctagcatatccgaaggctagttttggacctgcactggagttaagcagatcgcctaggcctcgtgttttacgtcaacaggattgtatccacttgaactgatagctagatcaaatagtgtaaatcaagccatagtgaaagaaaatgatgtacattcagattcaggtaatccacatagaggactattgggctgaagaggggaatcggaagactcactttcagctgaagcactctgcactctcacctgcaaaagagaggatggcacacgtccgtgagaaccgagtgcatggtgtgggcagactataacccttacaacggcggcaccactggaggcgcggcagagtgtcgttggaaggcaggaccacagggccgtgacgggatggtgataccagccgaaaggcatattcacgggggagtcgactatgtgcggcagcggagacaggcttcatgacatacagatccacggcgccggcgagggcatggcatggtggtgtgtggcagtggtggggaggagcggagcgaggagcgcgcggcgaagtcagctccgttgggagcaggccgtggtggagtgtgtcagcagcggggaggcgcggagcacgctagagtgaggagttgcggatcaagggaaggaggagcgtcgcggagtcatcgcgcggaggatggggccgaggtcgactccggtcgcggcggtggacctcggcgccggtgccggcggatggggccgaggtcggagccggccgcggcggctccggcggcggggaagaagcagcggctccagcggcggggatgcggcggcagtccacgcggggaagaagcaccggctccggtggcggggaagaatcagaggctctggcggcggcagtccatgcggggaggatatccagcgaggatgcggcggcgcagcggcagaacatccggggaggaggaggagctagcgaggaggaggagaagcgaagtcttcgcgtgtggagcgatgtcttcgcgggtggaggaggaggagcgaagtattcggcgtggcgtggatggatggatcgtgcggtggcgaaatcaagcacgcagatagacggtagagatcgattcgagtgatttggcctgtaggattggcggagggaactgctcctttttatattagtatagatatagatgagtaaacttcataaaaccacacctattgtggttcaaattgtaaaaactatagggattttggcacgtggcacgtaaccattatagtcctaaagttttataaaactatattgttgaccattttgacatactcctatataaaaaaaataaaaaaagatgcaacatctatatgatagtaaaatcctcataaatttaagatgtgattgtagaacttgaaagtatggtagatcaaaaataaaatgatcaatagtgtgattttgtgaaactttggtattataatatctagggttatatgcgacattccaaaatccctatagtttttgtgcaactttgatcatattaaattgggatttatgatatttgcttttattaaattgatatgctacatattttccatgtgatattactatggagtaataaatatcacctaaatatcttgacacgagtacttttacatgtttatgctagcaaaaataaaaactattggacacgagtgacgatctaatctatggaatgataggacttagcattatatgtactttgattataaaattttgtctacaggcgtgtgttttggttacatgtatatatattggccttgtttgaagaagtagctaagagttattttgagtgctatttttagcataaagaaatagccctaagttatttggatgcaagggttattttaagagctatttggcctttaatgcacttttctatggagagagaagacatttttcggtgggccccacccgaaatagccccaattagcactcctttacagatttttgggtgtgttatttccaaagagccctgaaatagctcatatgtttgaaacttttaggctgtttaggggctatttgagagagggctaaaaagtaacccatagatccaaacagagctactgagagtgttctcggtacaattctattgtgttgatgtaattgtatgagcttttttattaccttaaaaattttgttggaatttaattacataaactacaatcaatttctaaattaatatatgagataggacaagatgatgtcttcaaatcatgacacttacaagacactcaaggtaggagaaaaaaatgggctaccacaagttcatcaaagtaagagttaagcaagcccccttcagaaaataatatagttactaggattggtgggaaagatttcttttatatcgataagctggagcgaacacgctcatgcaaagaaaaagctcgtaagctgctcaaccaacaatacttctttacagggcgagtagcatgatgaatgagatggctgtaacggaaggggagcagcagataacaaggaatgtggtgcggaagaaatggtcgcctcccgggctggtcagcttaagctcaatattgatggtgcttttcaggagacgcaaaaaactggcggttggggatttatcttacgcaacagtgaaggccaagggctgcttgcgggtgctggacggctggcgttcgttcatgatgctgactctgcggaagctagggcttgccaggctgccttgcttgccgcttcggtgcagggcatcactgaggtggggatcgagactgattctcttatcctggtgtcggccttgaaatcctgagagtatgatcaggccccaggtactgccatcttcggtgaagtgaagctccttattcagctgaattttatccattccccgttgctgtaatagtggtgcccatgatcttactaaaatgggcgctagttgggacccgggtcaatccatcgtttaggtcgaccccctcccagaatttataaatgcctttgtggttcgtgatatcactgaacctgctgggtgaataaaaaggcatcgatgaagttcaaaaaaaaaaaacaatactccgttcttgaaacctaatcacgagcaatgtaacaacgaaactgaacgaggtaagcatagcattgctgatctaagccatctcgccttcttgaattgtattggattctctcaaacctataaagttcctttttctaaaatttagaggagatttcagaaattttaaaactctgaaaagagtaaaattgttcaaaataatattgttggattctatgtttgtccctttattacctctaactaatgtaattttactaatccacgcaaaaggactaggtttattgaatccaaattcatttatccaacaacatcaatgctggattcatcactagaaaaaaaagaaataagttcactttttaggttcctcaatttgtcgccgagtctaaaattcctccataaaccgaaatactatatataataggtcccttaatttacaaaaccagattatgtgagatcctaggtagtattacatccggttttagctgacgtgacaagctgagtcaacatgagacccacgcggatcccacatgttagtgactaccacttcttcctcctctctgtccccttctactctttctgtctctcccctctgccagggaaggactcgcagaagaaatcgtcaaactccagtagcgcatgtacgagcgggacgcgattggaacgagatcaagtcagagaagcatagtattgtgactttagggtattcttagccgtccgatttacagtgaacgaacgagatcgatcgctacagtataccacagtaacactactcttgcacagtgtacttcactgtttgttactgttgctacagtaaaaaccgcaaaccactgttctggcgatgaggacttggcgcagcttcacaagcgttgattccctcctagcgccgatgcacctaaggggaaggaagaatccgccgccgccatggaggtggagagcgagagccccgttgcctcggtggagtccagcttcgcgctgccgatacaaacaaagcaggactcggatcttggcccccgccgcccatcccagcaccctggattgggaagaaaggggaagagatgggatatggaagagagaggggaagagatgggatatggaagagagaggagaagagaggggagaaggagagggatcccaagctcgctacccgttttttgtagctacccgctcaccagcggtttggcaactaatgcatgatggcgatcgatggtttcccggtgatccgcttgccagaaaacaaggcgggggcaatggtggtacgtggtaggggcccggccagttgagcccgtcgctctcgttgccgcaattcccaaccgctattggatccgagcgaaggggaactacgagtcccaagctcccagcttccagcttctgtgatacgagtcctaggaggcgtgagcgagcgacacatgctgccggtggctggtgttaacaacggaattttgcattagattcggagaagaaggaagaagatcgaagcggatttggtgttgaatcgagttggatttggagtcagactacgcattggctagatatcgtatcggctaaaaatagaatatgggttgatcaaggttgatgaagttgatggccgatacagccgatatggtataacttgggctcggtttgggtctagatcgggataaccgtcattatcaattagagatagagctcgaataatacaattgtatctattaattaggatatttcagtcggtttgtgttagatttggcaagagaccgccgtctatggtcttgtttgtattttatctttagaaaggtttgaatcgtgtccataatggactaagtctgtactcggagtataaatatgaaccccataccactgtaatacgagagagaatccaatacaacttcagcgcatcgccaccctaatatacatgcttctttactggttttatgtatatttgccacttatttagacagatcatcctatataattatatcaagctagatcagtatcggctgggctatttgaattagtaactgatcatgatttcaaatgtttatatagattgatttgtttatataagttcgtactaaattattagctagtactttatcgttatctatagattctgctctaaatattgttccattggctattttcataatattgtctttatgcttctttatcaaacctaataggcagtattatcgtcggtgaggcatgtttagggtttgttattcactaatctatccagtccatagcctatttggtctactacatcagctgagatcaccaactatactctatcggcctatcggctgactaactatgcttttatctttattgcttattgcatgatcaaattagccggcctagcctgcccttgacacactcgagtaggacctgcattggagttaagcagatcttctagaccgccgtgttttcactcaacagctgggttgccccattcgttgctacggcggaccgaggtgggtggtgggcatgggcaaacaaggatcccatgcagagttttccccaggattgatgagtgctcggaggatggcggcgaggggaccttcgttggatcgatgagtgctcgatgtccgaaaggactttcaacggcaacgctagccccgacgcgggccgcatggatccctccgctatttcactagattggggaggatgaggagacggggagattggggagcaggaggaggagaagtgggtctgtcatgcccagaaattcctgaatagaattccaagcagaatgtgcattaaaatccccgtccaggaccggccgggtacacaaatgacaatgttgacattcagatccatgtcttacaaacatcataaaagtcttacataaatgcagcggaaaaacaaaagataactggggctaagcctggacttgaactgcagcgggaataccactccacaggcaccctcgacggcacggacgaagcctactcctcggagaacccgccatcggacacatactcgcactctggggttggggaaaaaatagagcaagactgagtactatccactgtactcagcaagtcataccagaataggggtatgatgcagggaattatcaaaggagagctagagtggttcatttgcataaagcgagcatttataaacagaagttgaaagaattaaacagttgcaataattaattaatattgatcatccgctgtccaacgctatcccacgttgcaacaggcccaaccatccacctatactatccaatttcattagactaaactagggtgagactaatcacggtgaatctggttgaccgcccataactgcgggcacggctattcgaatagttttactctgatcagaggtgtacagctgtacccacaagacacagccccacaacacgtttccgtgcgccgacatgccaccacgacataccggaaagagtccgtgataggacccttcgcataaccccctctagccaagcacaccacacctcaggtttcaccaccatccccagcgggcgacgggcagtcccctctcgcgcctaggtgaatccggaagccgcataggccgtcgcagggcccatccaaactccatcacgcccacccttgcctggatgcgtcagctagagaaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacaataccattagaaccaacagtctaaacattaataagattttccctattgtatcctagttgaactaagcatggctaagcaactcctagtccaacgtctattcatgttataacccaagctaacaaaggagtaaggtaccaaaatagcatggctgtaacaataggtaaacatcccataataacattataaaacgctttgcagctggaggaacctcggcgactatctcgaagtacaccggaacgtcggaagaaccggaatctaggcgacatacaaagcaaacaatacaaacaggctacaaaactactgaaacagagaacaaaccatttttaatggattctacgcatttttcttgatttactgagacttgaatgggcttaaacggagctcggatgaattagttatgaattttagaagattcactgtgtttattactataaaaaaataccttaaataatttattgcgcaataattcccagggctgacgtcatcaagggggtgcggcgccgacatgcggggcccaccggtcagcggctcgggagagagggaaaaggggcgccggcacgcgggccccactcggcagcggctcaagggggggcggtccaccgtggaccgggaccacgcgggtggtccaccgccggtccacgggaccaacggcccagatcgctcccggggctgatcggacgggcggcggcgacctggctcggctcggctcaaggccggccgaccggccacggcgatggcgacgacgcgcgggcacacgttgccggcgacggcaaccagcggcagaggcggcggcgctaagcggcggctaggaaggagagggaggggagtagaggggagagggcgcctcaccgagggtggccggcgcggaggaagacgacggcgaacgacgacggcaagccacgggaggacgacggcaaccggcggacgggcttcggggtgccctaaggaagaaggagagagagattagagagagggagatgaaccacggcggccggcatccatggccgaaggcggcggtagaggtagaactcaccggagcgcgaggggatgcgaattccggcgacgaatcccgacggaggaagggcggacggggtggagttcgtccttgcgaacccgacggcggcgacggcgcggtgcggcggcgagcctagcggcggctagcggcggccagagcggtaggaaaggcggcggcgggtgggtgcacggcgcgggagcgatggggagcacgagggagttcggtgaaatggggaaaaagagagagagggcgacggcggagcttaaatagggtaggggagtctcggacgtggccggtaggggcgagattccgccggccaatgtgggggagtgggagaggagagagagaggcgggattcgaaaatcgaatcccggccatctcgggcgcggccgagggtgggagagagaggggagtgggtgcgggaggtgcggcgcatgcgcgggcgtgaccgacgtggcctggaggaggcggaggcgtgggcgcggcggcgcaggcgcgaggtaggagacgggcccgacaggtggggcccacctgtcggcgtcccgggtgggaggagggaggcggccggcctagctgggccttggccttcggccggcccagcggaggggagaggaggaaggagaatgggctggcggcccactcgaaaagaaaagggggaaaaagaaaaagaaaaaggaagaaaaggattttccctggaattaaaatattgcttgctcaattttaattggttaaaattatttctagggctctgaaaattccactaaaaatcctgttagtgaatttcgacatgtagaactcaagaaaaattccacatgccagattcgattattatttgtattactttcttagggttttctcttgatttgcaccggcattttcttagggtcatttataaattaaattttaggcttgggaggagaacttcagggtgtgacgaacctacccccttaaacggaatctcggccccgagattcggaggagctggtgaagaggtgcggatgggcagctttcaactcatcttccctttcccaggttgcttcctcctctgaatggtgactccactgaactcggcaaaacctggtgaccttgtttctggttcttcttttgctggtatcaagtatatgaaccggcttctccacatatgtcaggtcctcctggatatcaatatgctccgaatcagcttgttctttgggtactcttaagcacttctttaattgggacacgtggaacacgtcatggatgccgatcatattggatggaagttctagctgataagcaacttccccccttcgttccaagattttgtatggtcccacgaagcgtggtgccaacttgcctttcgtctgaaaacggtgtactcgccggagcggagtgacacgaagatacacgtaatcccctgcttcaaaagtgagctcccttcggcggttatccgcgtagctcttctgtcgagactgggcaatcctcaacctttccctgatggttctgactttctcttctgcttccgctaatacctctgtcccgaatagttgatgctcgcctatctgatcccagaagagaggtgtgcggcacttccggtcgtataaagctttaaacggtgccatctgtagactagcctggtagctgttgttgtacgagaattccgcatatggcaagcttttgtcccaagctccaccaaaatcaagagcgctagctctcaacatatcttccaagatttgattgactcgcttggtctgaccatcagtttgcgggtgataggccgtgctgaaatttaaacgggtccccaattcttcctgcagcttctgccagaattttgaggtgaactgactccctcgatcagttacaatctttttgggtactccatgtagacacatgattctcgagaggtagagctccaccaaccttttgcccgtatacgtggtatgtactggtatgaagtgagaaaccttagtcagtcgatccacgactacccagattgaatcgtgaccagatgatgtccggggcagtcctgttataaagtccattccaatctcctcccatttccattccgggatttgaagaggttggagtaaacctgctagtctttggtgctctgccttcactcgttggcaaacatcgcagagtgcgacgaattcagctatttctctcctcatgctgacccaccaaaacttttctttgaggtcttgatacattttggtgctgcctggatgaatggagtactgggtctgatgagcctcggtgagtatcagatccttcagttccttgccgtcaggtacacacaatctttctcccaatcagattgtgccgtgttcatcttcatggaaatcccgggcttttccgactctcatgttctttttcagctctgctatttcaggatcatttacttgagctgctctgacttgatccacgagcgtaggccgtgcatccagagtggctacgaacccgtgttcaacaattcccacgttgagatgctcaaactcctgccgcaattcctcacacatgccctcgatgcatagggcagtgcagtaactcttcctgcttaatgtgtctgccaccatattggctttccccgggtggtagtgaatgctcatatcatagtctttgattaattccaaccatcttcgttgtcggagatttaggtccggttgggtgaatatgtatttcagactcttgtgatccgtatatacttcacagcggttgccaatcagatagtgcctccagatcttcaaagcatgaaccactgctgccaattccaggtcatgagttggataattcccttcgtgtggacgcaactgccgcgagcatacgcaaccactctgccctcttgcattaggacacatccaagtccgtggcgggatgcatcgcaatagacttggaagtctttcatctggtcaggcagaatcaaaactggtgcggatactaatttctttttgagctcctcaaaactcttgtcgcactcaactgtccatttaaacttctcatctttcttaagcaactgagtcatgggtcgggcgatcctggagaagttttcgatgaatcggcggtaataacctgcgagtccaagaaaacttcgaatctgcgacacggtcttcagtggggtccatttggtaactaactccacgtttgatggatcaactgccacaccctgagctgtaatgacatggcccagaagtttgacttccgtcaaccagaagtcacacttgctgaacttggcgtatagctggtgctccttcaacttctcgagtaccagacggagatgctgctcatgttcttcttcagactttgaatagataagtatgtcgtcgatgaaaacgacaacaaacttgtccagaaattccatgaacactttgttcatcagattcatgaagaatgcgggtacgttggtaagtccgaaagacataaccgttcgatggattcatgaaggccgtctttggaatatcctcttcccgaattctcaactagtggtagcctgatcgcaggtctatcttagaaaacactttagctcctttcagttgatcaaacaaatcatcgattcatggcaaaggatatttgttcttgattgtgacctcattgagtgcgcgataatcaacgcacatcctcttcgtcttatcctttttctccacaaaaatgaccggagcaccccaaggtgaagtacttggtcgaatgtaccctttctgcagctgctcatcaacctgcttcttgacctctgctagttcgttggccgccatcctgtacggtctcttgtaaattggcgcggttcccggtgccaaatcaattcggaattcaatctctcgcttgggtggcatggtagtgaggtcttcaggaaagacttctgggtactcgcaaactatgggaatctcttccaatttcctcggattcttctccttcgtgaccactgggatttccgcctcaatctgattcaaggagaccccttgctttggtgagactagtgatttgtacactacggtttctcccttctcgttggtcaaggtgactgtgcgattcgcacaatcaatgactcccttgatcttggtcagccaatccatcccaagaatgacatctaggtctttggattcaggaagaatgaggttggctagaaatggtgatctttggatttctattagcactgaagggctaaaactgaccgaggttgaactatttcccggggtatgaaccctcattggtgtattaagctcttctttccttaacccatgcatccccacaaatttctttgaaatgaaagaatgcgttgcaccggaatcaaaaagtactattgcagggattgagttaacaggaaatgtacccagtacgacctttggttctgcttgcgcctcctctgcagacgcgtggttgacacgagcctggacaaaccttggcccggcacgcctgggcttcgggcatttgtcagcaaagtggccaagctcgccacagttgaagcaagaccctggttttgttccagtctccttcttggcttgcgcggacgggcctgactgtgccggtgccactggtgggcgtggagctgcaccgcggttgggctgacctccatggtggttctgactgccactggcgccctggtggaagttgctagagttgaacgggcggtactggcggacgatcatggtggtaggtccaccctgctgcccgggagcgaagcgcggtcgctgatggtttccttggttggaccggaactgtgccgcctttctcttcctgtccattttatttcgctgatcctcctgacagattgccttgtccaccagcctttcaaaatccgcgtagtccccagatatcagttggttggtcagctcgtcatccagacctgccatgaacttttcctgcttctcggcgtcagtgcggacatcctccgatgcatatcgcgcgaggcgattgaactcatggaggtactcggtcactgtcctgtttccctgatggagtgcccggaatttcctcttcttttgtgccacgaccccgtctggcacctgcgccttcctgaagctacgacagaactccgcccaagtgacttcagtgcctggcgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatggggttggtggtgctggagaaagtgggtggcctgacacgtagaaactctggcaacttggactgagggggagggggaccaaactgctggtgctgctgttcggcgtgctgcagcatcctctggtgcatctgctagtgctgttgctgcatctgctgcatcatggctgccatcatctgagtctgatgtgccatcacttgggctagcgtcggattctcgggaagtggtggcggaccattgccggaatcgctgttgggatgcacaccatcagtgcgctcttcgtcgttggtgccctcgcctgttgtacggctaccattcctggtgtagaccatctggaggaagagcagacggggaaaagaagaaaaacagatgctcaagaactaagctttattatataggaatttaaactgcaattgttctgatctgaattaaaacacttaaaaagcaagcaaaaatccttattaagacaaccatatcataggcacatgatatcgaccgtcgactgacccacaagcaagcaacctaaacacacaaactaacaaataaatgctagacagtcgataaactaatggaaaacgagcctaatgctcggaacggctcctgcggtcggtggagtcgaaggcgtcctcctgctcgtcaccaggtccctctgagcgactcctggagcctggcggataagtctcgccgctgcccggctctgagccactggagctgctgctgctgaggtcgcgactgccactgggagtagctggcaaccaacctccattgccactggcagggaccctgacggctgatgtaggcgcgaaggagagagcggatgcaggagctgacacgggaacgggagctggagctggtgctggagctgcaggaactgctggagctgcgggcggaactggaggtgctgcgggagctgctgatggaggtgggttcctgggcgcaagctggatgcgcatgggtgccgttgtcgacttgcggggtgtagtgcggatccggactcctcctggcgcgtgaagaccctttaacagagcattctccctcttcaggcgcgctatctcgtccttcagagcgacgatcctcatgagcttcccatcattcaaggccttggacgccttgtgcaggtccgagtgcatcctgtccatccccctcatcacagtgcacatgtgaccaaaggtggtgtcattctcgccggctgtcggacggaaagtactgacatcatcaccgctggctcgacgagggtgaaatcggtatgccgtgtcgtggaagatgtagttgtggcgctcccgtagtctggccatcatcaggtatgctgcctcctgacaggcgtgatctgctgtgccttcggatgcctcaaccaccatattagctaggcaggtaccgacgtagccatggacctctaggcggacacggtgaggaagctcgccgctgagtggtggaacagtcgtgtactctggcgcgttggggtagcccaccaccagcgtcatacgtgctaactctgccacaaagtcgatcatgccttctccgcggtggttgggtgggtggccggccatctagagaagacaaaggagtaggatcaatgcatgcttaaatccaaatttaaataaagcaataaaggactcaaataagagaatcgaataagagcgaaattttatgcatagataattttgcatgagagcgaataaataagacagacttacataacgataaaataatggggaaattagatacatactaataataacaataaaggtacaaataccttgcaacccatattcctgagctaggacctaatgcatttcacccatcaaatcccaactgactgacgaataaaccccaaataattttactaaaaccctagactgacttgttttgccaaatctcacttaaacaagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcctagaaattcctgaatagaattccaagcagaatgtgcattaaaatccccgtctaggaccggccgggtacacaaacgacaatgttgacattcagatccatgtcttacaaacatca

SEQ ID NO: 1758 - DNA, 5204 bp, Oryza sativa
  unsure (1)..(5204): unsure at all n locations
aaaaaataatgcacgccatcaataaactctttggaccgccggtcagcgtacatccattgccgatccatctacataaaatgaaaaaaaaaatcgtacataaataaattttcgtacaataatgacagtcatacaataatgataaaataattaaaaactctttcaacagttataaaataatgacatatcattattcatacaataattataaaataatccaacaaacaattcttatttattatttttgaagttttaaactaatattaatgttgtacttctttgaattttcaatttagtttgttttctattttttaagattaattttcattatattttaaactatgagttaaaaactctttcaacagttatacaataatgacatatcattattcatacaataatataaaataatccaacaaacaattcttatttattatttttgaagttttaaactaatattaatgttgtacttcttttaatttttaatttagtttgttttctattttttaagattaattttcattatattttaaactatgagaataaaactttcttaagtaaacaaacaaaattcctatatattcttcttccccacacaaattttctctctcatcaacttacaacaaagttttggagacaaaaaaaatatgtgaaacattgctcccaaagtaatataacaacaaaaaaaacattggaggatgaagttactaaccttctatacacctccaatttatatataatcaccaaaaaaatttcacaagaaattttggcatgacctcccctcttttttgaagaaattttgaagcttgctcgggctgaaggaggaagaagacatatataaaggggatctttagttccagttggtgttaccaaccgtctgaccgatcaaagatggtttctccactggtgttactcctggaacttattaatccacaagctaacatttaatgaattaactctcttagctacagaaaaagttcatttgacgttctaattatatttttcttatcttctttattttatgtttctcttcatatatacaagtcgtattttgctttgataaatgccaagagacaaaagctaataataaatccatcgagtcaataaactcatatccttgtacgtagtagctttataggtttctctacatcttgtatatatacacgccactagctcaaaatagtttaaattgttcctattaaatctacatgttaagacccaagtggactatatgtttttctctaaaatatcgtacaggtcctacgtatcatgaagaaacaatgtccaagatatgtatatttcttccgtctttactcattgacatgaatgcatacaacaaattgcatgcttatgaaccaattaaagtgatgactcgaatgttacaagtaaaatacattttgttagtaaaagtttctttgaggtttcttaagaaaaaggagacaatgagacaatggacgacattcaattaaaaaaagagaacatcttgcttttaatttaaacttaatttgttagacctgtttttctgcacaaattatacatgtgcccgcgcgaatgcacgggctaccttcctagttgtactctaaatattacaaatacgcgaccggtaatatatagattgaatatgggtacagtgatacaagcctgcgcagtgctcaattaaaccttgattcacgcctgtctcttggattagaggctacgggtgcctattgcggttctttctaactatacaagtgattagtagtttttcttataaattaaatatggactcttcttacaagatattttttaaaataataaattataatcgagaaatgatgacttgatatgatttatgaaatcgcatgccatacatccttgctaataatactgcttgctgagtacttgtactcacccttgctattaactatcctccaaacacttttgggcaagccacttttgggcaagccagtgagttaaatggtgggttggagggtcagtactatgccccttggtgtgatgaaaatcaaggggatgttgtttatgactatcacgtgtattatggaggatgggatgagttgatgtacgcaggggagtggtctagtagctatgtcagtgaacctgggatatcgaagcaggaactcccccgtctaaaaaaaagacaaaccataaattttcgtgtccaatatttgactcttcgtcttatattaaacttttttataattagtattttcattgatgttagatgataaacatgattaatactttatgcgtgacttgtctttttaattttttttatatttttttcaaataagacggacggtcaaacgttggacacagaaacccagggtttgtcttgttttgggaccgaaggagtaatgactaaagtactgctagctcctgcttagaacttgtattattaatgggtgaacttgtaaggccatgtttcagactttaaccctgcatggcatggtattgtaatgttatctgaaccttcgctatctctgatgtggatcattattcgcaaaagcgctactgtggcgaaacataattgatggactagtgacgtcattttggtaatgacggcgcgggtcgtcacaatattcttactctataggaccgaaatcttttgaaaaatattatttctgtaaaaatgtatttaaagccactcataagtcatcacggaagagagagcgggtggataaataaggaacgagagggagagagaggggagtatgataagtgggctctattttatttattttattttattagaaaaaatgctcgtgcattgcaacgggaaaggctattttaatcttatttttgttatatggtttagttaagatgaaattcactgtgttaaattcgtttggatatatatattgttagaaaatcatgatctgcaactaggagtctgatcttctcaaattagcatgcgaatttttttaaagagatttcttatacgatttcttctgtatttccaaaagcgaatgaacttaaaaaccaactcaaatatggatttgtatttccaaaaacgaacgaatttaaaaaccgacccatacacaaatggcgtaccaaagtaccgataaaaacatcttcaatttataatagtagagaagagatataagtagtagatagatagagaataacaaattaaaaccgactcaaacacggatgacgaaccgtaggagcatcttcaatttttataatagtagagatttgataaatgggatgccacgtgtacaccacgtcaacagatactatagtcaatattgctctggaattcaaattataccgtttttaatagtttaagatcatgatatcgggtattacgtactctctctgtcccaaaatataacaacttttagccatcaggatttatcccaaaatataacaatttctccagcaacattctctttccaaccaatcataacccaataagagcaaaatggaaaacttgtcgtgaaaaattttctccaaaaatttgaaatttttgagtatgttacaagcatttagctgttctcttcccaaccaaatacaaccctccaccattcacttttcccatatacctccactactcatcgaatcacaaccctccaccattcacttatacctattttcttaataaccgtatcccacttaaaaactttttatattctgcgacggagggagtattatagttgacaaaggtatattcagggagtcaaagtggacttatcactgcggctttgataaatccgaagtggactggaaaccgacaccgtgtgatccgtgggcgggcctggacttgttctccttgtcggattccagcccatataccacatcacaggcgcaggggcacagagcagggcgacccgtcgtataaaaccctaacgccgcctccaccagctctctcaccccagaattcccaaatccgcaacgcacgcacgacagccagagagagagagagagtcagaccgccgacacccgacgacatggccgtcgcctccgcgtgggccaaacccggctcgtgggccctcgccgccgaggagcaggacgacctgcccccgccgccgccgcccgttcccgccgccgacttcccctccctcgccaccgccgccaccaccaaggtccccaagaagaagaagccgcagcccgtcccgctcggcgagttcaacagcaccaagttcgtcgcccccgcctaccgcgggcccacccaagacgacctcctcagcctccccacaggcccccgcgagcgcaccgccgaggagctcgccaacgccacgcgcggcttcggggctcgctggggcggcgccggcgccggtggcccccgcggcgacgacgagccccgccgcggcggatctggcccccaggacttcggcccgtcgcgcgccgacgaggccgatgactggggcgccggcaagaagccgctcgagaggagggagcgcatgggagggtttggcgtggactcttcgatgtcgcgtgccgacgacgtcgatgactgggtctccaccaagagggcggcagcccccgcgcccatggagcggagggagcgtagcgtggcgttcggggccgactcgcattcccgcgctgatgattccgcgagctggatctccaacaagggctattctgcggcgccgccaccgccctccgacagccggaggggcggtccagtctggggtttcaacagggatggaggcccagacgccgactcttgggagaggaggagggaggaggtgagcggtggtggttcaagcggtggtgcccggccacgcctgaaccttcaaaagcggaccttgccactggctaatggcactgatggagaagggaaggaggacaaggaggaggagaagggagagatgcagcctaaaagcaggtcatcaaacccgtttggtgcagcccgccctcgcgaagtggttcttgctaccaagggagatgacgggaggaaggaggaggagaaggagaaagaggaggagaagctggagattcaaccaaggaccaggacttcaaacccgtttggggctgcccgcccacgtgaggaagtgcttgctgcgaagggtgaggactggaggaagattgatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1759 - DNA, 982 bp, Oryza sativa
aaaagagagggaaaaagaaaaagaaaaagaaagaaaaaaaaagagaaaaggattttccctggaattaaaatatttcttgctcaattttaattggttaaaattatttctagggctctgaaaattccactaaaaatcctgttagtgaatttcgacatgtagaactcaagaaaaattccacatgccaattccgattattatttgcattgatttaaaagggtttactcttgctttgcaccggtattttcttagggtctcttataaattaaattttagacttgggaggagaacttcggggtgtgacaccggccggcgccgtgggtcccacgcgtcagccgcacctaagggcgcgggcggctgacggccgggccccacgcggcagccactcggcgcgcccgagggcggccaagccggcacagccggcgggaggcggcgcccgcgcccctatggtcgccggcggtggccataggcacggcagagcggcggctgagagagggaaagggaagggggaaaagaagaggcggtccacggctcaccctaggtcgacggcgacgacgaaaaaggcggccggagcggaggaaggcggcggcgcggctcgggtcgacggggtccacggcgttccggcgggcggcgagcgaaatggaggggtggacgaggtcggcgaggatgcggccaacccgaaggaggcggcgccgaggtgggaggtggtccggggcgacgacggcggcggaccggagctcgacggcgactgcagagagagagagcgacggcgcgagctctattccggcgaggagaaagggcggcgagaggcggaaacggacggaagaggtgcggggagggtttaaatatagccgggtccagagagggtggccggggaagggaggaaacctgcgcgggaggtccggctgccatgaatggcgccggcgagatttgcgggggcaaatcccgccgtttgaacgagagagagagagggaaaaatgggggg

SEQ ID NO: 1760 - DNA, 3985 bp, Oryza sativa
agatgggccgagccggcccaagagggagagggagggaaaggggactttttagagtttttctttttataaaatcattttaactttgtttatttcttaataattattatttgtgctctgaaaattccactaaaatttatttacgcattttaggcttttaggaaatatacaaaaatctcccaagccttatttgacttttaactttgcaccttttaattgttggaggctttcacatggattttaattattcttggcataatttagaggatgtattttagagtcgttttgggacgtgattatagggagatctgtctatataagtggcaaatatacataaaactttagtaaaggagtatgcatattaggtaagatcgactgaaaccccgatactacccttattaacaatcaagaaacaggctagagatcatggttctaaacacgacttagtaggtcgaatatactgatgcggcactaagtatgaaaagaaacatgatatctaaacaatcaagccattgactaaattttcagggtggtagatgtctaagctaatctaatctagcaacacgatttagccgataccggcaggacccctaaagcgagaagcaaccgatagagctaaattgatatgctaagactaaattaatagagacatatgataacgatggtcacgataaaaaggactaaaatatctaaaaatgacatattagcccacgatagcacaagccatcgagacgggttgcttcttgtgaagcaaactcgtcgaaaagtaaaagagaaaagggtggtgatgcgccaaagttgtattggattatctcccgtattacaatgctatggggttcatatttataccccgaatacaaacttagtccattatggacacgactcgaacctttctaaagataaaatacaaacaagaccatatacggtggtctcttaccaaatctctaacaaactgacataactatcctaattaatagatacaattgccttacatgagctctatctctgattggcaatgccggttatcctgatctaggcccatgccgagcccaagttatatcgtaccggccaagccaagcctttgtccaatttttagctgatgcttagtccgtcttggagataaacttgataccacaccaaatccgcttcggtttccttcttcctttttgaatctgatgcaaaattccattgttaacactaagataactgataaccagcagctacaatagatagattagaacatttaaaacgttatactaatccaccgatgcaaactactgtgacaagtcatacctctcatcggaagatcgaagaagatgccccaactcgaaacaagaactcattgagaaaattgaaaacaaaaagtttggcgatgcactgagagtatattgaactgttgttgttcttcatacaagaccctgggcatatatttatactcgtagtacaaaacttgttcatatcggacatgattcaaacttcacaaaataaacacaccagcccattgtggatgctaatatagatttctaaaacacaaaaaggaaagcttactcttatcctaattaatagatgcaattgcttctttggactctatccttgtatggcaataattctgaatcctcaatccgaactcatcatgaactcgaaatcgtatgtatcgactaatcaaatccaactctatatcgactgatacagactccagcagatgcattgtttcattttggaaaccaaactaactccttcaaatccgcttcggatccatccttatgtccacgtatcttaccaaattttgttgttaacatctatgctttgtggattctggctagaacagtcactggttgatgtgtacctgtacaggtagatcacgcatgtgcatgttgttgatgtagaatcgcgccgccacaacttgagcatgttatgtgcaacccgcggaatcacccggagacgtgccgctgtagggtgtgggtagaggctgccgaacacacacccaggagggaccctgttagggtgaatgcgctctggtttgtgctagactcggcaggccagctaggatgtcctttaacaccgtagagacgagaggcggcgagcaattaggggatttggggagaatttacttgggattggaagcaaggagggagatgtagaatatagagggtttggataactaaattgagtttgacgattgagtggttattgtttcaatcgaacttgtcccccttatatttatattaggggtggacttacttcccatggtctttcccacgtccaattaggcttagaaatcaactaggactcgagaaatcccgattgttggcggctgttaaatacacatttttataccgccagcatttgcataaaactcatataataaaacatccaatatagtggtaggtgttaattctaacatattccacgagtgttggtgtttaattgatgcaggtcctaaaccaccgaagttgggagaaaaatcagtctaaagtgaagaaggaacatatccatacaagggaggggctttacactttactaaaataccagagaatcagcccaaaactcacagtaatggataaagcagaacaggaggagtccacaggccaaaattgagggccagatgggccagcccagaaccctgatctccaccgttgatcctggggtttggcagggacgctcctgatttgatcctaatggcggttggagggcacttcggacaattctcgttccacaaccgtcattaactgcctatttaaggagtttcactcattcgcttcttcacacacttccaagcttgagctgaattataagaggctctgttgtactattttgtatactagaattaggaagagagtagagtagaagaaatcggaggaatttcggagatgtcggtaatcctctcatgtttattttattctgttaattactctattttcaatagaaatatctttctgagtaatttagatttacttgtgagtacttgtgagaattacctcttataagaattattgatcacaaacatatattgatctcgccacaattccgtcatcaccagccacgccaagcaccaacccgtgatgtgtttgtgcttctaacggtggctgctataacaatactgccatttttcatttaagcaggttgtccatagaagtcaaatttgagaacttcatctcttcagtcctttggctcacatagcaaaactctgagttatcgtatacatgatttgttagtaagtcagagtagcatatacgtaattgtagtgcaagaaacataacctaaattacccatgcataacttgagaccacctttttttttattcaaacaagtatggcggtcagattccatttccttcattgtggttctttggcttgccttagtcctgacctgcaatcgataacattgtgcaatacatctaaatgagaaaaaaaagattcatgcatggggttgaaatgaatgaaaatcaatgttgctgtccaccctgaagatgctattgccatttttccaaaacattgcattgacgaaataatgaccgaacaaatgaaaattcagatggaagcagtgctctgcacgtattgcacatgcaaattcaataatgcacacatgaaaatttagataagagcaggaaatggagatgcttaaagcatcacaaaaacaaaactctagcagcaggcctacctatgcatgatccttatccatatttcatatccacaaaaaaaaactactactattttgtagtcataatactgctaaaaatagcatgttcaacgagaccatatatatgtacgtagtgagcagttcagaaacacaatccaatccatctcctttttcaacaagaaacatatcgtcagaagttcagaaaaaaaatcaatcgatgtgctcctttgaacaacaaaattttggaaatgttgctatccaatcgagttatttgagttttcatctatccaaaacttcagattcaggacatgcagtaaaaatttcagaaactacaagcatatgtgccaat

SEQ ID NO: 1761 - DNA, 6235 bp, Oryza sativa
ctgtgggtgcatggttttgctggtcgcacccatggcagttaaggaccggttcgcgggatgccctggaagaacttatcgtacttaccacaagccagcgtgggcaacggctgggcttgtagcgtagcttttctctagccgacgcatccaggcaagggtgggcgtgatggagtttggatgggtcctgcgacggcctatgcggcttccggattcacctaggcacgagaggggactgctcgctgccttgcgaggagtgggggtgaaacctgaggtgtggtgtgcttggttagagggggttatgcgaatggtcctgtcacggcctctttccggtatgtcgtggtggcatgtcggcgcacggaaacgtgtcgtggggctgtgtcttgtgggtacagttgtacacctctgatcagagtaaaactattcgaatagccgtgaccgcggttatgggcggtcgaccagattcaccgtgattagtctcaccctagtgtaatcttttgaatttggatagtttaggtggatggttgggcctgttgcaacgtgggatagcgttggacagtggatagttaatactaattaattattacaactgtttaatctttcaacttctgtttataaatgctcgctttatgcaaatgaaccactttagctcttctttgatgattccctgcatcatgcctctattccggtatgacttgctgagtacagtgggtagtactcagtcttgctctatttttcccaaccctagagtacgagtatgtgtcagatgaaggtttctccgaggagtaagcttagtccgtgccgtcgaggatgcctgtggagtggtgttcccgctgtagttctagtcaaggcttagctcctgttgtctctctttctttccgctgcatttatgtaagacttttatgatgtttgtaagacgtggatctgaatgtcgacattgtcgtttgtgtaccccggccggtcctggacggggatttcaatgcacattctgcttggaattctattcgggaaattctgggcgtgacagccggtgtgagcccgggtgcacccggtccaccgtggaccgtgaggctgccgcgtgggccctactcccgtggacccggtccgcgcgccccctcccctcggctgacacaataaacccttttaaaattaaaatttaaatgaagaaattcgcaaatattcatttaaagagcatataaactttaaatgaccataagttggccatttgaactcggaattggaccgttcaagtctctaatttttccttaagaagtcaagaacccatttttgtgctttgttccagcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcctagtttataaaattattttgatttaacttattgcattatcgctttatttaaattcccgcgttatcattgttttatctagccatgcttatgtacctttgttatgaccttattattgttattgttattatttccttgttcaccctagaataaacaaaaccccaactagtggacactctactcatggtaccactagtataattttagttagatgcttcgctggttaattaggtaacattaggtggtttacaactctagactttgggaatactcttatcacctggacactatggaattgttggactattgtggaattggattcacacctcctcctctattcaaaatcctcaaaatggttttaggctgggctcggggtgcatggttttgatagtagcacctcggccatataaggaccggtcttcgggcctatgttgcaaagcactaccgtacttccacatgtctagtgggtaaggcttagtttgtggctcagtctggttataaaaaaaagtacacggatggagatggacgaagtcggggggtcgatggacatctctagggcaaatgaaggctacacgagctgcggcccggtagtcgagatgtcatggcacagggccggtgtcctgctgctaggggctcagtcctgcctacctgtcccggaggttccggccgtaagtggggttgggtcggtactcttatctatggctaggatgggttggaaactatgtcacgtcttccgtccatataccgtggtggtatgtggcacgtggttacacgtgaggaagatgtgtcttgtgggtaaagatgtacacctctaatcagagtataatctattcgaatagccgcgccctcggttatgggcaagcggagcaatgtacccaaattagtgttttaattctaaaaacctgcttaacaactaaaatgtggaatggttggcctgggttggcttgggacgagctgggacccagggtcgggttgccggttcggtctgaatcatcgtaggccttgggttaaggcaggttcgtgtgggttcatggccttgataaataatattgcatagttctagaatcgtgtttacaaaatagctttgagcaactaagcatctttaaatgctgtttactgcaaccctaaccctttatattataactcccttgtactcccttgcatttattatgcacttgtgggtgtgtcttgttgagtacggtggttgtactcagtcttgctcaatttttcccaacccagaagaggagcccctggatgatgaaggctttggtgtctagctcgcgcctgccgtcaagcgcctgtggtcgtcaccctagtcttccgctgtttcccgtttgtctttgtgtgtgctgggtcttcgccgcccatgtaataaattaactatttacgcttccgcttgttaaactctgaactatatcaacttttggtgtaccttgcctcctgggacaaggaataatgcacgcacgtaaggaacgcccgttgggttatttttggtcgtgacaatagttatgtcaaaccagattggtatcggctgggctatctaaactactaaccaattatagtatgatatatttatatagattgattcgtctatataagcatgtactagagtattagctagtacattatcttccttgctctatttgctctaaatattgttctatcagctactttcatagtattgtcttaaacttctttattaaattttgatggacagtattacagccaataaggcatgtttagagtttaatattcactaatttacctagtctatagctaatttggtataactatatcggctgagaccaccaacgatatgctaccggcccatcggccgatcggctatcggttaactaattctgctttttgtctttcttgctgattgcaggattaactcagctagcatgcccttaacacactcgaggctagccttggacctgcactggagttaagcagatctcccaggccgcattgtttttacatcaacacttagttaatctaacccgatgactcgatttacttgcatcggccaagccttttgtatggttttgctagtatcggctaaatcgtttagtcagtttagattagctaagatatccaccaccctaaaaatcaataaaaagcttgattgtttagattttatgcttccttccatacttagtgctgcatcaattgagtttgacctactaagtcgtgtttagaatcatagcaactaaccttgattgcaaataggggaagaatcagggtttcagctgatcttaactgatatgattgcctttctttgtttaatatcttcaatctagtttttcatgttatatctgccctttatataagtatatcactctatttaaatatatcaagcttgtattcaattttggccagattatcatatttgggattgatgcttgtttggtatatttacttagaatgatattcttatataaggttgtatcagagcaatagccaatattgtatctttattaacctaaactctatatcatctgctaagatattattgacgaaaaatccgtgatcggccgatagtgccggaactgtgttggcgcgaactaagccgacgaacacagcggcttgggagatctgcttagctccagtgcaggtcaaaaatattgatgagatgtgggcgtgccagtcattttgatcctacaactgacaagatatgtaaacaatagatcaaatagccgatcgactaacaagccgatggagcaattctagtcgataccgataccagccgatgtcgatagggttttgagcaatcagctctatgtacaattaatgtagattctaacactcgagtaaataatgatatatagataatcggctgataataatatatttaagcaacaatataatctaatagaaaccaatcggctaataatgatcaagtgttgatccaaaggttaaagcatacatcggctggaggtctgatgtcaataaatccaaacgattagataaacagtaaaacctttgctgcaatcggctaaatccaacttgtatgtaatccttataagccgatgcaacatccagataactcatcatctgaaaccccgatgaaacccttattagcaatcaaaaagcaggatagaaattatggttctaaacacgactagggctgatgcagtgcaaggtatgaaaataaacataatatctagacaaccaagcttttcactattttttagggtggtggataccttagttaatctaatctagcatgataatttagtggataccagcataaaccttaaaaagaatctcacccgatatgatcaaattaagatgctaaactagattaactaagatatatgataactagcggttcgtagaagatagattagaatatctaaagcgatgccctaatccgccaacgcaaaccactgaaacaagtcatacctcttgtcagaagatcgagccgatgccctaactcaaagcaagaactcgtcgaaaaagtagaaaggtaaaaggtggcgatgcgctgaagttgtattgattgcgaaatagtttacaatgaccccgggtgtacaaatttatacccatgggtagatactagtccttgttggacaagaaagaaactttactaaaataaagaaaatataaattccttatcggacactaaacacactttcctcaagataaaaggaaactaacaaactcttcctaattaatagataaactgtcatggagcatcctctttgaactcggtcatttctagataaacttcctttaatagattcctttaaaccgaatctactaagaatccgactattggtgacttgataactcccatcggccgattccaagatgctaaagctgatagtgaatctaagccgatgatgacttcggggcttatcaaattttgatgttaacacatggttacagatatgatccgcaagcgcacagatataccattgtagcatttcacttggaagtattccaaggtatcgtatttatttaatcccaagggaagatatgataagagagtactttgctactaatttatatattacttgtatacatcaaagtctatgcaggggttaattaattcaagggtaggataaggttgacacgaagaatgaagaactaagatactctcactaatatatataatctaggctaaatggagaaagaataagaaaataatcattcctatacttctagtatacattcatctttagtttacaatcatgtagccaataccccctaagtatgccctcgcggtgtttctagagactacccctgatgccgagttccttacaacaatccgttatgaccatccaaccggaaatgaatacggaggagtacccataccaggaaagtgtctttggactatatactaacatggaggaatacccgtactaagctatcaccatcagcagcccacctctactgacctgcagtatataaccccaattaatgatatctaataatctaagcaccacgcttacattattaaatacaactctacatccccaagaacgacatagagcaatcactcgcatgaacattaaacccacaccaatgcatatctcaggtaagctagctacacaattatatcgagacaagtataaagtaaagccgatactcagataatataaattaagtaaaagaccgaaactatataaagaagaatatttcattaactctataagtcttacaaaaggaggaaaagctactagagccatacccaaaatctcttgaagactcgaggactaaatgaactattctattcctactccactagcacaagaatactgaactaaacttgagagag

SEQ ID NO: 1762 - DNA, 8068 bp, Oryza sativa
tttagtgtcattccctgcaaatactagtggaagtttattattctaatacatttatgcattgcaagcatcactagttctcctctattttggtaatattgacggtcaaaactgatctataacgaccgtcaacaaaaccccccaagcttggacctttgctcgtcccgagtgaaggacgaaaggaatcaaagacttggttgttgatcaggagttgctactatgctgcatatctcaaagatacaggtgcaaggtatatgtactctctctcagattaaataatttttggcacggtggcttacccttacccctgattcccacgagacactgcttttccttgccttgggcggttgaaagattgaacagcaatttagagtaccaatcacccgatctttatattcaactcttattccggaagttttcaaatgattttgcaaaaagaaaaccaagttcctcaaatgattcactcagtctctcttagtgtatcaacatgaattcctcaccaaatgttgtcttgttgattcctactctaaggttttatatgtagagctcggtagggatcaaacatggcatacttgcattcacatttattactaagtcaaaaacttagactagagcagataactaaacatactcaagatcaagatcgtgcataatgtgtgtgtggtatatggtggaatggcacatgaataaaaaaataaagaaaatgcttctcctttgcgcttactttcttctcccaaaaatccttcttttattgattaggagagggcatggctatattattttttttcaatcatgctcatgcttgatggagcataactttatttttttttctttcataaccatgcctttccctccttctctctttttttttcaaaaagtatattattttctttaggagaagaaagcacatgaaagcatggagaatttattttgatggtaatatggaaatggaatggaatattgcttagctcccagtgtaggagtttggcatatgcatatatgtgggtgtatgaccttgatcatagagcatgagaagtatctacacaagtcacaagagtttgatagagttcaatggaatgacaagcaaccaaaatgtatatggtttaatcatgatagcatatttttggctctggtaggaatttatatcaaatgaggaactttcaaatttattagtttgaaaaacaaaacatccggaattcaagtcaaactagtatcaggatcatagtaactcttatttactatctcatatctcacaacaacctagacttagatcagcaagtgcagcccatttacctgaggttcccggataattgttggctacttatatttaacctttgagagagtatttaccaagaacccatatatcagagatataaaatagagcaactatttatcatttcaacaaagagaactagcttgtcttacctagcttgactcaaacctatcctatctttttggtattttatattttgcaaatttttatgttgttttcaagttttataaaatgcaattggaaagggaaatatgcaatgtgatacaagttacctcaataggggggagcgatgtctccccccaagcttggctttcgctcagggtccttgataaggattgaacccccgaaaacggaagtacgcttgaaggtcatcgtgcttttgctgcatcatgttgttgttgttggcgaactgagcattagcagattgttgccattcttgcgtttgagctatgtgttccgtgaggttgtactggatctcccccgtctgcatatcaagggtgtccattctcttagtgatttcacccaagtcccaacgagaggaactcgagcgccattcacttggagatggaggcacaccacttgatctgggaggttgattgtccccccattggatgtcatgaggcgcatgccaccggtcctcactggcgcttgtccaggttgagattccgatgctatggcgtggagcttgggtccacccgggtgcatcccagttggtgcccaacctgcatcatacatctgcacgggtgttgaggatgatgaactttcttgctcattccttgtcatgttgcgcgtctccctgtatgttccacctgcacgagattcttctatggtctgcaggggaatggttacttcatggcagttgtacaaatgataccccgcatttggcaacgggatttcatttgtacaaccggggaaaaagtatatcaaagatccatctgctccatgtttcacaatatgcccttgcactagataagcctcatcaatacgcggacgagcggctgagataaaagcaatttggtcgctaacgacccctagcccttttgctatccgagtaatcagagaagtgcactaaacaggagcagagaactttatactttctaaccattgccttatcatacatttcacaggagcaattttgatttttctaaccatggcaaacatgataattaattcatcccctaatgggtatcagatcacctctaggaaacaaagtcatagcaatccatttgtacatgagcctaagtgtaggattatggatatcattcgttctaggtttcttgcaaattgaagcaccagaaatgtcttcccaaaacctatttttctcgaacccagaaattcctttccggagatcgattttataggaattgtgaaatccaagaagtgtactcaagcctttccatgtgagtgtgaactccttacgaaaaaagtgaaaagaaataccatattctatttctttcaagtgcacagaaattgcaaagtaagcaaatgagaaccaggctcatctaccacagcaaatctcttccaaccaaaaactttccagatagaacaaaattcaacatccatacctatcttttttagcaactccgaagagtattctcgcgtgtgagcatactcccggtcgctcagcatgtagtaggcttgtctctcccgatcactgacaaggtcgaggtcggtgtcgttcaggagtcatcgcggaactttggcgtcttccatcaagacatcagctgatgaacgagtactagactcatcatgatgacttgatgaagagccggaccctttgaatagacgagacagtcgcctcctcatactgcacaatggagcaaaagtggactaactcggcgggggttagaagtgacaagaatttcacctgccagttagtttcaccaaagcaacttgtatatatatgcaactaaatttttgaatttgagggaaactatcaaagcttgaatgaacttgagagcaaactttggagcgggaatgaaaatgtgttgaaatgggatggaattccctctcccagccgactggcttttatagggtgcccacaacggtcagaaatgacatgtgggacctactagccgttaccctgccaaaagtggcagggagccgttgcctggccggttcggccgaaccagggtgttcggccgaacccctggtgggcccaaccagccccacttttggccgttggattccaacgatcagtgtggtcgtggcacagtaaattttcgttgaaaattttattttggtttgctctgaaaaattcatttgaagaatttcctcaaaattcaaaaagcctaaatgcattttgaaattcaaatatgtgatgatgcaagaattcaaattgttgaaagcaaatatgcggatacataccaatttaccttttgatgaaggtcgcatcattttaggtccgacgtgcaagaccgtccctcctttcggttcagtgcgcggattttccacccgtctccggaggtgatggagcgggcgtctttggttttccttccacaccttctttggttttggtgcggaagacggcttcttctgagccggttgctctaacttcttggccggtacgggtgattttaccggcgttttccaataacggttcctgggcatcgttgtttccttctccaggaagttctgcataaatttcaccaggctgtccgttttgggtggctccactttaaccacttgaatattctgcgggttcgacccgtactttattctgaccatggagcattgttccgtccttggttgaaactcaaatctttcctccttgccattgatatggaaacggatactactcgttcccacatcgatgttggatcctgcggtgctaaggaatggacgccccaggatgagtggcgtctccttccccgtgtccatgtctagcaccacaaaatcaaccgggatgaagaagtcccgtatcttgactggcacatcctctgctatccctaccgggtaacggactgatgagtcagccaattggaggtacatcagtgttagtgccaacaccgtgaagttgagcttgtcgaagacgtcttttggcatgacgctgatgctggctccaaggtcacataaggcctggtcgaattgttgtgccccgatcgagcaggtgatcgtaggacaccccagatctttcttcttttccgggagcttatggagtatgacgttgctgcattgttccgttagcttgaccacctccattgttgggagcagtctcttgttgttgagtatatctttgagataacgggcatatgtcggcacttgtatagcgtccaacaacgacacgttgatgtggatcttctggatcacttcaacaaaacgagcgaactgctcgtccactgacggtttcctcatccgttggggaaacggcagcaaccgtgtgtcacagtattcctgcagcacggtcttttctggctgaatctccttgtcagccgagtcattagatggcgcttcttttgacatcccattagttcctgcagggttaggatatggcggatcacgagtggacttacctcccctcgtcgtgatcgccttgacattttcaatggaggagtcgggttgcctcggaatcctcccagtttcatttgcagggactaaagatgctaactgagctaactgggtttatgtcattttgttaaagctcagctgattttgaaaggcagaagcaaagccatctaacttgacattaatgttctctaggaccttatcattggcagcaagttttttgcttaatccatcagtggtttaagcttgcgcaaaaatgagatccttcagggagggctggttagagaagttaccgttattgttacctccttgataatatgggcgtggttggttccacccctgacctccttgtggacggtacccgttgttgttgcccatgtacatcgcctcctcacgggtttccgggcagtcattcccagaatgacccgtgccgccgcagacctcacacgtgacgtgtgagtccaaggccttgacggtgccttgtggccttttctcatggtcgtccaagcgtttcatgaggaggtccagcttggcagcaagtagctctgtctccttgacggtgtgtatgcctcgctgacgggtctggagtcgttcctcgctccaacccatattggagaccatcttctctatcagttcaacgactccttgaaccgttttagaaaagaaggctcctccagccgtagcgtccaggtgatcgcgggacattggggtgagtccattgtaaaaattctgcaggatcagccagtcgtccatcccatgatgaggacaggcggccacgtactcctgcagtcattcccatgcttcgggaatagactcgtcccttgtctgctggaaactggaaatccttccatgaagggcattggttttgcccgtcgggaagaatttcgagaggaatgccgtagagcatttgtcccaggtgttgacagcagcatggttggcataaaatcactactttgctctcccgagaagggagaacggaaatagccgcaacctgacgacgtcgggactgacacccttaatggtgtacgtgctacagatctccaggaactgttgcagatgagcattggcatcctcattaggcttgccatagaacgggctagcctgtgccatcgtcatgaggctggacttcaagtcaaaatccacgtcccctatgttgacctgcggcccaatggccacattgtcagcagagggagcagcgaactcgcgaagagtcttgctggccatagtcttgaaggtcggtggcactggtagggctggtttctccgttggtagagttttctgcgaagcaacgactcgcggcctgacgctcggaagaaagcttctggattttctttgaagttttccggcaggttgaaacctgtcatgcactaccctgttttcacaacaaaaagtgaaaacaaccaaggttagcctgcaaaggaaatgattatatagatgtaaatataaagtattagttcaagtaatctctattatgaatcttccccggcaacgacgccagaaatgcttgttggtatttcttaatgacattactagaaatataattcccagcaatggcgcagaaatacttctagtatattatggttacagagttcatccgcaagcgcatggatataccattttagcattttacccgagagtattccaagggtatcgtatttattttatcccgtgggaagataatgtagagagagcttaactaatagtttatatattactttgtgataatcatattctaagtaggggttaagataatacaagagtagagtgatacacaagcattactactcatcctcataataaattatctaagctaggtggaaagaaaagacaaagaaaatatattcctatacttctaatatacatagtatacatacattctagttaactgatatactagctaataccctctatccgatgctctcctggtacttcgagaagccacccctgactgctgagttccttacgatagcccgtcatgaccatacaaccggggctaaatacggaggaataccctccccaggaaattaacttaggattatataccggcgcggaggaatacccgtactgagctgtcaccatcagtggcccacctctcatccgcaatatatagccccaaataatgataccttgtaatctagacaccacgtctaaactatcagatactactttaatatcatcatcatgacatagagtaattgtatatgcaaacattatacccgcaccaaagcatctcccagataagctagacgtatatttagtataacatgaacataatgtaaagtaggtactcatatactcggaaagtatttcaataccataaatgtatatagaagagtattctaataaaagtacaaagcttacaaaagaggaaaggaaagctgttagagccatacccaaagtcttccgaaggcttccagactcctgatttctactctattcctattccaccagctagatactactaaactaaacttgagagaaatgagagagctattgcttgaggtgtgtgagtgaagtgaggatgagagctccttttatagcctcccaatgacggttgtgactgttggaatggtcggtaataccctccaaccgccactggggagccatctcagccgtccaggagaaccctggatcaaacggagctgcgggaggttcggccgaaccaccaggttcagccgaacttggggccggcccaatctagcccaatttcggctagcggccttctccgttgttcttctcctcagacttgtgaattttggcccagtttgtcgtgtcaattctgagttcttggcccattcatacatacgtctggttctcgacatcgtctgattgatttatcgtttgagttgatgtcgattctcctccactttagtgtcattccctgcaagaggttagcatgcctaatactagtggaagtttattattctaatacatttatgcattgcaagcatcattagttatcctctattttggtaatattaacggtcaaaactgatcgataacgactgtcaatagctaccaatgacggttgtggtggttggaatggtcgtaaataccccgcaaccgtcattggaagggatcctaggcatccacgtgcaagggggagccaacagccaaccctagttaggcccaaccggcccagtttttggtcggtgtgttgcctgttgatccatcagcccagtagtgtgatggttgggcctatttgatattatttctcttagtaaacaaattactattacatcgatggttctcaacattaaatatttatcttgccacaaaatttcacttagtaaa

SEQ ID NO: 1763 - DNA, 8509 bp, Oryza sativa
gtgtttaattgatgcaggtcctaaaccactgaagttgggagaaaaatcagactaaagtgaagaaggaacatatccatccaaggagggggctttagacttctctaaaataccagagaatcagcccaaaactcgcagtaatggataaggcagaacaggaggagtccacaggccaaaattgagggccagatgggccagcccagaaccctgatctccaccgttgatcctggggtttggaagggatgctcctgatttgatcctaatggcggttggagggcactttggacaattcccgttccacaaccgtcattaactgcctatttaaggagcttcactcattcacttcttcacacacttccaagcttgagctgaattataagaggctctgttgtactattttgtatactagaattaggaagagagtagagtagaagaagtcggaggaatttcggagatgtcggtaatcctctcatgtttattttattctgttaattactctgttttcaatagaaatatctttctgagtaatttagatttacttgtgagtacttgtgagaattacctcttataagaattattgttcactataatcgactaaaatatagtgattgctttagtgagttagaaacactaaagtagatattaattgctcagacgtggtgtttaggtaatttatatccagtaattgttgtgtatcccacagtacgtttgaggtgggtgtagaggtggtgacagccctcaagagcacttaagtcctccctgtcagggtatgtagtagagcgacatctaggaacagcgggttgccagtgtctgaattatcgcgttaggattaaaattaaactttccttagacaatgtttctcactaggaaatcctctctatcctttgcgcatcttagcttggtgtccttgggtgaacctgataaggaagtaatacccgttgcctgtggaaatcgatacctaagaataatcccaggtgaagtgctgcatttgtgacgttaagaaataccaacaccgatctaaaacaaggaaatacgagaaatacctaaattggactctgactctatgctgaaggtctgaccacccggcggtctgatcacagctcattgtccggtctgaccagccacactacggcggttagactggccttcgcgggaatgacttggtagtttccaaatttggctcaaactagctataacatgacccgtgtcaaatttggttactgcctatagatcatgtgacagattttttagcctcctatgatgcacatttcttaccctttaaatcaacatctaacggatgacattaatatgcacaaacaaaatacaaaaaacaaacaaacgagccacgtggacaatctgaagctcatggggctcaaatgggctcaagtagatttcaaacttacatcgtaaatacactaaaattatatatgtaattttcagacttacatcgtaaatacactaaaattacatatgtaattaatatataattatagtgtaagtacgatgtaattagtacgcgtgggatcataaataaattagcattgaaaaacacgtacggctagtttaacaacagggaacagtaacgtggacctagttaattagcaacgtggacctagttaattagcagctagatgctagcacggatctcaaaaaccatatcctacggcaaaaatgcgaatgatggaaggctcataaatcagtcaaacgatagttagcaattccgttctaaatttggctcaaactagctataacatgacccgtgtcaaatttggttatcaacacatgtatagctcggatggaggtgggttgatcgatcttatcaggtgattgaatcgtcatacatgcaaaacaaagcaatcatgaaaatcaatccgtcagtaagctgaaagatatagatgcttcatatatcaatgtattgtgtgtgattaagtcatgcatgccggttgaattacacatgcacacgagttaaatcgtggttgccggcggctccgcgtgcgattaacgttaataggttgtggacacaacccgtagacctgccttgttcccatgatgagcgtgacccgcaccggcgtgtgcattgagtgcatcaaggagcacgtcgggctgacgcactgggatgacgaccactcatctcgatctcagctagcatttgaaaacaagaaagtaacaggagatcaatctacctttagatatcaatctaatagaagttagattggaatgacaaacccaggttagagatttgagccatcaaactcgttgagattgatctcaacacttctctagaagttgattctatcgcacttctcgacaacaaactcgacgcgaccgctacctaacgtgccaaactatcgattttggaaattgacaatgataagggggtagggcacgagacctaaaagtggatagatgcgaaagacgagagtttagacaagttcaggctctctgaataagaggtaatacattacttttgtttggggattgtattggtccgatgatctgactgtggcttatgttgctataccctttaaggtctccctactcaccttatataggttaggggcagggatacaaattaaagagaaaaacctagccggacacgatacagtttgctaatctattacatggtagtactcaatcgggactctaggtcctacaatagaacacaaggcaacattgtgaccgagccatactttatctctatctctactattataaaaattgaagatttttttgctagaattttatatttatgtcaaatcctttccttttttcttacgccagagtgtccctcttatctaagatgcgtgcaaattaattaggcccgtagcatttcacgcgccccttgccacacacggcaatcgggcccgtgcctgagaatatttccacaggcgcctttgcacggcaacgccctcgcgcgcatgatttgcctttgccgtatgtccgattgggactgcgtcgccctcacccgtgatttaaaattttttttcttttttgtgaaaactatggtacgtcgcctgtatctgattccgttacgtgtaacattcattgcgaagtcatgactcgcgagcgaactgcgaaagaaagtccgtgtcgtagagtccatgtggatatcacatacgccgttgcccagattatccaattctattcatattacacgacacggttcctgggacatgttagcatgatttcaagtcactctccacacatgctcgtacgtactaccagagataccgttacaataatccagaatcagttttacttttgaaaagaacacgccaaccgaaatagagtatgatcgaagttgctgattccatccgtcatcaattcctgcccgacttgagataaagctgggcaacaaatcgagctcgtgtttgaaggcctcattgtttggcttatgcttattcctataagccaagttttaaattttagaacgtaattttaaatttgactttttggtttttttatcgtactttattttacagtatttgcttttgagtcgctaagaacttgtgtatgagagatttgcacacaaatagtcttttattttgttgtaagtgattccgataagcacatgaataaacgaaacaatggccgccgacacatgtacaaattaaattggctcaacccgttgtaatgcacgggcatcttttctagttatataatacatgaatccagcccacctcctatctatagtcggatatgcagaccgtatgggtaccgggtacccatattctccacggaagatgacaatggtggcaatttcatctcttgtgcttggactgcgataaaaagaatagttcgctgttctttctcgagaaaatccatgaaatgcaattgacaagtgtcctaatcgaagaaatgccattgacgaacgcaacttctagaaaatgccatcgtacgaattaacttctcccaaaaatgccactaccgtttggtttctgttaattccactccgttacacctatttatttttttttagaaaagcccaaagtgccctcagtacatactatacttactctatcctttatttctttttacctagtaaagacaaattcgacaaaatggaaacaacacctaaccctagccccgatctaggaggaagctgattggatcccggcggcaccgcggcgctcccgaccaatgatggcagcggtggggtgaatcctcacggcgacggcggcgtgggtctcccagccagggctacgttgggcggtggcgtgggggggggggcgaggctgcgatgctgcgctcctaggcggcggcatgggggcgcaaggaggtgctagggtggccccagacaatggtgcatgggcccgaggaggaggtagggccactccaaccggcggtggaagtgaggctggaggcggtggcgcctcactcccaggtagtgatacgggggacgcaggcgacagcactgtggtccctgaaggtggtcatctgcgatatattatccagaagtgaggaaatccaagtttctattgtcattgacaaaaattggtataggtccatttacccactgaaatgtgttgatttgtaatgattcaattatgaatatatgattattgatgtttgtaatgattttatcttgatgtgaagtcctgtttttttcaaggttcacttttttagagttctgcttgtgctgttctgagcatagtggtgttcatgtgagttcatgcctaggtatttggccattccctttagttcctgacattcaataaatttagacaaattttggtctagaactcgaaaatgagttcctatataattgtgctactattacatgtgtgtgaaaattgaaaatatcataatgtctcatttttagttttagtaagaatattacctggtgcaaatattacaagagaaaatccactctttaccaaagtatcatacaatagttttgcagatacattatgtagcattcacatggggcaaatggtcttttcaccatgtccaacggagtatagctaagggagtagtgatggtgatggcatttttgggagaggttgattcgtacgatggcatttcccggaagttgtattcatcgatggcatttcttagatatagacggttctgttttgttctaagcgagctatgctgtgttgagtctccagcgtgtagttgtatcagaacccggtatggcttcagtaaagctgggtcgtgtatgccttttgtcaaaaaaaaaaaagaagaaaagaaaagatgagttgaattgaaaagtatcatttaatagctcaaaaagtttgcatttaactttaaagtatcgagctgattcctccaaaacacaccaaaaatatggataattataactggttggctttttgcatatacctagcggccttcaatcttctttttgcagcaaagacaaagctattctttttctctttgttttttccttttattctctttcttgctcacttttgctcatgctcacgtgcccctcagtactaacttccctccgtcctctcgcaaattaagcactttcctctttcctttgcatcctggtaatctttccttactgttattgaaagaagacaagttttagcgcaaatgaactgatgggttcctccttttcatctcgtttgcaacttcctcagattcctaaattgcttgatctcagccctctgcctccttgtgcactggcatttactgtatctagcgttcctgtttcttccttttccagccccttgcaaggatctttcctgcttcctttactgaactgcttataagcatgcacatcgcactgtcgttctgtcatatccattccctcccgtggacatctccgacgagcctaggctgctgctgctgctagtatgcacaactctttctcctattgttttgttttgattgttcacatcaccctcaagtctgagagctagctgaccaatctctagttctgttcaatgctcaggggttcatcaggaaaacatgggtttgcagaggaaaatcaaaattctagccaagagaaccatccaggaggcgcaagctgtaaccctacatcccgcgaagacgaagcggccccgttcagaggaggaagaagaagcagcagcttcgacgccaacagctctctgtggaggaggaggaggacttgaaggtgctctgcactgcccaccggcgccgaagaagccgaggcttgtgatgggttgcagcctgaacgggttcaaggttctgagcgtcgtggatttgcgtttcttcctgcgttgaagcggcagctagcattgtttttgtacaggcaagagttagcatggtgcctgcttatgaatgtttgtgaacgttgacatggaacaaacagatttgctttttagtttttttgtcttttcttaacggaagctaatttcacttcttccccatctccatagctcaattggcaagttgacagtagccagtagttcttagggttccgcaaaaaatttgttcgcccaactgtttggacatgatgaaaaatcgccgatattcacgaaattcagaccatgccaaataatttttctacactggcgagtaagtacttgtttagctcagcctaaaaaggaaaaagtctatgtaccacatatacttgataaaagtttatctagcatcgtaaaaaaataggctgtgttagggaggtgaagtttggaactcacctcctgcgcacgtaaaacggaacaacgcattttctttgattaattaattgtttaataacttttttaaaaaatagattaatatgatttttttaacgtaacattcgtatagaaaatttttacaaaaaacataccatttagcagtttaaaaagcgggcgcggaaagaacactgctaactaatgtagtatgtttgcatatcgtcaatcatatagtatagtggcttttggatagtagttttgggtatttggaaccttaaatcagcagttttaaataactaatgtagcatgtttacatatcgtcaaatcacatgtgaccaatttatactccatagtattgtcatactagaattatatgggcattcttttgtaagcaattaagagcaaaaagttggggaaacagaagatttcgctgatgattttaacacatatgtccaaattccaatgcatatgtcacctagttaaactaatccaacatatatgtaaattagataaaaatcattttgtaaaaactacactagggtgcaatataaacgatattatatagtagttcggagggctggatatctcatttcaaagttcaagctgctagatagactttcaataaaaaaatatgtgtagggatgaaaatagattgaatctattatgaaacaagatatatgatctcatccatatatatggatggatcggcaaccaactccggggcacggtggtgccccatgtcttcaggccctcacgcactcatgccaacatgcctctctcccccatatatattgtaaaccccgtgatcaatgaggctcaatctctcttactatttggaacattgagtttgagaggagagaagagaagattgagaagatacgtaaaacgaggtgagccattagcgcataattaattaaatataaattattttaaaaattaaaactgtatcaatatgattttttgaaacaactttcatatagaaatttttttttaaaaaaacacaccatttagtaatttggaaaacgtgctcgcggaaaacgaaataactttcacacaatgtgctgctgccgaacgttaaggagatatcctgaggtcgagagttctggcttctctcgcccccaagttaattttccagaaaagggaaaaacctgatatttttgtaaaaaaacagaggaaagaacctttctctacccgagaaatccaacgctgtcttgtcacttttcaaatttgatctctcttcaagcacacgcactttcatttgtaggacatttggcgagactcccacatcaacaaagaatcggttatgcctggtggctgaaccatactgtaaccattgcgataccagcagcccagttctcagcgtgccttgtagtccatacaagcataatgatcacactgactgaactgtatccactgggcagaagattacggcccgggttagagcccaccctaaaattttacatcctatcacatggaacgtttgaacatcagcatgaagtattaaatagaggataaaacaataattaattgacagattgtgactaatttgtgagatgaatcttttaagtctaattgctccatgatttgacaatgtggtgctacagtaaacatttgctaatgacggattaattaggcttaataaattcgactcgcgatttactgacggattatgtaattagtttttttattagtgcccgaacaccccatgcaacaccctatataatacccgatgtgacacgccaaaactttacacccctggatgtaaacacccccaagatctaaacaccccctacattgtttgtgtgttcagttgtttccatgtgaaagcagggaaaataaattctcgttcaccttttatgccaagttgccaacagtacttaaaaaaaaccctcatagataccagctcataataccaacac

SEQ ID NO: 1764 - DNA, 17023 bp, Oryza sativa
agatgtgtcttgtgggtaaagatgtacacctttgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcgtgtgggtttacggccttgataaataatattgcatagttctagaatcgtgtttacaaaatagctttgagcaactaagcatctttaaatgctgtttactgcaaccctaaccctttatattataactcccttgtactcccttgcatttattatgcacttgtgggtgtgtcttgttgagtacggtggttgtactcagtcttgctcaatttttcccaacccagaagaggagcccctggttgatgaaggctttggtgtctagctcgtgcctgccgtcaagcgcctgtggtcgtcgccctagtcttccgctgtttctcgtttgtctttgtgtgtgctgggccttcgtcgcccatgtaataaattatctatttacgcttccgcttgttaaactctgaattgtatcaactcttggtgtaccttgcctcctgggacaaggaataatacacgcacgaaaggaacgcccgttgggttaattccggtcgtgacaagttggtatcagagcccccttgaccctaggacgagccgtagatcccaagccttagcaatatcatcaaaaataaaaatcctttgctaattgtgaaaactctctagtctctctctgtcctgctgcttcatttatcgccaaaatctgacttttaaatgttgcttttctttttgtttttgtttgtagatggccggcagcgttagtcgtcgtggtctggacatgactggtttcgtcttggagctgcggggtatgtgcgttgtcctggggtatccgcatggagtggactaccagggcaggccgctcccggagcaggagggtgacgatgcagagccccacgctgcttgggaggttactgcagtgatcctcactggctcacccgagcggacttcgttggcagtcaccgcgggtggagattctttctccgccgcttgccagagcgtcgctctcctcgccatcggcactcttcactagcgctacccggacgagctgcagcactcgccctaccgctaccaccctcgtcgcggaggagcccgcgactacgccaccttctgggatgctagctcagaggatgacgctaccatcatgcacctggcgcgcatggtggaggcgtacgacgcggctcgtatcgacttccatcagatggtgcgccgtgggatggtcgagaacgacctgaagatcctggagctgcgtcaggagaatctgcagctgaagaaggacctagacgcagtggaggcacagctgcatcagctcaagatcacccagggagaggtctgtcgccccaagcgtcgccgcgtctgccgcagccagaagatcaccgcccgcaagagcacctccaggcccgagcttgttcgtcagtccctggcgtggacttgcttcgtggagacccctcgtgccgagcccgcgcccgtggttcctcaggagggggaagcctccggcgtcggtagcacggaggatgcgctgttgctcaccttccgtcctggcccgtcgcagtggtagacgagcagttagtaggcttgcacgtgtgttctttctcgtttgtcttcttattggggtcttgtggagcatggttatgccggtgtgtggcataactgtgtcggagcctgtctttattttatttgcttaagcaacttgaactttaatgaaccaatttaatagcagtaataaattcaagagttatggtagtcgtggatggttagctttaattgtcagctctctctgtttgctggttctgtgtggggttttcagatggtgacgaccaggagaaatgctgccaccagtgatggcaaccaacctgaaggcagcaaccacaacaaccatggcagcccacctccacctcctccaccgcctccaccaccaccaccagacaccaacgccattctcacccaaatcctcgcccagcaggccaacatgatggctgctttcctccaccacatccaaaatccgccacaacataatgctccaccaccacccccacaacactctaaactcgccgagttcctacgcatccgtccacctaccttctctagctccaacaaccccgtggatgcgttggattggttgcatgccgtggggaaaaagctagacactgtgcagtgcagcgatgaggagaaagtcgtcttcgccgcccaccaactgcagggacccgcatctctatggtgggatcatttccaggctacgcagccagaggggcagcctattacttgggcccgcttcaccgccgccttccggaggacccatgtgcccgccggagtcatggcccttaagaaaagggagttccgagagttgaagcaaggcaaccgctccgtgatggagtatttgcatgagtttaacaacttggcccggtacgccccggaggatgtgcgggaagatgaggagaagcaagagaagttcttggcaggaatggacccggagctgtctgtccgtctagtctccggtgactatccggatttccaacgtctggtggaaaagagcatccgcttggaagccaagcacaaggaactggagtcgcacaagcgtcgcttggcgaatttccgcaaccaacagggtgctaaccaaaggatccgctacaccaatccctatccagggggatcttcctcgcagcagcagcaacctcgctccgcgcctcgacctcaattcgtggtgcgcgtcccacagccgcagcaacagcagagccagcaagggacccgtgcgccccgtcctcctacgccagccgcgcagtctggacaaggccgcagggacgttcaaggtccgcagcgtctgtgcttcaactgcttcgagcccgggcactttgcggataaatgcccgaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcatccattccatccctgctaccattttgttcgactctggagcttcccacttgtttatatctgtgccattcgtggggagaaatcagttgggggtagaaaggcttaggaaccctctactcatcaccacccctggaggggttatgacagcaaagtattatagtcctgccgtccctatagaaattcaggggattccttttccctcggatctgattcttctagacaccaagaacttggatgtgatccttgggatgaattggttggctcaattccaaggagtagtggattgtgcaagacgcactgtcactctgtaccgagggccggaacaaccggttgttttctttgcacccccaacctctgtcagtagttcagaacttcatcagataggactgtcagaaatccccattgtcagagagttcggagacgtgtttccggaagaactacccggtatgccgcccaagcgagagattgagttccggatagatcttgctctaggaaccactcctctgtacaagcgaccctaccgtatggcagcaaatgaactggccgaagttaagaaacagttggaagagttgaaagaaaaggggtatatacgtccgagtacttcctcctggggtgctcctgtgatttttgtggagaagaaagacaagacgaagaggatgtgcgttcactacagagctctcaatgaagtcaccatcaaaaacaagtaccctcttccccggatcgatgatctgttcgatcagcttaaaggtgccacggtattctccaagattgatcttcgttctggatatcaccagttgcgcatccgtgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgttgtggttttcattgatgacattctggtatactcacaatcagaggaagaccatcagcaccatctccgtctggtgttgggaaagttgcgggaacatcaattgtatgccaaacttagcaagtgtgagttctggttgtccgaagtcaaattcttagggcacgtgatatccgctaaaggagttgctgtggatcccgaaacagtgaccgccgtcaccgattagaagcaacccaagacagtcactcaaattcgcagtttcttaggtttggcaggatactaccggaggttcatcgagaacttctccaaaatcgctcgacccatgacacagttgttgaagaaagaggagaaatttgtgtggagcccgcaatgcgagaaggcgttcaaaactctcaaagaaaagctggtttcctcgccagtgttaatcttgccggatactcgcaaggacttcatggtgtattgtgacgcttcgcgccaaggattggggtgcgtgctcatgcaggacggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaatcttcggcagaggagatggttagaactcatcaagaattatgatgtgggaattcactatcatcctggtaaggccaacgtggtcgccgacgctctaagtcgaaaaagccattgcaacactcttaacgtccgtggcattccacccgaacttaatcaacagatggaagccctgaatctaagcatagtgggtcgcggattcttggctgcgttggaagccaagcccaccttgctcgatcaaatccgcgaggctcagaagaacgatccggacatgcatggactcctcaagaatatgaaacagggtaaagccgctggtttcacagaggatgaacacggaaccctatggaacagaaatcgggtatgcgttccagataacagagaacttaaacagctgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaaggccacctatggagggaacaaactagccgagctctacttcgctaggatcgtgagtctccatggcgttcctaagaaaattgtatccgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagcatacaaatggcaccttatgaagcgttgtatgggcgcaaatgccggacaccgctattgtgggaccaagttggggaaagccaagtgttcgggaccgatatcctgagagaagctgaagctaaagtcagaaccattcgggataatctaaaggtggcccggtctcggcagaagagttatgcagacaaccgacgccgtgacctagaattcgcagtggatgactttgtgtatcttcgggtcacgcccttgcgaggtgtacacaggtttcagacaaaggggaagctcgcacctcggtttgtgggtcctttccgtatcattgctcggcgcggagaagtcgcttaccagttggagctgcccgcctccttgggcaacgtgcatgatgtgttccatgtgtcgcaactcaagaaatgtcttcgagtgccatccgagcaggccgactcagagcaaattgaagttcgcgaagacttgacctacgtggagaggccagtgaaaatcctggacaccatggagcgaaggaccaggaaccgggtaatccgtttttgcaaggtccaatggagcaaccacgccgaggaagaagctacttgggagcgtgaagacgagctgaaggcagcccatcccgatctcttcgtcagttcttccgaatctcggggtcgagattccgtttaaggggggtaggtttgtcgcgtcccaaaatgactctaaaatacatcctcgaaattatgcctagaataattaaaatccttgtgaaagcctcccacaattaaaatgtgcaaagttaaaagtccaataaggcttggaggatttttgtatatttcctaaaagcctaaaatgcgtaaataaattttagtggaattttcagagcacaaataataattattaagaaataaacaaagttaaaatgattttataaaaagaaaaatcctaaaaagtctttccccccctccccctcttgggccggctcagcccatctccttccctctctctcctcctccccgcggcccattcggcctcctccccgcgcgcgcgccgctgacgagcgggcccgcccgccacccacgctgacgggtggggcccacccgtcatccccttcctcccgccgctcccgccgcctcgcccgtgccctagcgccgccgccgccgcaaatcccgccgctcccgtccgccccgcgtgcaatcaagaggggggaaatattccccgtgattccctccctctttccccccatttttccctccctctctccctcggattcgttcggaatctttccccctaaacctcgccggcgcatcaatggcggccggatcttccgcgcccgtttccccctcatccggccgccctctctcactcccaaccctatataaacactccccgtgcctccctccaccgtttccgccactcgccgctctctctctctccgccggaatcgagctcgcgtcgtcgctctctctctccgccgtcaccgccgagctccggtctgccgccgtcgtcgccccggaccttctcccgcttcggcgccgcctccttcggtttcgccgcaacctcgccgacctcgtccacccctccgtttcgcccgccgaccgccggaacgccgccgtccccgtctacccgagccgcgccgccgccttcctccgctccggtcgccgttcccgtcgtcgccgtcgacccggggtgagctgtggaccgccgattcgtttcccccttccctcccctctctcgggcgccgctccgccgcgccggtggtcgccggcggcgaccatcggggcgcgggtgcgccgcctcccgtcggctgtgccggcgtggccaccttcgggcgcgccccgcggctgccatgtggggcccggccgtcagccgcccgcgccctcgggtgcggctgacgcgtgggacccacggcgccggccggtgtgagccgggagcacccggtccaccgtggaccgtgaggctgccgcgtgggccccactcccgtggacccggtccgcgcgcccctcccctcggctgacgcaatagatccaaattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaggttgaagccgacgtttgggaaagtgagcaaggcaagtcacatcatctttgaacatattgaatcccagtttataaaattatgttgatttaaattattgcattatcgctttatttaaattcccgcgttatcactgttttgtttagccatgcctatttacctttgttatgaccttattattgttattgttattatttccttgttcaccctagattaaacaaaaccccaactagtggacactctactcatggtaccactagtatgatgttaggtagatgcttcgctatttaattaggtaacattaggcggttttacaactctagactttgggatattcatatcacctggacactttggaattgttggagtattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcgtggcacagggccggtgtcctgctgctaggggctcagtcctgcctgcctgtcctgggggttccggccgtaggtgggattgggtcggtactcttgtctatggctaggatgggttggaaactatatcatgtcttccgtccgtataccatggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcgtgtgggtttacggccttgataaataatattgcatagttctagaatcgtgtttacaaaatagctttgagcaactaagcatctttaaatgctgtttactgcaaccctaaccctttatattataactcccttgtactcccttgcatttattatgcacttgtgggtgtgtcttgttgagtacggtggttgtactcagtcttgctcaatttttcccaacccagaagaggagcccctggttgatgaaggctttggtgtctagctcgtgcctgctgtcaagcgcctgtggtcgtcgccctagtcttccgctgtttctcgtttgtctttatgtgtgctgggccttcgtcgcccatgtaataaattatctatttacgcttccgcttgttaaactctgaattgtatcaactcttggtgtaccttgcctcctgggacaaggaataatacacgcacaaaagaaacgcccgttgggttaattccggtcgtgacattttggggatattctacaccccaatttttgtagtgcattctagctttttatctctgttgcatcaataggactttgcacagacactcatatatcatcttctagctaccgtcctattgataaaagtcaggataggatgaactcgttatcttggcgttatcatttggccaccatttgtgcgagtatgataatgaataagtacctgtgtttgatggtatatgttcacgagtggctaaacgaaaggcatctattttgctccctttatttaacctaaaatattccttaaaaaattatgtggttatatgtttgaatggaatatctcttaatatgccttaacatacccatgtaagtaacacgtttccgccactaattaaaccctatgtaagtaccattactagcttgtttaaacaaatattaatttacttgtacgcttgcatatacgtgcatttgatagtggtgtagagctcctaggctcctagcactgtactatcgagttgattttcctcgtcggcgtattccataaggcacattgtcggtgtatgtaactgtgcgtggaataccttttaggatgacaagggtacactttttacattgccctgatcgttttgacgaattggccagcatgaatgtcctgttgtgtgttgatgcttcactgcacaacaactgccccacatgcttgacgcccggatggccgtattcagaagcaaaaataaattaaattaaattgtctcgaggtgtgctcctctgtgtccagttctttttcgtgccctctctgatgtaatgtaccaattagtacctagttaatcatgaatacgtgccagctcgaccaacaaagctagctcctgtgaggcaaaaagtgaactatacgttggcatatatcatggctgcccaaagagcacagtactatatgtcatgtgtacgccatagtttgctaatgccacatatttgatgccaatactccatccagcttgctgtccttcacggtgcatgtacacggttgtggcttatttcgtttgctcatcaacatggtttaatttgcagttttgcacaaagtagcaaatattatgtttttttccttgtatttcttataaaacctaaaaaaaatttcagagctttttatttttttaattttattaatagatcttccacgccaccgtagctagcatggccaaccaacgctgctacgccagttcggtttttaaaaataatttttggaaagatttattaataaaattagaaaataaaaagaaaataaaaaaaattataaaacctcctgccttttcccacacatatgtcacactgaaaaccagacagcggtgagagagggggggagtggaagagaagcaagcgcgagacaaggcggacaggaggcgtggcttttttgtgcggtccgtcacacacacaaacacacgcgctgtcgcttttctcggagaggcaggatttgcaagggtggttagggcaagtactataaggttttaagcacaaactccaaagtgccatgtatgcttaaataatgatgtggaggagagaaaagaagagagaggggaggagccacccctcatgcaaagggcaacctctacacaaattttaaggaacaagagaaaataaaaggactgattggtggcaagtgtattgagactagtgtattaaatgcaatgcatttacataagttaattttgattttttggatggatgatgtgaataaaattggaggtgaccaccacatttattataaaacttgccctttgaggacgaggcggcaacagctgcaaacccaagtaaagccagccagcctacccatgccacaccagtacaccacagaatgtgatggtgattgtgatctttcacagtaaaaaagaaaaaaaggaagatctgttcttgaagccaaacagcgattgctggttttgctggtgttggcgatgagattctattattccccttgcccctagtgggcgatcaacaccgacacccactgcactgcccctcccctccattcttttcttttcttcaacccaccgcgcgctccaattcggaagctcggggagcagcaggcagaagcaatggcgggctcgtccaggctcaagtaagtgtgccaatccggcatcaatctctcatcttctttacccgcaattgtttggctgcctttttggttccatttgacttagttcttggtctgagcaaaataagatttgttggacacatgctgcagttctagcacggccgacgctgccaaaagcagcaagagcacgccacatgtggccgccaccgctaggccggtggcctgtggcatcccacgtcatgcggcggcgcgtgccgagaggtccccggcgttggtggagaagacgccgtcgccgtcgtcagccgaccaccgctcgcccaagatctcctcccggatcagtacactgccttctgccgaggtacggtccattgatcatctttactgcttgcttagattcttgagagatgtttgtttggttgtaaattttttttgagcgactcctgtcctgcgcccactggaattgaattgaattgctggctgcagaagcacaggactgccgtgaagaagcagtccatggaacagctcgcggcgatccaggaggatctcaggagggcaaaggaacagctggcaaagaaggagacggagcatcgtaaggtcgccgacgacgccaggaggacggccgatgaggccaatgccaagctccggtacgccctcgccgagctcaagaaggcggaggaagcctccgagaccgagatgttccgagccatcgagctggagcagactaccatcgagtccacgcagaggaaggatgagctccagcggaggctggaggcaacgcggcgccagcaggaggccgacgccgcggcgctgcggtccatggtagcgcagctggaggaggcgaggctagaactggctgacgctattgacgccaagaacctggcgctcagccacgccgatgacgccatcagagccggcgaggcgaacgccgcccaggtggagctcctcaacgcggaaatcaaccgactcaaggattcgtttaattctgagctagagagcaaggtaaaagaatccgctgagaaaaccaggaagctggaggccgagacgtcggtactaaggatcaagctcaagaaagccaaggttgccgaagagaaggtggctgaattggaaggtgccgttgaaggtctcagagctgatgttgccaatgccatcaaggccaggagagaagcagatggattggttggtgaatggaagaagaaggctcaactttttgagatcaaactggagctagccaaccagtccagcatcctcaaggctgaatccatgagttcggtgatgaaggaattggatgcggcgaatgctttgttgcaggtaaaagagtctcaaattgctcttcttcacgacaagatagagtccttggaacatgaagtggtgaggcagaatgaagatatcaatgcatcaggtcagcgcgtcgatgccgcgcagagaggagcattagccttaaggacagagatccaggagcttaggtcaaggcttggcgcgatggaacaagagaagaggggtactatcaaggatggaagctttacaagctcccaaattgaggccatatgtgaagagaaggataagctagctaaggaactagaatctagcaaatatgaatgcgagaaagttagaaaagcaatggaggatatggcctctgcattgcaagagatgtctgctgaggcaagagagtcacaggagaattacctgcacaaagaaaaagagatcgagcacaccagggcaaaattacaagagctcaacatcagcctcaacaacaccagggataactatgaggtaatgcttgatgaagcaaactacgagaggatctgcttgaagaataaggtggaacagctggaagcagaagccaagaccacatctgaggagtggcgatccaaagagcttagctttgttagctctatcacaaaatcagaagaagagatcatgtcaatgagaactcggttgggtaaagcactagagacggcaagagacatggagaacagaaatgctcaactagaggagaaggtaagagaactggaagctctgatggacaaggataataattacagaggaggcaaagacacaaaagcgtacaaagagaatgatggcctgcatctgcatgtcaaagaatcatctggttcagagaaaatcaaggacttgtattctctgataggaaatgacgagggaaacacggagaaagatgggccagttttgctagtttctaagatgtgggagaacagctacaacttatctaaggagagggacgacggtgaaccggaagttgatctgttggacacagacagagacattgctgctgatggcaatggcagtaggttgtccacagagaagaccaacagtaacaccaaattggtagtcaagcagaaccagcaaaagaaggctttgatgaagaaattcggtggcttactgaaaaagaaaagccaacattaggtaatccttatcaaataaaaggaaaaaattgcttgatctataacacatatgactgttttatctcgtttatatattattacgtcctgctgacgtggcagtggagatgataactgtaagcttaagagggaagagaaaactgaagggtggtatatttcctttccctttttcgggttaatttcttacgttgtgtatttgtgagaagtatttatgctctagttttgttttctgactggttctctagtttttgtatctatatgtatgctgcggttatatgaatgtaaaggaatatgaggttgcacttgggttgttctccaatacatttcacaacctatgtatatgcatcatgcgtgcatagaacaccaaccaagcaaggggtatcaactattggtgtgtactttctactccctctatatcacaaaatagaagtattccttgtatccagtgacaattttattaatggaaaaaatattattggtggtgagtggtaagtaatattgaatttaatttgctgataagggtagataggattgtaggaatttatcgaactattcttgagaaagtttaaatcctagagatcaactaattttagaatggagggagcatatcgtatatagttctaacagattgcgcatcaactgacagcgtatcagctgaaaatagagtcggagtttgattgagccgatatggaaagcagccgatacagttagacttgggttcggtttgggccacgagataaccaatattgcgatataaagatggaactcatttaaggcaaatgtatctattaattaggatattaatgacagtttgaatttgagatatggtaagagtccatcgtatggacttatttgttgtttttatccatgggaaagtttgagtcaagcccataatggacaagttttgtacttggggtatgaatataaactctagatcattgtaataagggacgagaatccaatcaatacaactttcggcgcatcgccacttttttttttactttttcgatgagttctggcttcgagtcgggtattggctgcgatatctcgacaagaggtaacttgtcttgatggcttgcactatcagggctattatgtcgattttagcctttttaccgtggtcatcatttatcatatatcttagttaatctagtttagtatttcgatttagtcatatcggctgattctcactttagggtttatgctggtataagctaaattgctttactgtattagattagctaacgtatttaccatcctaacaagtggttaatttcttgattgtttagactttaggtttcttaacatactttgagttgcaacaaccctagtcttgtctcgaaccctataaactagcctggaattaatcataactaaggatagcatcggagtttcagctgatcttacctaatatacataataatgcatatttcataatctgttttatctatatttgccacttatatagatagatcactctgtataaatatatcaagtctgattgatctcaactaatctattatatctggtgatagattattatttgatacatttatctagattaacctgtttatataagtttgtattggattattatatattctcgctctaaatattggatcattggctatttctataatgctatctaaaagtgattgataaaaacaaaagacatagtattacagccgataggacatattcagactttttgctttacgtatccatctcaaaaccgcaaccgatttgatttaacttatcggctgggtcttgatgatacgttatcggctctattggccgatcgggtatcgttcatctaattacgtttattgtctttcttgatacttgaggcaagccttgaaccagcataggagtgaaagaaatctcccagaccgttgtgtttctcatcaacactcttttagcgcgcccggtgggaccacttcaccattcatcatgccgccatctctcattgaaatcaccgacgacaacatcatccccgtcactattgagcacttgtctgatgaaaagaaagcagagagaagcttgttcaacatatgcagcggatgtatctcagttcttatagtatgactcggcaagggaagctgattcagaagaataaagtcgagttcccaaagcttgttgaagaaaagatagataagaagtctgaaggtgatggagataaagaagaatacaagccaactctggaaggtcacattgacttagctgtgcatcatgcatttgattaattaatctggtgtgctagtcaatacattgacgggtatgatcagatcagtggtagatacgaccattgctgaggagaaagctaagggcccagtataatttctaaaggaaaaagtacgaattacccccctaaactattgcggtagtccgaattaccccctaactacaaaaccggacattcttcacccctaactatgcaaaccggatgaattaccccccttgatccaatccacggtggttttgatctacgtggcgtacgcatggcagtccagtcagcaatttatttatttaaaaaatgtgggacccacctatcatactcctattccactattcccccctctctctcttctctttcactcttcctctctctctcctctctctctctatctcacgcgcacagcagcaggcgggcggcgagcggcggcggcgggggatgaggcgatgagcggtggtgggtgcggaggcggcggcggcggaggaggcgagcggcggcgggagctcgcgctgctcaagcgaggcgaggcggcagcggcggaggaggcgagcggcaggggatgaggcggcgagcggtggcagggtgcaacagaggaggcgaggcgaggcggtggcggcaacgggagctcacgctgctccagcgaggcgaggcggcgactgtggaggaggctagcggcgagggatgaggc

SEQ ID NO: 1765 - DNA, 6712 bp, Oryza sativa
accaacgcctccacgctccacttccgcctcacccaccgcgagcacttcgcgctcaacgccaccgcttccgatgtgctcgcgcaccttctcgcccgggacaccgcgcgcgccgccctgcttgctgcacccaacaatgccacgcgcccgcgctgccgcggcggcttcgtggcgcccctgctgtccgacctgctgcaggggagcagggagctccagctccacgagcaccacaggcaccacgggcacgtccaccgcccgcccccatgcgtcgcgcccgtagccgccaccgtagtcgccttcgctcggccgtcgccgcgacgccgccgtccgccgcccgccctcgtgcacacctgtagacaaagagagattgaggggaagaggggaagagagagagagattgagaggaaagtaggaaagagagaggtgggagagtatgacagacgggtcccaccattttttattaaaaaaacgctggctgggatgccacgtgtacgccacgtagaccaaaaccactgcggattaggttgaggggggtaattcgtccagtttgtatagttgggggcgaagaatgtccggttttgtggttaggggtggtaattcggacgaccgcgatagttcagggggtaattcgtactttttctatttccaaatcatatttttcccacagtacaggaatgtaaaaactgatctaggtaggctgggaggagaagaggagggagtgggctggcccggaaggagggcaaaaagggaggaaggaagaagagggagaggaagaggacttcggccgggggtcgagggacagaggggaagactctgtgccagacttggcctaaatgaaggagatggattatttttaggtttttcttttttaatatgaactctgaaaattgtttttgttgcttaataaatatttctgacgctctgaaaattcaaataaaatttgagggctccttttagaccatggataatttaacaaaaatactccgggacacattcagatttttcatgtacgagttttgatgtttgtcaatttctttttgagttttaattaattctattattccttttggagaatgatttttaattgggatgaatttatcaagacgtgatagattctttgcatatttttagaataaaaatgtaaattttagacttgggtggcaagtgatatgcatatggtggtagttgcataccgataggggggagtgtttgtctgagtcaatttaggaccgaactacatgtcacccacttatgtatactgtactattcctccctccaaaaccgcgtagctagcccatccaacgagcggacccacttacacataccacttcacttatacttttgtgctcgcttggtgtaaaagggttaacccgggagtgatatggttggagggacaagcccttataagttggttcaactcttgctaaactagcaaggactaaacgtgctgtgtgtggcctagatctggcgcacgcggagtgacgtgaagtcgccatgctggtgtgttgaacacgttgtcccttgttggcatgtaagggaagtgtcccgacctagatgcttcctgggtggggtgaacatgaggcggaatttggaatacctagggacgtggttgtgccgtggggacgtggttgtgccgtgctcatcgggggtacccctgatctagctgaccccctggtgtactccggtgctggggtgtgttgaaaggaaggacgactgtgagatggttgtgctgcttcgtacccgcggcatgacgaggagggaccactgtgatccacgctggaatgtcggggtagtggtggtgatgccctacgggccgacggctgcaccacatctgccgcgctccgacaggagacacgacgaagtagtgcggcagcacgggcacggaagttgcgaaggatgctcgccacgtcgtcaggcctgacggctggaggtcttgacggttggaggtctcgtctctagtctttgcagcaaggtgtccgactcgacttgcacgtgctcaacaaattttgcatgttccacaaataagcaagacaattaaaattatgatatagttgcacatttattcaaagtattgaataagttgcacatttattacgaatattgaccaagttgcacatttataaaaaatacttaactagcacatttattaaaaatattgaactagttccacatttattagaaatactgaactagttgctcatattccgcatgttccacaagtaaacacataccattgagttgtaagctgatcgaggctgaggggcaaacgtgtcagtaatcgctgcctggtgggggacggtgctatctccttgtggcggaaaacacctccatcgtgtgacactgcggtatcaacgaaggtaggccccatagtaactcccatcgtctggaggtttctgaagcgccaaattatcaactgcgtgctcccactcttgtacagtcggctgaaccatggtcacaataacaagctcgtaggaaagcccgagcccctttcgggaatacctgcacagcaagaaatggacacatttattcaaaatcgtacgtacacatatttttgttaaaaattggattaaacaactgttatgtgtaccaacctctgaagactatcagccaaagcatgaccaactctgggagaaaagtcctgatacatgcccaactgtttaagaaccctttggacattgtgtggctcgacgtgcacgtccagcacgaggtgacaagtcgtcctccatagtgcttgatcccgcgtgcaaaggtccgcgagaccgtgcggtgcacgatcattgacatcgtgttgagtgtacggagtctaccgcacacggtcaggcgtaagctgatcaaagttagctacgaactgtgtgtacacacgacgcgtcgtcccgctaacccacttcggctgtaacaagaagatagtacttatgattagttatatcaggaaattattcaacttgtggtgaaccgtatataatgagaagacaaacgaattaaacaaaaattacctcacagtgtgtccacaaggatcccatagtgggacgattgtcgaggtcaccaaccccggacttgtacatctctcgcaattcgtagtttgcgtacgagtccagctgaggcctcccaatgtcgaagcgctcgtgcgcccacaacatgagtagcaacgggcatccagggagtgaatttgcttgctgttcctcaagcaagcatcacatagtccagcatatgtggccgcaagtaccgccgacccccaactgtactgtggaaactctgcgataggtaactctgcaatctgctccgcgtagtggatgaagtgcttgtccaccgagtcagtgtgagttcctgtgaacatcacccatccaaacaaccacaacaggtaagcgactaagtgccgtcgcacgatccagtcctcctgatcatcaggaaagacatcatgtcgaaactgattcaaccaactttttgtcggcccgtgcccatccatgagatcctccagtgcaacaggcagcacaccaccaaaattggccagaaggtcgtctgcccatccagcttgtaccattgttgggccaactgctggcccagctatcggcagacccaacagataagacacatcctgcaaagtgggcaccatctctccaactgtgaggtggaaagtgtgggtctcaagcctccatctatccacgagagcactcagaagcgccgcgtgaaggctcgaccaatcgtgcaaaggtcaacaagccagctgctctcaacctacaagaagagagagtgcaagttattaatacagggaaatgtcaaaatcttataaggttaaaacaatatattattacgcaccttggaacccaacgaggatcaatacgccaatattgatccggtcctcgcattttcagcacattgcagaaagttcctctactaagtcgtcgcgaccgatggttcctatcaatctccttgtcgatcagctgcacgtcatattgttcagccatacctgcatattgaaaaccatattagtacaatgttcatatggtaacagtaaattaaatgcatgacacataattcagatacataatttagataattaaattgcaacacatttattcaatttaaaattacaataccttcagataataaaagtgcagtatattgcaaattaaaactacaagccaacaacacgtagatttggatattaaaagtgcagtgcacagttcgaaaattaaattacaagcccattacaaatagattcggatattacaaaaaacaagcccacaacacattgattcggaagttaaaagtggaggattgttcaaattaaaaatacagacgcgctaaacataaatttgaagacaccaacttaaaagtacaagcccaccaaggctattagcgatctaaggattatttttcttcttcgactttccctttggaacgcgacgaacatcagctcctgcggcgtctttccctacattgtacatggcacaatctttacgggcatggttctccccacaaagaatgcaagctttcttacgacgagaacgatctttcgctttagcttcatccataaggttcttgatcctacgcgactggcgacaacctttagtatcaactaataaatgaatccagaacccaattggcttgccctggaggaggacgagtgaaatcgcacacggctcgccaaccacgcaattcacctcgccaagttgcctcccacgcttccttcataaagtacggagaaacaaaatggtttgcatcaacacctccttttgtggaagcgacaagaacatgagaacatggctggtgtaacagataaggcttgtgcaattgcatttgcaagcatgatactctggccacaacgtgcattccaatgtgatgtcagtagtcccaatgccgacaccactcttgtcacgaagtcgtatctcaaatagcaactctctattcccagcaggccacactctatgcattcctcccttcttgcttttctcatccatgtactgtgtaattgctgggctatacttaacactgggtttgctgaggttaagactagccatagaataccttttacagagatacttctgtgtacccctagtgatgccctcaaggatagcaacaagtggtagcggtcgtgtatttttttcataacccagttatacacttcagcaagattagttgttatcacactatacctcgatccatttgtatcgtacaataacgaccatttctcccttggctcaaattcaacccactccgtgaagcacttcgtggcccttccgcgcttcctgcaccgagtaatacttggtgcttcattaggaatgggttcaagtccctccggctcctcctgtctggcaactacgggctttttcctaacctcttccatgtgtgtagtggtcaaatgatcaagttgttcccatatagcatcaaactttctttgttgattctgcttgcataacttcttgaacaggtccatcaatctcttactcctaaattgcctgtaaaaattagccccaagatgtcgcatggaccatctgctatgcaaatctggccatggcacggactctgtcacatcttcttgaagcttctgtatcgtcgataacaaaccggcatgtcggtcatgcagaacacaaacatttggtctgttttgaacaacacacattttaatgtgccacaaaaaccatagccagcttgatgtgttctcgctttcaacaaatgcaaaagcaacaggaatgacatggctatccgcgtcgactccgatcacggttagaattgttcctctatacttgcttgtcgtgaaagtgccatcaacacagagcaaaggaatgcaatttctaaaggcctctatcatgcacccaaatgaccagaaagcccgacgaagaacattctctctattttcattcacctcgtggagaatagccatgtgtgtgcctgggtttcttgcctgcatcacctccaatagtgggggaagattgtgataagaatcctcataagttccaaacctcatctcaagtgctttctgttttgccctccaagccttgacatacgatatctcatatccgtactctttctctacgtcatgcattattgtgaaaggggacaaagatgtttttctaaccacctttgaatataccatttgtgccacaaataccgctgtcatgttcctatgtaccagatgagtattctccaacaaacacgtatgttgctcaaccctcgaagctacccataaagtgtcatgttgtggcttgtaaccatgcactctccaaggacatccagcctgtgtgcacttcacgtcgtacgtcgtcctatttgaaaccttcaccctgaactcacgcttctggtcaaatgcccacctcttcaccgcatcttgtaagtgacctttgtcatgaaacatctgcccaacttgcacctgcttactatcataacgccagtgggcatctaaaccatcgttaaccttcatacgactcatcgatatggtcgtccaatcatcgggtatgttggtttcgttgtcccacagtgttgtatcttctccttccactacaagcgcaatgtattctttgttttccacttccatccgatccactaccgcctcattctcctttgctgcatcaacacgcataggcgaatctggttcttcatcctccgagtcgtcggcctcacgattattgtcacgaacaatgacctctgcttgtgtattaccctctactacttcttcccccgaccttgctcaatccgccaaacattttcagcttgtgca

SEQ ID NO: 1766 - DNA, 10697 bp, Oryza sativa
acttaactaatttcagcatacgactaatttaatatctctactcacatttcacaatgacaactgttaacgtatcatatgatatgtagtcacattggagaatgataaacaattaacaaatcacaagtcttcttctataagattaaaaaatcgtaatcctcatacttagggattacaaatttatacctcaatgtcgtcgcttcaagccgttgccttcactgccctccaggccggcgccgccctggccttgtctctggccgcccacaccctcccctcactccctccagcgcgcacggggacagcactggcgactgcaatggtgacgatggcgatgtggtcctcctcaatcggtttagagaaagctaggttcgggctgccgatataaagggacctgtcgaatgcccattgttcgacaggggcggcggcgggaccagtcgaactccccgtattcgacaggccgcgcggcaccgggtggtgggcccagtcgaacaaccccggttcgataggccgtcctgtcaaatggctacagttcgatagggcccaatcgaaggctggatgttcgataagccccttgtcgttcctcccccattcgataggagcctatttttgcgatttccaacagatggccgctaattttgcgattttccataaaaataatattaattctcaaaaaaattccttcaaggcatggcaacatgtgttgaattgtgtcttctcggtacaattgtgcacatctggccagagtaaaactatttaaatagttgtgccctcggttatgggcgatcaaccagattcaccgtgattaatcacattctattaattaacttgacttaatgaattggtttagatcaggtagaatggttgggcctgttcaacatggtgtagcgttgttcagtggagatttaatagtgccttaattaatcaaccgttttactattttaaactataaaatgtttgcaatcgcctttatgcaactagccacaaacccctctttgttcccccttgcatgtctgcatcattggtgtggcttgctgaatatttgtactcaaccttgctattattcaccctttttcaaaagtgtagtgtttctgagttgaagacgaagttagaggaccaaggcttataccccagttgagttttgcctatggagtggagctaaagccccattaggatcgcctttgtccgttgttgctgttttttttctgtgtgaggactaagtgcctcttatgtaagtatttacagtttatttatatttggatctgtatatttacttgttgttttgtgtaccctagctgattcctggacagggacttaatacacaaaatagtctgaaaatttgggctaaatttctagatgtgacagttttaggctttgcagagtttgtacagatatccacatgatatgaacactctaatttgttttgtgctcgccaggcactgccatactcttcatggtgaatgtggtctagaggttataacaaggcttttacattgactaccgtctgaccttgcatgagcacgatgaattttcaatccctactaagtccagaacattagtgttgttaggacggttggcctatcgaacctgacaccgtggcgaagcaactcttcccatgaggcattcagcattgtattggacaaacttagacacccacgctgtgaggcggaacagtacactcatcccctcacagaaaacacacacttaggactagttcactcatcctaaaattcaacacacacatgggtagctcctctagatagcctacagttcactcgtggccactacctatactgcatcggtctccttaatgcaatgttagacaagtactcaacttaataggccaaggttaccccataaataacatatgtggatgtacggtatatgtgatatcccggcccaattagaatgaggcctgtgtggcccatgagagctgtgtttaaacaataacacgctttagtttcaaattatatgcatgtatcattactaactacgcgattatttgtttctccctcttatgcaaacagacgatgagtacggttcggcatcgacgtatcatggaatgcctacttactcccctcgcacagcattcgttgaggacttcttttccactgagcctcctcaaggggaactagggatggattactggcacgcagcacctcaggtgacacagccgacgcaggagatgggggccattcaggctcccaatgtgacaccacagcaggcagcaagagagaggcacccccctgataatttgacttatcccactgagcaggttaggcgtaggaagaaggggggacctagcaagcgtgcgaagggcactgatcgtccttgagttatctatttctgttaaaaattgagacatttatgttgtgtccgtactatttgtgaacaatttattattaacttagtaactatcagtactatttttgtcttttttttcataccctttccaatgacggagtacaaaagattcgcttcgaactttgcagcgcactatactacaataatgaaaatataaattcattcatccaaatattttaaccaaaaaataaatactaaaatttcccacaaaatattattaaaaaatattaattgtagaaaagttccagaaaaaaattcacaaaattcacaaataaaaattcagcctgaggacaagtcgaagaacagttgttcgacagggatcctatcgaaccaacgctattcgactgctacctgtcgaactgcccctgttcgacaaggcgccagtcgaactacccctcttctatcgcggtccacccgttcgataaggcgcctatcgaactgcacctattcgacaggaccccatttttgcgattttccacaggtggccactagttttgcgattttccataaaaataatattaattctcaaaaaaattctgccttgaagtaccacgatgatactgcaaagggggaaatggtaactccccctaaccaatcgcactacacacctcaggtttcaccccctccttaagccaagtcgggtaggcccctctcgtgcctaggtgaatccagaagcagcataggccgtctgtcgacctccaattttggaaatcggaaatcttctgtatttatcagtaccaatccctggatcagtagttggtacacacatacatagccaaatcacaacatatcatgaatgaattcaggctaagagagttaaatgcttacattagggcaaggcaggccaacaactatcagagaacaacagcggaagacaaaataatacaagggcccggttgacatgccacaagcaatcgactggggaacgagacctagaatggaaccgcactccgatcatcttgttaggtacgcaagcatactaacaagggcttctcttcaacactctgctaaaagatatatatagagcaacaatgagtacaaaagtactcaacaagccaccacacaaaatgcaataatgtacaggataatacaaggagtggctatggtttctttgcgtaaagctgagttttcaaatattgtttcacaaacctaagacctagcataaactgatcaagttttaattccattattcattaaacagcgatggttctgtccaccatctattgtgttcccaaggatagcttctcgccactggtcatcatggttttctggggtctaccacttctcgcctctcgagaagttgatccaccagcacaaaatcatcatgcatatcccatccatcattttaagaatttagagtctagccaagtgtaatacatatcccggtgctcaatatccgcgagcatggctattcgaatagattgatttactcacactgcagtggatgtacactttacccgtactcgtactccgcgacttgcccatcacataagcctatgtcccaacgaatgagacttgctacggcaaagcctttcaacaacctcactttggcagtacccgctccatgaactttagtcctcatgcactccaggcgtccaaggtttctagcagtgagaggagttctggcgctcgcgagggggaaagactcacacattcattaagttatagttaagtttaggtttgcacatgacagtcctaccgatggcgacaccattgtaggcacccgccccttgcggtcctaccaatggctgccccaccgtaggccctgcctcacacacaacaagaaaaccactatggcttgggtaccgcctccgctcggctatttactccgctaggtctatacccacacgagaagtacggttgtacaggggttgtttcatgcttaacttcatggctcggtccttaactaaccagggacggcactagccttttccggacaccacccaagtcctctagccgccccagtcgaaaacagttgtttagtttcatttttttcatttaacaaatcatgtcaccaatgttcatggcaatgtggcgctcatatctccacatgccgaatctcaactaccttccctaaggtagttgcccaagcatatagcatttaataaatatgagaatgcatgattctaaaatagcattactaagcttttgtcataattgactaaggactcatacgtaatcatgggtacaaggaaataatgagggaaataataatcaaaggcatggcataataacaagtaggatattcatcttgcatgcaattttatttataaacaaaacaatttcgcaattcggatcaacatgctaaagggatggggtgatgacttgcctgctcaggatagttcttattcttgatataatcttgatcaacgttcacctcctagaagctgcatatgttacctcacaactaattgatacaccaatactataatacgcgagagaaaccaatattcaaacaacaatcaaatatgcacaaacaaaatataattgttgaagacatacctaaggctgttggtactactcgcgtttgctaatggataatctcttaatcattcttattgtcatggcggcttatttaggagctaaccagtataatatgaatgaggtacatactactaatatgtggtttattctagctacagggttatgggagggttatagtcaaacaaataattacagtgtttcatttgtattattattttatcaatggagtcattattttaatcatgatcaggttttacttgtcactataaataaaaaaaggtaataattatccatgctatatatgttagatttgtgaggttaataatattatagttacagattatcttattgtataactttataactttataatgaacaatcctcagttgtggttaaactaaaattatgtgtggtcaagatttataactagcactagtatttagctaatatactggttcttcatttattacctagtttaatatatgcaacttgtagattatctaaaagggtatgtgtgtgcaacagtatattaacattgaaccatttactgaatataggcaatcgactataagctatatcatattggtgatctaatcacactagctctgttattatttctcaaaagcaagtcaacgattcatctatgagtattcatattttagttacaggatatgaggccaaatttgatttagataacctataagtcatgggtttaattatatggccatcgaatattaaataatactagaattttcctatacatccattcatttgagacattacttatatttaatttacatggttgctactgtgacaaaacatgctagaaacaaatattattacatctactctactgtataataccaattttatttattagcatattttcaagttgaccataatctaatcatttgatattaattatgtaataattataaatatattttattaaacagtgagttatataccattggaaagcttatgaatttagatgaatttaggttcaagtttcacttgaatcggagctaaaatgaataagttatgctagtttaaatattcaaatttgaataattgcgaaacagtactgttcatatccgatttattttaatccgaaacctatctacagctcagagtcacagacgtgtggggtcaggggtcttattatcttttctactgaattatttttgctaggggaaatatgggagtgggcccgacctgtcagcgacttggccaggagtcgtcttctaccttcgtcttattcttcctcccgaccgagcgggagcagcatgggaacacggcgcgcacgggaaggccggccgagggtgacccgacggcagccaggagaggcgcggaggagctccagcgatctcccgccggtgaccacgacgcgtggcgatgcggaggcgagcggcggctagggcaaaagggagagtttccgatcgaattggtgggcgtgggagtatctacggggtatggggatttcttttttctcgctagatggagaggggagctcccgggatagtctacccacgaggggcttgccggcggcggaacggcggtcgggccggcacggccataggcattaatagtacaaactggagccgacgctagctattagaggtacagagaatgctatggtctcgagggtttacccagggatggagagacagtgaagggcggcgacgcgtggtgcagtgcagacaaagcagaggtggctagcggtcggcgacacacgaaagtgttcgacgcgtgtttcccggcgtccagcggtcctcggcttccccaatggcaacggcggcagcacgacacccccgcccccccgccccccactccctccaacctccagctctggacggggagtcccgcaatatggtctttggtagcggtgagattacgcacacaaggtgttcgacgcaatgtattcgggaagaaagctgagaggaatggggatttttgttgggggcttagcttaggttgtaaggaaacggtgtggataagatcgccagcacattcccaggcgaaatagagctctaatggctatcggataagggcaaggaggtggatgacacggataaggtttgatctcctcctccattaaggttctatggctccatcatcatacctaaagcctaaagtctgtgcgttctagctctagctgtggtaggaggctccgttttacccagcggacataaggaggggcgccaaaacatcatgagatgtggataaggttttctcttctctctcacactcagggatttggggaatcaaatggccggtattaggtttgcaggcctcggagctaggggtgacgaagggcgaggtggcggccgttatccctcggcgtcgagaggcgacgcgcgatggcgacatcgatgacgccggcgctcgtggcggcatgggcggagcggcttccgcggctgaggtccatgtgcgagcgcggcatggcgcacggtctcgcggtggagtggcgcacggttaagtaaagacggacgcgtggtgggggctgggtcgctgggtgttcgactcactaggttcgagtcgaacacctggcgcgcaatgaataatgccatgctggaataaaaagagatttttagggttttggtttatttaaaaatcgagaaagatagctaattcaatttgtattttcaccagtgcatttgatcaacaatattaagtattcaaatgtgaatttggtccaaaattaatattgtccaatattttaaattttactatagcttttatgatttcctatataccttgtaggctctgatatttataaaaattaattaaaatattctaatgtgactactattaatacaatagctcattggttgaacttatttgtctagcaatgtattttacatggaaaagtttaatctattttattctagaggtaatttgagacttggtataatattgatctaagtatttaattagatactcccatccttcaatctttatatatagggataaatttattttatgtgaacaattattttatatgagtgaattttatgccatgagagatttgttgtaagttatagatattaatttaattatttcagtgaaacactcctatatatatagagtcattgtagtgacgactatttcgtggttacttagatgtcaggacactattcaatccgtaacttatagaaattaataagtgacttgtactttatttggctttgctatcatgtgcacaaatatttatgggatcgatagatagcgtattcttgcaaattgtacatctttaatttaatgtttcattgtgacaatttatagtttggcaagcaatagcaaccataacatccagcatgatgcaaaagttttaaaaagttcgaaattttagtgatttttattgtcgggaattttcagggtgttacaccgtcgcaaggcccatccatactccattacgtccacccttgcccgggtacgttagctaggaaaatctacgctacaaagtgcagctgttgcccacgctggcttgtgtaagcgcggtaattctattcttccagggtttcccccgaaccggtccttaattgccatgggtgcgactagcaaaaccatacacccagagctcgttgttaagccatattttagttagataattacgaccaataaaacatgaccatatgtctcgagctcatagctcatcaagatgctaatgcatatagtgtgattatcccataatgtgagctagtggtaattaaaaatggctaagcatataaagattctagcaagatcaacataagtgacacaagctagtcaaattatcacccaagcttgacaaaggagggatcacaagtaaacatggaacacgcgaggaaataggtagtcccataatcccatgtactcctaattagcaaaacgtgcaattttagttgcaaagagtaaaacatttgtaaattagcaaggagggctaccggtttgaggaagaactggggagtgaagctcattagctgcaaacttgagggggatcaatcaataaaacatcacgcaccaacagaaaagagaaggtgagaatttcccccatactaccaccacaaccacatcctctagtaaattaaacttaaaacaatccatcaccactgtgtagtttttccctagcaccttagttcagcttttaatagaaaagaaggagcggtagcaggctagcagcagataaaatggaggaggaaagaataggagcacttacctaggggatgattgctcggtgaagtcgagctccatggggcgctggtcatggcgtctgggtctagagctccatgcgtgaccctattctagccatgggggggtccacttcttggagctgtgggttggagagcatagagagaaggattaagaggggaggtcttgctggtagcctgggcattgaggtcgccgagagcaacatggtggtagcagcagcagtactagagtagtagagtgaggatttgagggaaaagatatccactgctaatggcaaatggaggaaggaagaaggggattagctagctgatgcttttacctgcaggagtgataagaggggagagacggggagaggtttctgcaggtgagagaatagagaagaaaggaaaatgtggactgattgctagatgtacattagtaggctacacagaacaccaacctgagcatagtgacccaattctgtagtccaagtatagtttgataaattatctagcacatcacaactggagtttcggtacaataaaaaggttacaaatttgtaagcacatttgtatttgtaaattattgtatttctattagtatagtttaattaaatctcgacgcatttgacggaatacaacaagggaactagaggcggagtctggtcagttgggagcgccagctatttttgatttgaactacgagaattcaggcaagcgaacctttgatcttgatgatttgaattattttgcataaaccttattttgcttcatgaaactgtcaccttgcataaaatagatttaccaaactataagtcggatatataaggatgatgatagatactgggaggggcagttgatggagaaactgatcaccttcggaccttccaacacttattagggtgtccacagatggggattgactggaaacgggaccctttacatatggctataatataaggactaaaatcactctcacatgcatatgtgtgctgtataaaaatcatgtcaaccatatccttgttgcaaggcgagcaacgctttgtatcttatcaagttcttacactccgcatggtgtgtaatgatagatagtgctaagatgggagaccctataaaccccatagaacattagtacttggatgggagatgatataaaccccatcaagatagtagcacgtggtggagtggagtgtaatgtgctgaaataagagaagagcatctagctatctattagtccattaaattttctataaacgcttctaaaccgccacgtggcgctcctacaaatgttcttatatcgccacgtggcaggtggacccaatattttataaatcattaaattatactaattttcaccactacatcttatctccaagaatgaaaatctgtacacgctccactttccgttcgcatatttatcacgtaatatatttgaaaagaaaaacagaacgtgcacatatatgtacatactctccctccctccctgtctgaccctcttcccttccgtctcttctcctaatttctacctctaacaaccatacattataaaaattaattatacattaaacttcctacaaacgcttttaaaccgccacgtagcgctcctacaaacgctcctatatcgccacgtggtaggtggacctaatcttttataaaccattaaattatactaattttcaccattac

SEQ ID NO: 1767 - DNA, 11181 bp, Oryza sativa
ctgcagccttgatttgcatggccctgttgctgcatggtttatatatatatatatatgtgtgtgtgtgtgtgtgtgtgtgtgtacacatatgtatatatatatatacatgtatatatatacatgtatatataaatgtatgtatatatatatatatattacattatacatgaataatatatatatgtatttatacatatttatatgtatgcaaatgcatatggatatgtgtacaaaatagacatatatgtatatattaaagcacttaacattttatgtgcatatatgaccaaaatatatatttacagtaaagtaaatgtgtacatatataaatatagacatgtattacaattcattatgtcctagctacgacttcgacgtagtcgttatctcagaagataacgtcttatgaattgtagatttgtcgtagtagaattcaccctcgggattaaggacttgttctttgatgaatcccatgagttgttcttgaaccgccgtgataaagtccttgtgtgtgaggttgtccctcatgtgaataacctatgaatgtatgaagttatattaattagtaaacaagaaatcgatacgtatgcaatgaaattttgaatggtttatttatacgtacatcgagctctcttgtggtgatgatttgagttgcaaagcagtggcaatactcacatacgtagtagccacacaagttagttccctcttcctgctttgcacactatatacatgacaaacgacgagagatttaatatacacttatatttgaattagagattcaatataaatttagatcatgtactcactggaaatttgaacctctggctaagtttttctttccaagtgccgcggaccaaatgacagaaccgataccaagccctacatggagtttaaagctacgatttgtactagcaatagcaaaattcataataataacactggaacatatgacattacctatctataagttcaaaaacctggtcaaaagtagactcatctttattcattgagtcatagacattaactctgcatgcctccaagtcgaagagtaaaaggacccagtggaatatgcaatttgtgttagatgatatatgaaacactgtacatgtatatgtacgggaatgaaatttgttcggtagacaataaaaactaacgctgtgttgtacggcagtagtatgaacgtcttgaaatgctgctccttgaggagatggacgagattttcctcagtggcctgtggatacttggtgaccatttcgacgtttacattccgagggtcgatgaatccagtatcgaaaaccccccgccgtcgggcccattgaatctccattttacaacaataaaggaattgttatttatggtgtacatatatacaaggagctaattaaaggaacgtaagaaatataactctcaacgatacgtacaaaatccatgcgctcagaagagagacgtcgacgacgtctagctggtatagttcgtagatatccttaaaattgatccagagaacatcttctccttgtaagaagtcggcgttcttgatcctcgctccgataatctccctaccgctggtgctcatctctatgtaccgttcatggaattggtacgtctgtgtcggtagggactgtagctgctcaggtgatgaggacacaactaagcttggatataaccatgactaccttatgtattaatcaaccaaaggtgcatatgctctacattagatttacttgttatatatttgaacaaacgttgcaacacaatgagtttcgtgtgtttttgtttgcagaggtacttgcttgggcgaaagaaaagagaccgagcgtaaggaatgcatggatgattgaagaagttgattggggaccaaaccaagaccttctccaagtccacttccatctcaccacatcacttttggtccatagaagataagagataaagttctacacgttttggattcggattcgggcctcctagcagcatcaacttcaaatggatctaggcgctgatctagaaggaatttcggggtccatgagtacttgttgaaaagcttatggagtctactttcagatggttttggtcctgcatcaaaattcctactgagctgccgggaatctgcaaaacaagccatgtatctcatccagtccgaatctgatttgggttttgggccttgtaattgtgtcgtgggcttagcccaagggggtgtgcgccctagtgcaaccctaggacgtccctaatcacatttattcagtagccgtcatcgtttagagttgggttttacttagattattctgttaagaacagtttcgtcgctagatcggtttgtggaaccccaaattcgagtgcttaatcattcatatgcaatttggttgcaatctatcttgttctttcttgtgttcttcgattcgcatgcagggattagccttctcggcgaggtcaaccgggtttcagcacggttgataaccagaggagacgtagtgctgcgattgcggggctcagtagcgtgttcgttcagaagccggatcgagttgtgtctcgactccgtccaaatcaattgtttatcaatacctatcggaagatcaggacctaacatccctcatcagtaggtatcagagcccggttgcccgttaggtaatttaaattcccataaccagaaaattgccacacaaaaatatttattctttacctagacaatttgaactgttgcattgttctattagattttgcttcgttgaattttagattgcatcgtcgtgtcgagtgctggtttagttttagatttaattttagttttgagtaatgcatctgttcatcactttggtccagggttcatcactcaagtgtgtgagttgtacgtcagttttgggtccattttttcatctcgttggttgttgccgggacattgaaaaattgaatcgtctcgtcatcgggtttccatttttgtgatttggagaaattttttatgagttgccgtactgtgcacgtgaggagagtactgcgcgcgtgaggagagactccggatcaaatccgatctatccgtgaccgtccatattttcctctttatagaagtgttaagtaacggatttgagatattttttataaaaacagaacatacatgacatgagcaatccatttttgagatgatccaattttagttttgcactttatgtttgagtccttgtaatatttatatttacatttgagtccctgttcgaggtcagtggtcagtttctgttgaaaacaaaaacacacgaaactcattgtgtagcaacgtttgttcaaatatataacaagtaaatctaatgtagaacatatgcacctttggttgattaatacataaggtagtcacggttatatccgagctagttgtgccctcatcatcaggcttgacaagcggtttaccgagttcgtactggtgtctcacttctgccttagggattggtgcgctttaagcaactgagccctagttagcccggtgtcagaaatgaatttttttattccaaattcttgcccggtcactaacaactcgacctcctggtttggttgctctccaagctgagggacttttttggactttccagaatgtgctttcctaagtgttcgctcatagtccgttagctttaaggcctccttgagtggtcccgacatcttctggaagaacttcttggcactcgggtctataggaatcttcttttttggactctgaggcttcaattgcctcttcacttattctgccacgtaagcgtcgagctcctcttgcgtgcaatcgtacggtggctccttgttcttggcagcgtcaactttcgccttcttcgttgcccttgtgcgggcaagcggtggagcttggtgagttcttgacttggaaggtgccggaggacatggcagaggagcctgaggagaagtcgatgcaggagcctgaggaggagacggtgcaggagcctgatcagtaggagacggtgcaggagcctgaggaggagatggtggagccggaggggatggtgcacgagacaccgcttgtcgcccagggaggatgatgtagcgcttgcgccatagtataatggcgtggcttgtgtcgcgtagatacgtcttaccgtctcctccagggtagtccaactcgagttcctcgtacgcggcttccaccagttcaacttcgaccctcgagtatcctgctggaatcagcctgcagtggtaagtccctgaagggtccgttgggatggtcattcccgacgtaaccttcacgtgatgagaggttatctattagtaatcaacctaagcagaaacttgcggaatgtacaagtccaaaaaaacataaaactacgggcataccttgattgataagttcttgaagggaatatgcagctcacatggtgtccgctgcgtgatctcatcaatggggcaagtggtttcgtcctgagtttgcacggcgtccatgctctgtgatcctacctgccccgttgaggcgcagctgctacgattgcctgaggggctgaccattacaggaggaatgtatggctgggcatcatggcaccgatgtgcggccatgcgttcatccaccttccttgccacctcctcttgcatgctgagctcgtagctcgataccctgtactcaagatctgcaatcttcgcctcggtatctctcttgctcctcatccgactcttgtacgtgtggatgtcctccttgaatccaatcttccaaggaaccacgcctttccctcgtgttcgtccaggatgctcgggagtctgcagggcgagtgacagctcgtccttatctctgttgggtcagaacgtgccctgacaagaggcttccactacatccgttagtcgactggcagcctcgcgtatctgatcgctgaacaccagggagccgtcaacagggttaagcgttccaccgtgagcatagtaccagaacttcgatcgatccagccatttagcggtggccggttcgacacccctctcaatcaagccggcctccatctcctcccacttcagcattgtgacgctatagccatctgaccccaagaggtgatggtacttcttggcggcattttctttgtttctgtccatcatcgcttgcccttgttgccctgtcttgtaagcgacgaactcgtcccaatgatcccttagcttcgggaatacgtcgaagttcggtgtcagccccttcaggatgtatttcttgtagagatctcccttgaagctctggaattgttctaccattttcttaagagtccactgtttcactatgttctccgtacccgcagggagcgtgaacgtctcgagcattgtgatccacatcgtatctttctctgattccgggacaaagctgtcataatccccgcgtgcccttgttctgcgccagtacaccttgctgacaggcacgttatccttcacaacccaaccgctgtgtcgtacaaaattcttggctgcttcagccggggcactaggtcgatcgtcttcgtccacctcagttatgatgtgccgaccctctatcttcttcgcggcacctcgttgtccgcgtgccctcttctgtccagcggaggattgacttccactagcctccgcctccttgttcccctcctcagtcccctctgcatcactctccacgttcccctcctcgttcaggtactggtttggatcctcgttcccctcttcttcgttccagtactggctgcttccctctgcgattgtatcgtatagtatatgtttgtcatcgcgatcagccatctgttcatacaagaaatatttgcagccgtttgttatttacgtatataatatttgattagaactctaataatcatatattaaaactctaataatcatatatgctaagtctaataatcatatatgctaactctaataatcatatattaaaactataataatcatatatgctaactctgataatcatatattaatactctaataatcatatatgctaactctgataatcttatattaaaacgataaatattaatacatgctaagtctaataatcatatatgctaagtctaatattcatatatgctaactctaataatcatatatgctaagtcgaataatcatatatgctaagtcgaataattaatcatatattaaaactctaataatcttatgtgaaaactctaataatcatatatgctaagtcgaataatcatatatgctaagtctaataattaatcatatattaaaactctaataatcttatatgaaaactataataatcatatatgctgagtgtaataaccgtatatgctaagtctaagtttctaatattaaaactctaataatcatatatgctaagtctaaataatcatatattaatactctaataatcatatatgctaactctaataatcatatattaatactctaataatcatatattaatactctaataatcatatattaaaattcgtaataatcatatattaatactctaataatcatatattaaaactctaataatcatatatgctaagtctaagtttcatatattaaaactctaatagtcatatatgctaagtctaaataatcatatattaaaactctaatactcttgtattaaaattctaataatcatatattaatactctaatactcatatataattacatcacttgcctgcgcaaattcctactagggctagctaccactttggcttaagggacgacgacgacgtctttcctacaacatggaaaaaaatgtgttagtctaaacacaaaggaacatattttgattagtgcgctgcatgattaaactaggacggaggggagtagaagtttaggttcatggattaatttgtgagacatgtaactttgcgttcattcgcgttttattcccgttcgttcgcggttcgttcacattcgttcgcgttcattcacgtttcgttcttgttcattcgcggtccgttcacattcgttcgtgtttcgttcccgttcgttcgtgtttcattcccgttcattcaaggttcgtttacattcgtttgcatttcattcccgttcgtacacgtttcgttcccgttcgttccagttcgttcacgtgtcgttcgcgttcggcagtggcggccacggcgtcggcaaaggcggcggtggcaaaggtggtggcgttgcacggcactggtggcgtggcacagcggcgtcgtcggcgttggcatcggcagtggctttggcacggcggcggtggcatggtgcggcggcggcggcggcgtcggcgtaggcgttggcatcagcggtggcgtggcgcggtggcggcggcggcggcgttggcgtcggcgtcgagagtggcggcggcgtcgggagcggcgcgaggacgacgacgacgagcgaggcggccggtttagagagagagagagagaaagattgagatcgcggagcctctcaccccaatgcggcggcggcgtcgacggcgacgacgacgacagcgagatgactgcggcgtcggagcaagggatgccctaggcgcggcggcgaaggtgatgcagctgagatcggagaaaaacatctaagtgttggtggagaagacgagtgcgccttgggcatatatataccccatgatctttagtcccggttagtgagaacaaccgggactaaagatatctttagtccctattcatgacaacaaccgggactaaagatcttatcttaacatctttagtcccggttgttcttacgaaccgggactaaagatatctttagtcggactaaagatatctttagtcccggttgttatcaccaaccgggccaaaagatcttttcccgctatttccaaattcttttttaacacggttagggttaagaaccgggactaaagataatagcattgcatattaaatttcattacatatgggtttctaaaatagtaaataatgcattaaaatgatttaaagtcacaaaattaatgacaaaaccttgaaaatatattgttgtctatagtaaattaagtggataatatataataagcacatgaatgatttaaaattgttaaaaattctaataatcatgtgtaaataccacatgtatgatttaaaattatcaaaaattctaataatcatatataactagcatatgcatgatttaaaattgttaaaaattctaataatcatatgtaaataccacatgcatgatttaaaatttttaacattctaataatcatatgtaaataccacatgaatgatttaaaattgttaaaagttctaataatcatatataataagcatatgcatgatttaaaacttttaaaaattctaattatcatatataactagcatatgcatgatttaaatttgttaaaaattctaataatcatacataattaacatataccatacaacaattgatttatatggatattcaatacatccaaaatagtttacatcgtgtacacaacaattacggcaatacattggcggtgacggttgaccacacgtagtttctcctcactattgtttcttccttgtgatcactaggtgagtaaggggtgtcttcatttgataggaggatgctagggtcaattgtcaccgtgaaagggggttgcccatcaaactgatcgtaatcctcgtcagtcttgtcctctacttcgacgatttttcttttgcctgggagaaccacgtggggctttggctcgtcaggccctttgcccttctttcctttgctagacatgtccttcatgtaaaaaacttgcgttacatcattggcaaggacaaaaggttagtccgacaaccttgttaaggtcaatcgttgtcatcccactgccatcaatcgttacgcctccaccagtcaacctaacccattggcaccggaacagagagaccttgagaggtcgatagtcaagttcccatatgtcctcgatggcaccgtaatacatgccagttgtaccatcgtgtcctatggcatctatacgaacaacactattctggttcgtgctcttcatgtcttgggctctcgtgtagaatgtatacccattgatcttatatccctagaatgtcgcgatcgagccagatggtcccctcgctaggaaggccagttgttggtcaatcgtctcgttacacatgagatgttgtcacagccacgcggggaaagtatcaatgtgataccgtgtaatccatgcatcggacttaccgatgtttctggcgcgaactagagccaagtgctcctcgacgtaaggagccaccaatgaagattgttgcagaaccatgaaatgggctttacggaataaattgttgtccaccgtcattattgatttccttccgagagtcccctttcccgtagtctcctttcatggcgtgattcaagcaccccgattgggcgaaggtcttcaataaattctacgcagaattcaatgaccttctctgttccataccccttggcgatgattgcctctagacgagcacggttacgaacatacttcttcagaacgcccatgtacctctcgaaaggaaacatgttgtgtaggtacacaggcctgagaataccaatctctttgacaaggtgacaaagcagatgcgtcattatattgaaaaatgaaggtggaaatatcaactcaaagctgacaagacattgcaccacatcattttgaagggcttctaatctatccagatcgatgaccttctgcgaaattgcgttcatgaaagcacatagctttgttattgttgcccggacattgtctggaaggataccccgaattataactagtagcagctatgtcatcaacacgtgacagtcatgagactttaggtttgtgaacttcttctccttcgtgcttattattcgctttatattcgtggagtatccagacggtaccttaatgctctctaagcattcaaacatactttccttctctgccttgctaagagtgtagctggctggactaaagtaatggcttcctttatcctttggttccgggtgaaggtcgccgcattgttccatatgcttcagatcattacgtgcttccagtgtatctttcgactttccatatacacccagaaagacaagcaggtttacgcaaaggttcttagtgaggagcatcacgtcgattgcatggcagacatccaagaattcccaataggttaagtcccaaaatatagagttctttttccacatcgccgcatgaccatcttcgctctatataggctggctgcaggcccctttccaaaccctactttaagatctttcaccatagcaaacactgttttcccgctgcgatatttaggcttcgtacggtggtccgccttatgttcaaagtgcttgcttttcttccgtaccgggtggtttgtagcaaggaatcgatgatgacccatatacacaactttcttacagtgcttaagatacgtactttcaattttatccatatagtgagtgcaagccttgtaccccttgttagattggccggataggttgctaagtgcaggccaataattgatggttacgaacagcagcgatcgtaggttaaactcctcctgtttgtcttcgtcccacacggggacaccttctttcttccacaacagtttcagatcttcgaccagtggtcttagatacacattgatgtcgttaccaggttgcttggggccttgaataataatcagcatcattatgtacttcctcttcatgcatagccaagggtggaggttgtagatacacatcgtaacaggccaagtgctatggccgctgctcatctctccaaaaggattcatgccatccgtacttaaaccaaaccgtatgtttcgtgcgtcctttccaaagtctttaaatgttctgtcgatgttttgccactgcgaaccatcggcggggtgtctcagcatcccgtcctgttaacgttcttcagcgtgccaacgcatcattctagcattcccctttttcctgaacaaatgccttagccgtggtattatagggaaataccacatcaccttagcaggaattctcttcttcgttggctgcccgtcaacttcacctggatcatctcgtctaatcttgtatcgtagtgctttacaaacaaggcatgcttctaggttctcgtactcctcaccacgatataggatacaatcattcggacatgcgtgaatcttctgaacttccagtcctagagggcagactatcttcttagcctcgtacgttgtctcgggcaatttgtttccctccaaaaaaatgttcttgatgaatttcaataaatcgccaaatgccttgtcactaacaccatttgttg

SEQ ID NO: 1768 - DNA, 1202 bp, Oryza sativa
attatcgatgatgtggcttaacctggatgcttctttatagtgttaatgcttgtagggggtaccaactatataggaagaagggattgtctttgttgtcctcctttgacatgtcaataaaaacttcatttattacataaaatatggttaatgcatgccggtgttgaaattctactagtttaattcttctaaactttgccattctttagaatgcttttacgaaaagaacatccgatttagtagctgtgtcaagtaaaatattttaagtcactgcaaattagctttgggatacatcatcaaattaacacagttatgctaatctgtgtactttttattgaatgtaatctcacaatacgatgaaaatacctagctaggtttatactgtagctaatttcaatgtcaggacattgataattgcatattcatacaaaaatatatatagtaaaaaaacaagacccattttgaaaccaaaaccaacagcagaaattcatgaccagttcatgcagatatatatacctgggtttcagaaagtgcattgttggaatcttgagcattgtagcaacaatgttggtacctttctaaagtctttgttatgctgcacaaaaatgttatatgtaaatttctcatatatcaaattactacgacgtaaaaagtgcatagatgttatttatagaggcagaagcttatattataatgatatcaaaggtcactctatatttactatttcttttcgtccaacaaaatgatcatgttttttttggcaaaacatagtatgtaagaacgtaaaaaaaaaacatagaaatgttacttgtagagccagaagcttatattataactcttgatttatgacatagataatttttttcatccaacaaactgatcacatgtgttttgataaaacatgcagtcagctttcatcgttgaagtggctttgtgtgagatatcacgaagtgactttgtgttgcatttatagattgataaaattattggttacaataactaggttttactacctccgccctaaattagtggttgctttaactttttcttgtaacatttgaccattcatcttatttgaaaaattagtgcacttataaaaaaagataagtcatatttgacatacttttgataataaagtaaatcacaaacaaaataaataataatacgataatttttttaaataagataaataaccaaacgttaaa

SEQ ID NO: 1769 - DNA, 2939 bp, Oryza sativa
ttcctaggaaattaaatcctctaaaattcatatggtaatccttaattcatttcaaataggaccttagagtgggcatatccttaaaatgtgcactcacgcagaagaaatagtcggtcgtggttatgcaggtgtaggagtgaaaatggggtgggtatttcccgcccgcccgcttgaccacattatttcgggacaaattccggtcgaaaattcgggtacctgggacttttcatggatatcgggtccaaatacgagtcttttttggcggatacgagatcaggttcgggaacgtagtatccgacggatacggattatccggtaaataatccgggtattacccggataattatacggatattacccgtattatatttttgtgaggcactttttggtactatatattggttctattataaaaacaaccttcataaaacactgccaaaacaaccttcataggcactttttgtgtgtttagttcacgttaaaattggaagtttgattgaaattgaaatggtgtgacggaaaagttggaagtttatatgtgtatgaaaattttgatgtgatggaaaagttgaaagtttgaagaaaaaaattggaactaaacaaggccataaaatatgggttaggatatagaaaagatgagatctcactaatatgtgttaggatatggaaaaggtgcgtaagcagaaagccggtaacgttctagtagttgggtgaaccggctttacccaccagtttcttagctaactccaaatatcttcacataaaaacaaccttcataaacactgccttcttagataaaagaacaaaatttaaacgaaagaatgctgttgtgcactgactcaatgcaatgaccttttagtatagtcgtcctctatcacgtactacctgctcgtcatctagtatacgagggccatcgctgtcgtggatgtcacatggatttctcgtgtggcccgaggaatggatcgtggccgcgcgagcaagtagttgtagtatccccaactatgaaagtgggagtagcatttaatatgatcaagaaaggcaaccaacaatcgccttggcaccctgaaatatgccaaattgcaaaggtttttttaagctatgtaatcatgcggagcaaagcaacgtggacagattcctaaagtaaagttgtccctgcgaactgagaacacatgaaaagaccctcaaggcggttctgaactggagtaaacaccctagcgatgtgtttaccgctaataaaaagttgtggtggttacttggttatctccgcaagataccccggtatcaaaaaacgtaagcatgtacgaatctgtggcggcaggtgaagtacagttgtagagaagtttctctctcttcaaccgcgagtccccgcaccaacggattcagactccacatgactcgtcagaaaaatcagggattcaaccatgccatggaatcaggagctgtttccacaaaaacacccagctaaacacgctaggccggctgtttcgtcccgatcgtgcgcagccggcggcgccgcacgcgatcgtgtggtcgtcgcttcgcttggaaacgcaccgcgttggcgcgccctgcctctcccgttttttcccatcccttcacacaacaatcacaccaccacgcaagttctcacctcgtcattacggattttacacttgcacacgcatccaaacctttcgccatggagtacacgatcgccctcccggctctcctctcatttactccgtactatttgcgcactaccggagcggaggagtgggccccacatccacggcagcgaaggctcaggtcccacgcaccgattcaccggacgtggggccaaactgtcagcgtcactgctgccgtatgggtgtggatccacgagtcagtcctttcttttttattattcggggagtatattaacgtcagggtgggccgtaaaaaggtaggcgttttattagggggaagccattgaatggcgcaagcggtttatagccgctgtaggtaggattcctccacggtaaggttcgttccatccaaaggcctttttatttctcctttctctgtgtctcgctcgtttccattgagcctttgctctcgcgtctctcgtgtctcgtggtgtttttggtcttggccttcctctcgccatggacccggcgggtgcgccgtggtgcgaccctcgccgagggtacggcggctacggtgttggatcggcggcgttgcaggcggcggcgcggcaacaatcgcagcagccgcgatctgatggtgcgggaggcgcgggcgtcaccggaggcgtgctcaagaggagcctgggggagatggagaggtggcagcagcagcggcaggtggcggcgcagcaggccatgtacctgcgctcggtgaggcagcgcatggatatcggcgctgtgctcggtggggccgcctcctcgccggcctatggcatttccggcttgtcgtctggttttggcggtatctcgcagcagcagccgtcgtcgacgatgtcgtcgttgaccaccgcgtcgcgcacggtgatgccagggatgcagcagcggcggcggatgatggccgttccgaccgcgcagaatcaagcggtggcgagggcgcccgctgctaggccggcaacggcgaccgaactggtcttgttgcaagagctggagaagcagctgctgggcgacgacgaggaggcggacgcggcagggagcggttgcggctctggtatcacaagctccgattggggcgacacgatccagaggcttaactccgtcaccgccgcgtcgtcgccgtcgcttcccctgccgaccgccgtgaacagcaccgcgctattggcgcggtccccgacgaactcctcttcgtccacggcttcgtcgtcagcgtccagctcgccgccgatctccgcggcctcgtcgcggcagcttctttccgaggcagccgctgccgtcgccgatggcaaccagggctgcagg

SEQ ID NO: 1770 - DNA, 3234 bp, Oryza sativa
aaggcacttgcttggggaggatcttggaccactcagcgtcaaagaattgcagcagctggagaaacagcttgaatgtgcactatcacaggcgagacagagaaaggtttatggcattctgcagtcctttgtttggaaccaaaatacttctgtttctagcctaccctgttcgcttgttatttgtccactgatttggatataggtgcaatacgtgagaagcaataaaatatacagtatgtctttagtttgtaggtaaagttatatatatttataaatagacaggaggtgtacgctagctatggaatatccccttgctaaagtttatataaagagcacctaactaatttgtttttgttcatggaagtgaacataataactgggaatgcttatcctacattatctaaagagaattgcataaaattgtttcaatctctagctaatgcatggtggtggtttggtagaaagccaagacatatttcacttagaatattgataccttattttatggtaaaggtcaactgatgatatttttaaagaagtgtgaaagctactatgcagcataagtaatccctttgtttcataaatttgccctaagtcattatctttaaccatcaatttctggaaatttgtgtagtttaacaaaatgtgaactgtacattctgtaaggatttttcatgttgtgtatctaacaacataacccttgtggtgttaaactatagtatcatttttttagaaactaatggtcaaaaatatatataagtgtttgaattaggacaaacgtagaatgacaagtaatttgaagcaactgggcgtagcatgtatcttgataaattcaccctattctaggcacgaaggtgatgcatacagtggcactaaatttcatataaaagactatctaagtatagaatagaaatatagaatggctagcacgcatgccctttttctttatatggatacatgtgtagtgacagggccgagcaactgcaacattaatctaaactgtcaatttcagatatactactacttatggctgcttgtttaggctaattaataattatatgtttactcttttcaaaataaaacacttcaaagctgcatgacaatcccgtcaacaaggatagtaatgacaatgagtagctgatgaaataatatggcttcaattctggagtttcaggaaaatttagctgctaaaaaaagaataagtgaataacccaaagaaaatagaactttgaaggatagaggtagagagattaaatatacactagtattcattttgtggtgcgtcgtacatgcttcaaaatctcccaaggaccataaaagatcccaagaaatagctaggtagaacacatgaaagttcagaaactggatataatctacacttcattatattactgtcaactcaatatgactgtgcttgaatggtttttgtgcagacgcaactgatgatggaacaagtggaggaacttcgcagaaaggtacattatcaatccaaagtttctcaagcatacatacagtatcagcattgccatgggcgggtgacttcaggagtgctagctactagtgataatctaaattaaaccacgaaatgacttggctagctttgacaatgcatctatattgccagcaaggctgctagggtataccgcatgcaagttaattagggtagatcgtgtagcctttgactgtataactaaagaaatggtagcttcgttcttgcgagagatttctttcatgagagttgttacatattatactatctccaatatatttttcttgtgccacaggagcgtcagctgggtgaaattaataggcaactcaagcacaaggttcttattcactcggaaatctgttatgccaatgcggtgcacatataattatttattgataattttcattcatatattctcatatccaatgctgcagctcgaggttgaaggttccaccagcaactacagagccatgcagcaagcctcctgtgctcagggcgccgtggtggagaatggcgccgcatacgtgcagccgccgccacactccgcggccatggactctgaacccaccttgcaaattgggtaagattaatcaagaaaagccaagaccagaaatgcatatacttataacttctagctcaaatgcatacagctcgatcacagcatccgaactagtagaactaatgaaagattctcatcaaactgactgtgtatatcttgcttccattatattatctgaaaaacgattatgttactaggtatcctcatcaatttgtgcctgctgaagcaaacactattcagaggagcactgcccctgcaggtgcagagaacaacttcatgctgggatgggttctttgagctaagcagccatcgatcagctgtcagaagttggagctaataataaaagggatgtggagtgggctacatgtatctcggatctctctgcgagccacctaatggtcttgcgtggccctttaatctgtatgtttttgtgtgtaagctactgctagctgtttgcaccttctgcgtccgtggttgtgtttccgtgctacctttttatgttttgatttggatcttgtttgaaaataatcttaccagctttgggtaaactgtttattacgtactctatatagcatatgtgaccgacgacaacggtttcattttagatgatgtgtatggatgatttctttccaaaatcacatctttagtataagagcaattttaccatccaataccaaattttatactagaaaatattttgggatatcaaaatttatggtacctccagtaccaaatgttgaatggtaaactttcataatatacaagtcactctaggatatttaagacaatttttagttttttcttattgttgcccttgttaaatacatgagaaattttacatcacttaaaatgtatcaagaggtatcaaatttttttaatacaaaatttagtactttctccgtttatatatgaatgtggacaatgcttgaaagtcttataacctgaaactgaggtagtgtatcgagaagtacaaaattttacactaaaatcccagtacttactcaataactgtaaaattactctaaatatgtactccctctatttcagattataagttgttttaactttagtcaaagttaaactgtttcaagtttaaccaagtttgtagataaaagtagtaacatattcaacacaagacaaatatattataaaaacatattgaattatagatttaattaaattaatttgg

SEQ ID NO: 1771 - DNA, 1362 bp, Oryza sativa
tcagccttctaatcctcgttgtgtagcaatctttcacatgcttgacacacatgaaggtatgatcagcatctaatttgttttatttttctgatttagtatcaccatccaatatgtgacttcaattcttggattttctattaatatttttttagagtaatcactttgacgattcatgaaattgtgaggcgcggttataatctagcacacaaatttgtaaaatatttatttttatatacaaactatatagtgcgtgtgaaccatagccaaaacaactcatggttacaagaaaatttgtgacgatatataacatatataacatattggacttttgatcgacatccccttttcaatgaaaccacaacatgtatgcaatgtttatctccagaacttcattccagctagtactgtttagttattgaataatgacaatgacatgacaatcagaagcatgaagatgatctcgtttttttcttgtaacggtatgggtgcaaactaattgtactattgaataaaggaatctgatcgaatttgccataacccaataattaatcaagtaggatgtcatgtgcactcatcaattgattggtacgtacatatgcattcaatattatacagaattttttccttcagtttctgtagattgctgaagctgtagcctttatctcacaagggaaggtggctcaacaggcacgcagggccatctgatcatggccgaaaatgattggtgttgctgatattgatgaatgtactttcgttcaaggtgagagaagaacgttggaagaatccagttaatggcgcaagtacatactagtagtagatttaattcaaactgctggtctagttaaatacgtactatattcatatttatttaggtgatattttatttaaacatataatagacgcaaatacaaaaacactcgtatacacttatatatttgtccttatgaacactcatgcacaccgtgcttctaactatgagtgtatatcataagaatgataaagttatcgtaggagcctcgttgttgacaagtacattgctaacaacttaaagaacaattaaccgtaaatacgaacaaccatatgtactaagtgtgatacttaaactcgatacacaggttcattataaaggaccttagcaggtaagctagactatttgctttttaaaggttaaatttgatgccaatgtgctttcaaggctgtgttcttttctcctgaagatgccccgtttgtttcttctgcaagggtaggataaaattttggattctcgtggcacgctttttaaactactaaacgatgtgttttgtgcgaaaactttctatatgaaagttgctctaaaatatcatattactccattttttaagt

SEQ ID NO: 1772 - DNA, 2700 bp, Oryza sativa
atgattgattgagttttaattattacgaacttgaaaaatatattaatatgatattttagagcaactttcatatagaaaattttcgcacaaaacacatcgtttagtagtttaaaaaacgtgccacgaaaatcttaatttttcatccaactcttattaaagaaaagaacgggaccagtcaattcagtcagcttatcttgggccgtttgtttgtttacttcgaacacagtcaataattaaataacaaagtactaagaacgaggagggattaagatcatctagcttctctctaacgtggattactcattactgatatatggccgggttccttatgtagcgggtccacacgtcaacaattgaaaatcagagagaagtaattgagtcgcacttaatttaaaaaagttatactcgaaatttacaccgaaagttcagaaatatgagtgtagctgactcgaaatagatatatgccctgttccttccacatttagaactgtggaaggataaagaggcaaatttggaatattccacacattagttttgcaacgactagctaggagcttctgtataggacaaatgatcccagtcctacaaaatcataaagacattccagttgatacacaatcatgcatcatgatcaagtggatcaataaattatatatgcaaaatggaccagttcagctctcggttcagtgacgtactagtataaccataaaggttcaatttgcaaacattgaaaaacccaataccggaccagaaaaacagagacataccaaatgaaccgtttatcattataccactgtacacaggtgtattatctctatgacatgatttacttacatgcagtatctaatcatcgcagtaattacatgaacctcccaatgatcatgccaggtgccaggccgggccaaccaaccagctgcttgcctgcttctaattaattgttcctaccgtctaatcatcgatatattccaccgcattccgacacgtaccactctcctccagctggataatcctcggcagaaaaagaaaaaggaaacgaaagggaaagagagctttgtctccgttgattaacagcagcagtaagctagcttaggctgtgaaatggcgcgactgccctcccacccaaccgatcccgtgtcgcgtcgcggtcgcgcgggccaaatattgattcaccaaacgacgcccgtgaggcgggtggcgaggcggcccagtcgcccgcgcgggccggcggcggggcgcgcgcgcggcagcagggtggagcggcacagcgggcacgtcaaccggccgaggtcgatccaccggtcgatgcagccgcggtggaacgcgtgcgcgcagttgcccagccgccgcaccacgtcatccgcctccagcctctccaggcacacgatgcaccccgccaccgcctcgtcgtcgtcgcagccatgacagccgtgctccgaggccgcgagcagctgggcgaactcgaggggcgggaggcggtccttcacctcgtcgggcagcggggcgtcgacggcagccgggcggcccgatcgctccgggtggtggcagatcccgacgacgaagagcatcagctggagggcctccctgatggcggcgaggagcttggccaaggcgatgagcggcttggggatcgccatgcagtagcacaccagagggaaccccatgatcgccgctgtatcgagcttgctacgcacagttggcaatactactatacaccgagtcgccgaacgccgatggatgcacggaagcagagactgcggcgaaagagagtcgtggaaagcaaagggggaggatggtgacgagtgacgactagtcgttacgagcgcgcgcgcttatatagagcgccagcggtgatgggcgccggtcggcggtcgcggcctcgcgggcggtgtggtgaggtgatcgataccgagacgttttcacgtggtttttggtggataacgcgcgtgcggcgtgcggaaggaaccagaggcgcgcttgccgtacgttttaaccgcgtggcgtggcaagctgacgcgtaacgggacaacgtcgcgggttgttttgagttcgtttgagtttgaccggggtggtgcccccgccgccctggtacgtgcgcacggactacgggcgtgggggcacatgggaaacgcacgccgaaacttgatttgggcgagggcgagtgggcgtggggtccccggcgcggcaaagacggatgacgggctcgctggtcagacggaaaattcgtaggtgcttctactccatactgttgcttgtgttgtttactcctactaataatacacttgtacaacttgctatgcggttttcgacttttctcgcctcaccagagtacagcacggaagtggagtcatgttttgctttttttttccccgatgctcactgcgtgacggagtccaccaggcactagtggttcagagcgagactcaagggtactatacggagtaattcgcaaccgtatgtccatgttcaattcatacagttgacaggcgctatccgagatgaagacgatcgaagaacaagtcagcgcttgacggttgtaaaccacattggctagtcctagtgtggacgagagaggacacgtccgttagttgcattgatggagccactagcacatggatagagatggacggttgggattgggacacagatagcagtgacgaacttggtaacgttatggggaataggttttgcagggctgcagga

SEQ ID NO: 1773 - DNA, 1597 bp, Oryza sativa
acaaaacttagatatttataactcaatgtaacattagtgctagaaactcaaactctaaattatgtaggttttgtgataattatattactaaatctttagatttgcaatagtttagttaaattatatgtagttttgagaaacttacttggaaaagaaaatgacaaaaatcaattttcaagtatggtcttttcaaaagctacccgccttactttaaatagggtaatgggagaggatgacaataactagagagaatcaaagccaataagattggagaacttaagtgatgattatatgttaaaggtggatgatagtgtaaccactctgcttctctagattgaggagatagcgaaattgatgatgggagaggggggaggggtatacggcctagatagatggataatctacttgaaaaggttgaaatgagttaggtgatggtgcgatggtactagagggattataagacgtagtcaatttttctgagcaattttgtattttatctccagatctaaagacgcgattgcatttcctacacattcattgctataatctgcatcgttatagttagcatgatccaaatacatgtcacaatgaaaattttttttcgctggtctttagagcaactagaaaattgtgcttttcttaaaatatgaatttaataatctattttttttacactaaatgtatttgttattggactactggttgatcaaaatctgtaaaatttacgttttaaaatcaggacgcaccacataaaaaaaatttcaaccgaggcagtatcgctctaaagccaacaacacggggactgatgtcaaaaacattataggcgctagtcgccatctgtgcccatttcgtcctgacgaaaaaagatttaggagaacaagaacttttgcaagtttttaaggagagcatcttggctttgtgggcgcctgggcaatcatggatcatggccgcctcatggttgtgctctcgcaaacccctcttctaaaccccagcggcacagtggcacacgacggtgcacgttgcaatcaattgcctttgcgtgtttacatgggaagggtgcacgaattcggtgagccatcctctctgtcgcgaagaggcatgtctaccggtggcacgcacggccgagcgcatgatttcggttcgctgagcggtctctttcgcggttaggcgagtgaattgacaccgagacacagcgatgtgcacggcagcacggggaatggggtagaatttgccgcggcagtaagagattggttcgagttggctgttgctgtcgggcaagatttgggtcgcgttacgcagctacgctcgagccgcagcgtgaccagcgtggctggaaaagggttctcgtagacgattggagttcgagaatcaatgcgaaaagcaaacggtgccgaatgtaccaagaatgggtcgacagccatttggccgaaccgctgaagggagatgcatgacaggggaggcggaacaaatgaacaaaaacgttcacggagcaggtatgatagtagtaacacgacactgtttgatggatgattcaatgagtgtggagattatgaataccccatatctacatcacagttgtaatttagtcgaatatacg

SEQ ID NO: 1774 - DNA, 12891 bp, Oryza sativa
gaatatctctacgaagactcgagtcagattctaaacttgtatgtcaaggaaatacccgggattttagtcggttatgattgtattttatctataatcccatattccgttacatcccggcctagggcttaataggattaatagaatactcatatcaacaagttgcaacttcttttccggaagccaatctccaaaaaaactccagggttaagcgtgcttggcccagagcaatttgggatgggtgaccgaccgggaaattcttcccgggtgcacacgagtgaggacaaagtgtgcagaaaagacatgtgttggtttgttggtttgtgagggcagtctatgacctatgaaagctatcaaatgtaagcgggcccggcctggggtaaggcagcatggcacatgcgctggcactggacacatgaacgtggccaagagaggacgttcctggcctagggttgatcgacggggcgtcgatctctcttaagggggtgagggtgtaacatcccggcctagggcttaataggatgggtggcccagagcaatttaggatgggtgaccgaccgggaaattcttcctaggtgcacacgagtgaggacaaagtgtgcagaaaagacggatgggtgaccgaccgggaaattcttcctaggtgcacacgagtgaggacaaagtgtgcagaaaagacatgtgttggtctgtgagggcagtctatgacttatgaaagctatcagatgtaagcgggcccggcctggggtaaggcgggacgttacagatatggactgtattttgtaaagcggactccttcccctatttaaggagggtccgtgtgcctcttggggggcgattctttttttccactttatacaatcaataacacactcggcggaatcatccccggacaggagtagggtattacttcttgaataagaaggcctgaacctgtataaaattccttgtctcaaaacccatccactttcctagcttgatagccacccccttttattattgtcgaaatcttgcttcgacagttggcgcgccaggtaggggcagcatcaagttctcgccgactaagtgcgatgggtttcgtttctggcatcgacgacttcgccttccctcccgggcaggcgttccggttcggcagcctcaacttcatcaccaacgacttcggcaagatctctctccttgactcggattcaaaccagtcggggatagaccaggtccccgtgccgttcggtattccgaactcggccgaggcctaccctaagatcatctctcccgagtcggcttcaaaccactcggacgagatccaatctactcttccgcgaccagatcaagacgacgagtcctatccctcaatcctgatgaaacttcctgatgatttggccgctgtcttcacagtcaagacatctcccactcgaagatctaggcgagctcaagcttcggccccgatccgatctagatccagggaggttggcgttatactccaacctctcgggacagtctcgacggaagagttggatggttacctcagctcccccggcatcagttctcgaccaaccgagatcctcgactacgacgattttggctaccactacgaccacggcgacctcgacaacttcgacgacaactatgaggataactacacgcccctcttcttcggcgtattcatggctgacaacgaaacggaggaacagcgccaagcccgagaagcggaccaagatcgcgcacggcaagaagctgaacgtcgccgactggaggaagagcgacagcgacaagagcgagaacgactacagcgtgagcaacaagatcgcgaacggattgcaaaggaggctgaagatcgacgacaatgcgccttggaatctaggcggcgagcgagagagctcattggacaacaagacgtcgatgggagagcggtctttcgcacccctagcagaacgcggttgcagcaatcactctcctcaagaccctcctcatggaagacgcactcaaccaagctgatcatgtagtcaacatcttgaaccagacgaagaccatgatcgctgcctcggttccggccaactccgcaagcacccgcaccccgactggtagccgagtccctcatcttcgatctcaagactatcaccagccaagcctcagcattgccggcgccgaatctagtcgcaggagcaggggacatgatgaacggtctgttcgctcgcctcccgagcgatatagggagcgccgagttgaacgaccacactccccacatcgaaggcgccccatcgatcttcgcgacaccatcaaccagcgcccgcagcaagaggccatcattcaccggatcgctacgacgacaacgtggacggagttgccgccttcacaagcgatctgcgtcgagtggattggccagccggctttaagccgactggaatcgagaaatatgacggcaccaccaaccctgagtcttggctcaccgtctatggtctcgcaatccgcgcagcaggaggagacagcaaagccatgacgaactatctacctgtggccctagcggattctgcccggtcatggcttcacgggctaccccgcggcacgatcggatcatgggcagagctacgcgaccacttcatcgccaacttccaaggcacttttgaacggcccggtacacacttcgatctctacaacatcgttcagaagtctggagaatctcttcgagattacattcgacgcttctccgagcaacgcaacaagatctccgacatcaccgacgacgtcatcatcgccgccttcactaaaggcattcgccacgaggacctagttggcaagttcggacacaaacctcccaagacggtcaaacagatgtttgaaaaagccaatgagtatgccaaagccgaagatgctatcacggcgtccaagcagtcgggcactacttggaaaccaaagaaggatacgccgaccgcaagagggagtggaagaaacaaccacaaggatcgcaagcgtaagcccgaagaacttgtggccacaacctctccatcttcccgacaacgttcccgcgtcaacaccttcgacaagataatgaactcccaatgtccgcatcatcccaactccaaccacgtggccaaagattgcttcgtctacaaacagtttgcggagcaatacgtcaagaacgcacgtaagccctcagacggagatcaaggcacatcaaagaagaaagatgatgaagacgatgccctgaccggttttcaagatcatcacaaagaacttaatcacatcttcggcggacccctagcttatgagtctaagagaaagcagaagctaacggaacgggagatcaatgcggttcagcctaacacgccccaatacctttagtggtcagagatagcaattaagttcgaccgctcggatcatcccgaccgagtggtccacccggggcggtatcccctggtactagacccagtggttcgcaatgtcaagctccaacgaactctcatcgatagtggcagcgcactcaacatccttttcgctaagaccctggataatatgtagattcctcacacggaattaaagccgagtaatgcacccttccatggtgttatcccaggattgtcagctacaccactcggtcagatcactcttccagttaccttcggcactcgggagaattttcgcacagaaaatgtttgtttcaaagttgctgatttcgagacagcatatcgtgctatacacggacgaccggctctagccaaattcatggccgtcccacactacacctacatgatgatgaagatgcctggtcctcgaggggtcatatcactacggagcgacatcaagcaagccgtcacatgtgacaaagaaagttgcgagatggcccaaacccacgagaccactctcgcccgcgaagagatccgactggctgcgaccacggcaagcgagggagaagtgcctgcaaccaagctgacgaagaccgaagaaagtgatgccaagacgaaaaagattcccttagatccctccgatcctgacaagactgctgtaataggcgctgagtaagattgtaaataggaaagcgcgctcatcacctttcttcagaataataaagatatttttgcgtggaaaccatccgatatgcctggtattcccaaagaggtgattgagcactctttacatgttaaggaagacgccaaacccatcaagcaacgactccgccgttttgcacaggacaggaaggatgcgatcaaggaggaattaaccaagctgttagcagcaggcttcattaaagaagtccttcatcccgattggctagctaacccagtcctggttcggaaaaagacggggcaatggcgcatgtgtgtcgattataccgacctcaacaaatcttgtcccaaagacccttttgggttacctcgcattgaccaggtggttgactcaacggccggctgcgagttactcagcttcttggactattactcgggatatcatcagatccgactaaaataatccgaccgcttgaagacctcatttattacgccctttggggcctactgctacatcactatgccctttggattgaagaatgcaggagcaacctatcaatgcatgattcaaagatgtttttcaactcagatcggtcgcaatgttgaagcttatgttgatgatgtagtcgtcaagaccaagcagaaggatgacctgattgcggatttagaagaaacttttagaagcattcgtgctttcaagatgaaactaaacccggaaaagtgcatcttcggagtaccgtcagggaagttgctcggatttatggtatctcaaagaggcatacaggccaacccagagaaaatcaacgccatcctcaatatgaaaccgccaagctccgaaaaagacgtccaaaagctgactggttccatggctgcgctcagccggttcgtctcacgactcggcgaacgggggatgcccttcttcaagctgctgaagaagactgacaatttccagtggggacccgaagcacagaaagcctttgaagacttcaagaaacttctcaccactccaccagttttggcctcgccacatccgcaagagccgctactattatatgtgtcggcgacctcccaggttgtgagtacggtcctggttgtcgagcgtgaagaggaaggccatattcaaaatgtccaacgtccaatttatttcgttagcgaggtcttagtcgactccaagacaagatatcctcaggttcaaaagttactatatggtgtcttaattaccgtcaggaaattatctcactactttcaaagtcactcggtcacggtggtcacatcgtttccactcggagatatacttcataatcgtgaagcaaatggacggattgcgaagtgggccttagagttgatgtctttggacatatcgttcaagccacgaacttcgatcaagtcacaagcgttagctgatttccttaccgagtggaccgagtgccaagaagacatgccagaggaaaagatggaacattggactatgcattttgatgggtcgaagaggcttacaggaactggagctggggtcgtcttgatttccccgactggagaaagattgagctacgtattgtggatacatttttctgcgtcccataacgtggcggaatacgaggcgctactccatggattaaggatcgcaatctctctaggcattcgccgactaatcgttcgtggagactctcagttggttgttaatcaggtcatgaaagagtggtcttgtctagatgataatatgactgcttatcgacaagaggtacgcaggttggaagataaattcgatggactcgagctcacccatgtcctacgacataacaatgaggcagccgacaggctggccaattttggttcaaaacgggaagcagctccttcagatgtgttcgtcgaacatctttttgaaccaactgtgcccagaaaagaaacacttgaagccatggatactcaaggcgtaagcatgattgaaaccgactggagagaacctctcataaaattttttaccaaacaagaactccctcaagacaaaaatgaagccgagatgatttccaggtgcagcagactttacgttattcataagactgagttgtacaagaaaagtccatcaggaatactgcagcgctgcgtatctttggaagaagggagacaattgttgaaggatatacattctggtatttgtggtaatcatgctgctgcacggactattgtcggcaaagcttaccggcaaggttttttctggcctacagctgtgtctgatgctgacaagattgtgcggacatgcgaaggttgtcaattttttgcctgacaaactcatctgccagcccaagagttgcaaaccatcccgttgtcctggccgtttgcggtctgggggcttgacatggtcggcccgtttaaaagggcagtcggcggttacacgcatctctttgtggctatcgacaaattctacaagtggattgaggctaaacaggtcatcacgatcacagcagataaagctagagattttttcatcaacattgtgcatcagtttggggtacctaatcggatcatcactgataatggcactcaattcactggtggagcatttagatacttttgtgaagattttggcattaaaatttgttacgcctccgtggcacaccccatgagtaacggacaagtcgagtgcgctaacggcatgatacttcaagggatcaaagcacgcgtttttgaccgactacgtccctatgctggcaagtgggtagatcagctgccgtccgtactttggtctttacgcactactcccagtcgggctaccggccagtcgccgttctttttggtttatggtgcggaagcaatgttgccgagtgaagtggaatttgaatcactacgatttcggaacttcaacgaggagggctatgaagagggccgagtagatgacatcaatcgactagaagaagcccgagaagcagctttaattcagtcgactcgatatttgcaagggttgcgccgttatcataatcggaatgttcgatcgcgagcctttttagtcggcgacctggttctgaggaaaattcaaacaacacaggatcggcataaattatctcctttatgggaaggaccgttcataattgctgaagtcactcagccaggttcttatcgactcaagcgcgaagacggtactctcatcaacaattcttggaatattgaacaccttcgtcgattttatgcttaggcatttcgtttgtatctttcctctttgactgctaacttcaagtttttccttgaagttttcagtcagggggctactatgataataatggagtgtgatttttatcaattcaatttgcttacttgatttatcattgccctgtttggtctttcgacttaaccaatgaggactgaaggtttttaatagcttttgcgggttttaggctcaataaggcttgacaaaggcctttaagaaatcagaagctaagtatggaacaccaagcatagcataaattcatcagtattgtacaaattgagcctccactgtcattgatcatcaaaatcattgttatatcaatcagtatcagttttttcatcattagacttatcagacccagtcggccgaaggtcgacatcttggaatctctcaactacatcagcagcaatcttgtcagccgctttctgcgcatcactgatgaggtcgagagcagcttcttcgctcgtcccatctgcaaagccatcaatggcatcaatgtcaactcttggataaagggatttggtcatcgccaacgccagactcgctcccatacttccagcttctttgatgttcttgaagtaagtatctggagcgactctcagcttgtcgaagatttcggcagcatcaagtgtactcgaaccagcgttattgaagaacatggcctggataagtggagtagcggcattagcgactttatccctggctccttcaagcttgttgatattgtcaactaagacatcaaattgtgcttgagacttgatcttgcggtccgcgtcgacagattcacattaatgaatcagcatatagaagataatggcttttgaggtattgattattgttaccttcaacctcctttaaagtcgaatccctctgtcttgccagctctgccttgtcattttccagagtttggatctgcttctctagttgagatatcttggcagcttgcactacattaacttcggttaatcaagattacagagataacaacacaaatcagttgggcagagtttgcgcgaaccttttgatgagccactcagttcgaaattggactcctggagctcagcaatccgatccctcagatcgtgttcattcttcttggcaagttctctggcctcgtgcagttgactcctggtggctttgagggttccaagatgaggaactagtctctctagggttgcggtttttgcctcgttcctaagatgaatcctctgcggagcagtttaatcagcgctcgagccagacggtaaacaagatggctaaggtcaggcgtcaaggaacttacatttacaatgcgagtcgcttggttgagttcctttttcagtaggcatacctcttcgtcttctttttgccggtttattacaattccttgaggttgcaagttgtcatcccaccacttgaccagaataggagggcacgaatcttcggctgcttgtatacggggaatttcttcttcatcaccgatcattggtcctaatgcatccattgacaaaggttagacaatcgatcagagttatttgggtcaacatggtttcgggcaaagtgtttacctgtaatgatttctggacgaggacaagtggattcggatgcctttaaaggggatccagatctccggtcattgctggcgtcttgtccgcgagggttgtctgcttgggtttcgacttctggaatctcttggcttggccctgcgtccgactggtttccaatcgggggctcctgattaactccggcttcggcttcggccgactggatcccagtcgggggttgatcaccggattctaaattatcggttgccggttgattgtcactcggatgatcctcagtagttgactcggtttctttggaagaacttgtgtccacgttagtcgggtcagagtccttcccagacggatctatatcagatggtttcctgcaaatttgattatcagtattattgccgcaatgggtgcgcatcaatgcaagagagatcgttatatgagttgcacctagaagacttcctgatctttggcacagggcgactggatgttttcttccttggagtagcctgttttgttagtttcttggttgtctctcggtctccaggcctcctggcggtatcatcggcttcgtcgtcacttagaaccagcttcctctttcgagaatctgactggctgattggatcagaagcacttggttgagtttcagaccgaattcttggtcctccgctcccttgcccagtttggtggcggggcgatcggtgttgggagatccgacttcatcaaagcaaattcctgggtgtaatatccttcattgttaactgattcaacaagaaaacaagatcatattttgagaaaggttgaagtgtatgaatacgtaccggtggaggaggattgaatgcattgaacggtacgactggcagcaagtgtgagtagctgacaacgatggtgtttgagaagatcttatacatcctttccttcatgaccttgaagtcaagagaatctggatcttcacggtttgggtcatgcttgccgtcaaattcgaaggctgtgcgagatctttctttgattagagctaaccgacacttgataaagtgccgggtgatctgttctccttgaaggccctgttctttcagctttatcatcctctccatcagttctactgcttgtgcagcttcatctcccattggcagtgagttccaagtatcccgataaactggaggaagacaggagtactcgggaagaacaggctcggggttttgaacataaaaccaatttgcgtgccaacctttatttgaggtcttgaagggcatggagaagtatttttggcttattgttcccctgagttggaaaccagcacccccaacgacgcatggtttactcttatttggctggggcttgaggaagaagatgcggcggaacaaggcgaaatgaggcctaatgcccagaaaagcttcgcaggcatgaataaaattggcaatatgcactatgaagtttggattcagatgatgcaagctaatcccgtagaaattcagaattccccggaaaaatcttgaggttggaagagaaaatccgccatagaagaaatgagcgaataccacgattttgtgtgtatcgggggtcaggaatgcctcaccaaatgccggtcgccacccgatgatctcttttgctggaagaacgccgtgcgccaccatctccttcaaactgtcttccgtcacatcggagggcgcccactgactctcgaagctttctctttcttccgccatgaatgtgaactggatggtctgatttagttcgagatacggctggaaagggatggggaatcggagcggtggatgtggggagaaatttcgtgaagtttttgagggtggattggagcggattgatgaaccctagtttgcccggcgcagttttgcattgtagcaggaaatggggaaaatggcgagagtttcggcggggaagacgaagagacgtttttcacttcggtgttattagggtatcgggggtactaatgggcctgggcctgtacagtacttcagcccaatactataatcagcgtggcctgttgtgatctctagggacttaggcactttttgctttggcaatctgtgttcacgatggtgtggcccaatgctgttaaaatcctttttaacgcgattcaataattctttggaattattatgatgcacataaaaaggcgcccgacagaaaggtgttataccattttttgtaagctttattaggctgcaaaagctgtttgggttgatttgagatgactggtttattaatagtcattcttttagcatgttatatgcttattttggttatggtaagggtcacagcctaggctattggactcattaattaccatgattttctatcctgtttggtgggtcattttatgagatttttactcggattcctatcaaacatgtctatttttggacctttgagtgtttatcactcggctcttcttgtattttttgtccttgatatgctcaagttgagaagcagtcagctaggtatcttactaagtatcatgcgtgcttcgctataaaaccactcggttcttgactatatgtttagtttttcaactaatcacatagtcgggggctacacctaattaggtgtatctactcgatgcaccatgttttattttcgcccttcacagtttttgatttttagtactcggcaagccggagcaagttgaattgaagcactcagattactgttttttgtttcgagaaggctattttgtcaactgtgaaggtctcgggggctactgtggagattatggataccccatatctacataacagttgtaatttagtcggatatacggtaccaaatatagatggaatatctctatgaagactcgggttaggttctaaacttgtatgtcaaggaaatactcgggatcttagtcggttacgattgtattttatctataatcccatattccgttaggatatggactgtattttgtaaagcggactccttcccctatataaggagggtccgtgtgcctcttggggggcgattctttttttccagtttatacaatcaataacacactcggcggaatcatctccggacaggagtagggtattacttcttgaataagaaggcctgaacctgtataaaattccttgtctccaaacccatccactttcctagcttgatagtcacccccttttattattgtcgaaatcttgcttcgacaatgaggatgtccaaattaactcatgtcgctgccatggtttcttgtatatgattgctgccatgttgattggatgcaaaagtgcaccattaacattattagagctgaaaggctcgtcagttacagttgcggcatccaaatcaattgatggataggtaccggatgtggaataagttcactttagttctctcaatttgtcgtccagtccagaaaaccggacaatacatcccttaatttataaaactagtacaaacgaggtccctcggcagtattgaccctggttttagctgacgtggatcttttgactaagtcttcgtcctactatgcattgacgtgaggcttgcgtgacagattgatccaaaaaaaaagagcaaaattgaaaaaaaataaaaaaataaaaacaaaagatgtggggcccatatgccagtcaagcaagaagataaaattgtgtgttagtgggtcccacttcctccacctcacccctctcctccatctcctccccctcactctcaatggtgagtcaacggcgactgcatatgccaagggaggcaattgtggcggaggtggccagcgaggcagcgaggagggagttgcggcgttccggtggaggagaggatggaggcgagggagccgacgagctcgagctcgccatccctgctccagcttcatgaggcgttggaggagtcagaggagaaggccgagccgcgtcagtgccaccaccagcagtggtgacggtacagggtctagggcggcgatgcttgcgagcaagcccttgcggtggtcgaggcatcacatcgtcggagggaggagatgggggtgtcggggaaggtgtcgtcgaggtattggaggataaaagactcacaggcggtgtggccggcatggaggaagacggggatcctcttgtggatgaggttggagcatagcaggaggttgctctagttaccgaggtcggacggggattttcccgacgcctagaagggactggcttggggggaggggctc

SEQ ID NO: 1775 - DNA, 24235 bp, Oryza sativa
ccactgccgacgccccgccgacaacagagctcatcgctagggacaacagtgaagaggcggcggcctgaatctgtgcgaacgggaagggcgcgtggcggacgggcgagtaggtggcaatgggaacggtggagcaggcaagcgaggcgggcggcggcggaacgaagcgacagcgggtggagacctcggtgaggcggtgttaacagtgaaatttggtaatcgacaaagacgtcatcggcttagaatcattatcggctgcagcatctcggaatcagccgatgggagttatcaagtcgctaatagtcggattcctgttatattcggttaaggaaatcaatctactaaaggaagcttatccctaagtgaccgagtttaaagaggatgcggcatggcagtttatctattaattaggaatagtttgttagtttccttttatctttaggaaagtgtgtttagtatccgataatgactttatattttccttttatctttaggttagtttctttcttgtccgacaaggacttgtatcaacccatgggtataaatatgtacacccggggtctatgtaatctatctccacgatcaatataattcggcgcatcgccaccttttaccttttctactttattttattgtccagcggaacttggcacccgacgcagggctacatcgtcttcgatctccggcgaagggataagtccaatgttccgtcggcccaggcaattgtatcgtttacgtcggcgtcgttcgaggctgcatcagtacattcgacctcttggattgctctagtttggatgatatatttgcctacctatttatcatatgtctctgttaatctagccttagcatatcaatttagctctatcggttgcttctcgttttagggtttctgccggtatcggctaaatcgtgttgctagattagattagcttagacatctaccaccctgaaaactcagtcaacggcttgattgtctagatattatgtttcttttcatacttagtgctgcatcagttaagtttgatatactaagtcgtgcttagaaccataatctctagcctgcttcttgattgccaataagggtatcatcggggtttcagccggtgagttatctaaacgttgcatcggctcataaggattgcatatacatataagttggatttagccgatggcaacaaaggtttcactgtttaatctaatcttgtggatcttatgacatcggacatccaaccgatgtgtgcttcaaccttcggatcaatatttgttctactatttcatattgttagccgattggtttctactggattatattgctatattatattatcatcagccgattgcctttatatcattatctacattggacatatagccgattgcttaaaccctatcgctatcggctggtatcggcatcggctattatcgactatcggctggaactactccatcggcttgtcagccgatcggctgtttgatctattatttgcaaatcttgccagttgcaggattaaactgactggcacgctcgcatctcattaatctttggacctgcacaagagctaagcagatctcccaggccggtgtgttcgattttttcgtcaacaggcggggagatcgtggctgtcgtgagggcggcgctgcggtggtcggccacaccccagcgtcgccaacggggttggggagtgaggagggccattgagactatggaatgtcgttgtcgcgagcaaccccgctcggtggcccaaccggcgaacatcttccaggagctcgcccatcgctgctccgcccttctccttgtagtgcagggtagagagagggggatagagagaagatggagtgaggatgacatgtggaaccacatgagccccacttttttattattttgtgtgtagctggttatgtgggtcccacggtttttattatttttctaagatcgaattgtcacgcaagcgccacgtcaatgccatgtgggacgaggatctagtcaaaggagccatgtaggtgccacgtccacgtcatccaaaactaggcacaatgctgccgagggacctcatcagcatagttttgtaagttgggatgggttatatccggttttctagattgaggatggaaatcagactaggcaacaaattgagggaccaaatgtgaaattattccaccggaagatggcccaaggacctaattcagcccatcatccctcggaagatggaatattgtactgcattgaattacgtttcagggcatttacatacctctggattaattaatttcaaaacatagtactccactaagtttgaatatcgaaaaacatatggagatgttatacagagtagaataaaaaaagactgagaatgtgttggcatcaaaatctttgctaggccctcaaaagctttaattacaggtttgaaataatctcttcagacctctttggtggttgagaagaccccccctactccctacctaaatcctactccaggaaatatgtatgaaaagaagacacattgtacaacctaaacatgatcaaatatccaggaaatattatattagcatatgataatgttatcaagaagcaaatgaagaaagttagcgcgatgaatagcacagcacgagcagaaaaacgaaaatgactacaggactaaatgcaggagcagtgagcagtccatctatccattcatcagctgattcttgtactggcaggctagtatctatatttctatgttcacaacacagataacttccacaaagttcaagttaaagctggccacaagatcaatccttgctgcaagtttcatgctttccgtagcttagcaggagagtagagtaatgaatatatcaagagatcaccaacataagacacatgtgaactgatggaatagaagaaacgccaaggcttcagagtcgaacatccttcagaaaacatctgcatggcaaaaaagggggtttcatatcaaatgtacagggttactacatcgataatagacaaaggttaagatgattcacaagacattagaaatgctaggcagctgaaggagaagttaaatattttcgaagtagaacataatcaaattccatgccatgttccattgatgtcccagttgtgaagcgatttgaacattgcttggattgcgaaatttggcggtatgtcatgctggcattaaagaatatatcatctaagcaaataaaatgcagcttgcaccagagaagagtaagcagggaggcctaggaattgttgtatgggctttatgtttatacagatagattaaacaatctgctgcaaaaaatatcaaattactcaatatagaattagaactgttgggactaagattaaaagaaacatatatattacaaggacactgacatagacaataatatccagaaacagtatctgaagtgcgagtacggtaggataaatggcagtcagacatactaggttctgcttctagttagcgcttcttatttgatgttgaacaaaataccttgttggctcttgttgtgatgggaatttacaccttgtaaacagaataatgaaaagaatggagcatagtctaaatctgttttttttttccatcaacagtcagaatataacttacgatcataaatagacacaagtccaggacatcaagaaaataagaagatttcatctaatcctggtcagtgctgactaacattgagggaaggggcagaggaggtggtacaatcacaggatgaaataatggacaaatgaaggtgacaaagtgtcataaaaagtgcttgtgtgctgattgatgtttcgatttggtttgaaccgataacctttgttcagttggtgcaagtacaacaccactataataatcatgccttctagtttgtatggaaatgaggcatcttgtattgtcgatcattccagaaacatatccaccagacagttcatcacaaattgagttcacccaacaatattaggaaattctaacctttataggactgatgaatgaggttacttttgcagtataatgtagaagcttctgataaatcaaattcaacaatcccaaaatctaatactaatgtttagaatcagcattattcaatcttaaaaatattatgctatgaatcaatagactatttgaaccatgaagggccaaaggaaccaacctcgtcagaccctgagaagctggaccttgttctcaaaggcaatcgatatccactccgggtaagctgccgcccattgcagttggtttatctctgcaccggcatcatacaccatcacaggatcaatcccctcggccggcactgcgccgggcgtcgctggcagctcccaaatcagcgcttggccgtcgtccccagccgagcaaaggtgcctcgtggcctgtggcgcccaagcgaccgcgttggcgcacgcccggtgtctgtgtagttcggccaccggcaccccgggcgcgcgcatgtcgagcacgacgacggcgctgctgtccatgagcagggtggccatgtagtggaagtcatagcggttccatgccagcctgaggagcggcgtgtccgggcgggggctctcgtagaagatggtggaatgctccttgtcccggaggtcgaagacgcggacggagccgtcggctgagacggaggcgaagatgccgttctccccccaggcgatgtcgtgcacggccttgtcgtgcgcgatgagctgcgtctcgacgacgccgcgctcgatgtcccagatggtgcaggtggtgtcgatggaggcggtcccgatgcggcggggctcggcctcgttccagtcgaaggaggtgaggggggcgcagaactcggaggcggatgtcttgcggttgtcgaggacggagcggagctcgggcgcggcggcggtggcggtggcggcgagatcgtcgagcggggcaagccagagccgcagcgcgtcggaggaggaggcgaggaggtggggcgcggaggcggcgcgcgggtggaactggagcttggtgggcgggtaggggtggtcgaaggagagcgcggggagggcgcggaaggaggcggcggtggggtggacggggtcgaaggagaggagggagacgcggttgtggaggtcctcgaggaagctgccggcggcgaggacgggcgcggagggggagaaggccagcgcgtagatggagtgcggcagctcgcaggtgaaggcgttcgggttctgcgcctccgccgccgaggcggctaccgacggcggcttgggctgctccatgggaaaaatcgttggattcgcttcgctttgcttcctttctttctcgggtggatttggggatgaatggactcacgcgccgcggtggttgatcgggtcggggagttcagagtaaaaaacgcgagcagccaggccgagcaggtaggagggacggcgaaggaggaggcgcgtcaacgcgcgcgtgccacggcaaccggccggtaaacgtcagctcggcacgagggttgaacgggcgacgatgcgggcatgcggccgccgggctgctgcagttggtggccgcctgaagctgattcaacggtggggccagaccgtcagtgacttatagtcaaagctggtttcgactttcgactggaatcagtttaacttaaacaggatgtactcatttactcaaccagcctctcatgagttcttgagcaaccggcaggacaggtcagtcctctcaagcaatgcaaacgatgctactaccatcaggatagggtagtgccccatggggaacaaaagaaacaaacagttaagagaaactgcaaggcagaatttgcggcttttaacagctgaaaaccagcttagctaatagttgccacttaattaatataaaggttgctctctttctcacagattagaaaggcaaaaataacgagtctaggaaaaacatttttccccaattctgatttaagcagcaactgaaggctacacatcgtcgctcagcgtgtggaactgaacagagctcggctgacaataccagttgcctcaatgtaacgatcaacacagcgtgatatgcaactgctctcgctcccgctcaagcttgatcctggctttgtcacgcacttggcaaagcacttgtttccaacagtctgtaacaacaaaacaagagagaattacaaccatgtcatgtgtttaacaaagaagcaatgcctggaattggcatgttttatttcaaacactaccctttttctcatgtaatctgtattacatatatgtcatgtaaaccaacagtggcagaatcacttgatcagcaagactaagggtgagtttgaggagaaggtgattgaggagattgggaagatacgtaaaacgaggtgagccattagctcatgattaattgagtattaattattttaaatttcaaaaatggattaatatgatttttaaaagcaactttcctataggaaatttttacaaaaaacgcaccatttagtaatttggaaagcgtgcgcgcggaaaacgagatgttatctccctcaatgttacccgaacgaacgcagcctaattactcatatgtcaaacttcgtagtaatagtgtagcaacaggaagggtcaacttcaatgctaactttgtgaacacatattttacctttctggtcgtggcaggccagcacaagttaatagttctgactctatgttgagttcaaatatataatgaacacagaagtgaaagacatacaaaatgtcaccatagttttaagcaaaggaaaagcacttgaaatagaaaatgcaacagttagaagtatataccaaaactcaggcctgtattataaagtctaggtgactcgatgtccctggtccagtcaatttaaatagtttactattatatctattggttttataatatgcttaagtcatggatatgtactggatcctaagttccttctatcagtcctacaaggttgtggtcatcactagactggggagatcttacctcatcaagacaacattttaagtttccaaattcaatatgtattgtaaatgatagatgagtttgatgcacctattccaaatacgttgttacagttcaccaaagggtgtgctcaactgtgcttgctgcgcagccacagcagccagcatatcgatcaaccccaatttctcttggtacttaaagtgtgcattaagactgttaaatttatgctcttcaatcctcagttttcttgataaattcaagaaatcatcaccgtataaccgtatatgccaagtaaaaataacaaaagaaatcaacagatgagccaccacatccaattgtgtgattcaattggacatttggacgcaatgcacaccagtatgatcaacttgtatcagtatgcagattacaatcaatggatacagtgagcatgaaagtcacagcatgggcatgttgattccaatttaataatactttcttaagcggttccaagttaataatccttttcttggacaaaggaaatcaatttatgagttttagccatcctatgcaaacaataggacttactggagtgtaatgggattgagtatagatttaatcatacaagatacaaggatacagaaactaaaatccatcctatgccaacatgtttaaactgtatcgccctccaatccggtaaatggaactgttgtaacttgtagaacatcaaaccactctaacgaagctattgttaagcttgttgaaggtgctactgaatactgatgctcattactttagtactagaatacggaaaaccacaaaacaggaaactaattctacccccaaatattcgcttccgtagagtgctaccagcgaaatctagtgtcacctaaaccaagtatccacctacctaatgaatattcatccatacagattcgcattaacaaacgtgatacaagagaggaaacgatttgggtggggaggatctcacctcaaggaactcctgggcgtaggcctgagcgagctgcgccttgatctggtccatgagcgcctccgtattggggggcgacccggacgacgacgagaaggagtccatgccggcttcccaccttcttgattcccaagccttcgtcggcgaccggttgttgaagagcgctctccagcaacgacgattctccggcgcggcggggtgtgcgaagcggaggaggcgggcagagcggagtaataaaaccctagctttactggatcagaaccacgaatccacgattgggaggaaagggtagtaggcccacatttatcccccaagaaagagcccatatagtaattgggccgtacagcggaccatctctcgtggctatgtggatttaagccgaaaaaagtctactttgagtccttaaagtagtccgaatctaatttgtaccccttaatcagaaagttaggtaggacgactccccaaactattggaaccagtataatttgactccctcgaaggttttggaggacagtttcgctgatgcggtactttgacctagtataactggttgagttggtgtgtggggctacctttcttctcttcgttccctatcccctcctcaccttcctctccgcgggaagcatcagggcagcagatcgacggcaacagggggtgcacagcggcagtagcaagggagctaggccccgaaggaaaaccgcgcaccaccatcagacgtggcacccccacgttgggtcacgccactggcctcgataaagagccgtacgcatcggcattggtcgtggcaccatatcccaacctcccccggtagatggcggcggcatggagcggaaaaggggtagtaggggcggcagcgcgttgcgagcgattcgaggcgaaccgagcgacgacgcgacctcgtggcggagagcggcgatgtctctttctcccttcccacacaagtacacgattcgagatgaaccgagtgacgatgcagctgagtcggagcgcagcacgacttcgtggcggagagtggcacaactttgaggcattgcacaatgcggcccaaggaggagcaagcggatctaagcgggtcacgtcatcgacagccggaccacgccaccctccctgtggcgtcagcccataccactagagcacaccgtgccctccctgtggctcccgcgatgctcgaagccctcctcgtgaggggtgcacaaaagcttgaaactcatgagctaactcaactcgagtaaaactcgggtcgacttgagtagttaatgagtcgagttgagtttgaacttttacttgtttgcttaacgagccaactcgagctagctcatgagttacttggttagctcgctgagctcatgatgcattaagatagaaattgattgttcatattttgcaggtgtaaaagtcgtgaactcataattatacattatagcacaatcttatgagtcatgatacatagcatggcaatcataatctttggtcataaaatcacaaattatactgcatatgaattttaaaccatgtatttcggtgtaacgagtttagtgagtttaatgaatcaactcagacttttattgtgtcgagtcgagttccatttttaacttgttatgttaacgagtcgagccaagatagctctttaacttaacgagtttttacgagtcgaggtaagtcggcttgtgagccacccaacctcgtggcgtcggcccaggctgccgaagcacgccgcatgctccttgtggccgctgcgttgctcaagcaccgtcacgttgaggccctctcacagtctggctcctttccccgctgaccaccacccactgccctggagaaaaagagaaaataaaaaggaatgaagaaaatgtgacactaacactgagtcagccgattggactgggtctaagcaccatgtcagcgaaattaaaccacactccaaaacggttaagggagtcaaattataccaatttcaatagttagggtagtcatccggttttccgattaaggggtacgaataggattgtacctacttttttaagggagttaaagtagactttttgcatttaagccttggaatggcctacgtactcacatataaggaataagttcatctgaggtcccttaacttgtcaacgaatccgattttcatccttgaaccgaaaaaccagatacaacgggtccctcaactatcaaaaccggtgcagattaggtccttcagcggtttagatagcggttttggatggcgtggcgcctacgtggctaatttgatttgttttcatctgacgtggcattgacgtggcgctgacgtggcaattagatttgaaaaaataataaaacccatgggacccatatgtcagtttcacatataaaataataataaatggtgggacccacgtgggccccacatgtcatatctatcctcttgtaacatcccggcctagggcttaataagattaatagaatactcatatcaacaagttgcaacttcttttccggaagccaatctccaaagaactccagggttaagcgtgcttagcctggagcaatttgggatggttcccgggtgcacacgagtgaggacaaagtgttgcagaaaagacatgtgttggtctgtgaggtttcacgggcgcgtgtgtcgcagttgcgcaggcatggtgcgcatggctggtgtagatcgggagtggttacacagcatggcacatgcgctgggtggccaagagaggacgttcctggcctggggttgatcgacgggggcgtcgatctctcttaagggggttaagcgtgcttggcctggagcaatttgggatgggtgaccgaccgggaaattcttcccgggtgcacacgagtgaggacaaagtgttgcagaaaagacatgtgttagtctgtgcccccgtcgatctctcttaagggggttaagcatgcttggcctggagcaatttgggatgggtgaccgaccgggaaattcttcccgggtgcacacgagtgaggacaaagtgttgcagaaaagacatgtgttagtctgtgagggcagtctatgagctataaaagctaccagatgtaagtgggcccggcctgggagaggcgggtcgttacacctcttcacctttcaccttcccctttaccctttctctctcgtgcatggcagcgacggcacgcgaggcggaggagggaggggcgcgggggtggtggcctgccggcggcggtcgcccctgccctggagcgacacgggggtggagaaagtttctcctcttatgtccacatctgtagagaagaggttaaatcaaggaaggttgcatcttgttcttgactgattaattggtgcgccataatctgcaggtaaactggttcttgcctgacacttgtcttgtccgggtggccaccgtggggcagcctggtgccatgagaaggatcaccgttcactacgtgaatttgctgccggtcgccggcgccggagaagcacacgtcgatggcgccgcgaattattccggcaaggtacgcacgacggattgattgttcgattgattggttgaccgacgagatgaattggttggtttggtttgttgggggactcgcagcagaggagcagtgtgatggagctcatccatcggtggtcgatggacatcaatgcctgggaggcgaaggagcggctggaccagaagctgaggaaccagatggaagccgtcatcaagaggtaactgatgatgcaaagatcaaatcatttgtttttttgaaaagaagaaagatggattgaaattttgctgaattgtttttcgtcgtttcgtttctgcaggcatcacagcacaggaagcatcaagctgaacagagccagcagtggaggggggagatcgacagtgacggcggcgatgggggtgcagagggcggtgtactcgaagaaaggggtgatgcggcggctgatgcggtggagtcgactgcggtgggacgcggcggagcaggcggagtgcacgtgtgcctagaggagttctccgccggcgacgccatggcccacctcccctacggccgccactttcactgggcctgcgcactccctggctcgaggctggcgccgcaccccgctcctgcccattctgccgcaccgtcgtcgacacgccggggaaggggaagtggaaggggaaggtgaaaggtgaagaggatagatatgacatgtggggcccacgtgggtcccaccatttattattattttatatgtgaaactgacatatgggtcccatgggttttattattttttcaaatctaattgacacatcagcgccacgtcaatgccacgtcagatgaagacaagtcaaattagccacgtaggcgccacgtcatccaaaaccgccatctaaaccgctgaaggacctaatctgcactggttttgatagttgagggacccgttgtatctggtttttcggttcaaggacgaaaatcggattcgttgacaagttaagagacctcagatgaacttattcccacatataatgacgggcccatttcatgttcgaaataggaagtttttggactatacaaagccgattttgctaaacatctcccgcgatttttttcctggcatttgatgtttttttggccacatgatctttgcaccaagatttgtgcagcaattgccgtggatgaggtcgacagggagtcaaggtgtgttggtattgccgtgtgaataaaatacgtgaagtatgtaattttcatatgtcaaattaagaaatatctctatgttaatttacatgtcaaattaagtactaatcgatacaacaaatttaacatatcttaaacatctaaataaaaattgatttctttaaccattgaaaaattaagatatttgaaactaaaataaaaaataaaaataaacttaaaattacagtcctatataactaaaattatatttgtaaatttagttgatttgacatgtaagtgcactgtaattttgataaaaataatgggtaagtaaatatgtacttattaaattctttaaaatataaaattacagtcttatataactaaaattacatttataaatttagttgatttgacatgtaagtgcactgtaatcttgataaaaataatatgtaagtaaatatgtacttattattttctttaaaatataaaattacagtcttatataactaaaattacatttgtaaatttagttgatttgaaatgtaagtgtactgtaattttgttaaaaataatatgtacgtaaatatgtacttattattttctttaaaatataaaattacagtcttatataactaaaattacatttgtaaatttagttgatttgacatgtaagtgcactgtaattttaataaaaatgttgtgtaagtaaatttgtattaattattttattttgtagtccgttggatgtaaatccaaggaaagaaaaaatctgggtgattttttctcaaaaatcacccgagtgatgtataggcagtcccatacaaagccactagtgtactactactgtatatatatatgagattctgacgatttccatgagaaaaccaggagattgtcctaccttactctgcgcgtgcaatacatccatcactcaatccatccaagtccagacattctggcaactaggcctagtcacgatcacgggaacctgactacaaatccagattcatcaaacacatcaaccagacgattctggattataattattttccgccgggccctggattataattatcgatacagcatcactgatcaggatcaggcattggcgcattgcctgttgttacagtaaaagaacagtaaaaccattggtgtacctgtaccggacgccgggcgagcaatggagagggttgctagttgctactgggctgtacagcagaaggcaggcagcgccacagcgcgcggcgtgtgtgcgaccccgcttcggcgcggcatgcaaagcctgcggcatcgtcgtggcaggggaggggagtggagaaggggggaccccgcctgcctcccggaaccatccaaatgcaaagttcaaaggccctgtagccagagcgcgcgtcgtagcgaaagccagagcgagagcgaggtggttctcgccatgcatgcgcgcgggggcggtcgcgtggggggcgacgacgtctcgcgcctgcaggccgcgcagctaagctgcagtccttgttgttgtggtcatcactcactcacgcatgcatatggctgggctgtggctagcgaacgacgacgagcgagctagggcggtttgccggtgtggtggccactgccgtggcatgaagtagtattcacctcgccgtggtttgatcctggctagctgtccgcctgatttttcacgtaatcaccaacctaacgttagaaaacgatatgaaaacaaacgataaaaaacaatatatcgttcacggaagagacgagatttaacgtagaaaacccttccaaagcaaaagagaaaaaaccacgagcgtcagccagtaaaatatcttcacaatatcggggtgaggttacaacaccgaacgacggcttacaagaggtatatatatgatatgaaattctaaaagggatgacgatccgtacctctgcttcgctctggcccagcctctggcatctactggcctccacttcacctttacactactagaaaacgcatttttcccaacgcaggggtctttttttcgcaggcggacatgattcttatagccaaatgaccgcctaaaaaatataaatcggggtgaagttcgctgtccgcctgcgagaatctattttcgcaggcggaccacttaagcggcgcattttcacaggcagactacttaagcggcgcctgcgaaaatagattttcgcaggcgaaccttatgtagtccgactgcaaaaatcgtacctacccaaaaaaaaaccccacccttatcttctcatcccacccctcccaccactcaactctctctctctctccttctccctccactgactcagtctcactgactctcctctccctcactgactctcctctcctctcatctccggcggcgcggcggggccgacgacggcgcggggcggcggcggcggcggcgcggggcgcgtggccggcggcgtctcccctcgccccctccctcctagatctggccggagggaggggggaggccagcgagggcgacggcggcaacgacggcgcggggcggctggcggcgtctcccctcgccccctccctcctagatctggccggaggagggaggggggggcggcgagggcgacggcgacgacgacggcggcgacggcgcacgtggtgcggcgtgggccggccggcggcgtctcccctccctccctccctcgcagatctggccggaggagggaggggggaggccaacggcggcgaggacggcgtggagcagcggcggcgacgacgacgacggcggcagcggcggcgacggcggcgacgacgacggcggcggcgacggcggcgacgacgacggcggcggcggctcccctcccctcccctctcagatccggccgggggaggggggcggtggcgaggcgcgtggcggcggcggtgcggcaattttttttgttcgtttttttgcattttcgcagacgggccgttgccccgactgcgaaaattatcgattttcacagtcgttgtgttgcaggcggacctccctcccgcctgcgaaaattagttttggccgcttgaaaaaattagtttttagtagtgttataaagtacaaataaatttggatcacaactcaacccctaacgcccggatcaaaccactgttcgattctttcttagccgaagttttgcgatgttggtgggctcgacggatgggagggcctgctttactggagacggccgggtgggcccctcctgcgctccggttaactgcgcccatgctatgtaggtttcggtggtgtggtggcgccatcgtttcccggtctggagaccggaactcaccacctccgtctcgctctcttatcccctcgtgtcgtccggccggggtccggccccgtggacaggttagtgtttacccactttgcgatccttttttctcgttctctttcgtcttttcgagcagcagcagccgcagccgcgcgcgtgacggggacgggccatcatgtgcatatccatcgttcgtgcgcgcatgatagatgcttctgcgtttgccggtgttgcgctgccccgtcttaatgcaaatatgcaatcataatgttcgcgtggatcatgattggttggttgattacaacgtgcactgcgggcacggcgtgctaccactgtacacgcgtacatcaatacaaagcgtttcccaaaccgccgggaccggggttacggcgccccggcggtaagcacggttaccacgcggtaaccgtgaaaaaccatgtaaaatttatcacaaatttaaattattttttaaatttatttaaatttaaggaggttaccgcggtatttatattgccgtaccccgcggtaaggccggtaaccgcgcggttaccgacggtaagggaaacccatacatatatcactcagatctacgagaggatctccgaaccgcgcgagatcagtgatcgattgagagttagatcgaaaagatgtgcagatgcttgagttcagtatatatattaaagcacaacacacgttatattataccgtaaaagttttccttcttttttgattgttgtgaattaatgcagtgtatatctatctatttaatctaataaaaatatgagggaaagtaggctggattgattccttggttcgtgcatgacagcggggaggtgaagaacatctcctgttctagatgcgaccaatttgatcctccgtgtcaatcatatatatcatttggtatgggccatgccacctcttctcctcagtcctctgcgtgtgctttagccggcaggctagcttgcgcgatgtggtccaaaactaaagacagcatccacatctcccacctcctaccttcggcagcgacgtttgccggtcggccggccgccggaggacggatgtcccttcaatctgatcgatcccctctccggcatcacagacgaatacagcgtattagatatttagataggcagctatcagctggctatagatcgatgctctttctgaagtccgagaaaatgaagtgcatgagtacatcgtctgtactggggtattaatttatcaaccccaaaccctgctgaccttcagtgagagagagagagagagagctgcagtagttgtgtccatggatgggagagagagcgagcatgggaacaaaagcatgtacaagccaggtatgcatgccgatccgcctgcgcttctctgcgtgcacactacggctggtgatgggagcgctggaaagctgaagacgcgagcctgcgctcaagactacttgtcgttgacatgaactgacagttcgtttgtttctttctacatgcagtgtcagtttatgtatggccattgtgctcagccactcggagaggatctacatatataggagtatatatcgatccaacctctatacggaaacttgcaggcagaatagctgtagtatcttttctttagctgtacaaaatatagttgtcgcatataaatagacagcacatgtaattttggtttacagtagatagcaatagcctaaagatatttgctagctaagatttaataaccttccaaatgagtcgtcagttgaaggatttcaacaattgagagccgcgccattgatatgtgcaattaacttaaccaatggaaattgatactccctccatcctataatataagggattttaagtttttgcttacactgtttgaccattcgtcttattcaaaaaaattttacaattattatttattttctttgtgacttactttattattccaagtactttaagcacaacttttcgtttttatatttgcacaaatttgttgaataagacgagtggtcaaacattgcaaacaaaaactcaaaatctcttatattataggacggagggagtaataaatatttatcatgttataacttataagaaattaaaccaaaactggcaacactggcaacaatgacggtattggtagctaaacacagacgaacaccatagaagatccaacctttatgatggtaccgaagcatgacatttgtgaatgaggtccagcagaagctagcctacatccctactggttataggcatatagcttaatcggccatcgactagcgtaattatagtgtatctgagtatcacacttctcttagatctagtacaattacgatgtatctgagtatctacgaccttcgaatagcttggctgtcgcccagtagtatctatacctatgctatagtcaccatgttaccatgcagttaaaacactacaacaaaacttgtaataggagacgcaattatatgtgtcggttcatctaaaacagcacatatgaggcttttcccgctttcccaacccctcatgtggatctaaaataaaaaaatcggcacctataacaccttataagtgccggtttattaaacaattgcgctttagggatggagctgagctgaacacatatttctctgtttttttaagtcttcctcagtctaaagtcctaatcttatgttctcccaaccaccccctctctctcatactccatccccattcgctctctccccacctcaccaagttggcgagcgatgcatgcaacgacgatggctcgtctctcttgctgacgtgacgacggtggttctactacctcggtgacggcccgcctattctcagcgatgccatggcagtgtcaggtcctcctcatgctgccgtcagacatggcctcggctccgtctactggatttgatggtgatggcgatagaattggcacctacgccaaattcagcgggcccaagctcaggggtctccgaatatggccccagtatcatctcatctaccgcaccaagaggggttgccataaccacatcgcctcggtggctaggtccccagatttgacctcaggcaacggcaagacgcaacgtcaatgctccactattgtaacgtcccgtcttcccccaggccgggcccacttacatctgatagctttcataggtcatagactgccctcacagaccaacacatgtcttttctgcacactttgtcctcactcgtgtgcacccgggaagaatttcccggtcggtcacccatcccaaattgctccaggccaagcacgcttaaccctggagttctttggagattggcttccggaaaagaagttgcaacttgttgatatgagtattctattaattctattaagccctaggccgggatgttacaactatgaagagcttcaagggcctcgtgaggtaggactcctccttgaactggccccctccctgttgcggggattccctagcaacaacggcgaggacctcaactgctcaccatcatccagcaaccaggcccaaggcccgattacttcgtctccaggtggtgctctcctttgcgtttttgtcttgggatttctcgatttttgtggaaagggaaatgtatgggagtttgtgttctagggcctatgagttcttgttggatctgaatatgaactcttgtgtgcaatgtagctagcttattgttgttgatgtagggccttatatgtgatgaatgttcttgatttgtttttccatgaaatacaatggacgttcttgatttttctcccatggcttcttaatctatgccatggatgtggatatggggggatgtgctgctcgaagcatcggcacaattcatcgagccgactccctttttttttctccgtcataggcctcacatgtgttgttgtgcctgttttgaaatcgacaccaaaagcatggctcatcagtgccggttgcagaaaccagcacatatatggacttatagaccgacactgtaatagcaggcccttcggaactgcacaacccaacccatccaacagacgggcatacttacacatactatcccatttatactttcatcctcacttcgtgtaaaacggttaagccaagagtgacatggttggagagacaagctcttataagttggttctatacttgctaaactagcaagctggtattaaacatgcacacatagctctcatgcgacacgtaagtcttatcctaattgggtcaggatgtaccatacatacataaggccatgaaagactttagaacacgctaagttgttatgaatacctgaattcctagtttgggcttgtaaataatgaaatggcactaaatgtcttggtaatgagatatattatcgctattgggggagcggctttgccctcgtcctagggaggcagttgcccccttttcttctctcttttgtctctgtctgtgcatctcaagaccggcttcggacaaggggcccctaagaaagcctttggaggggctttggggaagaaagaggccccccgtaacccataaaaatgcctcggagaggggcaccctgaaggagcctacggggtggcttccccgacacggggctcccaaataaggcattccccacggtggggagatggcaacaacattgatggggcattcaaagggcaggctcaaccactcctgacatccacgaggaaaggccctaagcaatgtatacatttcgctctttttccttgtgctcgatccctattggattctattccaacataccctattgcactctttctccttgtgctcgatcccttttggattctgttccaacatacctccatttattaaatagatgacgtcattgacttttagacacacatttgatcatttataatattaattttttacataattataatttattttgcagcgagttattgtgccactaaaaagtattataaacatggtttatatcttatacatttgcatacaatttttaaattagatgaatggttaaatatgtgtccgaaagttaatgatggtctctattaataaatagaggaagtatatgctatgtaactttactttagcacacggcagtatataggaatctactgaaatgaattaaggtcatcacacacgaaatttcgattactgatcagtaccaaatggcagctgggatcacagattagattcagaacaattatactaattcagagtaattaaggatataaaccttcaataaatagaaatccttatttatatagatcaagtaacttgcactggaagcacaaatttcttaactgtaatagatcaagttatggtaaaaaaaacgtaagttatatacacacactcgcgcgtacaaaaattaattttcacccaagtaattaattcatcagagaatatatgcaggacttgagttgcatatatactccctccgtcatctaatataagggattttgacattttgcttgtcctgtttaaccattcgtcttatttaattttttttagaattattatttatttttacttattttattatccaaattactttaagcgcagcttttcgttttttatattttgcacaaatttttttaataagatgagtggtcaaatagtgcaagcaaaatatcaaaatcccttatattaagggacggagagggagtagttattattttcagtttttcaccctgataaataaaaaatgcagaatcatgatgggcaataatgcataatgcacatctcatgcaaacactgcggttgtcacaaaactaaaccacaattaacaccagtacacacacatgtacactaacccatatatttatcgatgcggttcgttagccatatgattcccctcgtaactagtaccacatgatcgactagtatgcagaatttaagtatatatatatatatataaataacgatgtcttgcttaattttgacacatagtagaatttaagtatgcagagtatagctagctagcacttagggcgctccctttgacatatactatgcaggaatggtaaaacacataaatagaaaaaaaacacaacattttgggacgaatgcatatgcaaaacggatgaatacacaaaacatatatatagaaacacggaaatgggcgtaaggtgtttgatagactcttccaattagaaaaacatatgatttagattagagagatatatagactcaatagaaatcggaaaactccaattcgtttcttaaaagattaggtaagaatactctataggattaaatcttaaaaaatttcttcacataccatttgtctcgagggaggtcttaaaagatgtttctgctgggtgctggttaagagagacagtttacacttttacagccgcctgccatctctgccatagtagttcaaaggcattgatcagataaggaagagtactcgtatatatatgcggctatatacgcgcgctgcccaggcaggcagcacgccaaatatgcccgtacctcactattactacacagtgaaaccagacgttgcagagcctgaagaaagccccccacttctctgactatctgaacatcacccatgcataagctcatcatcgccctcgctctcacagtcacatgcatgcatgtatgtgtgtacgtatatctgcagttatgcaatgtgtaactggcccatgcatatgtactatcagccagggagaacaggctcgatcttttaatgctactttaatttcattattttttttatatactgttgctatgtggatatatattgtacacatacctgtatcaatatatgcatcagtgcatgtgttccctccgtacgttttagttgcaaaaagaatagccaaagattaacattttgttttatattccaagtttcccatatttctcttctagatccctccaccatcctccatctttaattacaattttatacacacacacacacacacctatcattaactcattatgtatgcatgagatgatgagatattattgaggaatgctttgctagattatctaaattgaaagtacagttgtcttggtatatgcatttttaaatggcaaaatttgccacaggacatgcaaaaaatgtgtaattggttgtaggacaccggtcgcattattttattatttccgggtcaaaagaggtgagatatttttctaaatgcccagattgcccttctctttccttccttttctcttactctgtccttctttcccccttcttgttgatttcgccgggaacggcatagcagcctcaaagcagcggtggggcgaggtcggcgcggcgtggtgcggaatcaccagcggccggggcggtcgatggcatggcgcgaccatggaggagtggtgttcggccagatcgatagcgggcaggcgacgacagtgccggtgcggtggggcgcggccgggaggcagcaccaagcgtaggcggggaggctacgatgggtcccggcatcaccaccgctacgatggccagtgcccttgctcccttcggtgcgcttgacgagtgccgacgactgcggcgggttcagatcggcgccgacgaagaaggggtgcgatctccctctccggtgcaccatttttcggggtccttgaggggagatggagaggaggatgaggcgaagatgctggcgcgacagcttggcccggcttggtccagataagtgggaatgtcgatgatgtcgctgcggcggtgcgcaaagcacgctccagagctccggtgggcacaacagcattcccgtcgattggctgcacgaatcgagaggttgtcaaagcaagatttgatcggcatggagagaagataatagaacatgaattagataggaacggagatagctcgttggtgatcagcggcgtcctccttctcagcggccgacgacgaaagataggtggagagggagagctggagctctcttcctcggtttgctttgtgtggaaatgaagtggagtagatggtgatgcagtagggacgagatgaagactcgcctcagcattttgaggcgttgacacgtcgtgcacacgcgtcgaactcagccggcgccgatctctctctcggctgtctctggtcgatctctctcccatcgcgtgctagctcatgtcgcttggcccaacctcccccaaacacgacgagctgaggaggctattctccaggttcggcaagatcgagagggagaagaagataagggcaaaactgtcattttacattgtttctctctcatcaattgaccgaatattatattttaatgtgtccaatgtcctgtagcaaattaccacatttttggagtgtcctcgggcaaattcacgtctttagggtgttcaacagctaattacacattttttgagtgtcctgtagcaaattttgcctttttaaatttgtcaagggtgtatcacagagctttgtcaacatagatcaatcccacttaagtgccatacacatgcatgtcaatgagaaatcaatatgtgatctataaaaaaattctatattccaaatatatatactttcttgatttctcaagtgtaattagatatatttgtgcaacatgtcaatcagctctgtaatgaagtgtttgttctcaattaatctctactccctccgtccctaaatataagggattt

SEQ ID NO: 1776 - DNA, 29415 bp, Oryza sativa
aatcccttatatttagggatggagggagtatgtcccaaaataaattaacctagtacggaatgtgatatattttagtactacgaatctggacagctcataaaatgtatcacatcccgtactacgttaacttattttgggggcagaaggagtacgattcctcacatcaacaactccgcacaactaaaactaaccaaattttagcaatatatagtgcatgcatgtattgtagtatagatgtaattcatgagttaatatgaaaaaatataacatacataaaatatataactaacgactttagtgcgtcacttcccaattgtgagttatttttttaactgccgccttactagatagctagccctacattatgatgtcatctcagaaaaatcatagcaaaaaaaaaaggttttcgaatagactatatatatgttagacacaacgtaaaactttcaacatcttgttgttttcttgtggactttaagtaccttcattttttttacaattaattgtaccttcttgatcaatatatatttgcttgttaactaatctaatgattaattagaaatacatgcatgcataggcgttcccatattatagtattgattaccacgtgaacataaaagtggaattgctagatttcaagtgcctaaaatttcacatatagtacctaaaattaattgcagtgctatgcaaaatgcgatttaggttcattttaactacattatgttgttatatatatggtttgaattcatttttgtctatatatgtttgaattttctttcatgtatcttaatttgtaatgttttatgagttatatgaatttatttgtatttttgtatttttttcttgtttgttagaataatttattgttcaaccattgggtagttgtaagtaccactaagtaacaggaatgtaatggaaccattggattattatctaacaagggacgataaaagtgagtggactttttgaaaatttcaggcgcctaaaatctagacactcacgaaaaaaataattacacaagggcatgatgatttactaacacatcttgatatgttgttgatcatatgtaaccataatcaactcatgatcactcatcatgtatatccaaaatatttggccttttagccctgtcgtaggttttaatttgcctagtagtactggccatattatatatctacatcttcatataaaatagctcactagcaagataagtatatatatggacaggaatagagctagacaccataagttgccatttcatcctggtaaccgggctatatatgtaatatggatatttgtcaccttcacaaatacaattattgtgtcaatcagtaatatgctataaattcattggagtctgttgtggaccctaattacaactgaacaatatatagaagtgcatgttactatgcagcctatttaaacttaaatggggagaaataaattaagatagagttaataaactagggagaaacatatatatataaggagactgaaagcaaaaaaggaaaataattgggcttagtgggactaatgcccattgaaagaagcaagaatcaccctaaaaaacaaagaaagaagcaagaatcaattggaaagaggtaagaactatatattttcactcaaacaaaagctaattaaactatatgcgtacggaaaatatatgtctagatataccatggtatgataaccttgctggaaatgaagatatataagatcaatgttctgatccgctcgatctcaatttgcaaaatattggtcatttcagtatacagattcacggaacaagaaataattaagctatgttttgactatagatactcagatttatatacttgatataattatgttccaaggaattaattagttctctgggagattggcaacactgtcaatctatggagaaactttgttcagcataactggggggggataagagatgtaatagaagcttatttatgaaagaattaatggatcaaattagacatctattttcatcatgtatattactatatatattaattacctattattctcaatctagatcatatatatcattagatatagagatagtaaactagagtttatattagaacttaagaaaacgagcaagactagctacatgtaaagttttcatgctaggtgatgcagataataattaagaaaaagacgttctaatttcaggcaagatgctacattttaatttctgtgcttagctactcaagaatagtacctgtagtccttaattagtaattcagacttttcaattcacaggatagataggaccaaccggcaaactctcatcctagctagatggatgttcatagcctatacgaagatcctcaaaaagaagctaggcagattccctcaaaggcatgctaactgcaccctaggagagaaaacttaaccatgagctatcaaattgcagccaccatctagagggtatatacatgcacacatatagcatggactgagcttgggaagcaaaaactgaagcaaagcagaagaaagaataagcagacgacagttacatgtaccaacacacctcccattcgtcccccttttgttttgcgaaggagatagtagaagactttcctttctcttttcaacttcccataacgtactccctctccctttcccctttcccctttcccaatcttacaaatggaccaaaatgtactcccttgcaagctagctatcctcatcagcatcaatcaatccatctctattctctgaattccaaacccttccagtgcaaaacaaaaaccgaaatgcatgcgcctactctcttactacagatgattgctagttatatatcgacaatgcatatgcatctatatatctagccaaggccggctcatgtcctcccttttgctcccatcactctctgaacacacccacaccgtgcaggccagtagtcctagctagctacactacactacacttgatgacttgatcagtgaaaaggaaaaggggagagagagagagagagagagagagagagagagagagcatataggggagctgagatcaaaacagcacaagcgcacagccaagaacggaagcagctaagctagctagcagccgcagcacaacgacagccaacaagtgtacacctcctcactgtttgctactcccaaatcaacagtgatcgctcgtactcgccccataaattctcctagcgggacgtacaaggaagttatggccagtgagtgccactgcatatattgtggcaatattgccccctctttacagactgccacggccataaagatctcgtggactggtatactgttcgcgctcaaggcccagacaatccaaactatacgtaatctgtcccactgccatcagtaaattttccagtgtaccccgctaatcagcaacagaattatgcgtaatctggtccaccctgcatcacttaattcagtgtcccccgttaatcagcaacagaaaaatttaagacatggaaaactcaacaccgtactggatatgccagtagtatatatatcccccatatgctgctactagtagctagctcagtactacactctataccatgacgttacttatacagatatcatacatccatgatatatatacatgcagaagagagcgacagtactactgccactgtagcaggggaaaaagcggcggcaaagagggggaaaaatatatagaagaggaatgtacgttcacgacgactttcactgtaaatactgaaattatggtacagtgaatggaagagaattttgagatctaacctgcaattgttgctctctggagttgtttgttgtcgatcgatgcatggttattaacgcgccgtccaaacgttggggtcgagatcgatgcgatcgattggatacagcatatcgcacacatatgatgtgcaagcgaagtgaggcagccaggcactgcttgcttgcttgctttgtgttcgtccatggatatatgttcaaatcttggcagatgttaggagagattatataaagaattttgcagatgtatgttatcatatgtaggaaatgggcttgtgtttatggtaacaaatcattggacagaagtaatcgagcaagaatggaatgtaatagaacaaagcaaaggaagagctcaagctcatcacacggatttggggaaaactttcaagtttcctaataattctctatatcttctcaaaccaacagaaagattccaattaagtggccaacaaaacaaaaatgtcaaatcctaatgctgtcatcaaatttcaggttataatggaatcacaagagaaagtgagatcgatgttgctgcgagaagaagaacaaaccaaatcaaaacagaagaagaaaaaagaatcgttgatgaactttcctttgtttttctctctttaggtcgctacagatcgagatccaaggccgaatgcgcgtccctcttggaggaagacgacgacgacggagacgatgcagcggacgactcggcgccatggtggtggtgaggaggcaattccagcagccgcagtgttggatccctcctcatccacgcgggcgtctgcaatgacagtgcattgccatgattgctcgactcgccggcggcggcgccgccgccgccgccggcatgcgggttgtcgaggttcacgccgaacagccgcacgcgcttcgcggccgtcgtggggctctcgatgaccggaaccgagtcgagcaccaccggtgagcccgccgcccttacaccatcgccgctcggctgcagcgtgtagtggtggtgcagcggcgacggcgcgcgcgccagcagtggtgcttgcggaggaatcctcgccgagccgaacaggaggacctgcctccccatcgcggcggcggggttgaaggcgcggaagtcgaggccttgcctgaggcggtgctcgtagagcgtgccggcggcgagggctgcacgaagaatccccctccgccgccgatcccccacggggcgtagtgcgacgtgagcggcatcgggagcggcagcccgcggggcagccggagcgggtcgcgggtgtcggcgcggcgcttccagtcgatgaagaggcggtgccgcgccgcctcgtcgccgatgccgcgggagaaggagacggtgtccccggcgtcgaggcgcttctccttgacgaagcggctccaccccttggtcatcacgtagctctggctgctgttccagtaggagtagcggaaccgccatggcttccccgcgcggtcctcgaagttgagcaggaggcccttctcgttcgccgccgcgtccagcgggaagtacttctcggcgtactgcttcgggatcaccagccggttcagcttcccaacgtcgctcggcgtcaccaccttgtcgaacatgtgctccttctccaccacctccgcttctccgccgccgccgccgccgccgccgctcccagacgccccggcgccatcgtcggagcgaaagggagtgctgctccctgacgcagacgccgacgccgacgcggaagccgcgtgatgagcaggagacgacgacgacgacgtgggcgcaggcgcggcttcggccgtggccgtcatgaaggggatctctcgccttcccgcctcatcctgctcctcgtcctcctcttctttagaaaacctactgcttgtagtgaactccatagaaaactatcactatttcctcaaattcttggctgtatttcttgctcctctctcccaactcctccttcttcttcttccttcttcctcctctgcaagatgttcgaggataggcactgttacaaagaagtaagctataggatactagagagggggatatgatctacctatgtatgcgtgtatgtattgtattgttgttcctatgaattcctattgatctcgagctgtgtttggaggaagcaagccaagctctagctagggagagggagaagagcagagagaggaggaatcagagcggtttgcattgagtcttgtgcgcttctaagctatggggaattggggatatggtgggaagagagagagagaaagtgaccatggaattggatgtagatcggtggttcttactggttatactactgacactgtcatcgaatacgtcactccgtcattttctttctccattttttttgttcccaaatacaaggcattcataagttcaaatacttcgatgccattttcatccgtacaaatgatcccaggaaatgtctgcacgtgcatattttagtaagatattggaaactattttgatatgattattcctcgatgggttgtcctctcatttgcttaaaaaccatccaaatagttatgaaaaattctagaaaaatttgataaaaataaaaatttggcaaattaaggtcccttcaaaaataaaaatttttttgtggtacttaaagaaaggtgtcattcttactaaagataatttagctaggaggaattggcatggtgatttaaaatgcgctttctgtcatcagcctgagtcaattcaacacctgttttttgattgctatattgccaagttcttgtggcgagcggttcatattttgtttggtataagtaccccatcaaacttagttgagttattccaacagtggtctaaggggggtaataaaaaacaaaatactttactgttaactgcagcagcagcgcttttctggacagtttggttaacaagaaacgagttagtgtttgacaattacggaccgaaatcttttttgcaggtactattcaggggtacgcattggttacgccaatgggcgaagctgcaacggcatgaggatctgcgttcacagttgatcgcggcatcgcaacatcttgagtcatcagctttgcaattttttagttccaatggatggttatcagctagacacatcggtctttagtcgtctgaacttttatctcggttttgtttccaagtgttactctgtaagaacgtttgttataattggcatgagtctatcttttgatagatgaagccgggtataaaatatccattatctaaaaagaaaaatttgataacactcatgccacatatctatataacttaataaaattttaggtccaaactgatcaactcactagtcgagatataaaaaacaaattcaacgtatgaatagtgacatactgttcactatatatactttatattatcactttttgaaaaaaaatcgtaacacagtttgtatttaatttaaaagaaaaaggtatacaaagggatatcccttcgaaggattagaatccactctctcagatatttaaccaatattttctaatgatgagatttttttctagacaccacaactgtgtgtggtagcatttgtatttttatgacttaattattcgtcgctgatgtcgtggggtctaataaggagaggacaaaatgaaactactgttctagtttctttcgatctaaaatatagttaactttatatatatatatacactctctccatcctaaattatagggcgatctctttttaagaaaaattaaactcggtaacttttgactaataattatactaatcatatttatgctaagtattatgcatgctatattaatatatttatattttaaagtactttcatgtgatgctaatttcatatttgttagtaacataatatggaataaattaattgtcaaaatatgtcattgaagaccgtgtaaaaaaatatatggcttataatttaggacggaggaagtatgttattttcgaaacttaattgcgaagttgtacatttattttctttttctctctttgtgaaagaagatgtaggtgtagaggtggagaccggagaaagagctagaaaagtggggtgtactgtaccgtgtagtttcttagctttataaaggggttgagatggattgagggagagaggtggagcctatgaatttctctgagttgggctcatgtgagcttgtccttgtcaccatacgggtatcaaatatcacacgcctgcctatatagctgctaagctacccaaaggatatagcttgattgcgtagagtgtagacctggttcctaggttgggcctcctggtactcatcaaggggattttgtcatttatatatgttcatgtcttgaaaaagatttgtgataattgtatgatatgatgtggaatgagaagaccgcagtgtatatatgcctcaaaaaaaataaaacagctagcttgacttaattaattaatatgttcagcaatatatagtactgagtatgtatctatacgttcaagagaacttactagtataacctaaaatcaatatatattggaaaaagtccaaataccctcctaaactttagatggtagtccgtctaacaccctaaactttaaaaccgggcatccatcccctcgaactttgccataccatccatatatattacccctaatgtggttttggacgatggttttgtatatcttgaaagcttaaacaaacaattttaaataactaatataacatatttgcatatcatcagttataaataatcaatttatttttatatagtgatatcatactattattatggtggtactcgtttgtaagttggagctaataaggagcaaaaaagaaatatctaagtaaaaattttaatatatatgtccaaagtgtatggcatgtgattaaactcatccaacttatatacaaattagataaaaaccactatgcaaaaccatcttagggggttttacaaacggtgttgtaaagtttacggggctgaatgtccggtttcaaagttgatggtgctagatggactttcatccaaagtttagggcctttttttttgacttttgccatatatatttgcatattgatgtcatgaaaatctcaaagattttctacatgaagtatatgcaatattacccccaaacaataaggtcacttacataatatgtatgcaagctttgatgctcatatataaagttactatgatttccccaaatgcaagttccctagccattggatctcaacgtaagaactcaccgatgtctgacggtgcgacctgaacttcagaaagcatgccaaattgaggtctctagggttggaggggcgacgacgtacagatccaacgtcacaataagtgcactagagttgcaggaagacaagaggagcggagcaaaattattgagaaagcggagcaaaattttattatgacattaatctattaatggtttgcatatactctattttggaaagctttacacatgttatgttcaagcaaatactttagtctagatttctacaaaaaaaatgacgttttattttacataaaaactactccatttggtcaaaatatatatattttttgaaaattcttacaataaacataagttaattttgaacgttgttattatttttatgcaagttgtaggtatatgcaaatgacatagttaagttttatataaataagaaaaacattcatgatactccatgcatgtttataactattttttatttatgcaaaagaaataagtggtcaaaattgtatatcttataaacttctaaaagtataattaaaaaaacatcttttggggtataaccggaggaattatgttatatactggtctaaatgtcttgcatatccttcctattgcttaggttgcaatttattaatttccggataattggtgctaattaagctgtagcttggtcgttagtgcagcaaatataggtccacatcagttaattagtagtgggctgaaccatgcttatacgcgaatatttttcagcttcttgttccattcttattggccgactacaatttcccccttttcgtccaccatatgtatataaacaggttgaaatttccctaatggtagtcagtagtagtagaatttggttctcatttggccatctctctggtcaaaaactacctttaactgatccgtacgtataaggtgagcaggtttttctcagtagtcaccaagttgaagatctgctgctgatgactgatgtgatgaggcatctttccaaaccgacaaaaccctaacgatacacactagtgtggctagaaaggcaggtgcgttcccacttgtgcaatacgcgtgccttcgcatgtgtggagagacaaaagttgagggggaaatgggaggcagatcagcacaaggctagctaggagaagagagatcagtgagagagatggttggccgagttcaagatatctatatatcgatctagctagctcctggaccgcatatatgcagctctccccgaaactttaattattcgtagaatcgtagtatatcagtacaactgttcaacatgcctatcttattaagagttgagcagagcagagacagtggtagatatgtaacatgcttctcagatggttttgatttgatatgcatatgtcaagggagcatgtgactctctgggtgcccacttctctcactcttgctactacatggaatttaataatttgtggctaaggttagtatctaattatcaagaaaaggatctgtaggatcgaatcacaagaactaagccaaccagaggaggggtgaatggttggtatacccaaaaaccaaaaacttttagcggaaataaaagttaccctcgaaatcgacggagatcggtctgaccgagattgatctgtcggtctgaccgagtggatgccgccgatctgaccgatgtagaatgatcggtcgaactgccaaagtcgcctgccgctcgctgtcgccgccgccggtctgaccgccacaatgccatcggtctgaccgccggtgagttgccggttagaccgccgaaacccggtgaaacacaaatcgaagaactcttaaagtagataacaactttattgcttctctctgtgtttacaaagtgcaccaacagcactccttacaaaaatttcgactaaactcgaaaccctgactaaactagcaactcaattgctctcaaaagcgatacaaaaacgataccgggaagcctcacgctccccctctatttatacatgaggtaggcagcctaaagccacgaaccaaactcatactaagagtcctaaacaccttaggaaatcctctagtacaagatacaaactttacataaccaattgtaccaaatttggactccttccaaattcgactccgcatcccatacgcacacaatacctccatcgtatgccatatagaatcttcaccaaccacgtgcatcaactctagccttagtatcccgcatgatatctgaccaccacggacatcgtcttaccaccaagccgactcccggttcatcaccgcaaatactctcccgaggcatcgagtcacctacacatgaaacaaacaaagaaaccatattccgagaccaagctatcaccaacttgactcattgttagcaaacaacagtattacatacgtatagtatccatctagaagccataaccatgaaacaatcacggatatccaaagaaacaacccgaaaccgaaaccgacacagcgtcggccggtcagaccgcgggccggccggtctgaccgctagatcaccgccggtctgaccggcatacacagcccggtcagaccggtcacataaaataacagtgaatctgatcatcacctgaaaattgattatctccaaaaccacttcgacgataatctccaaatatcaaaaccaataatcacagatgccaattgttcatcacagaataaaaatcaaaacacacattgatcttacatgatcttcacgtgccttagtctgacatcatttgtgtaagcaaacacttgttttcagctggctctgttgaagggaaaaacattaaacaaagccaacacgtgttattcctattatatcggtcaatgatatacctatcttatcttgttagagtttcacatgagggtttgaaagcatccgcgttcaagtactacctctgtcccaatatatatagcaatctattatcggatgagatatatcatagtacaacgaatctggatatatctcatgttcagattcatagaactaggatatgtcttattcagtatcacgttgttatattttgggttgaaaagagtagaaattactattcaacaatactaagtttattatgtaaaaccaagtaaaaattaaaaaagggagtgtgtccatctttctcttgaaaactagctaaatcttagtcactattagctctaaattcagtcatcctcctcgtccctatataacccacaatcctatggtcaaatcctgatgtttcccgttactattagctctaattaaattcattgtcagtttgtcacccccgccccataacatacgctggctgaccaccacagtatgtgtgatgtctactaggcttcccacagagctgatgcattgcccatgtggaatgccatcgcactttttcatcctcttagctgtcttagctttcaccttgtaccatttggattaatttggtctccagtctcattttaatttagggtgtactattggtgaggtggtggacatccactagttcaaattttgttgtccacaaatattgttgtgtttatctttagttgtaaccaagagactagtatttacattgcttaaaaaaaatcccaggtgcacacgaacccctgaagattaactttgctttaattctgactccaacttccaccgcgccatctaccatattacccaaatgggatgatgttgaaatgagaacgtatcacaaacgagataacattgaaagccaacaaaaaattagtgacttttttctgggtcattaattgctgaatattctagcatataaaagaaattattatataccaagaaaacatgaattaattacatagaaataatgttaatatattttaagtatgcgacacgatcaacaacattttttttcttgtcaacattgtctattaaagtttgtgtcaaatatgtgtacgtgatcagttacagtttaggacttggagttgtactaggtataggaatagagtaagaatcggactctatcctggaaactctcttaaatagagggacatatctgttgtacccgtaagacgacaatagcataggtgtgtgggtacgactagccgacgacctagcaggtggagggtcgtggatacctggatacactgtaatatgctagatcggggagaggagcgcccgtaattagtgtcctggagatgtaggcctcgactgaactccgttattaaatatcatgtctcggtatcatcattatgtttagatgttctatgacgttttctttcacgatttggtttccgatgtgatttcggggccggttttataacattatcacgcatatcctgtgttctagactagtaacagttaagactgcccttgcccagcaatcagatacattaattaattacggtttacacttgccaagagcccaactgatattaataatgtgcttatgcagtacatgtaagacaaaattttcgtcctatctatcatgcttcgtaatagtagcagccttaatttattggtaccccatacaatttaggaaactatacgagtgctctggctatggatctagacctagtacgcagttcctgtacaccttaattggcatgtatgtgtactgtagcccatgtaatctggtacatagtttttatgatttatttcagccgtcagccggcagccggtcctactctgtcaggttaagtctgataagatcctaacacgatgctgacctgccggctttgtttgcctgtcaccgccatggatatctcaatagtcctataaagataatgtagttcaaaaaaagaagggagaaacaaatatatctctggcgcttggaatcaaaacgactgaagaagtacttcaggtttttcagtgcctggcaagtactccagaataaatcaaacagagcaaattgtaactataaccttcgcgcagcagatatatgttttttataaatccaatttcatcctataacctgttttaatcaagaggtagtactactttgtttttttaaaacaaaaaggcaatccagggctgaaaaaaaaacatgcatcgccatggacacgaactgaagaaagaacagcaggcgactgtctcggttgtagttaatcattattgcctctgcataatattcccggccgcttaaattagcaagtgaacttgagcatctagctgacaaggcgcttatatatatatggtcccaggagcatgcgagctccaacgtaccaaaaatggaggggcaacgactctgactgaatgcatggccagtctggttagatgatgatctagattaaaaggtgtatacaagtgtcgtctctttaacaacaaccatagcagctagaagcagatgattattaaatggtgatcatgtggcttgcttttgtaacgataaaaaccatagcagtactggctgtaacctctttacatagcaggcggcacgtccatttcgtttttccgtcgtcagtgggtgtgcaatctcttgcattgacctgcacggtctaccacagcttcgatcgatcgatggtttgatgagatgtttagctagtgaaattggctttggcagatgccgctacctttgtaattctttattattattattctttgaacattttctaataacattttgaaaagaaataatcatcatgtaacttatacggaaaagaagcgagcaactttcggtgtcggcttatatatgtagtttttgcaataggcacacgcacgtgaccgctatttgcatcatgccttattggtttgggacgaaaccaagcgagacatgtaatagatgaatgaagcaactacaacccagttggaaggtcaaaatctgtaattttgaagttgcaaaacctaacttcgaagttagatcgagtactgttatagccatttgggctgtgttcgagatatggtggtttattaatatataattaattaaatattagctaaaaataacttgaaaatatattaatatgaattttaaagcaacttttgtgtagaaaattttattaaaaatataccgtttagcagttttaaaagtgtgtacgtataaaacgagagtggtgtgttgaaaagtgaagaaagaattcagccttagttgatactcccggatgtgtgaacttttgataactcctccttaaacgtatgtgtgaacttttgattactcctccttaaatgtgataatgggggcgtggtaagggtttggacatgccataataaccttgtgaaagggatgaaaacgatgttgcggtagtaaactggtgtcatcgtggctggtactgtagctaaaaggtctatttttttaagaaaaaacaatatgatggatttattacaaaattctggaaattcgaatccttgtcttgtttgagtgttcgctgctagttttaatcaaagagaacgtctaattttaaatactaacatattcaatgtaacagcgaaagatggtactaaaaaattcggcgtaacattttataagaaagcaaaaggctgacaaaaattgtacgaaatttacactatagtagtagctatctagagtggggataacaggcgaggattcgaatcccatgaagttaatggaggtaaagtgcagttctgcacatacattaaatccagcatcaagtggtccgagaatttcttcagaaagaattctgcatcatgcactcaacaaagtcctatgtacccctatgttcgaatcaggaagagaaaacggcgctaattaacatgatatatatgtacgatttgcttaaacacaggtagagggggaaacaaattaaatacgaaacagtgccaggacagggagaggaacggcacaacacaactgtactaacacaaattagtgtgttcaagggtattgcagcactattgtgttttttggctgccacaaattaacttccctactgtacctgtagatctgagatgtttggtttagattaactatggctaaaacgcactgaagacacacaccgtactgttcatttcggcttttgctcatgcaacgacagaggatatgtttccctccatgcatggctccataatagagtactgtaggggaccgaaccaagaaaacaaaaacagagcactatctgttcgcattgccataatccatgtaaagttgttcgataatcagactagaaacagttgtcgcatattttataaaaacgacaaaattatatatatgatactaaaaaagttaagtatatatactagttaccgacctgtatatgtgtggactatgatatattatatttaaccaaatgctggctatttttaaattatactagttggctaaaccaaaagtaaattaagtccatatatacatagttaaaacttgctaactattagtttgaatttcaaaaccaaattataaaggactaaactgagtttccactatgggtataactatatttctgttaactctgaaacttttagaattattagatattagaaaaactaaaaatatgtagtctttaatatcttcaatggcatgcttttatttaatatcgatccatgatacatatgaattacttaaattagtagccagatctttctacttaacatgagaacttacattgagcttataattaacgctgtggcagatagatcaacatgcttgattctcttgatgagtactccctccgtcaaaaaaaacctaatctagttgggaatgacagtacctaactaggttaattagggtttttttttatagtgaaaataactacttgtattattttcatctggccaacgagtgcatatagatattttaacatataataggcgaatagttaatcgcagttttgtctccgtcgcacgaaactaaatcgaggtcttatttttttaaaatagaaaatttactatattgactggagatttgattgaaattttgaacgaaaccaaatgttgggagctgggacaagcatagtccccacaattaaatcaaatcaacactcatcctggtgatgagttaaactggggcatttatacacagggacctagctatggcaaaggatataaccataggccgctcttgatgcgcactaaaccgctggcagagattcttctctatatgctcaactatcccctgcatatgtatatatttttgcagtacaagctagggttcttttaggctgtacttccctggtaataaaaactctaagctggctaaacagtccaggtaaacggcgacgatgctcataaattgtgtcatatatacgcgtcgttcaaaggtgagtttctggaccacacacactagctactgcaggatactatgcacggtttcgttaataacagtgccacagctacagggacgaacgatcgtcagggcagattaaaggagcacaggtggtgataattcaaacacttgctgccatgcatgcatgatcccgtaagctagctagcgtggaatagtaaaaggggaatggatcattagagcacagagttaggtctctgaacactgcagaaacttaatgctggttgggcctgaacccccaaaatattccaaagtcgctgttgcgtttcaccatcgcctccaagctagtagtaacaatcacacaagaacagcagtccacttgtctatagcgatatccatctagggatgactatgcacagtatataaacatgtatatatattgtgctacacaacctaacacatgcgtatcgatcgatctgtacgcatgcatatgcatctcaccttggaaattaattagtaccattattttcaaagccctgctactctacagcaatagaatgcacacatgagatacagcataacagcaagatcagtagtaggacgcatggatgcaacatatgcatggatcaagagccctttttctggttttctccttagcgtcaaactgtcaatcaagctgaaatggagcgcgtgcgcgtgcgtgaatgcatggcatggcacgcactctcacacggaacaaattctttgcctttgtgcagcggcccgcgcgcgcgcgcgcacacacacactactacaccaaagcacgctgcatgcatgcagcatgcataaaatggatgcatggtcgagtatcatttgaactttttgcatgggcaaatctcaagcttacacgtcttttgcagtagggaacacatgactttaaagggcccaaattttgctgcctggctgcccggccagcctttgctccaagtaccaccactactactacaacaacaatacaacaaccaagtctcatgttgacgcacacatacacgctgctggcctcactacccaccagccagagagtgaggaaaagactgttttgtgtgtgtgagatcgagagagagagagagagagagatagctggccggccgggtgtggtccagggaagaagaggtgtcagtgacagtgagctagctagctgggggtgatggtgcatggcatggcactgctcacattcatgtcgacacacacagatcgatgcatgcacgcgactatgttctgatcaaccggggagtaccacctttcagccccaaaatcaacggtgatacttcagtcctacagtagctagcacccaaccacgtacatactgattgatggctccatgcacacacacacactagacactactatagctgatcgatcgagacgtataggtgtgtgtaccgtgtatcggtgtatgtgtaggagtagctcgatgtgcatggcgagtagtatgtgtaatttgccgcgtccggccgtatgaccgtatatcgcttgtttggttggcaccgtacgtacgtacaagtacgtcgcatggagttagtgttatggatacggacgtacactgtacgattatctcatgttgtgtcgctgcaagtacgtaccatggggttgatatatacctggcgatacgctggtgtagcgtacaccgttacatctgtacaagcatgcagctactagcttctagctagctcgatctcacatttactggcgccatgaatgtggtagtcgtagtagtagtaagaacagcagcagctgcaggggtacatggccatctcacacagatctgcagaggcttctaattccacacctgacacatgcatcatgatgttcaatcttttccctctccccactgttggccggtagaggccgaagacctgcaactgaaagcaattaagcgagcacacctagagagagagagtgtgagagagagagaggagcatgcatgggcattgtcattgggacgcagtggcagaaaggaaagataaaactgatggagaggccaaagagatgggcagccttttgctatcgtagaacatgcaaaacaaaaggccccttctttttcagagagcggcagaaggaaggcaggcagggcaggggggggggggggggcgcttcgctttccatttccacgcagcccaaaagaggtctcggtttcttctcatctcatcgatctcggtttctccctagctcgatcatcagctgccccatgcttcctctccctctctaccggtcgagtagcttcttgttgcattgcgtgatgctacctgcaaactgcattgcgctatctcccctggcatattcatatcgctcgtaacgtagatcagctggcattaatttgcacaaatgcagtactactacatgcatgggatcaccggccggcacaagtcattgcagtaactactggcacatgggactgtacatgtgcccgcagcatatatgcatgatttgatttttcaaaaagatgcacgagtacgtgctcgcctaaacgatcgcgactctaattcatggcattgtacagatcgagcgcgctcgacatatgtaagataaatacaagttatgcactgcaatcgccatgagctagtagtgtagttctgaactccctgatcttatatcgcctaatataagtttataaccctcatctcgatctctctacgtccgtacatcgcaaagtgtatattgattaatgaactgccaggcacgcaggtttcgaggggttatgtaacgacacgctagctgcaatacagtacaggtacatactccatcagctcacatacaggtagtacgagatggcatgcatgcgggagttagcggcgtcgctagctggactggccggctagccacctctctcttagcagcaacagagcaacaggctagtcgcgcagtgagcactcactgagctccgcatggcacctgctactctgctagctgagctgccgctactcctccaagctgcatcatgcgggcggaggcccacgcctccgcgacccaagtaagacacgcacatgatcgacatgccgcgcgctgggccacgcatctctctccaccccatctctaccggcgactaggtacgtactactgttcaactgtatgccacgccgtcgtcgctctgaggctgagactctctctctctctctctctctctctctgatctatctctcactccaaacagtgcctgcttgacgactccggccaacagacaggcctggctggggtacatggggcatgcagggcattcatgcttccaagccatctcgttaatgcgaggcctatggactttaaccagcccatcactggactcgattggtggtccaaactcctcctcctcctcattatcagcatcccctcgattatttggttccatatcgtttgctaagaattttttttttcggaatggttaggtggccggaaggacttttttgggttgtttgaaacatgcataccttgatgatttcaattagcatgatcctcaaaaataatgttcctgtaataattaatcatctcttgatttttcagtaaagaaaaatcacgttgaatatgtggttcagattttggattgtggtgtcggatatggattatgtaagatctctctagtttgctgtttcatgttacgggggaaacaaatttggtgtggtgagggagttgtaggcatcagagttgaaatccttgtgcatctataaatgatacaggaaatgaatgttatatattttcactgccttaaataaagtttcctacgatgactccaacacattcaccaccttatatatgtagtgcactagtacaaaaaaatgtttttgcatgcatgcggtcagaatcgatcttcacaagggcctaggcggcccgcctgtacgtaggtgtctacagaattcaatattttcacgtgcgggcgatccaacagcttgcgaaaatctattatcgatcgtaggcggttgcctctcatttttcacagattgtcagatgttgtgttttttttcacagattatttcactttagagtttgcctctcgtttttatctacaaatttagtcgctaaatttcacataaccgaaaaatcacatgatcaaagttgaaataagttttattcgcaaaataaagttgaagtaacaataagtttgattgtatgttttcaaaagcattgattgaatggatatatggccagggtgaaatagatcgatcagtatatggcctgtaagggtgcgttcgttctgggggattgggtgagaaaggtacatagtattccgcacgcacgcttcccaaactactaaacggtgtattttttgtaaaaattttctatagaaaagttgctttaaaaatcatattaatccatttttgaaatttaaaatagttaatacttaattaattatacgctaatggctcacctcgttttacgtatcttcccaatcttctcgatccccctctcctcaaactcaccctaagtcaagctcatatataatcctttgggtcccacacgcagccttgcatgcatgcttagtgaccacggtattacgcctgccgcagcctgcagctagccaacctgcacctccggacttacttggcgcatgtgagtagaaccatccaaccagaagccaacaagctgcattaagggccgggtaaggcacgcgcgcagcgcgctcaatcttgcacggcaagggaaggatcagacgagagagacgacagctgagagagacgcgtacgtgttggtcgttgagggcgagagaatcagagaaagcaaacggatccggtataatacggtctgtgctttgtgtagcatcacaactggattgagagaaagaggacggacgacgcataaagccaccgatcgatcttgccgtctttggggcccccggcctctctctatcatatatatgatgtacactagaaaaatatccgtacgttacaacaggtgaaggttattttaattttattattgttatatacgttttagtttaggtgaaatctactgtgagaactcgtttgaatatatattttatccaacttcctttcgtgttgatttggtgtttttcatcatctgaatttgaaaatttagagttctaatttgggaacttttgaaatggaggtttcatatttggctcgtgggtttgattgcttgtggttgtcagccttgcgtggtttacacaggatacggaagacgcatgctcgacgcgaggtggtggaatcggacagcacgagcgcgtgcgacgatggaccaaaaaaaatctacggaagccaaatttaaattcagtttaatttatttattactacatccatactaatcaaaatataaaaagttttatagttggacacaagtattaagaaaacttgtgaaattaaataggaacaaattctaaaggctaaaattattaaattttgagacagagaaaataccaaatagcatactctatggccaatcacaattagaagattatgggctgatacgttacttgggctgaggcccaggcaggcattgaggacgtcagccccttcgctgtccgtctcgcctgcaatacctgtctaatctttttttttcttctcactaataaacgaaacggctaaacagaataaacgaaaccgcaaaacagaaacagaattggattagaaagacgtacgaaaatttgtggcaaaaatatctttaatttttataataggtaaagatatgggatgctatacacagatcgcggtcgatcgatagtgagggtgcaaatcgtgcatactacgccgtattatcgcatgatagtgtgtatgtatgctgcatgcataggctgtaggggtgggcattcggtctaaccgaaaatttcggtctcgatcttcggtctttcgattttttcggtctttgaaaagggaaaatcgaatttcagcgcaaaaaatgttaagaccgacaaattcggtctcggtcctgaccgaaattcaacaacattttcatatatgcaaagaaataatagaaattttcaacataaaaatcacaaaaaaaaaatcgtaagcacttatgagtaaagactcttattagcttgcatgcctagaagaagtatggatgtgaaaaaatagagtttaatcctattaaacatagtatattgtaggttgcatttagacattttttttataattcggtcttttcggtctattcggttacccgaggaaattaaccgaattgaccgaacaaaattcgttttttcgttacgtatgactgaattgatgaccaaatttttcggtctcggtttttttgtttggttttttttgcccacccctaataggctgggagctaggctcgctggagcatgcatgcctcgatgtgccctggcccctcatgatcaccatccgtttcctctctctctctctcgcgcgcgcgcgatccatccaccgtcctgctctcgaaccgccgtctcgtcacgtcgctttcgcgcggcgcgctttccccacccacctcttgtctctctctcgcgcgcgcgcgagagcgcaccggtacaccaccaccaccaccaccacgtcgtccacccgatcggccgcatgtgcttccgtgggaggcggcagcagacgtgcgcgcggagagaggatgtgtacatcatcccgcggcccgtgaggccgtgacaaggacggccaatcgccagatcgaatgaagcaagggcgcgcgccggctaggcgcgcgtggaaggggaatatccacatgcacgccggccggtgtggcccccggcccgggcgcgacccctgccttgccggcaagataccgatccatccacgacaccgaatgcgcgcgcgcgagatggacgaatcaaaaaggggaattatggagtagcgctgcatgcacactagctgatctactgtagattcacctactacgtacagtatatattccaaatagagcaaagacatggttgagcccatcgcaaataatattgatgatcatgatgatgttgagaaagtacaactatacagagacgagctgccaaacaccaaccaaaaagcgcattccgttacaaactatcattaagtaacatgacttttttttcagctatcacattttcggcctctaaaatgcggcacaaagccaataagttctttaactgaataacagtacgtgatcaagggataaaccccaactaccctaacaaagaaaatcgatcgataaattaaacttaaagaaccatatagattctaagaaataagcctacaaatattgtggcatccataatgaaataaaaaatcctttatctaccgactcgaatagtgtagcaccattgcgtataatatcatgcttcccgatgtcataacattataaactaatattatgcttcccgatgtcataacattataaactgataacaatccggcaggcctaataacttaaggttgcttggaccccaacagttcttatgcacacccacccggggaagggctcaatctccctaaaagactagtccaataggggaagggtggctctcccttttaagatagcttcctcctcccaagttaagcaaggtggggggaaaaagactagtccaataggggaagggtggctctcccttttaaggtagcttctccctaaaagactagtccaataggggaagggtggctctcccttttaagatagcttcctcctcccccttttaagatagcttcctcctcccaagttaagcaaggtggggaaaaagactagtccaataggggaagggtggctctcccttttaaggtagcttccttctcccaagttaagtaaggtgggattattcagaggctcacacggtcgccgcccgacttttgcgtttttgccaacgggtaatagtgtaggatgaacttatcattcccacccccttaacaagggcccagctctgataccaaatgataaacaatccggcccaggtggggttggccgaggtccaacaaattaaggttgcccggaccccaacagttcttaggcccacccactcggggaaaggtccaatctccctaaaagacgagtccaataggggaagggtggctctcccttttaagatggcttcctcctcccaagctaagcaaggtgggattattctgaggctcacacggtcgccgctcgacttttgcgtttttgccagcgggtaatagtgaaggatgtcctcatcataaaccaatattggagccagctagaaaatatgaagataacttgtatactatatatagctatagttctatcaaaactagttggccgaatagatttccgtcaaattaaatagtgtaaaactaataagtccattggaagtaaaattgtaattgtaacagggtagctcgtgaatttgctcaatttgctaaatggacatctcattgcgcggtttggcatgatcatgctccgccttatgttaagcaagtgttagagcatgcaagattgtaatattattacataaccagtaattagctctcatttccctcaaaacaattattgtttatctctatatagaaatacacctacatttatatgcatatacaaaggtggtatcacttaaagaatatcatcctataataattgagacaacaagacctcttaaccattaatgtaaaaaacattttttattagctttgtttttttatcccatgcaacaaaaattcttttaataaatgctaggagtaagagttaactttgagccgttgtcaatgatatttctcttatctccgttctctatttttcacgtcactcgatttacttgcatggcaacgtgtacatgttcataataacgatcgatcaatctgcgaccatatcaattcatcgtgatttaattaatggctttaatctatcatattcttttattggtagaaatttccagaccatcacagaacaaaagtagtggaggcatgcacctatccttttttaaataagacaaatagattgattgatagactacatatcatttgctttatctatctgttctctttcattctcaagtagaggagttatgacggtgcaccagcacgccttgccgacacacacaaactgacgtagagaagcatgaagtggaataatgtaggcggtgttgcaagggcccagggttaacctggcatataccaattgccatttgtgagtaatagtgtggtgacaacattacaatgataagaacaatgcatgcatatgccttggggggggggatcgtcaattcggtgaattcttatgggctatggccctcatgggagactccacagataaacaaacactcttacaaatattgaattttacgtgtaaatcctttaaactaaataaacacaaacgaccccactaaaatataaagtaacaataatcgatcccacagtatataaatttttgctttgctactatttcagaatacgacaacgtcaaggagagcaagggtgaattcatcttattgtgaacatgatccgtcagaattcatcatagtgatcgagatgcaaatagctagtgtattggtaaggagtgtgtgtggtatcaacccaagattctatgtttacttttttaacacacatattatttcttctacttatttaataatcaagtcccttcttggtagtcctcctcgatctctctctctttcacagaattcatggaaagggtcgtatattttttcgcgcttttccgttgcttgaccaacgataaaaagttgctacgtggagccgtgaccaaccgtgagttctttcttaccctttcagaacacctctccgttcacaaatttatgtatttatagactataaagattaagaatgaaggggaaatgaacggaaagagtactactacttaaattgggagtgccttaggttgcattcatcaaattaattattaactagtaataggaatatattatattcatttggggggtgcatttggtttagaagaagttgcagtctgcagattgggtgtagacatcagcatagaccttgctacagtgtctttcagagtttcagttggctactctacctgagctgtcgaacagggtttctgacgttcatgtggagtatggttatgattcgcaatataatgtgctacagcattacagcaatacggcatgcatgccttaaaaaaagtatagtactacggcatcatgcattagacaaagacaagacctcgtgtttgagtgattcatatcgattggatggtttaaaaatctactacgaaatggatataaaattcttaaacctattggttgtggccagtccagcgtggaggctccctgcgcatatgcatgcatgctagtaaaatttgtctattgattgatctggacgttacagtaattttatccacagtttgaaccttacacagcttatttattctttatatattccgatggaacgagctcaaatgaactagtacttttcttgttcaacagagagagatcgaaagagagaaactaggatgaaccaggctgaaaaaaaaaacctaatccgcacttctttattttgggactaatggaccttacgtcatcgtgcgatgccagatgaaagagagaaagtcaatctttagtccctcgactatcactcgaatctaatccacataccttaattaacgataaaactgggtgtatcgtccccttcaactatcaaaactggcttattttacctttccgagtgattttgaaggtggttttatccggtgtgacggttacatggcattaggtcagtgtttttatctgatgattttgatctacttgcgctagcacacggtgcttatgctgcataaaaaataaaatcactactgccaccttatccctccctctcctcatctctctctctctcccgctgtcacattgggaacagtgtggcccaacgcgcgacgcgacagacaatagcacaacgacagtggcaacgccgagcaaatccaagtgattaggaaagtgcttgggaaaacaatggcggagaggtggtaggaagaaggacatgggatgggaaaaagccaaggtcagaggcgaacctagcctttttgtcgtgagaagcccgatagcagtgagagtatgaaacttggaggccgcgatgatgacaagggcctcggagagctatgcttggatgaggggcgatgcggtaaggaggagctatacgtagtcaaagagtgggaactgggaagtggtggttagcgtcgtcactgtagagggagggcttgggccaatgacgccggaggaaattcttaatatggacaagttgtggcatgaggaggggcaatggcgagcagttctagcaagaagccttagaagcacacggtgaatactaggctctgatcagtggcgagatgtacggtggcgttgggggagagctacttagcgaaccattccaccaaagtatcgagcatctttagcgccacctccattcctaccaccaaggttgatagaaggcaactgcattttgattgaaccaaggagatggggagaggagttagagtgccattaagagagagagagagagaggaatggtgaagaggatgagaggtagtcacttacatgtgtcccccatttcaaccttttcatttcttgaagagagaatagctaatgtttcgctggatctggcagaccagctgtcggcaggcgttgcttcacatttgtggtcagtgtaactcacggactcacgagaacggatagttcgtcacttgcaaaagaaataactcaagcctattaggtttttcttctaatcttctttcgactagtataaaaaagggatgggaaaacaacacagcacggttgtaattaacaaaaagtcatacagtaccatacaggcagctgctgctccgtaaccggttgcccctggggcctggcacatgagtacttctgtagttctgttcgctgatgccggccgggcggctgctactgtagtgcgctgtgctcgaccgcatccgcgcatgtccgtcgaccgtcgttcgccttcttcgcggtgcactcagaattaaccaagcaaaattcctccgccgcaataccgaacccgcgagccagtcggctgccgaaccgaccgtctcttgcgccggtgaaatcctatcccaagtcccacacgctgacacgcgcgcctcatcagcgagatggttcggtctcgttggtttgggagatgcaacggttggcggacgaggaattcgggacgttgggcttaaggctacaatgggcaacaaaaattaggaataatttcaccggaggtccctcaacttaacaatgagatttttttaacatccctttaaccataaaagcagaaatgtctacccctaaactcactcaaaccgttcaaagaaggtcccatgataacacatatgggtagtttcgctgatgtggcatcctagtcagaaaaaaataaaaaaataaatatgtggggcccacatgtaagtgagaaaaaaaatgtgggtttaaccattctaatcagcaatctcctactcttttcctttttctctttagttttatctttgcagcagaggggggggggggggggagg

SEQ ID NO: 1777 - DNA, 20177 bp, Oryza sativa
cgggcggagcggagcatcggcggtgacaaggggtgtgtggggtggttttttttggcgtcatcggcgcagcagagcacccgcgcctccgccgcatcggccgtcggccgccacgcgctcgcccgcctgctccagccgctgtccgctgccgccaccccgctccagtccgcctccgtcgccgctctgctccgcttcgccagatgcgttccgctttgccggccgcgcgctcaccgcctcgttgcttcggacgcgcgcttgcccgacgccgttgccacccgctccactccggtggtcgccgcgcgctcgcccacatgctccggccgctctcggtttccgctacccgctccacaccgccgccgctgtcgccgctccgccaaccgcgctctctcgccgctgccgttccactttgccggccatgctctcgccgccgcgctgctccggacgcacactcccccgccatcgccgccacccggctccactctagcggtcgccgcgcgctcgcccgcctgttccagccgctcatggccgcccgctgtcgctccccctctatggcaaagataagaacgaaaagaggagagaggaaagaaaagagaaaagaggagaagatttagaaaaagaagatatgcgggtcccatatttttttttccttttcacttacatgtgggctccataacttttttattttttattttgttgactagaatgccacgtcagcgaaaccaaccatatatactgccatgggacaaactttgaatggtttgagtaagtttaggggtatacctttctggttttgtagttaaaggactaaaaaaatctcgtggttaagttgggggacctctggtgaacttattcccaaaaattaagcccagtcaatagtccaaagttccagtcagttaggttgggccgtctgcgcaattgctagcagaaactgagtaaactgggccgtgtaatctgtatgtccattcaaaatcaggcccactatatgttctataccgcagcaagacaatggtaagcgagtagcgacaggaaacgaccactcacgaaccaaaatctcctccactactggacattatccagccgaacattatccctggctactggctagattcttcattcttgatttgtgaataacacatcatcatcctgaacctgcagcatccgtgtctcggtgatagaatggctgcctggatggatggctagctcttcccccaacatgtcacacagccgatcagttcctgcatcgatcccgaatatgatgccaaaagcaaaaaccgtccttcagcattagcatcccccctgcaacatgctcgtgagcacggcatgtgttttgatgtcaacttaccacggcatccgtccgctagcgctagtatttatacgcctagttagtctccgcgatcttctccgatatatcgtgcacatccatatccacgcgcacacgcagccggctggaaggaagaaaaaatgctgcggttctggaggacgcagaggagcgtcacgtcgtcagacgccttgtctgtgagtaaaacatgtaaatgcaccgtcagaaggagatggagtactatacattttccatatgcatttctgagtgctgtttgtgtatgtgtgcctaagatcgtggagatgaacgtccacatggactgcgagggctgcgagaagcgcgtgaggaaggccatgtcccggctcgaaggtgccagtactgtttcgtgtgtgtaaagtatactccagtacgtgtgtgtttcgtgtgtaaaatgcgtgcgtgcgtgcaggcgtgagcacggtggagatcgacatggacacgcagaaggtgacggtgacggggtacgtggaccggcgggaggtgctccgggcggcgcggcggacggggagggcggcggagttctggccgtggccgtacgacggcgagtactacccgttcgcgatccagtacctggaggacgacacctacatggcgacgcacaagtactacgtccacggctacaacgccccggtgatcggctcctaccccaaccacgccttcacccacatcgtcgacgaccacgccctcgccttcttccacgacgacaacgtccacgcctgctccatcatgtgacctaaaatataatcttatttaaaatcctacatgccagcgacagatacatatctgaccaaatcgaacaagctaagtgacctaattagtggtgcaaaataagagatgaaaaaccaaatctaacttcgtcgatcatctagtaatggtcaagtagttgctcagcaatccaacgtgcaaagagtgtggtgatatgatagacaaattaacgaataggaattaaggtcgaactaagcttatcaatcgacaagttgttcttaattaattgcactatgcgaccctttttcttatgaacatgaattaaaaggaagggagcagtagaactggattgctaattaacccgctatccttttgaattgactattcgacgggcatctgcatggtatcgatgcttgctgttgacagcacaaggggaagaaaagggtggccctgaaaattttcaactgttgatgctagctagcggctgatctcgctgaggtatctgtgccagtaatttttgtctgcggataggacaacatggagaggatgactaggaaaaggagcactgttcaaactatccaaatgtctccaaccaaaagtgatgacccatccttgcatatgtgcgcatcagtgcatatgttcttatgctggtgtggggtgaagattctggtgtgaggggcaaacggtgacaacggaaaagaaggttcgaatataccctgttccctgattacaaatacagttatgagttctgaccattggattgtatacatatgacaaaaagagagtaaacttcagttcacacatcagaccaaattgagtacaggtgctaccagtatttggctttcgaagatattttacattgggacagcgagaggagtaagttcagttcacacatcagaccaagtttgatgcagctgctcaatgctctgtttgttcgttttgtcagggaatatgggctaacagtgacccaatctggattggattcctatcaataaataaacaaataaatctggattggattgtggaaatgataagaacacgcgtgcaatttgatccactttttatgcgatcaatttgggaggaaatgctctttcgtttcgctctcacaaacctgtgaacaatttccaccctctgaactttcagcattgttcttgtattccccacttcctgaagttcttaattctgtcaccaaacgacttggcatgcagaacaattcagtccctcacgagatacagaacaagaagatatattatcttataccccatgggccaggtaggtacaccagcaacaatgcaaatgccgtcgcatcgcatctcagatacttatgcccactaagcttgaccattatgttaacttggattaggggtaggctagagattgattggggcttatatgataacactacatatacacataaaccacaaaatcaagctatcaacattcctcatctcgttgatgccgacttatatctgccctgatagcgcctaattaacccgtgaacaacgtgtcttttcatcgtccaagtgcccaaccaacacatgacaaaagcaaaacgagtaaataaatttatttagctgccaataaacaaaggaaactggacctgcccgtgtcgaatcaaatgctaataactcgaatctggaacaaaattaacgccaaaaacaacacaaaaaacgactctttttttttctccaaactcgactcggctttgagagttctaatcttagccaggctccaccccaacctgtgctgccctgttcgagcgaagaacgaaagcgacacgagccgtccatataaatccacgccgtcgccgccgaatctcgcgaaaaagctcgcaaatttctactcggggaagaagaagagccctctccaaaggatctcctcgcccggccggcggcgatggcggccgcggcgccgatgccggttgccggagcggggtggtgggatctcgtgaacggctcgacggcgtggcaggacgggatcttcctctccctcgccgctctctacggcctcgtcgccgcatcctccttcgtaagcatctcgccgcagtgctcatctcctcctcctcctcctcctgagtcctcctgactgatactatactctagttatgcttatgcgaaagcactgggggaaagattctttcagaattttgtgtcaagatggattaaggggtaaaaggaataacaatacacgtactccaactgggttggtgacttgagttcatggcaggagaataaagacttgatttttggtgcttgtttgatgggaataccgcagatttgcgatatcaccatcagcgagtttaattgggaataaagacggttttgtattagctttgtgctttgagcataccagtgttttgcatctgaaacttgtaaaagctgataatgaggacgaatattttacagaactttagatcaatcaatatgaaaaacctgcgatttgaaatagagatagctggacaaggacttgtgattatctgccatgcttatctttctgatatccggaaatcctgctggatgcctggatagacagtacaaaggacaataatgtgtatttatgccttggtatctgaataatgagtagttactacattagtgtgggaagtatgaactgcagatccagttcctatgcttacagatatggtgcacatgtgaatgctcgctgttaaatgattaaatttacttgaggaagacaaggcatacttaattacttatcatgtgatatgcagatccaagttgttaggatacagtacagagttcctgaatatggatggacaacacaaaaggtctttcaattacttaatttcattgtgaatggaggtatttgttcaatttcacttgtagtacaagttacatgctcaactccctttgtgcttttgagtttaatgtgatttcaatctgcagcgaggtgttctatctttgcagtccgccgccaagtccaacaagtgaaccctgaggtctggacatctttgctattttctgtcttgtaattgttatgtttcacccaattggccagagttatattcttcattcatttttattccagatctttcagcatgttattcttgatcttccggggcttgcattcttcacaacgtatgcaatgttggcacttttctgggctgagatatcttatcaagcacgtggtctagagactgaagggcttagatcaggtttctacactattaatggtgtaatatatgtgatacaggtaaagcaagttatctctaaaagtctgtattgattagtgattgctatttatcagattttgtataattccgttagcattgcaataatcaatagtacaccctattgcacaagttgcggtgatcagatattttctttggaactgtgaatttcaagaaatttgttatagaccatgaaaagctgtgatgcgcttatccatttttccctgaaaagaaaagatatactgttgctagtatgcactgatgtgaaacaatgagatactggatgaaagtagaagggaataactttagctgttattgtgccacttatcttgtgatggttcagtgcttgcttagtataaaacttccgctaggctgcgtatctcaaaatactcactcaagtttatttcttcaggttctgctgtgggcgttgttgtggcacaatccaaacccatctatgatagtcctttcgaagttgttcattgcaggcctatccttttctgcagccttgggttttctgctatatggagggaggtaggactaagagtattactgaatgactcttaaccaagtttcatcaatcatagacagccaaattggctggctagactagctgcaaactatgtaaccttgaaccatttagtctactaataacttatacgtagaacagtatttcaagaaaatgtccacttattcagtgcttcatctagcatttgacattaacattcatttgccctgttttgattggcaggcttttcttcatgctgaagcgttttcctattgagtcaaaagggaggcagaaaaaactgagggaagttgggagagttgccactatatgcttcctttgtttcttggcacgatgcattatggtaaggttttcagttctctgatccttggatgagtttttgagtttcagtgttccatttcttacttgagcggttttgacactgcccaatttgttttgcagatgtgctttgatgcatttgacaaaaaagctgaccttgatgtgcttgaccatccaattcttaatttcatctattacctggtacgcatgaatcctgcgaccatattgtttacctcagtgaaatcaactttttttccccgttatcagttctagctagaaattgatttccattatcaataccagctaaatatattctgtacttgttcttatcccctgtttggctgtacttgcagatcgttgaaattcttccttcatctcttgtcctgtttattctgaggagaatcccttcgaagctacggctcgcccagtatcatcccctcaacagtggctaggggatgaaaacggatgaaaacatgaaagctaaaaatatggagaggcctgcaaagtgacacggctgcaagcccaggacatgaaaaaaaaggatgacccatggtctaaaatctctaacccttgttcaaaatgtgtatagatagggatctgaaatctgaagttttcccacaaccttcacctcctgtagctaaccttggtggttcaaggtgctgatgatttcgtgtaaccaattgttcctttgtaacaatggaagcaagtgtcctcgctcttttgagcgagcaagccaatgtttgtcttgaaaaattcttgggtaatccattggtaattgcttactactgataatatccgctttgctaattgctagcacaactcgaatgtgctggatcaaatggtaatccagacatccagtatcaacgaaatttttgaagttttgcagagtagcagcgtgatgcagaggtttctaccaactccgcttcgtcagaagcgaacgccgccacctaccaaacgcatgaatcatacgaaatttcaaaattgaagtcttgaccctaccaaactccgccattcttctgttctggtctgcaaatatttttttctctttttttttttcgataactactcgaggcttggaaatctccgagccgcgagcaaaccctagccgccgccatggccttcctcgccgctgcctcgacccgcgcgccgttcgccgtcgcggcgtcctcctcccggcgccgcaccgtcctcgccgcggccgtcaaggccaccggcggctccaacccggccgccccgcaccccgtcctctcctccctccgcctcgccgcctccgccgccgtcatcctcgccgccacctccccggcggccatcgcgtgcaccccggcaccgccccctcctcccccggaggtaaccgtcgcggcctcgcccgacgatcccgtcaccgacgacccccaccccttcgagaagctaatcgtcgagaccgccgcgctcgccagcttcggcggcgcggaggccgcgcgggcccgcctctccgccgccgccgccgccgccgccggagtcgtcggcggccgcgagcaatacgcccgcctcctcgccgcgcaggagctcttcgtggacggcaaggtggacgacgcgatcgccgccttcgaggagctcgcccgggaggaccccggcgactaccgccccgtgttctgccaatgcgtgctctactccgttctgggcagggccgccgagtcggaatcgatgctccggcgctgccgcgagctcgccggcgaagaatccgtcgccgatttcgtaatgccggtctcgccgttgccggtcgattcgtcggaggcggaagcggagccggattcgccggaggcagagacggagaagctgtgaccggaatggccggtgtcacggttggaataaaggtattcacttgactcgcgatacaaatgtagggagatattaaatggcgatgatttgataatttttcatgcaattttagatttcaaatactacatgattttacatgtcctccaaataaaatgaagcgatcatgagaatttgatcgtattgataaaacagtttccacgatgatcgcattgcttagaattgagtcatttgcaggaatatcttatttattcctcaatcctgatggtggttaatccaccgtcgcagtgaaatttgttggaatcgaccgatcaactaagctcatcttcactctttgctcgtctctggactctggtagctgatctaagaacgtatacaatcaacatgtatcgcagcgacaaatgatcatcgtttcagcactagcaggttaggcagagcagccacaaatttcaagacaacgttgttttacgctgtaggactccatgctaatgccagtgctcaatgctgatacccggtcacattatttgtccccattctgagcgaacacggtgaaatcatgtattgctgctgtctgtgttgatgttgagggaagttatctgtggatcacgtaatgcggctgctagtaacagaaatatctcctagatagcattgttggcctgctggggtaatgacttccaactgatgaatgtacaaatggcatgtaaaatgacggcaaactagccctcgtgctctctaccaggaaaagagagttgtctcttcctacttcccatgggattgtcttgtgctgcatagctatccaggcggtctcaactcttctgcttgctataggaccagatgagttctttctttttgccaaccaaattcaggacgagttgggctgttggagtttggccggagcaaaacacgttacgagattgttgccatgaggtgcaaggtggtctaacgtgcaagcatgtttgcagtcagcaacgtacaatttttcatttttttttcttcagcttttgatgtgtgcttaatctccttctattaatataacgccaagcaacctgtttggccctttgaaaaaaaaaaaaacacactgacgagacaacgactcaataaccatccctggtagttagaaactcgacttgctttgctggtaaaaggagcattcaacataaaaaagacaaccatttattatgccattcaaatacttcttatcttgattttgaaacatcagttgcatcaccaaacataaataaaaacacaatatttggttttcccgggcttcaccgtggtcaaagaaataacttggcccatgttagcaatcccgagcaacgttttggccgatcgagcaagttgccatggcaacgaagccatgcatgcaacacaagatgcagagaaagaaaaccagacgaaaataaagttgctaatgcatctgcataagcatgacacacttgaggacttgaacaattgacccacgacctcgatcaatcaatactggcggtggcggatcagcgacatccgggagcctcgcagcttctcctccacgacgtcgtcgagcctccgcgccatctccggcgacatgtgctccttccagtctccgacctcacccttcctgaagaaggccgagttcttgaacgacgaccaggtagccccgtgctcgccgtctcgatttgcctccacgtttctcatcctttccatactgcagagctccacgatagtttcggggacgccaccggcaagctcctcgccggtgaacgggcagccgaggaagccggcgagccgcctcacgctccccacgccgtcctccttgaggctctcgtaccggaggaacacgacctcctccggccgcgccaggctctccttccagtactcggcggcgtggtcccacataggcccgtacggcgagacgccgtcgcagagcagctcgaaggcctcgtcgaacggcgtcatggtggatccctctggtttgatctcgtcgaggtaatgccggagcgagacgaacgcgtccttggggtcgcggcacaggtagacgacgcggcacccggacgccttgaccgacgcgggcaggctcgagagcggttcgtgcactgccaggatgcgcggcgacggcatggcatcgaggcgatggcctggcgcgacgcggcagctgcggctgatctcgtagatggagtgcaggaatggcacgaggtcgtgcgggctggagtggaggagcgggtgctgcccggcggccggcgcgtggcggccgcggtgcacgacgcagaaggcgagcgccttgagccacgtcgagccggacttgggcatggtggcgaggatgacgtcgctggggcgggccacgaacgtgtcccgcgcggccagcgtcgccggcatcaggtgcgccgggtaccagaatccgccgtacctgcggtacggggcgctcccgagaccatggcaagacggtagggaggacgcgagcgcctcgtacttggcgagggcgttgcaccagccttccccgtcgccggcgctcatgtcgtcgcctgcgcctgcgcgcggcgagagcaggtgctcggtcactccggcggtggccatggcattcctgggtcttggaggaccaacgcctctatctatagatggccatgcatgccaatctgtatttactactccctccatcctaaaatatttgacgccgttgaccttttttaaaaatatttgaccgttcgtcttattaaaaaaatttaagtaattattaattcttttcctatcatttgatttattgttaaatatacttttatatatacatatagttttacatatttcacaaaagtttttgaataagacgaacggtcaaatatgtttaaaaaagtcaatggtgtcaaacatttagggaagtaggaagtacaaaatagtactccatccattccaaattgatctacatatttcataggtacatcaagactaagaaaaactaataattctctcatactatatttactctagcaacaaacttaatacatgcatcatccccactatttcctagccaatagcaaatcaatatattgcatgtgggttataaatacatgtgtgcatggatgcatgcatcaatgtctatttactccaatgcagaaataacgaatagacctaataaatgaacacaaatatgcagatcaatttgaaacggatggagtaattaactgggggtgcagaacttgtgcgtgttaaaaaattattgcaagatacacatcaaaaggtacgattatcaatctttttgcactaatgcgccatcgcctatttgactcttccagtctaccgacacttgttaataactagtgccaaatctctacttgcctctccaaatctgcatacaaaataaaacaggtgccaagcctaatatactactctttgtacgactgattgaatcatttccaatgccacggccacgccagcatgaggtttttttttagccatagtgtagtattttactagactagaaccaatctgatgagggtacaagatgtttgctgatcgacttgcacaaaagttggtgcctcttgtccgcctaaaccaagttgcaaattctgaccatacttttcaaattatttctatccagctagcagagtttctacttcgaaattctaacgcatggagagagtaagatacttcgcaaatcatggatagaatcatagagagccatgcctttcatcatatcaatatctcatcagaacttcagtacatatggttgagaactatattggatacatgcatatagctactagtatatatatgctttagttgaaagattccacatccgggagcagttcgatgacacaccggcgagtagaggatggattctaatctctcgggtggacgtccacccgtttcttacatgtcacctaaatgattatgaaaaaaatcaaaaaaaaattacaaggtaggttaatatataatatatcacttcacaaacatgtaagttcaaatttgacttttacgagtctatttcgccttcagtagtctatttcgccttggatttctggaaagagtaacggcggttagttactgtaaggaacggttactgctcaagcctcaaggccttagccaaacacagaattcagaaaggcgttaagctagctttctttcgcattaactaattaatttcactgcccaaatatgctgcatgatatgaaagagcacggaagaggacacgatcaaatggtaaagaaaataaatgtttaaaatgtcaggtttaaacgtaccccaaatcgcgagccgctaagacgcagggagtccatctcgagcaggtcgtcgacttcgtccagctcgatgacggccctaattatcgcattgttgagttctttatcctcgctcgcgttaaagaggcagcctctgttctttgcatcagccactatctcacgccaaatggtctttgctactcgctagagtatttgcattgccaagaatccaaagacagtgcctgcaaaaacaaaaacaacaatggatcaaacaacaaaatcggagtgaaatcaactctctgtgcgactgacgtaattggccgggaggatcgaggcaacctacttggcccgggtcagcgcgacgttggtgcggttgacgttggagaggaacccgaccgatccggtggtgttgctgcgcacggcggagaagatgatgatgtcctcctcggcgccctggaacccgtccacggatcgcaccttcacggtgaagcccccgtgcgtctcgtacgccttcccgagcctctcctggatggcgcggacctgccccttgtacggcgacaccacgcccacgcacagcttcctcccggtgtcaaccgactctgcacaaaccaagctatctgagctcagcgatgccatgccagaatgcaagggcatgatgcaatgtgtacctttgaacaatctctgaacgatccgggtcacggcggcgacctcgatggggttcatgaggctcttgtcgtgcttgcccttgctctccttgccggcatcgacgttgatgaaggagtaggagccgtacattggcccggcaaggggcttcctctcgtagtccctgtgtaatacgttctcgccgtcagatatcttgttctcgtagaagcttgagaccgggaacttgctgatccctgggtgcatcctgtactgcacatccaggaggtgcttcgggtgtcccagcgaactcagcctctcaaacaggctccttccaaactcagcatcttcacaaacctgtgaagaaacaaacagacaattgttacatagcatagtaatagagattgtgaatgttctactaatagagatggtgagagcttaccctgcttttgacaagtgccggcagctgaaattcatagccgatgagaacggcgtgacgaacgccagggagctggagaggtatcagtgactcgcactccttcagctgtgctgcctcgtcgacgacaaggagatcaaacgggcttgcttctggcaggtagtgcagacgggatgagctagaagctgtgcagagtatgcttttggcgttccggactaggaaatcttctatcgaacgcttgtcgaaaacgttcggaagttcaaagtgatcagataggtgttttagcttctgaagacactgagctctagcatccttcagctctgtactcacactatcttgcacatatgtcacgaagttctgaaacagtgagctgatgctgccatcggggctgagtttgaacagggttttcaggctctgttctgatttgggctccacaagtttaccaaaaaattttagcatgtgcagggcctgggtcatgtaactgaaattctctgcagttgtagctgacctggggagataatcacagaaagtcttgacacaaacattaagatcattctcaagccgtttgtaattacttatgaagtattccttgaactaggaagatagcccgcgcattcgcgcgggcatgtattgtgggctgcatgtttcaaaaacttataagaacataatattaaccgaatagcactgtcacacttcgaagtatgttttctccacaaatattattcgttggtatttgttattttccacaaacgtgttatctaacaacttaaaagtgtttcacattgttgtaatgtaagcaacatgttgttaatcatatggtttaaaaatctttgtggcttttcctaaatatttatggctgaccaatagctagtctccaaaatatgctctaaagtaatttatttcttttacttgttaaatatagttaatttggatttcgactcatgaaagtttactgcaaataatctaatgaggtgcactaataaaaaaatagtttagatggtatagttgtttaaaaatttctatcacgaaatatgttttctatctaactaataagcatgaaaatagggcaatgggagagaaggaaaagaggaggcgaggttgtgctcgtgcatgaggggggagggcgcagacatgcacatgtacggacataacataataggacagctagacaggagggatgggattgggccttttctctttttgtctatctattaagataaatctaatggtaaaaaaataatgagaccatggtaaaaggcatatttcatataaattatgagtatatgtgattttttttaattatttcatattttattaagtcaatttagatgacatgtaaaaaaagtagggatgttgtctcttgacaaaacactatttaatagtcgagtttctaatttttgtttgacattgtagttttaatttacatatgaatgtttctagaataatgtggatgagaggaatggggaggaaggggaaaagatgtttttttatttaaaagtttaatagagatagatttaatgttaaaaataataggtttatcgatttaaatagaaatcattgattaaatgtttcttccgcagtatttgtagtactttttataatttattagatgtgccatgtgatgagctagaaacactataaaggatgtataatggaccattattatataatggatagatctgtatgatattttatggggatctgcttaatgaatctttataatataataagcattatatagtaattatttatatactaagctgctagctagaaaatatggataataaagtgagtaaggagagagggtagatcatttacaatggcatgatatgtattagtatttagttatcatataaaggatatgagtttatatccaaatggtctatttcttatatgtatatacacaccaacacatggcataattgaaatcaaatatattataagaaattataattatttaatattaatattttaatataaaaaatttgctacctataaataaatggagaaaaaagagagaaggtgggggacgtacgtacgtggtttttttttacaagcgtacgtacatagtttggtgtatgtacgtgatggagcggatacgaatgggttttgagattttttttccttgatataagatggatctaatggtgtgaaacgatgggtccaccatgttaagttgtagcgcccgtttcgtcgtggcgcctagtgggaaaactatctcttaaaaatcctaaatgcgaaaattttctccttgtttgttgtccagtgtccgtgccattccagatctcaattccccaatccattgtcgaaatccaaaccctaatctcaaatccgtcccaaatcaaatcctctcgaaaagtctattttgcctccctcgagttcgtgggccaatctcttctccccggcccatttcctcctcagcccaactctcctctcccctccatccttgcccgcacatgtgaggcacgtgcgccgctcgggcgctgagcgagagagagactctctctctctctttcacttctccctccctctctgctctcgttgccacttcccgccgatgccgctcaaatcgccgcgccacccgttgcttcccgcgcgcgcgcgccaaggtggccgaccggcaagtcgccgccgccatcagcgcctgctgcgcctgagcccgcgtctgccgccctgtagccgcgcccttccaaaccgccccaccgtcatcgccgtcgtcatcgacccggccccgctactccgcgcgctagcttccaagggatggaggcagagctcctcctcctgcctcgtcgccctctctccctccttcttttcccaaagaagcaaggggcaagccccctttcttccttcctttttcccttttctcttccaccaccggcgtcatcctccctgtcgctgttttggccgctagccgggacgccagctcgctggcttgaccgcccaaggtcggttttcgaaccgacataaccgcccaataaacccgagcccctcccctaaacccatctccctcgctttcgccttccgccattgtcgcctcgccccgtgccctgttcgtcgtcgcccttcgctgtcgcgtgcgccggaggagccggtgcgcgctaggatcggaaggggactccgggcactcgtcttcttcctcttccccggcccgaggccggagagatcactcccgtgccgtcggcctctcgtcacagcgccccgtctcgtctcggtagaacacctccctgttctccctcctcgctcttcctcctccccttagactcgagcagtagcttgtgtagcctccccgtagctagcctgcgtcgccccgaccgctgccgccgctcgcagtaggctcaccgccgtcaccgccgtgctcggtagtagccgcctgtcgccggccttcctcggcgatgttccgtccaatccgacgctagaaacggattcccggagtcgcgtagatgctctagctcgcccgaatcgatctcccgtcacgccatcgctgatttccccctttctcgccgccggttgctgccgccgcaatccgccgccgtcgagccccctccggcgaatccgagccgttggctcgctccctctcttttccccttgtcattctagtgtacacctcgtcgccctcgtcgtcgcacagcgtcccggagaaaccgtcgcctcccgccgtccattcgcggccggcgccttcgtctttctcccgccggcccgcgtggcagccacgaaggcgccacatcggcgctagctcggccggaacgggtcaagccgaccccggtcagccgctccctccgtccccgctcgcgtgcgcgcggcccacggagagctgagaggctgcgcgtgggccacttgcgcgccgcgtccaccgcaagccacacgcgtgcaccgcacccaccccaaccctagcgccgcgccacatgcacctcactcacggtgagccgagccgccgacaagcgagtcccactcgggaccacgcgaggtggacccggcccaccggttcccctccctctctccccgtgcgtgcctttgggccgccttctcgagcccgccggcccattagctcggccgagccgcgccccttctctcgggccgcaccctagccgcccgagggaagtctgttcctcctccctctttcttttctttttcaaagggtttaattaaatccgtattcctttagaccaaaaatccaataatcttagaaattcaatatcttctcaaccgtacatccgtttgactccgctcaacttccaaaaatcctcaaatctcgagatctacccaatggcacgcttagaggtcaataatagggctttaatttcgctgtttgttgagtcgtctcgttcgcgtgtagcttccgagctcgaagacccagagtgcgcggatttcgaggatcaagcttaagatctcgagcaaggcaagtcacctttgatcatcttgcacctataatttaaatctaagtatttcttttccgcaaataatacatggataggattaacacaagaaatttggccgcggcttgcgagatagcctaccggcccccatcctaattgctgcaattagcctccttgaattattgaacacttaaacctcctttgtcgactgttgtacttcgatgtacgggccttcgggcacgcacgtcggagtcctcccctcaaatttaaaatatccaacgatgggtaaaacttgggttttacaaaagacttggaaaaacccgacgcctgggtcgatgcttgcgaactaaatgaatttccaaaaatcgcagaccgggggacgtgccgggagcacggtttcctgctcttgcacttaaggaccgattcctttggaatttcatctgaacatataacaagtacgaccacatgggtggaatgggacacccctggctgagtaattagctaatcaggggagccttgatgccgggagacaagtggattcgccagggtggtgtcggggaggacccctgggcttcctggcatagtatggtctaggacctaacctgttgttggtctgggacccctctcgtcggcatatggtaaacctgtgtcggctctcgaaatgccttgtcatgaaagccttaaggtcaccagacgtggctgttctccatgggctgggtgatccgggttagtaatgtcgtgtgggtaaagtgtgccccctctgcagaggttattaaactgttcgaacagccgtgcccacggtcatgggccgatgtaaggtgattccttagtgtagttttgttcgactagtgcttggtgaaattgctgttgggaatttgggttcgatgtttggaacatctgtagctgacgggatcagctaggcccgggtggccatttgaaagttgtggccgggtgccaatcttgaatcaatcaaagactgatacattgcacatactctgaccggacgagatgtactgtctcatccgtgtcgtttgagaagcactcacttagttgttttaaaaatgagtttaactaaaaatcaattgtaaaaacaacagcctttcctttgaagccttcattaaacacataattcccatgacttgctaagtactcctgtattcacccttgctctatataaataatccccccagtggctgaagaagatgagatggaccccgctgacgaggagttcttcaggagcaagtcggctatgatgagttttggggtttcgatctggttcccaagtcgcgcctgtgatgttaggttcaagtcttggcttctgctttcctcttttgtaatgcagttgtgagctcggggtctgtccgcagcccaacatgactgtactcctactctataataaagagacctctgttgctgtgatattctgtcttcctgtgataccagctctatttcctgggattggtatcggttaacaggttaatttggagcgtcacaggctggttccgttcggggctagttcggggcgtgacataagtgaaaactgatggttggatttttattttttcctcataatttctataatttgttagagtgccacatgacgatataggagtgttcgtaggagccacatggcggtttaggagcgtttgtaggaagtttaatggacttttagtatataatagatagatggcattattggtatgaccttaggaacatcctcctttacctgctttttatcattctccttgttcttgtttttgttccttttcttctcagcaagatcctcttctatctccctttcaatttgctccacatatgaatcatactgaaccagaggttgctcaagaatccgtatcatggagctcagactgtgcacccaccctgaacctggactcaggcacttctgcagtcggcgagcgcgcttctccaagaagatctttgtcaggtttccgtccacgttcatccgatcctcatttccgaacagcacaacatcactcaaaaaacaggcttttccactgccagcagaaggatcctcgaggagattgaggacccgagatgcgacctcgacgacggcggtgttcgtcggagcgcaggtcagtgtcctgtggttcttgaccagcattgcccacaggagcgtgctgatggtcttcgtcttccctgtcccgggaggaccccagatcaggcgcacggaagagctccgctgctgcatcgctgacacacagtctagtactgccaccttttgcgacttgttgagcttgaaatcttcaaggccaccaagtgctctgtccggtagatgtaaaggcagttctgaagaatatgaacattcttggccgacctgccgtaagaattaaagaacatgcataagcaccaaattgcatgcaatggagcagatatattacatggtaatgcatacctttggattgcaatttactatcatccgaatgatgtcagtgttcctgacactagcaaccaccgcatccagttcactccatatgcgattgtacgtcgtcatgttgatcaggaacaccgcgaagagagacgattccaatccaaactgctgctcaacatgcttacttgacagcctgacgacggtgttgccttcagcatcctcggctttgagcaccgaggcaatcaccaagg

SEQ ID NO: 1778 - DNA, 753 bp, Oryza sativa
actccatccccattcgctctctccccacctcaccaagttggcgagcgatgcatgcaacgacgatggctcgtctctcttgctgacgtgacgacggtggttctactacctcggtgacggcccgcctattctcagcgatgccatggcagtgtcaggtcctcctcatgctgccgtcagacatggcctcggctccgtctactggatttgatggtgatggcgatagaattggcacctacgccaaattcagcgggcccaagctcaggggtctccgaatatggccccagtatcatctcatctaccgcaccaagaggggttgccataaccacatcgcctcggtggctaggtccccagatttgacctcaggcaacggcaagacgcaacgtcaatgctccactattgtaacgtcccgtcttcccccaggccgggcccacttacatctgatagctttcataggtcatagactgccctcacagaccaacacatgtcttttctgcacactttgtcctcactcgtgtgcacccggaagaatttcccggtcggtcacccatcccaaattgctccaggccaaaggccgggatgttacaccctcacccccttaagagagatcgacgcccccgtcgatcaaccctaggccaggaacgtcctctcttggctacgcccatgtgtccagtgccagcgcatgtgccatgctgtgtaaccactcccggtcttcaccagccatgcgcaccatgcctgcgcaactgcgacacacgcgcc

SEQ ID NO: 1779 - DNA, 1454 bp, Oryza sativa
tcaaaatgatcaagccaagatgaggaagaagatagaacaagagaagggggggggggaaataaggtgatggcatcagaactcaaagtatgaagacctcccgagcaaaaatagatctaattaaatttcttccagtatatatggaagtagaaaacacgaattaaatttgattcatgctgagaaacatggcatgagatccgaaggaagtggaaagctaggagaagggtgatgaagaacaatgaaattgatcagttcatagcatggggaggtgagggtaagaccaaaatggagcggtgctacgctgctacgccgattcttccagggtcatcacaaagtatgaaaatcaatgtgccggaaagatcttaataccagaaggggctcccctgatggatcaaaaaggaaagaacataccttcctttctagtttgcagccttcatgctaactctccactcagttctcacacacaacacaccctctctagtactggttttgagaaatttatcgttcgagctgtctctgacacacgcacaacccggaagatgggcaataataatccaaggaagacccggagaaactggaagaaagaggtcagcaggagtagggtttgtatagatccgctgaaaagatatcctcccatgctagttagggatccggcctcccggtttataagaacaccgcgccatgtccctatagtagtatgcacagacacacacagacagacggaataaaataattaacatggccaggtaagtatagtagctcggctacttggcacctgctaaaaataaatgaaaaagaaaacgagaaaccccagaggagcaggacgccgttgcagcagataaaagaaacaaaaaagaacaaaaaaaaagaagcaattgatcagagaaaacagcagatctgcaggttcaaattgatgctggtttgttggttgtgtgtgttgttgtgtctgtattaattatacccggcgctgccgaactcgtagagcttgccgcggctggagaagatgatgagcgcgacctcggcgtcgcagagaacggacagctcgtaggccttcttgaggaggccgttgcggcgcttggagaaggtgacctgcctgttgatcttgttctcgatgcgcttcagctcaactcttcccctccccatctcgcccgatcgatcgaacgattcctcagctcagcaccgatcagcaagcacaggctagctagctcctcctccaccaccaccaccactgcctctcttcttgcttgctaaagcctccaatgatgacgagaatataacgagccgcgcgagaagaggagaatattagtggagtcgagtccggagaaaggacattgggcactgtaccacagtagtacactagtactagtagtagctctttgtgaaactggtttcttgcttgctttgacacacatctctctttctatctctctctctctccctccatcacaattcacaca

SEQ ID NO: 1780 - DNA, 8077 bp, Oryza sativa
ccccgccacaccacaaatatacaccgttgcgatgatgcatatatgcatatacacgaggaagatggccaaaggaggggagagggctactcccagactcacagtctctctctcttgcgcgcgcacacacactgctctcctagacttaacccaaaccatgtatgtcgccacctactggtccaatggaccacggcaccgtccggtagaggctgcccaaaaataaagaagcagggaggggaggcttaaggattgttttgccagcatctgtgctttatccaataatccagtttgcctttgggtgcatatgcatggtagagctaggtagtagtagtacttgtattattctcctctccccatatctttgacaaattccagttgccgggcatactgctcatgcatgattaatgtttttcctttccctttttttctctttttgtttttttgcgtagctaggctcgatctactgcacggttccaacatatattgctgcaggtacttcttgtgacttgtttagtaaaaagaattgcgtaaatatcatttgtttcattgtaactaattttatcattgaaggtatatatatttgcgcaaactatctaaataagatacatggttaaatatatgaccaaaagtcaataggatcgtatatttaaaaacagaagtagtaataaagaaggctaactttgcacgacaaagaaaattgcaaaatgatccccatttatagaaaaatccattgagcttgtgctctcaagcttactaataatgtaatcaacaaaacctgtgaattaattaagtcatgcaatagattggcactggtagatatttcaagagtaatattcagcaagggaccacatgcatatgatgcacagaattgaaatgacatctcaatgtacttgtgcatcagcaagggaccatatgatgtttgccctagctagttcacaaatcctgtgtctattcccggtcgtttctttattttttttatttgatgcattttaagtgggaaattcattttaatattttttcctcatgttttcttcgtgttcccacatcacaccatcgtcctagaaaccgtcccaacctttgacatcctttaagccacccactggtcatggtggaggcaattaacaggaggccagacatcctctgccggccaatggccaccttctttcaatctccaccagttggataagagttcgcaccacctctagcagcaatggtcgtccgaggtcgtcaacacatcattgcaggggagccgttggcttcctcaagtagccccatgagcacactgtcactatgatccactgtgccagatcctaccggcagagacgagaatgcgatcagggtggtggtcaagctaggaggataagtcggtagacacggggatatgggtagcgtggtaccaacaatggagcgtggtatgcgtatgctaccgtgctcatcacttgggggacgacaccgccccgatgaactggataccccaggtgcatttctgtcttttcatttgcacatgtgccttctgcgccctcatccattcaaaaaaatataaaataatggggagggcgatctctaccatgaaatcaattactacatctcaaagtctccctccaaaagttaaatatattgtgaggtgctaactaaaattaaccacacaatgatgatgtactttagcaaaatttgctagaaagaacggtatagctcttggcaacaaggatcattaaatctctcataaaaataatattcattttctttccgttaatttcttttttatcatctctctccagacaattcattttttttacaacagcaccggagagaaagtttaaatgaattacactgcaaatgatatccaaattaactatccatatcgtctataatcagttaactgaaacaacatatgatgatttgttagcatgcccattatatataagactttgcaatgtcacgactagataaaccatggaaaatccacaacttaaaacattctaacttgtagttagaacatttattaacattacccgagctaccatcatgttagatagaatcctttatataccactgaaaatcagtctgatcccttatataccactgaaaattggttcatcccctatatgccattggtccaaaattgcgcaccctatcatgcaacttccatcagttgactgtgttgaccgttaactctaaagtaaaaaagacacatttgcccttcttgagttgttaggcatgtcctatactcagaaaggcaaatacgtcttttttacttgagagttaacagtcaacccacagacaacagacgagagtggcataagagagtgcgcaaatttggtccaatgacatataaggacatagccaattttcagtggcatataagagattctctcgtcatgttacagtgtgcaccaacaagattgaacttgtcaagttaaaattatttttaactagtgttttaaaacatttttaagaaaacttttatacgtgtacattctccctagcaaaagaacttgtgaccgagatttttcattaaaattttattctgattgttagcgtagtgatggggatgtatatatggtttaaccctgtggacctatgttcgatttttgacatgcccacactttatttttgattatttgagatgcactttcaagtgtgtagttgtaggtgtgtatggttttaacccagatgtaggtcccgctcaattctcaacaagttcactctccgtccttaattattcttgtccgggtagcttttttttataatggcgaggtacattaattcaaaaaatgcaaaccactattatattacttgtgtacaatgataggcatttttcgcaagctctactttattggactatagctcatatggtactcatcaactcaggttttcagtgatttacaagttgtatgcaggtctttttcattctttgttgtagaacatgcatgtgatcgaacaggctctttcagagaggagagagagagagagagagggagagaggggggggggggagagctggctgagatgacctatcctatggaagacactgaacatcctaggtaaggagccactgacaagcagccagagagctacgtgtcgcccgtcctgtggcccgccttcatgtcgctggaaaccatcaaactgaagccgtcggtttcctccttgtcctttgctcgccggccgatccgtccgtctctctcctctctcctcgccctcaatcaatggccagctccggcatctccggatcgatggacggggagagcgctggcgagtgcgaggatgctatgcatgcacgctgtgtcgttggcgcgcattcacctcggggtccccgcacgcgcgggggggttgcaacaacgcattacgcatcgcctcgcgcgagcgagagacggccggcgagcgagcgaacgcgccgtacgtaccccgggttttcctcgccgatccatcgtacgccgcgcgcccgcgcgctaacctagctatactagctccgccccgccgcgccggcgcctcagtctcctcctgactcctgtcacgtccggcccgcgccgcgccgcgcgcccgtccgcgcgtagtacagttgatgtacataggcaagggaattaaagcgcgttcgatctggctggccgcgacggacgattccctccagcgccagaacgggaaaaacactcaactactcaagtagccctccctcccctgtggcatcaatgcggcgcatatctttcgcttagatctcccctgcatcactcacacatccaccactgactgggccggcttggctggctagccacgccacgccaccatacacaaaccgacccacggcacaggttcgatcaccaccccgaaagtgtcaatattccttctcgaaacgcagggagagcatgctccagtcgtacgtttccattgccggccatgctagcaagaaaagctttgtggtggctacgccacggagggaaggagagatcagacattagatcgttgcacaaactgggaaaggctagatcgcagagagagagagagggagagatcgcccaacgatcggttgccattaatttgctgggtgtagtagtgacatctcacagcgtcgatcgtctgatggtgttatcagataaaaagtatccaaaatgatcggcgattatacatgcaagatctagcaagctggggcaatttaatctgtagatcgaactggccttgagccccagaggcaatttaagttggtcgtcctatccgtatgtctcgtatatacataccacctccgtctcataaaaattgaatttctaccttttaacttctgtaccataaaaattgtatttctactaatatgggacccagtaaactaattacattttcttgtaatcttccttccttctatcccatctctaacccattatctcaacatttcttttaatcaagtttatatatggaatatgtgcatgtattgtatttattaaataaggttattgtagtcatttgcctatcctcctagtatgtccttaattctttagaaatttattttttatgggacagaggtagtacgtcgtatggacctcaggataggtgttacacgtacaggtgacttacttgcagggtcatcatggacataagcatccttgcttttggtagtggaagatgttcatgcagctagctctactggcagctagcgcatgtactcatacgtaccagctggttggctagctgaggtacgtatgtgacgggaagggccaaatcccacattttcagggcaggttttgcgcaacatggcaggtgtacgtgatatattctcctcaggctgtgactttctatagactgtatatagcagtataggctgtagatatatacgcataccaggtccctttgtgttaagtactcctagctagctatgcagatcgatgccgaccagctacactccgtaaagaaagtcttgatttgattgaggtaaagtcatggcactagaatactggatagcgatacgtagatagtatatccgtatacatgcctcgatctatatactagtctctccatttcagattataattcgttttgaatttggtcaaagtcaaacaacttcaactttgataaagtttgtagacaaatatagtaacatttacaataaattagtttcattaaatctataactgaatatattttctttatatgtttgtcttgggttaaaaatgttactattttttcttttataaacttgatcaaacttaggttgtgtttagttcacactgaagtttggaagtttggttgaaattggaacgatgtgactgaaaagttgtgtgtattaaaggtttaatgtgatggaaagttagaaatttggaaaaaaaaactttggaactaaacagggccttagagcaatttgaatttagccaaagtcaaaaataacttataatctaaaagggagggagtacattattgctctccagctatcctgatcttttctctttttgtttttgcaaggatattatatatttccttgcgctttagattacaaaaggtgtgctaggtggtctcgtcatgtatatcagagtactgaacccttaaaaccgggaacccagagcagcggcagttcttgcccttctttcacgaacaagattttacgaatacagataattttcaacgtgaagtagtgttgtagacttgtagcttagccttgtcctagtgaacgattgagtacttgttctttatacaattttctcccatttgttagtactccctcgtactacgaaaagttcttttaattaagtgattctcaggcagtttgatacttcggagaaatgacttatgtgccactcatttattactggagaaatgttaataataaactcttcgtggacaaatttgtggactccaaataaacactttgtagcataaaacttaaaataaactctttggtaaatagaggaagcaggtttgacccatgaccaagaaaaaaaaaaccttttattaaagtaagagcatattcatccgttcccacttcccagatatctcatatatatattttatatatacactccctccatcccaaaaaaaggcaaaccctggctatgtatcagcatgtacagatatatgtccagatatatatatatatattcatattgaaaatgtgggtgcaccagcagttttctattttcccatatccaaaaaatatataccaatgaatcaccccaactccttccgaatgaagggggagttgcaattcccccaataccatagttgatcctccgctacacctaaccgccaacgctagctcagccggccatcgaagacaccatgaggatcgcctggaggcgttgctcggcccccgatgaccattgtccacgacaggcgtgctgctcggtacttgccaaaaatctaccctagagctccacccgagttcatctaccgccttgagctcttacgaccgccgccactcaaagcttaccatgctatcagaggtctctctatctcgtgtgcgtgtgtcacatgggacccattaatattagggatatgatattagggagctataaaagcacatcgctaaaatttcttattatagtagtattgggacatcccaataacctgtttatagagatggaatattaggagactgctggaaatgctattaccaacaatttaccttacatgtcacctagctagttacttatctcaattagagacaatttgtaaccacatgtaaattgaagttcgttagtttaccattaaccactaaatcctagtcctacagctgccactaagagccgtcagattaatctaccatcgcatcatagccatgcatatcttatccctttgcaagggatcaatccaaatctaagaaaatctccttttctgcaggaaaatctaagaaaagtctgtccctatatatgtcccaattattttcaaaagcactataccatctaaagtgttgagttggcttgtcaaaattaggttaccacacatcacagtattccctttgttccacaccagaaatcattttcggttttgttctaatcatcaatttaagtttaactaagtgtagaaaaataataacacctacaaaaccaaactagttttattgaatccagcaccaaatttattttaacattatatttgttttgtgttaaaaatgttactaattttattttataaacttgctaaaacttaaaaaaaataactataattgagtaaaacaaattgagctgtggttcgcttaaaaaaaattatcagtggtcaagtgatgtcgtacaacacatatagggtggtcatccttccgggggcgcgtgccatcaacgccaagccatcaaccccgccagtcgccaacttcagatcggcagatcccgcaataataatgacactgttcgtagatgaatgcgatcactgaacacacgtactgttttttttctgtggtgttccatgacgagtttcatgtgtgcgctgggctagctcggtgattgctcgttgggtcacacatcacacaaccgattgcttttgctggaggcacagttcgtggaaggaaatgcgttgaatcgagagaactatttcgactaaaagctgtgctttgccggaattggcatggttactgtttgggccaggagaccagttactgcaatttcctcgcaacatcgatcaatgtgagccagcttttgacggggccttgaagttatcacatcatgagggaacaagttcactttagctcccttaacttgacattgagtttgattctcatccttgatccacataactatatacaacgggtccctgaactatcacaaccggtgcaatataggtctcatggcggtttcagctgacgtaacgcctacgtggctaatttgactcagtttcatctgacgtgacattgacgtggcacatgaagcaaaatttaacgatttaaaaatgaagcaaaatttaacataggcgcccacatggcaattaaataataagattaaaaaataatgtgacctacatgtcagtgggccccacttcctcccctcatcctttctcttctctatctcctctcctcccattctccttctcccatcttcccctttctttcccagattcggtcggcatggttgtgcctggtggtggtcatggccgccggtggctgttgtgtggatga

SEQ ID NO: 1781 - DNA, 7701 bp, Oryza sativa
gaccaccacatacaaccaccacagtcgtgccggctaaatatgaggaagaagaggaagaatggaggaggggaggagatagagaagggagaggatgaggtggaggaagtggggtctactgatatgtgggtcccactatttttaaatcttattatttgactgacatgtggacccacatattttgttttattttttaaattgttaaatttcgcttcatgtgccacatcaatgtcacgttagatgaagatcgagtcaaattagtcacgtagatgctatgtcagctgaaaccgtcatgggacttatattacattggttttgatagttgaagtacccgttgtatctggtattgtggtttaaggattaaaatcgaactcgctctcaggttaaaggacctattgtgaacttattccgatcctgagtatgttgcacgagaataactatattgggccttctctttctcggccggcgggatggcccgtctatccatccaccgttggatcatctgtcggctgcggctcgcgttgaaggcttttggcctactagcgttgtgtgctgttgctgccgtgtgccgcttgcagatgcgagagctgacagtttggctgcagtacgtgatgctaccttctctttttctcctcaaatgcctccatgtatggtcgattctcgttctacccctgtcggtctctacttcgtttccatgtcgattgcaacatctgaagtaatcgtttcgatgttcgttttggtctgcggtccatgtcaaatccaaatccgaaaagaaaaggtacaagagatggtatatctttatccgaacttttctccgtgcccttcttttgttcctcaccatgtgcaaaatgttcccgtatataaggccatactcggaacgggaatgccagaaggagaacgtgacacgtagctgaaaggctcgctcgcgagtggacgactggacggatcacggatgccatcaacgtgcgtttccggctcggaggcgttggcatacatgagtggagagctatggagcgacaggctcacatcgcgccacgacgccaggttacgcaccgttgctagttgctaccatcgccatcctccgtacgtacaacacggctcgttttaatttcgtaatctgcttgctgttcctgagctagcttccgcttcgttcgggttagccggtggccgcctcaaacgtaagcggagcgatcagatccattggcagcgcccggttaacaccgctcgacagaacgagagggagccaaacgcatggaggagcctctgcgcgttgcttctgacttcttcagctgttggggtcagcgtctaagcgagcacttgtccacgtgatatcgcacacctgggagggtcttgtaccacgcgcgcgcgggccacaggtcgcatacttgcatgccagcgaagcgagagattctttgctctgtttcgtcaacccgtggacaggtcacaggtggacgtgtgatgctgcggacgttgttctcagaaccaaaaagaggaacaccgaaacgaaacaaaagtatcaacaatagatgaacagtggaaatatgctaagtttgtttagttcgcgaaaagaaaatctttaggtgtcacatcagacatttgattggatgtctgatgaaattttcggacacgaatgaaaaaactaatttaatagctcgcctgaaaatcacgagacgaatttattaagtctaattaatccatcattagcacatgtggtttactgcagcacttatgactaatcatgaactaattggtctcaaaagattcgtattgtgattttcattcaaattgtgcaattagttttttattttatctatatttaatgctctatgcatgtgtcaaagatttgatgtgatgttttgaaaaaaaaattagaaggcctaatggaactcaccaatcacaagatcaaagcgacattttccacatacagccgccgtcgggcaccggggcagtacagcgagagaaaaaaaatccgtcgtatttttttcacgaaataaataacttgaggggaacaagttaaattgagtataccagagttgaaattaagagcggcacaaggaaattagaaaatcacgagaattaggatgtcatcggtcgcccacccatgtgctgcacaggcttatatatttgtactttaaaaggtttaatcatgccgtaaatatgttaggtgttttttttataacactcagttaaattataaaaaaatctagtacaacttgctaattactatatcacaaaagaaaaaagtacgaactacccccgaactagcgcggtcgtccgaattaccccctgaaccacaagaccggacattcttcaccccaactatgtaaaccggacgaattaccctcctcggctcaatccacggtggtttttatctacgtgtgtacgcgtggcagtccagtcagcattctatttataaaaaaaaaaagtgggacccacatgtcatactcttcctctctcttctctctctcaatctgtctcactcttcctttatctctctctctctctcacaggtgggttggcagcagcgggggacacggagcagcgggggacccacatgtcatactcttcctctctctcttcctttaccccccctctctctggacacagccacacatgaggcagctggtgggtgcggaggcgaccacgggcgggtggcggtcgaggagtcgaggccggcgacaggcgggggtggagaaggcagcgggtggcgggtgggcgtgaggctggcgacaggcgggggcggaggtggcagcgagcggcgggcaagcgcggcgaggagccaaggccggaggtggcggcatacggcggaagcaaggctcgacgttgatgccggggaggctgctccgccttgccgcctgcacgaacgaggtccacatccgtcgcgctcttcctcccgcccttgggcccggttcgctgtgctggcggcggcgcatcgccggtggacgaggataacgtgcgacagacggggaacgaggcgcggcgcgacggctctattaacaaccaaatttggtaatctgagtatcggagatgaagataagatcaaagcggaattcaagatggaaatcgttccggaaatatagcaaggatcggctaaagtccgaatcggctgagaccaggatcggcagagtccgagttggacaaggttagccgatcaagccgataccgacaatatgacgtggtacgcgttgtcgggttgagttaatgtgcttcatgaggattgccatgcatggatagagtcctgagaaggcaattgtatctattaattaggatattttatgtaattttcttagagatatatttgggcaaaagtctgccacaaagacttatggtatcttagagtttgttagagataagagtcgtgtccgatatggacatattttgtaatctcggttataaatagaccccgaaccccatgtaatacaacaacacacgttcaatacaatctcggtgcatcgccatccttttacttttgttttgtttcgacgagttcttgctttcgggtagagctgcattggtttcgatcttcaactagaggtaaaacttgttatggcggcttgcgttctcgggattagtgcttccatctttatgatactctaatcttgcttatgtaattcgtcgagttatcatatattctatataatctttggcaatattgttatctaacctccagtcggctaacatctgtcgctataaggcagccgattaggttaaataccaatgttgacttaaattatatagaatatccaccactctatgaaacatccaacggcttgattgtctagatattgtccttcttttcatacttatagctgcatcagttgagtttgaccttataagtcgtgattagaatctcaatatctagcctgcttttggttgccgattagggtagcatcggggtttcagccgattttatctgatttaactacttttattttatatgcttgattgacatgttaagtatgccttttatattaagatcttgttgcattcaagtatagtaggcttttgtttagtatattctacttgctttaatatcttaatatagagtaatatcggagtattagccggtacatgctagatctatctgatcggctatgctatgaacatatatagtcttgttgttaatatatatttcgataagtgatttatactgtctcgacatggcgaccgatctatcccaatcacttgattcaagtatatatcgacataaagattatatatcgttaatatctacagctgatcgggtagatttagttctttcttgttcattcatgattgccgatcgattcacatatgacatcggctcagagataaatgatacgtcatcggcaactagccgatcagctatcgtttatggatttaaccgcgttctctttgtttttatttcttgttgattgcaggatcaaatcaactggcatgctcacacacttaaaggcaagcttttggacctgcactggagttaagcagatctctcaggcctcgtgttttcacatcaacaggctcggaggaggagccgcggcccctgcgctcctacgacgagaaggaggagcccgccgcccacagcgcttgcccgctcgcccggtcgtcctccgcctccgtcgccggccgctgtcgtcctcacctcaccgccgccacgctcctccaccacctccgactccgtctccgcgccaacgtccacgctgtccgcgccgtcctcgccgaccacccgtccccgcgccgtcctcgccgaccgcccgcgcccaccgcccgtggccccgtcctcgccgtgcgcgctgtgcgaaagagagaatagagagaggggaagaaagtatgacaggtgggtcccacgttttttattaaataaaatgctgactggactgccacgcgtacgctacgtagaccaaaaccaccgtggattgggtcgaggagggtaattcgtccggtttgcatagttgggggtaaagaatgttcggttttgttgttcaggggggtaattcggacgaccgcgatagtttgtggaggtaattcttactttttcctttcagaaataaattaataaaacactaaatctagagtgatatggattaatatttattatactttacaattattaaatataggaaaactgaagagttcataatatttacaattgcatattgtatctaacgtgagttatcaatatgatctacaattacgataatacgaactatctaatcaacaactagatttttctaattagcgtgggagctccactcgagtgcaaaaataataaaggtataaataaattttgtaataaacatgagaaattttgaacgatacgtatcatttagatgatacacatggaagaaatgtagcattttagtaacccgtggacggtccctttttaaagcaagaaatcgttaaaaacaccgggtaagcgcctataggagaacgatgaagtcattaggaccgaacatggatggggcaagttcctcgattttgtgataacttctacttctttataaaatgtgtaattttacgatactttgcctcaatacttcatttgataaattagtcgctaactatatagttttgtgataaaaacatcttaaatatatagttcttccgatagctaaacaagttttgatgctaccaatgtattggtggagatttctattgtttggcaagttttaaaatcaacccaatcaaacaagtactatttcgtgtaggataagatttgacaccaaaccaaaatagtcctaacacccgggtgcaactagagtaaatgctcccaccatttgtcttataatttacaatccactgatagaatttaaaaattaaatatttttaaatttaaagttgattataacttctcccgtcgtaatttacatctcgcattaattttttaatatctaaatacacatatactcccaccatattataatattataagttgttttgaatttttttcattcaaacttatttagatttgaccaagtttatataaagatttaataacatcttcgacctcaaattagtttcattaaatatatccttaaataaataatatgtttattttctattaaaaatattactatatttttataaatatagttaaacttaaaattattgattataaagaaaatcaaatgatttaaaaataaaatagatggagtacatattaataataggccaacggataacaaccctgaccaggcagccggcctgtcaccgggtgggtcccagggagaatgtgaactaatactaggtgggaccgaccaggccggtggcacagtggggtagtgttgaccgctctacacccttcgttccataaaaaactaatttctagaaataaatctagataaaatatttgtccagattcattctcagatattatcttttttttcttttcttggccggagagagtactcggcaaagcttccgggagtgtgggttcccaggagggaagtatgggcccacgaatgttgttttggctacaatgaacttgttggcagttggctgaggccttgttggttgccttggggaagcaatttcgttcgaaacattcggatttgttcggatgtttgtctgttggattttctgcaactattgtttcccaagctaattaggaccactacttatcccatactgtggattactacatttgtcccaaaatagttataattctaaattatttactatataataagattttaaaagaaaaaaaaaatgatgtccctcattaaattgtgtatagataaaagtgagagagtaattatttagcatatattaagattttagaagaaagaccaaatggtgtatagataagaattgctgagtgagagaaagaaattagaatgataagtgattgttgagataattagtacactattgtgataattattttgagacaaaattaaataaaaaatacaattattatgtgcctgagatagtactatttaactcatgtttagtagtagtatcttgctaccttgctttattctcttttctcatctaataggttgacatatcaagttttaatctatgtgatatattatttaatgctacgaaaatcattgtatgagaaatactgggaccacttgaccagagagcacgttttaattataggacgtgattggtttgacagtcctctaaaataaacttcgactaactctttttaattaaacttcttttaacttcaattaagtttataaaaggactgtttaacacatttttcgcgaacgtaaaaagattgcacgtcaatatattagaagaaaaagaatttttgttacacaacgtaataagcaagaccggtttatgccagggaagggagaaaaaaacaaaacaaaagttgcagcaaggaaaaggagaaaattttactacgacggctaaatgcaactccgatcagcaggaagggggcagagccacactacactcacatgaaatcccaaagactttttaccacaataaaaaatgttcaagactagatttaacgaaactaatttggtattcaaggcataggtacatttttctataaatattgtcaagcttaaacaagttataaaaaaatttataatatgaaacgaacagggtagcttcccatgcatacgtgctcaggctaaactatgatactctagaatttatttttgaaaactatttatttatgcttacataagagtaaattttagaaaaactacaactttagtgataaaactatcagtatactacaacattagcgacatgttt

SEQ ID NO: 1782 - DNA, 527 bp, Oryza sativa
  unsure (1)..(527): unsure at all n locations
nnnnnnnnnnnnnnnnnnnnnnnnnnnnnnnnnnnnnnnnnatcaatcgatttgatcacggcaataatgctgcatgcgggctcaccttgtggattaacgccaggcggatgcgacagtgacgacgcggcccatccacccgaccccgagccggccattgtcgagcttcacgtcgaacgccggcagcgcagggccgagccgagccctgacgcggccgccgatgtcctccccgatcgccacggcgcggaaccccgccatgccgaaccgggcgcgccacttgccgaacacctcgcaccgctccacccggtccgggccctcccggcccaccgcgttggccaccttgctcgccagggccgcctcggcccgggttctgtccgcgctgtcccggcccagggtcgcgtccagcgactccagcacggcgccgtagtgcgcgctcgcgtcagagaagcgcgccgccatcggcgccgtgttcgtgttcagctcctgctccaccaaggtcacgacccgcgggcccagcgcgcgcacgcgcc

SEQ ID NO: 1783 - DNA, 9625 bp, Oryza sativa
  unsure (1)..(9625): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtttcttttcttgcattatctgttgggactatactgtaatgatgatattatattgtaatgatgatattaggttgcatttctttcttcttttgtgctatatatattggaaacctccatagctattgaacacagcacacgcagactagtacaaatgtaacaccatgatgacatgatcagtggcagaaatgatgttcataacggtattatatattgacagaattatagcccatatggactttaagaagatgtaaggttcggtagaaattcagaatgatgctcctccttatagtcgaggagtaatagaatcacaaagcaaaaacattagggcaggaataatcaattttacctagtatcggcttgtaattcaaaattcttggctttcagatatgtgtttattaatttatttatgcaactgcttccagttagcacttcttttttctaagaacctaatgagccatgaacaatgcagaaaacttccttctgtaacttttgatgtgtggttcaacaagtagggacacggttttttttttcaggaatagccaataccccaacactttttttttctcatatcaacactcgcaactaaggagtatgaaatactcgtatgaactaaagcggatttctaagttactactgctaaataatgccacttctccgatccaccatagactaatggcgagaatttcatacaacaacaaccaacatcttgcagcaaaacaaattagtggaattccgtaacgagatgattcaggccagtacggtgtagtttcgagtttatcacctggtgggggcgccgcggcggaggggaggagtagccatcgtcgctcgtcggatccctagaggtgaggtcccagacacacgacgagttcaccgggcgccgcggcggcggagccaggaggggaggagtggcgcacgacacgatctaggagatggggggttgggcgcgccgcgcagcgccgccgccgtcccgctcgaccggcggcggcggccgccgcttcgcgcttccgcgtgccgtttcgggcttcacgctcccggtgagacctagtattggaccgttcagcagttggcacaagtttctaaggaataagttcatcggaggtcccttaacttaacagcgagattttttgtggtcccttaatcacaaaaccagaaatcttcatccctaaaatatacaaaaccgttcactcaaggtccctaggcaatatatatgggtggttttgctgacgtggcattctagtcagaaaaaaaaattaaaaagtacgtggggcccacatgtcagcagcacattgtttctctttttcttctccttctcctcttttctctcttctctctttctaaactttagtgagggaggccggcggtaggcggagaagcgcgcgcggatgcaagtggtgcagcggaggacgagcgcggcagcggagcggccgcgggcgcgagcgaggcgggccgagcagtggagtgcgagcgcagcggcgggcaaagaagcggagggcgagcgtggcgacggagcggcgatgggcgagcgcggcggcgggtggagcggcggagtgcgagccaggatgcgggtggcgcaacggagggcgagcgcggcagcggagcggcggcgggccgagcagtggagcgcgagcgcgacagcgggcagagaagcggagggcgagcgcggtggcagagcggcaatgggcgagcacgcggcgacccttctgccgccagcgacgactacgaggaagacccctcccagccttccctccttcctccttgagctccctcgcaccggcgccggtgctaggggcggaaagctgacagtgctggccgtcgtggttagctcgcttgccgcagcaacgctggtccgggcactaactggctgatgcttctgcggatcgatgccctggctcaagagcttgagcttgatgcgcgtgttccacctgcaaaaccaatcaatcagcaccaagaacacaagaagagctaaccgaagcagatggcaacatgttgaaatttgttttgcttacttgttcccgagagggcgtggagcctgatggtgagctcgtcgtcgtcgtcggtgaagttgccgcgcttgaggtcggggctgaggtagttcatctagtggaggcagcagctctttttggcagcggagtagccccaccgctttggggagggagagagggttgaccgggagctccgctcgccggcgggcggtgacgggacctgtggtcgagcacccggcgcgttcgaacatctccgccgccgagctcgccgtcgagccggccgccacctttcctcctctcccgccgctgccatcgggcggaccgcctctctctccctctcccgctgccgccgtccccgctccgccgccggccacctctctccccctctgtcgccgcgcctgctcgagagaactcggagagaagagaagagaagagagaaaaaaaagagaaatgtggaacccacaacattgtctcacttactcgtgggccccacatattaattttaattttttttgctgactaggatgccacgtcaataaaaccacccatatatactatctagggaccttgagtgaacggttttgtatagtttaggggtggagatttctggttttgtggttaaggtacctcgaaaaatctcggtgtaaagttgagggatgaccagtgaacttattccagtttctaatggcccagatgaatgggccggtcaaagtgggccgtatcgatgggggagttttttttttggaataagttcaccagaggtctttcaatttaacagcgagattttttttaagatcacttaactacaaaaccagaaatgtttacccctaaactcacacaaaccgtgcacacaaggtcctatggcagtatacatagttggtttcgctgatgtgtcatcctagtcagaaaaaaattaaaaaaatatatataagacccacatatcaactgcacatatttttttttcttgtcttttcttttctctcttatctcttctcttattgaggcctgcgctggcggagagccggcgggcgagcgcgacggcgggcagagcagtggagggcgagcgagcgcggcaggcgggctgcggctgttggcgccccgtttccttctattttcttcctgaatgccgtcggtcggaatgggtgggtgaggaggccgactattgctgttgctggcgcccgtgccgcccaactccggcagcgcccgagggaggggacggctggatccgcgcacagtggcccgccccctcagccaccgccgctctcgaggacagaggagctcctcagccgcatccacctccgcacaacagcaagggcatcaactaccagatcctctctccaacctaaccgtgttctcaccggcagccgcgagacgcctgagaggaggaaggccatgcaggctgcgattctatgtgcgcgtgcttgctctgcccatgcaactgtggggttcctatggccactgtatctttttttcctctcatcaggatggcgagctgagcttggcaaaccccatgcaggaatagaatttagcttcttgtttttatgtttgctcttctcctttccggttaattgtgggtgagagggagctcaaggtggaggaagacaagaaccagttgcccatggtggtggtagcagcagcgagtcgacgcccgtcggcgcactggccactgcattcggggtaaggccgcatcgtgtggtccgcgtccaggagcaaggaccgacacaacaaggtgtgcacgaacgtctccgaggtcgcctacgccgtccgccgcgctcacccgccgtccgctccgccagcagccagccgctgctccgctgccaggctcccccatcgccgcttcgcccgctgccggcctggagaagagagaagagaaaagaagagaggaaaagaaaaaaaagatatgcagctgatatgtgggcctcacgtaattattttttctgactaggataccacgtcagcgaaactacccatatatactgctatagaaccttgtgtgcacggtttatatgagtttaggggtaaatatttctggttttatagttaagggaccttaaaaaatctcgctgttaagttgagggacctccggtgtacttatttcttttttttcttcttcttcttctcttagctgttttctttttccttccggaaaagggtactcccatatgcttagagaaaaaatacatctcaaaatttgttgcagtatctactactagttaggtacaatggctgaaagtaagcttgctcgaacactcgaatagtactcctgatattcgcaactagcatatatactactaaaatacaagtcttctatttattaataaataatatcgttgacttttggacatatatttgattattcgttttatttaaaaatttcacataaatgtataagatataaatcattcttgaagtacttttaatgataaaacaactcgcaataaaacaaatattagttatgtaattttttaaaataagatgaatggttaaatatcattcctaattaaaatagcgaagctaacgtagctcaatgggttggttttccggtagaaccaacccacccgaatctagtcctatatctgacacttatggtcgtatttacgattcacctgtcgataatgaggttaaacgcgcttgtgtttgtatcgtatttctcaaacagaaagtaagtgaaatattctgctatttagccagcatggcaagtaacaagttcaagttctcattaacaacatatcctctgtccatacagttttgatccaacgatggcgacgccatctttggtttgctctcaacgagtctgtagtgtacacgtaaagtttgttatggcttttgtctggcacggcccaggtgaatgatcattaggagagcttgaaaagaggagagccattcaccaactgatcactcaacgccgccccggtgtttcttctgcaaaaggaggagagacgttcacgctctctcccctccaccattgtgtctcgctatcgaccttctcttgtacgctcaagctacacgtcttttcatcagcctagtgacatacaatcgccatactgattaatgaaacgttgtgcgtcacatgaaattgagagggtgtgttctcaactaagttatcctaatttttagttttcggttaaatggtatgtttattctcaacagttaaacggtgtgttttctttataaaagttgttttcataaagtcatataattttttttaaaaaaatatatcttttatttaattaatcatatgttaatctgttgttcatttttttcatgctaggagaagtgttcccaacccaaaacaaatgcatggtgagaatttcaatgtttaaggtggcaaatactaattccgtttcaaaatactcctataactgtaagcatatatattttcatgttttctaaacttttgaaaaaaaagcatagacatgcttatattttagaatataaagataataattaactgggcgcagagttcccaagactcaagtctcgtgttgtcacctgtcagaaggcgagatactctggttgttgttacggataaaatataaattttagagttaatttcgaggttttcttcgtagtttaaattttttagaaaattcaaaaaaatctattgataaacactcaatttaataaagactttatcctagaaacatcattgttgttatggttctagctgttcagattcgtaaatatagaatactccctccgtcaaaaaaaaagacaaaccatgggtttccgtgtgcaacgtttgaatgtccgtcttatataaattttttttataattagtattttcattattgttagacgataaaacatgattaatactttatgcgtgacttatcttttaattttttttcataatttttttaaataaaacggacgatcaaatgttggacacggaaactagggttagccttttttttcggagggagtatttcacatcggtattaagtttgctgttcactgggctccacagtcctttggacccacatgtcagtgaagaggatcccaattgtgttatattagggcggagggagtcctaataacacgcgcgacgacaccgcgcatcacatcaccgatcggcatcatgagccatggattttggtgtaacccccgcgcccccgcccccgtgctccgtagtggaatagagtaacatgctcggagacggacacacgatgggatcgcccgccgcccgccgcccgccgggcccccgtatcatctgccatccgcgcccgccacattcaccgcttcgctcggcccgcccgcgcggtcgtcgctgcacgccgagcccaacaaacaaaccgaattagcaaagcgccaccacaagcagcatgggttttccatgcatctgtccatccaccgatcgatcgatgaatcgatccacacgcatgtgtcgtcgttcgtcgacgaggcggatcacgtatgagctcgggggcttttattccctccgatccacggctgatcggttggtggggttggctggctgcttgctgctgcctgctggtcgtcgcatcggctggtggtggttggccgcccggtcggtctaacccaacccaacccaactcacatctctctcaggtcagagatacagggcatgttcactttcgtgccaaaaaaatcttaccaaattctaaaattttggcaggatttcttatatagttaccaaaatttggtagcaaactaaatatagccattttttagcaactttactaaaatttcataaggttaaaaatgacatcaaagtgaacaggcccgtagatgcactagtgcttttctcttttttttcattcgttttttttattttgtttgaaaccaaactttttttaacgatggatggaaaggcggtgggcatgattatggggtaaaaaccgagcaatggagcaagcaaaaaatagatgaaagcaaaagaggcaggctaaacaagacaatggggggtaaagtagtaaagaggggacaggagtaaagcactaaaacgttgttggggggtgggggtggggggaagggggttgttaattttcacaaaactatatgagattagtagaggtagttaaagcgggaacgtattatatacacacaaatttttcaatgtacactttatacaaaccaactagtaaatatcacaaaaaatatataaaaaattggatacatactttcagtagtattatacctatgtgtgaaatgttatctttaaatttattatactttcaatattataccatactatgccaacttgaatatccaattaactgcgtattttgactgtgtatagattcaacgtggttatccttctttactgctcttaatttgttatttcccgcgacagtggcatgtgtgagtgtgactaaggagaaaagtccggtttggtggatttcttattataagcttggtaaggaaaagtccagatccaacataccgcatttaaagtttgttaaaaaacaaacaaaaacatggatagatcacacacgaattctcagttattccatgcagatacatgaatgagttgctgttttgtttttccatactcataacattacacaatgttacaaaatttagaggcgacgtcctaaggtctttagtgtcttaattacacgtgcttttaagctttattgattttctttaccggaatttttgccctttacttgtcattttcacaacaccaacatacataccatgttaatagaacataaatagatcttctaaaacttactagcttttcagagggctaacatgtggaccccatagctcactatatttcatatgaaactttctatataaaaattgctttaaaatattagataaatctatttttcgtgtttgtaatgattaaaattcaattaatcatgcactagtggctttttccgcacttaactttatcttcatatttagtagaaataaataccacctaagtttactatagttgtctactatagtcttttgattccgtcaacattgcgcgggtattttaactaacaacgccttatttttctataccttttactatgtcttacactatatgagaaatgctataggcactactagagaaatgcctttctggtgccagttgccaaccacacataagtgccggatttggcaaccgacacatcgcaggtgggacttttgagttctctcaaaggtgtcggcttcaagaatcggcacatttgaggtgtatggatcacaaaaaaagagtacggctcggctccgctcaattcgagccgatgcctgcaaaccaaaaaagaaatcgaaaaatctaaaaaaaacatcggttcttgttcatcacaaacaaaaatcatcaacaaacaaaaatccaccgcaatcataatcataaacaaaatccgtcgctgcttgtggggagtccgccgccgccgacgggagaccaccgctgacgtcgtcccggtcgccgccgacccccctccccggccgccgccgaccctcccgccggatctagcggaggggagggcgccggccgctgctgccgcctccgccggctagccaccgtccgcgggagagaagggagggagagagagaagggaaggagacagagaggagagcgagagagagggaggagacgagagagaggagattgaaacttatctccttgtcgcctcgtcatggtggggcccgccggtcggctcatctaattactggctcggctcgatgacacctatattataggtgtcggtttttaatgaaccgatacctataatatattaaaggtactttttttttaaaaaggcacctatagaataggtgtcggtttttatttagtgccggcaccgataattgtttaaaggcgtcgttttattgcgatttcaacccacgaaagtgggaaaagatctataggtgtcggtttcagcacttccaagacctacttgatgctttgtagtagtgagggatgcatttggtcaattgatttacacataaattatggagataatgtgttaccgctggttagcatgaccctttgtcgtatcagcaagctactattgcgaaagatcttgtttccatatctttataaaaaaatataaatacataaacatgcaataataatcacatggaatatcaaaacatctcgcggtagtccatagaaaacctaaccttacacaaaagaaaaacaaaagaaaagacccccaaaaagcaattaaattttcttttaaacaacaacagaaccttagacaaaagaaaaacaaaagagaaacccaaaaagcaattaatttttcttttaaacaacaacaaaagaaaagaattaaagaggcctgcgagaaagaaaaagagaggagagagggttgagaaaagagaaaaaaaaggaggcacgcggccagggacggtggcggtggtggcgagtgggcagcgtcgtgggcggtggcagcacaaacaagcaaaccttcccaattaactcctcccccca

SEQ ID NO: 1784 - DNA, 8901 bp, Oryza sativa
ccactagcagcctcagctccaccgtcgagtcgttcggcacccggccgcggccggtgctcccgccgcggccgcccccgccgccgccgatccccgacggtgactgccgcagcgactgcgggtcgtcggcgtcggtggtggacgacgactgcgcggacgccgccgcctcgccctcgtgccggctcccgttccagttcgacctcaacctgcctcctggtggaggcggcggcggcggcggcggctttggctgtgcctacgacgacgaggagctgaggctgacggcgctgcggctctgagcccccaaccccaccggtcgttggagaaagaggaaaaggagaaaaatatttggttcttcccttctctcgtagccgacatgatccttccgcgctttgtgttgttcttgtttacttgatctgatgatgattaatgtggcccgatctgcgtatctgcctgcttgctgctggcgatagatgatgattgctgcgtctcgcagcagctcgctgtggttgtgctgttgtaatatagcaacattttacttgcttccttcctgtgaggaagcagacagctaaagtaacttattttcaatctttagctacatgtgctcatcttgttcttaccctttatactcttttagtttttctttctttttggaattgggaagcttgaaacatcccacctatttactagaatagtcagaaggcttgtagcaaacaggaagcttaaatgccagaaatatacagctgaaattcgttctgttaaagcaatgatctagatctgcataagatcgtcttgcttccttgatgcttgtgttgttaacatgttattatgtcgatccacacctgttgttcctacatctagtttcacatttgctttaaatttgtgttatagcataagatcgctttggatgttccatataattccatgtttgtgtgatcaaaagaaattcatatgaaccaagtttagaagctattatttagtgggtaatacataaagaccttcagcatgaaataatgtagcagcctttggaatttagctgaaaaccattagcatggataatttggcatctgattagctgattcattgggcatcaagccataataggctctgttgggcagccatataagctgcagctgctgcggctgctacatcagaaatttgctgcaagctgcagcaatccttaactactgcagctgcagccgcagctgaaaaataccagccgaacacacccataaaagtggatgattctatgtggtgtaaactcaggttaactgccctgtagcaccatatgacattggcgtcaagatgataacgggattaattcttgcaggtggaaaagttatgctagtaacataatgtgttgtggcctaatatgcggaacatgtatttttctaatatatcattgttttgcaaataatcttttctgtatgatatagctaacatttgtttttgtgttttgtcaaatcttatgcctacactgatttgcaggctttcccactaaacctcatacctgttcttctgcgcaacattggcaatcttattagggttctcttgttacatttatgggaggaggcattgaccaaagcaaacgacaaggaaatattcttacataaatgaagttagtaataagttttgttagttgcatgatactttgtttatatcaggggtgatagtttcttataaataattaagttccattacaaatataagggtataatatgcctatgcacctaactcactttgtttttttaacgcaagtcatgattttatcttgaatatcatcaattcatgtccgtttgcattatcctttcttttgtgtgcattgataacattttattctgatttcatcatttatgttgggatgcaacaaaaatgtgctggctcctttctcttaatgctcccactgtttcaatttatgcgaaatttggatatttagtgtcatctagaaaacatggtctgggaaataccattgtagcatatatgaaaatgtagacatgttttccataattgactttgcaaattatcatgctattcgcctaatcagaatctgagcatgatgcactctggtttttttacctaataatgtaagttaatctttaacacgcgatatactttctacttgtagcttcaggttatcaaaattttctatgttgctattaactttggtcaattattatgcagttatctacatgattacatttcttcttcaataggaaatgtccatctgatctttaaacatcaccagtgagaacctatggtaggaaaaagtagtccagatatcatgtgaacgcatcttattatatagtagctattaacatggaaaacatttttatatttttggggtcccagtggtaaaactagcatgcagtcatgcacttcttttatcctttcttcatgttttgcctgacataccgtgaactaataatcctgctgatctactattggataaaaccagaaacattgttgccaacaaagtggtagaagtccaatgggaatgagaatgatttgggcctgtacagcagatattggaaccaactgatgcatgtgatctgtttgtgagtgcttctttctaaacacttacacattactctgaactggtgacgattcttccgaactctgggttgagtaaagtgcaattcactaaaaacatgtttttgggatagtatttgctggaccatttgttttcttaacttttctgttctgctttgcatatttgtgcttgcatgtccaatagtcttcggtactccattgccccagctgcctggttagatttaagggcattattgagcatggtagtgtttatttcctcacatactattggacagtgatactgataacaagaagtaataactactcttcatagatagatttaagttccctgtaccaagtcatgaggagttgagggctgggaaatatgtcatgacaattagatttaagggcattattgagcattgtagtgtttatttcctcgcatactattggacagatactgataacaagaagtaataactattcttcatagacatatttaagttccctgtaccaagtcatgatgagttgaggactgagaaatatgtcatgacaattagatttaagggcattattgagcatggtagtgtttatttcctcacatactattggacagtgatactgatagcaagaagtaataactattaattatagacagattcaggttccttgtaccaagtcatgtggactgggaaatatatcatgacgattgatttcctagcttgcagattcacttttggaaaacctctctctgggaagaagcatagctgatagctgtgaggataaaatggaaactggtttgttaaaaagcacttacctgattagaatcacttctaaaatctggatctttggatgtaatttatcttgagaaaaggtgtaatttagcatgtgtggtaggcaatatgtaaaaacaaaatgtacatttgtgctattcttctttctcaagttaactgtcttgttactgtatggcatccattgcttgtcttgattgatgatggctttgggtttctgtttttgtcttttcgtgctcaagttcattatgtcttattttattgatttgatgatgcctccagagagaattgatctatccaggtgtgcttcagtgatagcatagagtattgaaattgtttcatatagtcaagttggagtggactctaatctactccatgagccaaatggtgcaatcatgggcaaggacaaggtgaggcgaaacagaagaaaacaccccctgtactaaggactggtgcaaagatgtaatataccttacggttatgagttatgacttaagttgtttgacatgttgggcccctatttatatttgtctggctaaaatgctaaatatacttgattgcctcccattgtatgaattgttagtcacattttctttggcctcttattgcagcatgactgattaaagaaatagctcgatgactattttctgccataatattcccagctatgctcatcatggagtaaattcatcactgcatttgctgatttcatttctaaccctgactggtttgattttgcttggtgactctgggatccatacggagttacagtgatattagtgcatcagttttgcatgccttctcttatttctcttgttgagatctgcttttctccttttcacaatctaaatctattggggcattcaatgattgttggtttcacatgcccctggtttctttatcattttaggtattattggtggcactagttccaacagacccggccactgactacccacttgtttatccagtagtaaaatgcaacatgagcagattatggggtaacaagtatggtaatgacctatttggctatttccctgtgtgattgtcttatggcattatttataacactagtgattagtaccattttctgttgtaccttctttgttttgttgcaacttatttaaataaaaatggatatggtgattggtgacctctgttcattcctttaaatgcgtgtatctgaatgaatgctgcagtttgttttcctccatactttctcctgtccagtactactttctttttaatatcatcttgttagtttctggagctaaccttgatattgctgaacatatatatacctcacgatgctatttgctgctagaaagctaaagaaaaccatgaagctagccaccaaaggtgccgcaaatcttgcgtgcacaattccaggttttttccatgataatctggacgcttgtgctgttgtgcagagttagctgcgctaatggctatcactattatactaacattttatcttagcacctgctccgacattgttgccattagtttattgatgatgatctgattagtttcttctcttcttttttacacactggattaaactgactactgctctctgctcctttgtttcagctgctgctccagatcttgcgcgtcactgcctgctcaccagcacgcaggagcaaagcttcccatgtgcctgatgtcgcgccggtggtgtgcaattccggcgacaacgacggcgacggctataataatcgatcatgggcgctcgtaatgaagcttctttcagttattgggatcaggaaactattttaaattctcgagaggacatcctcttgttatttgtactctcgttatttgtatgtcatctaaatggttataaaaaaatttaaaaaaatcaacaaaataaattaatgtgtgataaatcacttcagaaacatgcaaggtcaaatttaaattctacaagttgcaaaaaaaaaacaaatttaacggtggatatacattaaatagcaatagtttaatttgtttttttgttgcaacttgtagaagttgaattttaacttctatgcttgtggagtgatctatcacatattaatatatctagttgattttgttttaaaaaaaaattcataaccatttggatgacatgcaaataacgatggaatgtccactccctattgaggtcgccatttcaagattttttttttctttcttttgcatcatcatcaagccacaggcggtgcgtcggcttgcttctcttaaatttctcttgcaatttggtcgctttccggtttgtgttgatatcttaaatgcatcagctatttgatgaaatgtgtgagccagctaatgtggcctgtactgccagtgcttttgatgtgccggaatgggtacaaattgctgcttgctttcatatggcaccaacaacatgagagcattgctgaaagatgtgtactcgaagtacgacagaccgtgcaagattgcacgatatgtatttgctcttttttctctttttggtgaatgtgaacatgtgattatctgaaatgtacagcagaagaatacgtgaagtttgtgtgaaaacaatagaaaaagatcactggatcaagacttgtgaggctctgagatcttgaatttcttgccctagttttgttattttgagcaaaggctcggttcagtttactcttcgttttcatccaatggctgagaaacatgctcccaattcgtgccggaacgggtacgaattgctgctggctttcgtatggcaccaacaacatgagagcattgctgaaagatgtactccttttgtccataaaaaaacaatttctggctacaaatctggatgaagaatgagtatactcgaagtatgagagaccatgcaaaattgcacgatatgtgtttgctcttttttcctttttggcggatgtggtcatctgaaatgcacagcagaagaagaatacgcacagtttgtgtaaaaacaatcaacaaagatcattggatcctgacttgagaaaatctgaactcttgaattctcgccctcattttgatatctttgaacaaggcacgttcactcttctttttcatccaatggctgagaaatactcccaattggggtagaaaaaggtttgttcagtctgaacaaacaaccctatctgacagagatcttgacattgcatacagcacacaggaacaaaaagaaagatatgctatgcatgagtagctcaagttcagtccagtaaaacaaacctgttgccctaggacaaaaccaggtgctgttcataccttgcaacttgccaaagatacaactccttatgaacatgattgcattaccaaaagcctaaaatactgcactttgcatgttcatatgctgcaaggaccaggtgagaagagagagagagagagaggagggttgcaaaagcagaagccaactcaagaaacaaacaaccaccatgtccttgggtaggtaggtagaaggttaaaggcttgagctgttcttcttctctcttttgcctttccagtttccttcacctgcaactctgttattgttacacctctctatctccataaaggcagtggtacatacactggcaggcagggcaagggcagcacattctctcttccagctgccaccctgttgagttttgcttgcacagagtcacacagctgggtgatctcctttaattaggaatttagggaggctgtcagttctgaaccccaatcataaaaccatccctggtttctctgtcctgtcctgccatcattcctgcctgcttctgctttctctctcttctcttctctcctttcctcttgagaaagaggaaagggagagagaaagaggagaagagcaatcagcccaagaaggagaggccttcatcttcacctgatcggttcttcttcttcttcagcaggcagcatagtacttcatggctgtgagtacaattaactgattaattttacatcttcatcttcttgtttgttgattgcatttgcatatgcttgtctctgcatctagaatcgttcaattgcttccaaacatgaaaatggtactcccaatccattcttgcttgatcatgtgagatgttcttctttctctgctccaattacggtgtgcccatgattgctgcacataatatcaccatcaccatcatttttctttaaattactcgattaaaaaaagcaaatattaggaaatgatctaatatcaaataattagaaggggttaggcttcgaacccagatcgtctagtccaccaccttgtggagctagccggaaaatctatgagtgtttctcaaattactcgattagtgtcgttgtgttcaagccaattactatcaaattaggctcatgagttgggcgaggctactactaccacccccatgtgcaagatgcaagttggtaacatgcataactgcacaacagtcacggcaatggattatggatggacagatggatgggttaggcagagttggactgacggatctgaacatgcgatgctctgagccggctgcactgcacatgcatgcgtgacactatgaatctatgacagcatgatccgtgctaagatcttcatggcaaagagagaggaaaaagaaatttggctggcctttgcttggtttagacgattagtagacgtcaaggagactcatgctggaaatgacaacgacataatagggtcatttgtacagattggagttggctggatgttggactagtagttggcttttcgtgtttattctcccttttttttcacctgacttagcatatgagacgcgtattcgtacatttatatggtgattcttcttaattaggagaggtcggaagttatgctcccttcgttttttttaataactgatcattttcttttgctttctcatttatactttgactattacttacccttaaattggtaaaccagagtacacatatttatgttcacatataggacatacctcactttagtaacatgacaccaattttttagtgtatgtaatattttttaaaagttccaaaatgaatattgtctagtgccagctattataaaacggaccgagttagtttctttggattttgtaaacaaagttagagtaaaaaaaaattctcatggtgaaattaaattacgttgttatatggcatggttaatctcatctcgagattcgtgcagggacaaggccccgtggtgcccaaattcggatcgtgggacgccgagaacatcggctacaccgtcttcttcgacaaggtgcgcgagaacaagaccgcgcccacgccggcgacggcggcgccggcgacgcacgacgacgactacgagttcgatccctacgagcactacgagaacctgagcaggaaagcggcgtcgcgcccgccgagctcgcacggccacgggcacggccacgcgccgccgccggcgcaccaccaccaccaccaccgggcgccgccgccgccgcagcagcagcagcatcaccaccactacccggcgtcgcagcgtagcggcaatggctaccaccggaggagcggcagcaacggcagcagcgcggcgtccgaggccagcagccgcggcagcaagttctcgccgcccaagccgtaccagccgcggtacagcagcaacagcaacagcggtggcggcggcggcggc

SEQ ID NO: 1785 - DNA, 35256 bp, Oryza sativa
cgccgggccggatgtcacgccgcgcatgtcgccggcgcaggcggcgccggcgcggcatcctcggagaaaagccgagaagaggtccttcttatcaaaggcacgtaactttagttagttgattgattattatctaatttaataattcatttgcaactttagttaattaattatttaattctgtaattcatttgcttcttcgagttcatttttttttaaaaaaaattgcatgctttgtgaattgcaggtgtacaggtgcatgttcccaagggtgagggagtgatgcagaagctggatttgtattattaatccgaccttaattaattactgtaaaactcccaatcgtatacgtatttccgacaggaaatgtactgtgtaattaattaatttgttcgttcttgttctttattacagtcccctggcacaaatcaaatcacaatatgatgagattggcacatgtaacttacctgcctattcttgtgcggaaattgtaaattttgattttagacatccggaaaattttgcgtgtggtcccctttgcaatcttatcctctcgctcaaaccagatcattttgaaagtgaaacggtgaatctgaccaaacttcttatgcaattttgtgaacttttatcaccagcatcgaattgttttctgttgcagagactcgaaagattgttctcctgtacggccacattttggcccatgggcctcttcaaattctgagaaaatcaccagaccctgaatctaagcccatggttacctcgtggtcttgaccgatggaataattctattttgactcccttattacatccacggtccatcaacttggtagatgggtgcaatttagtacaataacttaaaaaataagtgctctagtgcaacaactttgacaggtatatgcaatttagtatgagaactttataagtgatcgtataaatgcaataacttgcaaggtaggtacgattttgatacaataagttaaaaggttaggtgacaacttaattatttggagcattttttatataaattcaatttttaagtactaattttgacaatatactagcacagatttgtataagtatatttattttttatcctaataactaataactgaaatccaattaaactagatgtagaaattattgtttttggttgatattttagaaggggaagaaaaccaaaaaaaaatcttaaaggtaattggatgtaaattgtactactatgtgtagtataattcttaaagattaaattcaatattataaggtaatatccgtatgattactatgtaatggcatattgacatcgtgaaaaaaaactcaccttgcacatgcttagccaagttgatacaccaaaatactaaattattaagttcttatattagaacgcactcacttattaagttgttgcactcggatgttcaattctcaagttcttgtactatatcgcacccacctgccaagttgttgtaccgtgggtgtaatttactctaatctcttgctctcgaatcaccttccttaaccacaaaaccgggtataacgtcttcacaacttttaaaaccagtgcaaatctactccttcgatggtttgggaagcggtttctactgacatggaaacttgactgtgtttgtcagcatgtgggtcccagaaaccaaaccataacttaatgcggtaaaaaatgcaatacaaatttgattcttcccattgatttgagatctaggggtttctgaccatgatgatgtgccgccatatatttatcgatttttttctctcgtcaagaatccagtacaaatcctacgcattacagataatctgatggatggatcagaggacgccttgctggtagcagacgtcgagcgtgtgctgcgccatgatccggttcaccttctccgtggggtggaaggcgtcccagaagaggtacttgctggcgtcgtcgcacgtcaatggcgactcgtcgttgcacatgaaccccatctcgaacctccccgtcgcgcagcacccctcctccacgttctccagccctacctccccaaaacattacaacatacttgggtcagtggccgagccacctaagcaaaactcactataatttttcgtgttcttatgagaatagaatgtgccttcctctcgtaattaacagtagatatcatattttctaatgtaaaatttggtacatttagctagtactagttaaaattttcagagtaaaatctagatacctcgaggtagtttttcaaataccataatttttctcgtatcgtggtgtgctaactaaaatttatttcgatacaatctactactggtgtaaagcaaatgaaacaatatatgctttatccaatgcgaaatacaatttactactccctctgtttcttattgtaagtcattttgacttttgttaaagtcaaactgcttcaatttttactaaattcatagacaaatataataatatttacaatatcaaattacttttattaaatcaataattgaatatattttcataataaatttatcttgagttaaaaatgttacttcctcgcatattacttttgtcactaagaccaaagagaaattaaattatcttggatattacaaaattaaggaatgaatgcaaacatgcaaccaatgagtgtttagatgactcattgggttataatcaaacatttaatttatctcttcatttaagtattgaatgcataaagtttacaaataggaaaaactcaaatgtgaaatatgtctaatttttgtggatggatggagtactattttgactttgaaactgacttataataaaggaggtgactcaccgtacttttccgggtgggtgatgaggtcgagcatgttgtcatagacggggatgaaggcgaccttgagtcgcgggagctcggcgcggagcgacctcaccatggcctccaccttgccgttgtactcgcgcgccacccggttgtactcctcgacgcagccgccgccgccgccgccgaggagcgcgccggcggtgcgctccagcggcaggcaccccatcggcgagagccccgcgaacgtgacgcgccgcgcgccgaggcggtggatcgcggcgaggaacgcgcgcgccgcggcgacgaggtagtcctcgtactcccccacgctgtaccgcgcgaaccgccccgtggcgagcatgtagtagttctccaggaagtcgttggtgccgatgctcacgacgtggagcgcgccgcgcacgacgtcgcgcgccgccgcggcgcccgcgtgcgcgcgcagccgccgctggtactcccggtagtactccacctccttccacagcgggatcactgactaatcggaacacgcgcgcgtcaattaatttcgcacttttgtgtagatcgatcgccatgaattcgatcgatcgaggtgagctctgattatgaacatgcatttggcagatgagatttggagcaggtgagatttggagaagagagtgtgaatgcgtcacatgcatctgcatggatgcaggagtacttctcgttgtaattagtagtagcatacgattttggttgggaccgggacaaccgaaacaaaagcaatgctgctggattctctgggtcaaaacttaagtactggttttattgcaagaatcagtcattggtaatatagttttcacctagttaattactattactatattttaactttatatgtaggagtcattgaatcaatcaacacaactagagtgttgtaaaacagtaagagtattgatccaacaacagtaagatcttgtttattttgagacaacatcaatcaacactgagattagtgctgtaaccctatatagtatacttgtcggaaaccatctagaaatgtactactccagtgagcagctctacacagcaggagacaatctcagagaaatattcctacttggattaatgatgatttaataataaattcagaactgcatacatgccctaccatgattaggcaatcaaatcaagacagttcttctctagaagacgcaatcggatgaatccagctagcctacttaatgccggcacaagtggttgcagaaaaacgaagaacaaagcagggaaacacatgcccattatgtgcgttcttcagacaagccatcgaaagataactgaatactgaaaacgtacagccatttttctttttcattgttacaggtgatgacagtggtgtgcatgcaacagtgcccgggaaagagagatttgggtcccaatgcatttaagttttaacaacgagacctaacgtcgaacgaactgccttaaattgcagacattttcagacgactccagcaaagtacaattattcagaaacggcaagtctgaatttttcttagattgcaagttgcaatgataatgctgcgattgattctttggaaaagccataacttgcaattcacaatgctgttgcatttgattctttggaaaggattttcacaacttgcatgcataatgttgtatttggttctttgaagcagtgcataatgttgtactactatttgattcttagaaatacttgcgagttgcaatgcacagtgtgtattgctacctccgtttgtcgttttgatttttatctaacccaatcatcttctttagctttggtcaaatttattgaaaaatatagtaatacttttaacatttaaactatcaaatatatccaatcttaaatttaataaaactagtttaatgctataaatattgtcaatttttctataaaattgatcaaactttaaagaagtttgacttaatttaaaaaagtcaaaatgacttgcaatatatgaaacggacggaggaaggtcagcacgcatttgattctttagaagaatttcatatagaatttgatgggcgtgtgaattttgcaagtattttgctgaggattgttgatagtgatgatggtggtgtagctttgctttaattattaccaggacgccggcggtggcgttgtcgaggccggtgccggcggaggcgaagcagacgccgcgggcgaagtcggcgatgccgtaggccgggtcgaggtacgccgggacgagcggcggcaggccgagggactccgacatgaagtccggcgcgaggcggccgttgccgaacctccccgtcgcgcgcgcgccgccgggcatgtcgcgcccgtacggcgggaagtcgctccgcagcggcgtcccgatctggttgttgttccccgtgtccaccgtcgagtccccgaacacgatcaccgccgtcacccgcgccgccttcgccttcgccgccgacgccgcgccgcggctcgccgccgcgacgacgaggaggaggaggaggagcagccgtaccagcggcgacgccattgcagctagctactacgtacgtgtgtgacgcgtcgcgcggtgtaagcagtgaagtgagtgacactgagagtgagtacgtgcgtgtttgttgtggaaataaatagatcaggcgcgaggtgagctgtggtcgccgttcagtgggagacactgtatcaactcttctacagtgcaatatgaattccagcgtaatgtgagcgtagctttactggacaggcttgttatggttgatttacacacttacagctaattaattaaaaaaaaactgattttttgaatgacttagagagagataaaaagtaatgtgtaatagtaggaccttttcgtgcattctaaattgttctattttcttccaacgaaagaatcacatttttgggtttttgatgttaaggagatgggcattttggccacctaaatagtggtaaaaaaataaaaaaaatagcagcataaattaatatgaaatatcattgttcaaatatgtaagatccaattaaaaaaacaaacttaactaaaaatgtttagcatattgcattaatatgtctactatttgatcattgtcatcatcgtgttcaatgggtatacttgttgaatagtagttcacagcacgcagaatcttgcttgtgcgctaaaaacaaacaagatttgaagggagagacatccctctaaatatttttttaagaagaaatcatgaacatattaaaaattgaacatgagactttagggttgaaatcacaccccttatcactgaactatcaagtacatctcctataaacacatggttgcgttcataggaagacgtggagggtggtgttcatcttggcgtcggcgatggcgcggtggaggcgttccgtggggtggatggcgtcccagaacgcgaacttgctcgcgtcggtgcacgtcagcgggctccgcgcgccggcgccgcacatgtaccccatctcgaacacccccgtcacgccgcagcacccggccttcacgttctccaccccgtacgccgccgggtcggcgagcaccgcggccaccgccccgtacacgtcgccgtacacgatcctcgcgccgccgccgagctcgccgttgagccgcgcgatcatgtcctggaggccggcgttgaagcgcccggcgacggcgttgtactcctcggtgcacgcgccgccggtggcgcgctccagcgggaggcagcccatgggcgggaggccgttgaggtcgaccttgcgtgcgccgagcgcgtgcagctcgcggacgaacgcctcggcgacgccgaggaggtagtcgccgtacgccgccgccgtcgagtactccgccgcgtggccgcgcgccacggcgtagtagttctcgaggaagtcgttggtgcccatgctgacgatgtacagcgcctccgacagcgtcgccgccgccgccgccgccgccgcgtcgtcgtctccccggaagctccggagcctcgccgcgtactccttgaagtagtccagctccttccacagcggcagcaccgactgcaccatggatatcagccaagaacaccatgaaagtggagctaagctagcaatccttttaggcttacgaaaagatcggaggtggcattgtcgtagccggcgccggcggaggcgaagcaggcgccggcgccgaggctgctcatgttgacggccgggtcgaggtaggccgggacgagcggcggcagcccgaacgcctcggagatgaagtcgacggcgaggcggccattggagaacctgccggtgggccggccatttccgcctccgctgacgccggcgccggcgagctggaggtcgcggccgtagggagcgaagtcgctcctgacgagcgtggagaggtagttgttgttgcccgtgtcgaccgtggagtcgccgaacacgatgatcgccgcgaccttgctcttgccggccgccgccgccggctcgccggagaggaggaggaggaggacggacagctgcaagagggcgaccgccaccacaagatcacgcggcgaacgcatcggatcgatcgttgagcgagctcgctggtggcgtgcaggttttcttggctcgccatgagtcgcttttggagaggtcggcgagctaccggagaccggccggggaagagaggtgaagcaagcttaatttaccgggttcaggccaactactgatggagactgcattggaagctttccattccatttgctcttcgtcgtatcgttcaggattacattaattaggacggttttttggaaagtaatttgactaatttcacgagaattccggaggaatttgacagcaaaatgatcaaaaggaagccgccaagcagagtactactaatgaacagaacatttttctttttttttttgaaaatttaaaattaaccatgtagcttttcatttagaatgtataaataaacattttagccatgccacaagctcgagacccgcatccaaatccttgtaaaataaaaaaatcacttaaaaactatattttaaaaaaataaatttgtaacatatcatattaatccaaatgcttgcaaaattaaaaatcactttgaaaaccatataaaaaaattaaaattttgagcatttcatcttaaaatcatattttaaaaagttcaaaaatatcaaaataatttgaacataaatcttattaataataacaaacggtctgaaacctgaaagtaatccaaggataaggagaaaggtaaacaggccgaaacaaacgcgaggcccatatacatcgaaggaccctatataccagcttagccatcctctcgaagcttccaactccggcgaaacccaaaaccctactccctcgtcctcctcgtcgacggcggcggcgatgctcccgcagagccagagcagctcgctgcagcggctcaaccacgtcgagcaggtaatcaatccatttctcccctcgagatttcccctccctttggttgttccctggaccgtcttcttgtggggggtttcactggatcttgatcttgatgcggcgagggggggatttgcgcgtgcagatgatagtccgggcggtgaatctggccgggacggtcatggaggagctggggaacgccactgggccccgcaccgagggcgtcgctggccactgccgcgagttcatgctcgccatgaaggtacatctcaatctcctcgccctaagatctgaaatgcttacctttgatcttgcctgcttggatgtttggtgatcttttgcacctacagattgtttccactggtaatttattggggccccaaaataactcttgtattacaccagaatttgtttcccttctaaacccttgtttgggtatgttatggatgctagaatcaggttacagtatgaacaaggagctaattgaatactttttcctcaacaaacattgaacatttcataaggttttgtatgtgtggaataattattagaactaccagaatgaacctgactttgtttcaagatttttgtgatgatcattctggaatttgttctgtacagaaaaacagatcttggtgaattgtttagagaaaaaaatatcaagtcttgcctccaattcatccaattactattgttaccgagaaaataaaatttacacaacatctaccgagaagttacaagagccacctaaatcatcaaaattacacaactttcctgataaaaaaatcagcatgttttcctgaaaaaaatacagcttgatgagcaattgaactcagaacagtaacatctacccagaaattacaagaaccaccaaaaaatagaaacatatttccttccaccgaatctgagcaaccaagtgaccaacacaacaatattcaccacgatgagatgtctcctgcaagaagtcgaaagttgaacagatcgttggatccaagaacataggtgaacagagcgaacatgtgaaaccgattgggtggcacaatctggtgccgactagatatccccctcccatattgaagccaagatgaggccgatgggatctggggagcaaggttgtcgctgtgggcgatggtgacggcggatccaagtggattgaaaccttggatgacggtggtgatgtggagacgtagggattcaagcatcaacgtaagggagcaccatcggaacagggaagatggagtggcggcagggcggaggtgtggatttacgaggcacatcgttcctaccttttgtttcatgaatttacgaggtgatgctcgacagggcaatacgttcaacaggaatcaacttaaatctgatttaccaggaggagaattacagacatttcacagccttttaaaaaagaggagaataatagtcatttcacagatttttggtcccagcagcttcaaaaacaaaaacaaaaaagtgtagtgccatgcaacaatcacaactgagccttagttgttaagggtgccaccataccagtgaacctttctctgggtccatccaagctctttctactcttcaccaaaatacaagtcaaatgtgtgaaatgacaattgtattgctgtacatgttcctgctcttctctttcactaactttacatttaagacacaatgtgcattgtaaatcatacatggcagactcatttgttattatgtctggagcaggaaattcaaacgacattgcgtgaggaaatcaaaagtgcttgcgaatatcgcccatttgagaagtgtgactacagtgcaaggattgctaatgagatttgttgcaaaaaggtggaatatgtacttgagaagctggatgctatgcaaaagaacattgaggaatgttctactactagttaattgataactagttatctacctacctactggtgagtgctgatgcatcaggcgacttccccattcgaattcctcattctccatctttgctgtagatgcatcatgtgttccattgttttgacagtaccagccctcaagaaatggtagtactgttgctgtatgtgtcatttatttgatgcatcagaacattatatggttatttcataccggtccaagtttgaactgtgctccatttaggttctaagtttgttatagtattggcaccattgtaattgcaactggcaaatcgttttaagaacattagttacttgcaaaggcagcttttacagttttaaactctagatctacacgacttgcgatagtgtatgctgtattgttggctatatcccttcttttgaactcccagcattgatccatatgttatgctccatatggataaactatttttgagtgtcttgatgttagatactcttccgtataagatgttttgacttttttcctaatcaaacttttttaagtttgactaagtttatagaaaaatatagcaatatttctaacacagaacaaacatactatcaaaatatattcgatttttatatttaatgaaactagtttggtgttgtagatgttcctaatttttttaatgaacttggtcaaacttaaagaagtttggctaggaaaaaaaatcgaagtgtcttataatatgaaacggagggagtactatttagaaggacaacagtcaccaaactagactatttttttaagtagaaacctaataaactattttttaaaactatgtgactgtgtagtgttataatctttgtcatttcatctacatggagatcaaccttgttatatgccccaggttgaatagagtttttttttcctcatcatatttctactagtagtattctttgtatgtactcgtatccttcaagaattgagaggtgtgtaatgtaagtttacacagctatctgtgtttctttcaggtttacagtggcacaagtgtgactgagcggtttacaaaggaacatgagtgtcggtgtagccagcttgcaaatgcacaaggcatcattgaactatgaaatgtaatttaccttcggtttacagtgctttggtttaggtggttgcacagtgataaactgcaagtaaccacttcagtcttgcagaagtttacagggcagaatctgaaatgaatgcttgctagtactcgtatgaaatgaaaggaatggttgcacatgcttgcttgctattgctagtagtacacatgagtatttgttaagatctggcatcgaatctgaatctcgtattaaagcagttcttgttgcgtgcttcgtctgtagaataaggctacgctatttatgtgtgatttgctaaactttgggcgtttattttataaaaagttattttggttggatgcatgatactacctattcatattaaaagttgttttgattttttttctaattaaatttatttaagtttgatgaaatttataaaaaaaaaattagtaatcatctacaacaccaaattagtttttttttacaactaacatttaatatattttggtagtatgtttgatttgtattcaaaatgttgctatatttttctataagtttggtcaaacttaaaataagttgattatgaaaaaagttaagtgatttataacataaagcgtaggtagtaatttgtttttgtagatttgtcgtgaaagtctttccataacattttgtggcatttttttgtgaccgcaagactcgcctctctcggtgtttctacaagcaccgtactgcagcatttacccgccgcaaataatgtatagtaatttactctcatcactgtttctttttttaaaaaagagaagcatggagacggttccgaacctttcacataaatttgtttttcttaatagaaatttggcagtacatataatataatataatataataatatagcttaaaaatcgtaaaaaggaagacaaaaagctttagtatatatcgagagaaagaaaaaaaatcacaacctgaaatgttaaaaaagaaaaaaaaatcacaacctgaaatgttaaaacagcatttacgaaaaccgtaattctggattatagaaaagaaaaagaaagagagaagaaaaatgtattaaatttattcaaagtattcccctccaaaattcacaaataaatttcctaaattataaattagagaggataagtcgccaatcctctctcttttgccttcactatccatccctcctccgcttcttcctcctcagcctctcatccaatttttccattcccagaaatcgagcgaggaagctaagctaaaccaatcgaaggccacggccatggctgccgctccagccaccacgtcactgctgagcgcgctgctgcagcttcccctggccccgttctccgggaggaggtcgccgccgccgccgtcggtggtccacgtggcgcccccgcgctcgccgacggcggcggtcgcggcgaccaaggggtacaatgtgcagatcgtggtggacgagaacgagggggaggagtccatcttccggcggttccggcgggaggtgatgagggccggcgtgctccaggagatcaagcgccgccgccgctacgagagcaagaaggacgagcgcaagcgcaaggcccgcgaggccggccgccgcaaccgccgcaggtgaaaacacctcacctccccccctttgtttgatgcatcgatattgtctatgaaatgatgtaatcctttttgtgaattgtgaattcttgaaatcgatataacctgcagataaaactgtgcttgcatagtttgcatcagctgttgatggtaggagtttctgttgataatttggttgttcagttcagagtttcagactgttcagagtcggtgtttgcaggaaaagaaaaattagcaagatagattgtgctagcactgaatcactgaaacaggagtaaaaacatctaaatggtggtagcactgatgcagaattgttgctttggttcatttcattacttccttaggatttttttaatgataacatgttgattgggtttgtccaagctttgtgtaattctatcccttagggaacacaagctgagcaaatccgatgatcttcagctttcagactgcatttgcatagctgaatacgtcattgtaatgtgaaaaaacttcaaggtcatggaatgtcttttgttaacctgacctgtgtttgtcgaaaatgttgtgcaggcgtatgatggaggagcctaggttcccagaagacgatgctgattcagaggccgcgaggagggctcgtgacgatgaaaaggataactgggagattgacggaattctgtgagtgaaacaatggagttcatagccattcagatgcaaagtttccatgttttgagttattgtttttttggtccgcaaagcacaaactatatgagttgtcggccttaatttcctcttcaattgtacggtttgaatgtactaaatcttagctaatgcagcatccttttttttttttacctctgtaccttttccagtttgtttgcaatacattttgcaaatatgagcctataattataaaagagtaaatattatacaatgttatcctatagttgagtaaaaatggagaattcataatcctacatgaccatttttcatcctgttacccagtgttaaacctgcccaaattatgcacattaaaaacatagaagttttatgccttaaaaattttcaccaaaaggagcaggaaacatgtgtatatgccttaaaataactcagccagaagatcaaaacaaactattcccacccccacaatttatgtttttgcagccaaaaaagatatccactctggaagaacaaaacatcatccaacagtacaagagtacaacaccagctgaccgtccagcttacaagcaaatgaagcaactattctttttttctttttcgcaaatcgcatgtaaacatgtctacatgtccttccaaaagtcacctggaatcaaaatgtatataaatccagccctctcaagaaagagaagcttaatgaggcaacaactgaatagatccttggacatttcagttgtacaattctcggtaaaatgcaggtaactgaaacgggatctgactccaatatttgatatcaaaccgaacagagttcatgccattgtcaacaaacaagccttccacgatcttggccaggggttcatcatcctccatgcatatgatctcaacaatcttaagatgctcacatgtaaacgatctttctgtaagctcatcaccaatgatatgttcatatggatgcggataatactgcatcagataaaaaagaacttgtaagttgtatcccgaaaagacgtactcgtgaggaaatggtttaaaataaataggatcagcatacatttgaagaaaatcatttaccttttcgagtttcagagtaagcttttccagttttggtgagctctgaaggaaaataatcaacacgtagaagtctgaatctagacaccattgtccgagagtcaggtcgacaagattgataaatttcgggcataactgaggattgttttttattgtcatctgcacgattcaaatgattattagaccatgtagaagagcatgctatagatacaaacacatgtgaaagatagaggagaggagagagaagaaaaagattttttttagaaataatacctttttaatagagaattgcaaaatagaggttaacagactaaaattacaagtttagcgcccatcaaacaagcaaagttcaacagggtatatatcgacaggggataaaaaaaagtaaataaaaaagagaacaaccactgtacgccactgtgtgcatgtaggacctatcgaacatcagagttcaataggccccctgccaatgccctttcatgtactttttattttttttagtggaccaacaaccttgcccaactgcggttgttcgacagggtattaaacttgagattgtagccgaacagcttctattttttaatttttcattaaaataatatattttcaaaacaaattcgaagaaaaatgggctacagattggactctaaaatattatatgtgtagaggtgggtcaaataataatggtgcatcatgtatttatataaaactattgtataggtaggctattaaagttgttatagatgatgtgccaatttttaaaggtagtagttgactatactattattaaacttgctcttagaaggtcacaatacacctataccaaattatatacaaaacttcctcaaagtcaggtagctcattgtgttcgttagtatatgttgggaactaacccttcaaacaagcaaaatggagcggtagattagtgcatgattaattaagtatcaactaaaaactttaaaaatggattgatatgattttttttctaaaggaacttccctaagaactttttacaaaaattgtaccgtttaatagattaggaagcatgcacatgaaaaacgagacctagaaactggaacacccatatatgcaaacttatcgccttttctagtctctatgaaagtaagataactaaatactactgagatatttaattatttgccactcttaaatgtggcatttaataattttccactgaatccacatgtcacagattatgagtagcaaattattaaataccacgtcttaaaagtggtaaatagttaaatgtcccactacactgtggatcaacaattgctgaagtaatccatcaggtggttgtgggagtgcatgttttaacaatagttgaagcattttccagaactaaaatttaaaatatacattattgttcataattttacatatatatatatatatatatatatatatatatatatatacatatttttaaaatatttgtggaactatacattctccatgggttcgggccacgctaccgcaccgtcgacgtagctcgaaggcatgaaactgatggaggggcggtccaacggattggtcacgttggaccgacatggtccaacggattggtcgcacgggaccatatgcttcagtgccggccactgcgatggcgcacgcgtgtgttggctccacgccacctcccctcccatcgttcccacgtgcctctaccacacggggaatgtatatttctttaaatatttttaaaacatatatatgtatatacacaaaattacaacaaaataatatatatttaaagatttcattcgcattttccatctctacgtcaccttttttatttctcacttatatacgctagtaacggcaacataattaaaagaaaaagaatcaccgagaagtcagagacaggttgcattttctattacaactgttaagtaccaagctaaacaagagggaatatgtaagatcaataagcattaccttacacgcatagtaatcgaggtccaaatttctaacaccagaaaggctccagagcaactggcgcatgtcataagcacaaaattcgatgagaggaaacaggtcaactgttgccgtcaccagcgacgcgacgtcgtccagtacgggcacgaagttctcaggctgatgcatgatcagagatgtcagattcggcgcagaaatgcagctctcctgcagagttgggaactgacatccatacatggtgagaacattcagggtctcagatgagatctcatcatctccaatgatgcagtcgtacaagaggagatcctgcagcagtgggcagccaatctccagctgctcgaagaagccttggtccaagaacacattcttgagagtgattctacccaagtagcatgatgtgaacaccgtgtgatcgaggtgcaattcgtgcgcatccacgatgatcttgaggaaactagcttgattctgcaacgcgtggctgatccacctgttggcgtccgccgagtcgttatcgcggttgtttgggttggaaatggtgtatctgaggttgaaggtgtggatgacggcggcggggtcgcggcgctcgagcagccggttgacgaacctcttgaacgccgcctcgttgtctggtgtgaaggcggcgatcggggacatgctgagctcgcagtagttggcgttgatgcggggcacggagcgccagaggtcgcgccaccgccacgacagcacgcacgtctgaatgacctggcgcacgttcaggaaggacatgatgtggtggaggataccctcggggagggcgctgagaaagtctgggccagcggttgcggtggcgttccgcccgcgcttgccgcgcgggaaaccgccattcatggcggtcgatgatgacgcataggcgtttcgtcgaacaggtggtgcgctgcagaaatgggaaagaataagaattagtaagagaaagtcatgattcctagcaagccatagttcgactaggaggactcgagaattgagatagcatgacaatatcaaagatagttgggatttgtttattcactgcttgcctattttattctctaccgtaatttttggacggttgagatcgctttgaggttcgtgaaatgtaaaaccctaagcaccttgccctcctcccaactagatccaccccctagcacatgcgccgccaccacttgcctcaccggcgcaatgtgcttctgccgtcggccttccccttctatcgtcaccaccaatatcttgatgtctcatcttcctcaagtccggttagtttcctccaccccgcctcaactaccaagtctccagtgcctcgcacctttcaatatataccagtcacatctgtccctgcctcctaaccactccgacaggtagccccatcgtcagggtaggtccaccaccctcctcctctaccacagctgaggcgaggtgacatcgtggccttgctaccccaaccaccgcgtagcttccacatcccaaaatttccctctaggtcccaaagccagtgagttttctttgatctccttcttttccctacccgtaccttgatttctaatcaagccacctcgccagaggaggtgttgccagagattgaagacgccttcgactgagattttccaagatcttagctaatcgattagtaaaaatgaaattcaaagagggaagaagcaacaagatgaagagcatacctcgtgcgatccatgcgtgaatctcacgtcaagcgttgagtccccagccctcaagtatctgttttaaagaggaaattacaagaaccttgatcctcctccaatttgaggacctggtttcatgatctgaacgcgtctgacacgaatctcaaagcaatcacccggtatcttaccctcaatctttctttactcttatctataattgccaaggaaatatgataagtctggcatgatgataagcccccctcgcatcagagaagggtggtttgtcctgatggcgaaattggcattttaaggctgatattatgttatactaataatggtatatgtgtaacacatttttgcgtatcgtaccacattccatatataatgagatggctaagtaaaaaaaaatcaagaagtaaataaaatactactttatgcttgacatttgactattcgtgttaggaaaaaaaactgttttgttgtgacttgttttatcaataaaataagtttatgtgtcattattttttatatttacactaaatttttaataagatggataatgaaatataatgtaatatttaaaaatggatcagggagtaataataatttcctctgtaaccttttataaaagtaaactttgtgacttcttcgatagagcgactaaagtgcaaattagcaagaaataaagaagtgcttgcttacgacattgtgacaccggcttttgcaagaatatattactcccttcaatcctaatttgatcttcgccttagattttttagtctttccaaattgatcaacatctaatcagtgcctattcatttatttataccggagtaaatggcatagtggtatgtatattcgtttatgtgtgtaggaggaagaacattcacattgtagaatatcctatgtgtattaagatggggtccacctaatatgcataaggcaatagagagatttgtgaaatgtatagggcacatgcctataatgggatccacacccatgggtattaaggtggatctatgctatgctatgctttttttttttttttttaatttgaggtacctgatatcaagggaagagctcatttgctatgcttggtgtttgagtcatgtgtttgcaatgtatagatgctttgttacagtgaaaagattctcttcatacccccttatatttcccctaaatggcatcactgtgtctgttcgtttatctgtgcaagagtaaatggtattgttgtttgcccacatacatgcctcacacgacacattgatcaatgagagctagttttgcggaagaaacacattgatcaatgagctaatttaaggaagaaggttttttttgccttggtctcggcgctatttgcaaatatgatgatcaaattaagataagggagtagtatttttgtaacaccctgaaaattcgaccaacaaaaatcaaagttccaaaaaaatatggaccttcaaaaactttttaaataaattgcatcatgccgattttgtttgattattttatttgatttcgacttcggggtttataaaacgcgaagaatgaataattaattaggaatgaaccaagcaaataattgaaattcaatttaaataaagatttggtgaggatagaaatgagtaaaatattaccgcgaccatatttatatccctcagatttaaaagcgatggaataagaaataactctagttaaattcaagtaaattacaataataataataataaaatatggaataaattaatctcgaatggatccatgggttggaatggcacaaatattgaatatattttatttatgcaaaaactgggaattaaagaatcaaatctaaataataaatgggccaaaatcgggttaatagaaaagggtcactattcatcggccgccaggtgttcgacgaggttccctagcctaaccctgccccattgccgcgccgacaccgccccgagccccgtgccgccgctgccggccgtcgccatcacgctgccccgcgcgcctgctgcccgagccccgtgccgcgccgcctgtcgccatcgccgtcgccgcgctgccatcccatcgccgtcgccgcgcggccgtcgtgtcgccgcgcccgtgctccacgcctcgcgccgcgcaccgccgctaccgccgtcgccgtcggccgtcgccgtcgccgctcgcccgtcacgtcgccctctcgcgccccgcgccccgccgcgccgtacgcccgtcgtgtcgccgtctcgcgccccgcgccccgccgcgccgcacgccgtctcgtcgccgcctcgcgccccgccgcgccgtgtcgtcgtcacatcgccacgtcgagccccgcgccgcgccaccccgctgacgccatgaggccgccgcccctctcccctcttccccttatctctcccccctcccctatataagccccactgctcccactcttccccttcatcctcacctcctctcctctacccactccaccacgccgccgcctccacgacgccgcgccgccgcctccacgccgccgcgccgtcgcatagagccgccgcgccgccgccacgaagccgccgctccgcgccgcaccttgcgccgacgtcgccaccgtcgccgtcgccgccgtcggtaagccgcgccccccttgcgtccatcgttgtcgccgcccgggagggcaagaagccgagagagagagggaggaatgagccgggagggagaggagagagagaaaaagaaggagaggagagagagaaaaagaaagagaggagagaaaaaaaaagaaagagaaagaaaataaataggcgtttgagtaaaatttagaagtttagaaaattcaaaatagttaagaatttaatcgtaggttgattatagtcgtaaaattgcgaaagttaattataggattaataaaaatatagttagatgaattcttactaattaaatacctaaagtactagcatttaaatataagattaatgaaaatataattggatgaattcctatagattatttttagtaatctccctaagaaatcaatttcgcggtaataatttacatgtgattaagaactcaataattcgatgagtcttaggacatgactataaattacaaaatatcttagggagaagaataattccacttcgcgaataaagtagcctatatagaattcacctcccgcgctcgtttttcaattcggtcattatttggattttgtttgaattctaatcgaattcaaattgttcttacgcacgtaactatagagaccgagggagccgcggatccgggtgaaggccaagacccacaagacctagagcaaggcaagtcatcactattctttgatcacgttgatcccaattgcgaaatcaatttttgtttacaaataagattgcatgcaatgatgaacatcctacttgtgattatgccatgccttgattattgtttacccttaaatctttgtaaccatgattacgtatgagtccctagtcaattatgacacttgcttagaaatgctactttagaatcttgcatactcatgtttatcaaatattatatgcttgggcaattacctttgggaagttaattgagatgcggcatgtggagacatgagcaccacattgccatgataatgatgacatgaaaggaattaaaaatatttgttttagaccggggcggacggtggatttgggtggtatccgggaaaggctagtaccgtccccggtcaattaaggaccgagccatgaagttaagcatgaaacgaccccgtacaaccacatttctcgaatggggatagacctagcagagtaaatagccgagcggaggcattatccatgcatagtggtttctcatgtgtaaggcaggggctctataatggtgtcgccattgctaggactgccgtgtgtggagttgaacctagttataacttaattacatgggtgtaaaactttccttcccgggtgcgccagaactcctctcactgctagaaactgtgtacgcctagggtgcatgaggatgaaaagttcatggagcgggtactgccaatgcgaggttatcgaaaagctttgccgtgacgcgtctcatgtgttgagacaaggctcatgtgttgggcagtcgcggagtgtgggtaaagtgtacatccactgcagggtgagtaaaccaaatctattcgaatagccgtgctcgcggttattgagcaccgggacatgtattacacttggctagtctctaaattcttaacttgtgtgggatgggttgttgcatgacgaatttttatgctgttggagccacttcctgagaagggggaaggtgggcgtactcagaaaaccataacgactcaatggcgggaagctatccttgggatcacaatggatggtggaaagaaccgtcgttgtttaaatacaaacactggtactaaaatttgatcagtcaatgctaggtcttaggtttgtgaaaagaattacaaaacttgctttgcgcaaaagagccatagccatcctttgaaatacccctttcatatgcattgttgctgtggtggcttgctgagtacggttggtactcacccttgcaaatataaaattaatcagaagcgggagatgaagcttcggaggatccctatgcctactaccaggagggagatgaagacgatggcgctcagtaggtcttagtacggtcgttgcctgtggcaatggcatgccgctgcctaaactccgctgccttatctatttctgcttttggatgtattccggaccgctcggtccgatgatttaagacaatgcctgcgggcttatgatgtaataattagcactagactctcttgtatgtgcttttggtatttcagctatgaactcgtgtgtaccagactacttgatccagggaaatggtactgtttacacgaataattcctgttatgaaaacggggatccacaattttggtgatagatattttaataccaccattatcattgtacaattgtctatcataatctaattagtactccctccgtttcaggttacaagtccgtttcaggttacaagattgacggagcgtggggctcctcaccgggagaccgcgcgggcccccctttgccggttcggccaggggcgctgggtgaggttctaagcccttgatctgtggaatggttcgcgagagagcaaatgcgcaagacacgggcgatgtagataggttcgggccgctgagaagcgtaataccctactcctgtgttctggtggatctgtgtatgaaggagttacaaagagctggagagcaagagagttcaaactctagagaccctctccctactctttttccccagtcccctctacgagctcaggtcttctccagtctttttttccgtcccctctcttggtaggcatggtcctccttttatctctcaaggggataccacatacaccatttctacctacccttcttttgggtggggacccatcctactttgaccaaaacttggctcgtacttttgcctgacaccgggataaccctgtcctccctcattaatgggcggagatttgcaatggctgttgtccgaatgaccctccgatgggatgggtcataccaacctccactccgccggaagcaggtgcaacgtggaagcacggttgtttgccgatgacgcgaccggcgtcagaccagtcacagaccggtcattcttgtccaccacgtgtcagtttagcatgctacacgtctgcccttcttcatacaatgacttccttacaatggttgcgatgaagcctggaatgtatctggccggggctgacgtgccaactccaggagttcccacgccggcttcggctagggacgagtgcctggaggctctcatcattccgacgggacggggcgaggcgtgtgtcaggccgcctgttgccccctaacccgcgatctgaccggtctgtgaccggtcacacactgcgaccgatcacggaccggatgagtgtgctgcgctacattaaatgcggcgtggggcgctcgtccaacccgcaataaacgcggttaggtgagcgccgctgtgctcacctaacccacacacgtggcgccaaaccctcagggggtcggggcgccccagccctcggggacgaaacgggagcggcccgacccctcggggagatagagggaggggcggcctcatcaccctcgggcccaacccccccaagggggtcaggccacgtgggtgaccgcggctgccccaaacctctagtcaagatatccccggtcccatgtcaccgacagtagcccccggcgttatgccagggcgatcgccctcctcgaggaaaacgctcgggtgtgacgccactcctcaggcctggtgacaggtggggccggtctctacaggcggacaggaatccagtggtcgcaaatcgcgcgcatcggcaagggaaaaaccgaccgacaataatgagcggctttcttcaagaccgttacattacttgagtagcgcgcgaattgggacgagccggttcgtttcgcctggagatgtgatgatggtgcatcggtcggcgagcgtagttaacgcgcgcacgatatgtcccatctcgactgccacggccgcacatccgccttgtgcgccgcaaacgggcgagcgggattagtggaggagtgggcgcgagaaacgagggggcgagatagtgggcgcgggaagcgaggagccgggcatagcgtttggcaagggtataaagacgccgaggaagagattcgtttccttcctctcgccattattccccttgccttcgccgcttgcgctctaacttctcgtttcctgtgccctaccctcgccgcactcactcgctctcaaacccctcctccgccggcgttatggcacggggctccgcaccgctcgacggtagcgtgctgccgccttctcgcatcgtgagcgagaggcaggccgggctgccgcgccgatttatgccggaatctgccaccggccgggaggtggtagagctgggcgagggacgcccggcgccacactacccggggcggtccgtcttcttccttcccttcgcaatggcagggctggtcccgccattctcttctttcttcatggatgttttggagctttatgatctccagatggcgcacctcacccccaacgcagtaatgacgttggccatcttcgcgcacctgtgtgagatgttcatcggggtgcgcccatctctccggttgttccggtggttcttcaccgtacagccggtgtcgccaccgtcggtagtcggtggctgctatttccagccgcgggggccggtgttgaaccgctacattccctgcgtccttcgcaagaagtgggatgagtggaagagcgactggttctacacccctctcgccgacgaaacgcgcctccgacttccgagccagcccccggcgcaggcctccagctggcgggcgccggtagatctgggagacggctacgacgctgttcttgaccgcctggctggtttgcgatcccaggggctcacgggggccatggtgttcggcgactaccttcgtcgccggatcgcgccgctccagcggcacgcccggggcgcctgggagtacaccgggcccgaggacatcatgaggacccaccaggggcgcaaatgggactgggaccctgaggacttcaggatagtggtccaacgggtgctgaatctcagctccgtggaggcatccctcatccctcaaggggtccttcccctctgctgcgatccagagcgcgccaacatcctgaccatcatgcaggaggtcggggcgtcgggggagcgggccccccgaggccacgatggcgcgggcgggagccgcaggggggaacaatctaccccgggagggggtcgtgcttctgggccccgtgacgggggcccggggggcagccgccctaccgacgcccgggggaagaggaaacaggaggataccccctccccatctcctccccgagggggcggggcggtgcgtgccagcagcaggcgcctggagggtgctgtgccgacgtcgcagcccgagggggagcgaaaaaagaagcgactccgcaagatgggggggaccgaaccatgccggggaaacctcatctcccccccaaggtggtcgtttagccgacctcctcgcaggttcgtccctgcgcccactgcggccgtattcattctcctatctcccaaggcaagttttcactcacccgtttttcgtcttctggtttttcttctgcatcagcgagatcccgtcgcgcccttcccgccattccaagttcagccggtctgaggccgaggagacggcgaccgcggaggcccggaggcgggaagctgaccggcgagaagccgcaaaccgtctccgggaagccgaggaagctgcccaggaggttgtccgggctcgccaggctgaggaaaccgcttgggaggaggccagactccaccgggccgaggagtccgtccgggagacagaggcggcgcgcgcacgccgggcgggctgccaagcccccgatccgactccgcccgaggcgacgacgacttccgaagccacccacgacgaggccgcgggcgcaccgctcgggcccgacccctcgggcgacgctcaggacgagccagcttcgggggacgtccctgagtccggcacgtcgatcggcgggccgagcagtgcggcatccttaccgaggcggctcttccccatgccttccgctgcaccactgagcgcagagccccttctgcaggccttggccaccgcgaacaccacggtgttggacgggttaagtgcccagatggagatcctgcaggcagagcgggcggagctcgacgcggcgtgggcgcgtgtcgaagaggggcgacgctcggtggaggccatggtggaggcgggccgcaaggcacaccgccggcacgcctcagagctcgaggcccgtcgtagggacctggcggagatcgccagggaggtggaggaggagcgggagactgccctcattgccaccgccgtgtttaacgcgacgcgggacgacctctgcctccaatacgggagccggggggcggagctagagaagaagctcgacgcgtcccggcagcgcgaagaggcccttgaggctcgcgccacggtgctggaggagcgcgcctgcgccctggacacgaaggagagggaactggcgggtcgcgaggccgccgtcgccatccgggaggcaacgctggcggcgcacgaggccgcctgcgccgaagaggagtccgcactccgcctccgcgaggacgcgctcactgagcgggagcgagctctcgaggaggccgaggccgcggcgcagcggctggcggacagcctgtccctccgcgaggcagcgcgggaggagcaggcgcgccgtaatctggaaggcgcccgcgccgagagggccgcactggatcagcgggccgctgagctcgaggcgcgggcgacggcgatctagccgcccgcctcgcagctgccgaacacaccatcgccgatctgcagggcgcgctggactcgtccgccggggaggtcgaggccctccgcttggcgggcgaggtagggcccggcatgcttcgggacgccgtctcccgtctagaccgcgccgggcggcaagcgggcctctggggcgagcggaccgcgaagtacgccgccaaccaggggggcctcgcccagcgcctctcagagatggccgggactctccagcggctccccgaggagctcgaggagacgatcaagtcatcctcgagagacctcgcccggggggcagtggagcttgttctggcaagctaccaggccagggacccggacttctccccgtgggcagcgctggacgagttccctcccggaaccgaggacgacgcgcgcgcgcaggtccgggacgccgccgaccacatcgtccactgcttcgagggtacggcccctcggctcgcgttcgtcctcgactccgacgaggagggcggcgacggtggtatggacgacagcgacgacgaggccggcgacccgggagcctcgaagtgagcccccaggcccccgccaatcttaaatagtttttcctttcttcttccgaggccttcgggcccccttcttgtataaactaattcaatctgcaatcaaataaagaggaaatttttgtgtcagctctgtttgttgtgtgtatgagacgaggatggtttgtgccgcggtccttctgtgtcttggcttgaacgagggctcgtgcccaggtcccagcctcaaatggcgcgggtcggggctagtgcctggggagatccgcgtgtcgagactggccaagccgggaacgtggtgaccgagggttatggattacccgattgtgggcctttgccgattcccccccccagagttcaccacgccccggggcacggctcggttctgggccccgtttggcgattttagccggcccgggccaccgagggcaggatcgagcacgagcgtgctaattcaagccaagattcttcgaaaggaaacaatgacacagacacagtccttaggaaatcgaaaatgcttttattgaaatacggaagagaaaaaatataagcttatgcatgtggtagcccccggccaaccctgcacacccgggggggtgcggggttggcccgagcccgagacctgacacccgacccctactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggttctgctggtagcgcgcggctcggagggccgcgcgccgccttcgctcttcaaagtagtcgaggtcatctctgcgaagctgatcttgatcagcctcacagtacatggtggcccgaggggacctcagggtgagctcggatgggagaaccgcctccgcgccgtagacgaggaagaaaggcgtttccccggttgctcggcttggcgtggttcggttcgcccagagtaccgctggcaactcctcgatccacgagtcgccgtgcttcttgaggatattgaaggttttggttttgaggcccttgaggatttccgcgttggcgcgctccacttggccattgcttctggggtgggcgggggaggcgaagcagagcttgatgcccatgtcttcgcagtagtcaccgaagagttcactagtgaactgggtgccgttatccgtaatgatacggttaggcaccccaaaccgagcagtaatgcccctgatgaatttaagtgcggagtgcttatcgatcttgatgaccggataagcctcgggccacttagtgaacttgtcgatagcgacatacagatactcgaacccgcccggggcccgtctaaacggacccaggatatcgagcccctagacagcaaacggccatgaaagaggtatggtctgcagggcctgggccggctgatgggtttgcttggcgtggaactggcacgccctgcaccgccggaccaggtcgaccgcatcgttgagagccgtcggccaatagaaaccctggcgaaaggccttgccaaccaaggtgcgtgaggcagagtgggctccgcactcgccttcatggatatcggcaagaagctcgacgccttgttcccgaggaatgcacttcaggaggactccgttagtcgcgcgccgatagagggtcccttccaccagcacgtagcgcttggagatgcgctggacgcgttcactcccttcgcggtcctcgggtagagtcttatctgcgaggtacgcctggatctcagcgatccaagcaatcaatctaagggagctgtgagcgcttacctcgggtcccgaggcctggactccgacgggcctcgggggccgttcaggcgcgtccgtctcccctagggggtcgggtcgcgccgatggctgggcaagcctttcttcaaaggcgcccggtggggtctgggctcgcgaggaagtgagccttgagagttcgtcggcgaccgcgttatcccgtctgggcacgtgccgaagctctatcccgtcaaaatggcgctccatacgccgcacctggcgcacgtaagcatccatctgcgggtcagagcactggtactccttggagacctggttaacgaccaactgagagtcgcctaacaccaggaggcggcggatccccagtccagtcgccactctgagtcccgcaaggagtccctcgtactctgccatattgttggttgcccgaaagtcgaggcggaccaggtatttgaggacatctccgctcggcgaggtcaacgtgacccccgcaccggcgccatgaagagacagggagccgtcgaactgcatcacccaataggcggtgtgaggcagctgcgaggggcccgagctggcctcggggacggagatgggctcaggggccggggtccactctgccacaaagtcggcgagggcctggctcttgactgcgtggcgtggttcaaagtgcaaatcgaactcagagagttcgattgcccatttcaccacccgtccagtaccctctcggttatgcaagatttggccgagggggtaagacgtaaccaccgtgacccgatgcgcctgaaaataatggcgcaacttcctcgaagccatcagaatagcgtaaagcatcttctgggcctgagggtatcgggtcttagcgtcccggagggcctcgctaacgaagtagacgggccgctgcacctttcggtggggccgatcttcttcactaggggccgcatctccagggcgctcttcgtccgagaggccgcgcggggcgcactcggcttctgtgccgacgacctcggggtcggagggcgacaggcgcggccttcccgcagtggccccggggccatcctgggggtcgggggcgcctggcaccgtcggacaagcgggcggagggccagctccggccgtcgggggccttaggccaccgttcggctcgggggcctctcctccctgctctctcccgggtcgagtcgacacagggtggggatgcgcggagcgagggtcgtcctcgtcgcgctccacgaccaacgccgtgctgaccacctgcggggttgccgccaggtagagtagcaacggctcatctggctccggggcgaccaggactgggggaaaactgaggtacgccttcacctgagtgagggcccgttcagcctccttcgtccagataaacggcacggagcgtttgaggagcttaaataggggtagcgccttctctcccagcctcgatatgaaccgacttagggcggccatacaaccaatgacgcattgcacatccctaagcttgctgggggggcgcatccgctctatagctcgtatcttctcggggttggcctcaatgcctcgggcagagaccaagaacccgagaagcttgcccgcaggcacgccgaacacgcacttgtcggggttcagctttatgcgggcggtgcggagactttcgaaagtttccgctagatccgagagtaaggtctcctggttgcgtgttttcacaaccaagtcatcaacataggcctcaacattacgtcctatttggctaaccaaagaaattcgagtagtacgttgaaaagtaggacctgcattctttaacccgaaaggcattgtcgtataacaataagttcctatgggggtaatgaatgcagttttttccttatcctccctagccatgcgaatctgatgataaccagagtatgcatctagaaaacacaaaaggtcgcaccccgcggtggagtcgacaatctgatctatgcgtggtagggggtaagggtccttaggacatgccttgttaaggtcggtgtagtcgatgcacatccgaagcttgccgttcgccttgggaacgatgaccgggttcgccagccactccggatggatgacctctcggatgaatccggcctccagaagtcgcgccacctcctcgcggatgaaggcttgacgttccggggcctgccgccgcactttctgccggaccggccttgcgccaggccgtacggcgagacggtgctcaatcacctccctggggaccccgggcatgtccgccggtctccaggcgaagacgtcggcgtttgcccgcaggaaggagacgagcgtgtcttcctatttgtcgtccagaagaccaccgattcgtgtggtcttggacgggccgtcgcccagggcaacctgcttgatcgggacctcgtcgcacgtgatcatccgctgcctcggggcggctgggacggaggtgctgagcctctcgtcgccacccgcgggcttggatgccgcggcgaggtggtccgcgtgctgctccatgcaagcaagcgcgactttgaggtcgccatggacggtgatggggccaccggggcccagcatcttcatctggagataggcgtagtggaccgccaccatgaacttcaccaacgcgggcctccccaggaccgcgttgtagggcagactgaggtccgccacatcgaagttcacccgctccgtgcggaagttggcggaaccgccgaaggtgaccgggaggtcgatatgacctagcggccaagtgtgccccggcgtcacaccgatgatcggctgggacggccggagcaccatccccggggccttgatggcatcaaaggctacgggggaaaggatgttgagggctgcacccccatctatgaggacacgccccaacttcacgttgcaaacggtgcgggaaaccaccatcgcgatctgtcctccccgggcaacgcacggcgggtggtcggtctggtcgaaggtgagggcaacctccgaccaccgcgcccgccgcatcgcctcatgggtaggggccgcggccagaagctctcgcttcatggccttgaggctccgacgagaagcgtgagcgcatgctcccccatcgacggtggcgatggtggccccaggctcctggaaccctaggtcatcgtcgccatcgtcaatatcctcggcgggggccttctgcttggcctcacttcgccggttgccggagggagccgccggggccttgctctcacggcgctcctgcctcctctcctcctcccacttccttgtccgctcagccaaacttttgaccgcacggcagtccgcgaggtcgtggagggaggtgttgtgcacggtgcaccacttgccggtcgggcgctccctactgggagcgccggcctccttctttttgtcgctcgcaggcctcccctttcgggtggcccgcgaagcgccctcgacggcgaggacgtgaccctcgtcgtcggaatgggccgatctcttcttcctcctcctgtcccgtcgccctgaccgagcagcgggcccgggggcggccggagcttccacaccggaaccggaggagttccaggtccatgcctcctccttgcgagccacacggtccgcgagctgaaaaagctccgcagtggtctggggctccttggaggcgatcttctcgagcatgcggttgtgtcgcacgccccccctgaacgcgtagatcaccgcgtgtgcagggatgcacggtatggtgttgcggacttgacaaaaccgctgaatgtacgagcgaagagactcatcgtcccctcgctgtaccgcgtgtaagtccgcttctttacctgggcgcggatatgtgccctggaagttcatggtgaactgctggcacaaatcctcgcaagagtggaccgacgcgggtggcaagttcattagccaaccccgcgcctgtcctttcagggctatggggaagaaattcgccatgaccctgtcgtcacccccggcggcctcgatcccagtcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacggggggctggcccccgcgcccggaccgaagtggcgctccggacgaggaagcgccctccgatgcgtgggcagcacggcgatcattgcgccggcgctcgatattgaggcgggcatccggcccctcacgcacatcttcttgggtcggaggcattgacaagggaatggcggacgaacggtgggtaacggccgccgctcgccgcgccctccgcctcgacgacacggagccggcagtagcagcgctagtggccttggtggcggaggaccgcccgccggcgcctaggcgctgctgcgccgtcatgaccaagttggccacatcatctagccaacgtcgggttggagtctctggatcagggacgacgggcgggtgacgtaggagcgcgcccgcagcctggagcgcgccctggggcgtgctgccatcgccgtagacgaggaggcgacgctccccgtctcgccgtccttctccatcgctcgtgggcggcgaagtcgcggatctttcgtccccctcgagcgcctcctcccgcctaagacttcggcgagaggggggcggtggagtacgagctcgacgacgcgggttctgctcgctgtcgtcaccgctagcgctcggagagaggttgtgcgccactgcccgttcggccattgggctgagcgggagaagcttggcgcacacgaaagagaacgagggcttagaaaaacacacgcgccccctacctggcgcgccagatgacggagcgtggggctcctcaccgggagaccgcgcgggcccccctttgccggttcggccaggggcgctgggtgaggttctaagcccttgatctgtggaatggttcgcgagagagcaaatgcgcaagacacgggcgatatagacaggttcgggccgctgagaaacgtaataccctactcctgtgttctggtggatctgtgtatgaaggagttacaaagagctggagagcaagagagttcaaactctagagaccctctccctactctttttccccagtcccctctacgagctcaggtcttctccagtctttttttccgtcccctctcttggtaggcatggtcctccttttatctctcaaggggataccacatacaccatttctacctacccttcttttgggtggggacccatcctactttgaccaaaacttggctcgtacttttgcctgacaccgggataaccctgtcctccctcattaatgggcggagatttgcaatggctgttgtccgaatgaccctccgatgggatgggtcataccaacctccactccgccggaagcaggtacaacgtggaagcacggttgtttgccgatgacgcgaccggcgtcagaccagtcacagacc

SEQ ID NO: 1786 - DNA, 12327 bp, Oryza sativa
gacccctcagggagatagagggaggggcggcctcatcaccctcgggcccgacccccccgagggggtcaggccacgtgggtgaccgcggctgccccaaacctctagtcaagatatccccggtcccatgtcaccgacaaagatgttttgactttggtcaaagtcaaactactttaaatttgacaaagtttataaacaaatatattaatatttataataccaaattagtttcattaaatcaataattgaatatattttaataataaatttatcttggattgaaaatgttattattttttctacaaacttagtcaaactgacttagtcaaatttgaagcagtttgactttgacaaaagtcaaaaacatcttataacctgaaacggatgtagcagtttatactcccccatctcaaaaaaaaaaagacaaatcctaactatatatcttgacatgatgaatgtccaaatacataggagtatgaatctatttgagatagctaaacagacgacatgttctgagaattttctttttcgcgaacgcatattatgtgaattgtctaggtatgaagtgtgccctgtaaactactgtacttaactctatacctcccttgtatttttgacacaagattattgagcaatgagtaaatcctagagattttcactatagcagaatcatttgctcataattatttattttgagaggacattattgttcttgattaacaatgtaaagtatatattctcctcaacacccggtcccaatgtaaccgtgaagacggagctcagccacacacgcatggcgcaactgccgcgacaccgaccaacccttcgccatgcctaaatccggcacctccatcgccgccttttatatcctcctctccctctcgccgtcgtcgtcgtcgtcgtgccgtgttcgatcgcgccgcgcatcgcattgacatctccgaggaaagctttggtatatattgttgcgaagctagggccgccatggcagcgtcgacgcgcgtgtgggtgctcgccgcggtgctcgtggcgtgcgcgatcgccgtccgctctgcccgcgccggccacgccagcggccacgccgccgccgccgacgaggaggacgccgccgccgcggcgccggcgccgtcgaaggggcacgggtgcaacccgctcaaggacaagacgtgccggcacgacgaccgccacgatccggagaaccaggaggaggaaggggggttcggcgtccggctgccgtccttcccgtccctcaccggagacgacggcgacgacgacgagctgccgtcgttcgacacccacatgaccatcctcggccactgaaaacaaggctgccatggctgcaccatcttcatcgtcatcatcatcatcttcttaactgactacgtagctctgttgattggttcttgcattttgcattgcttgctctgtatcgagaagaggggaaaaaaaggttgaaaacaagatggaaaatgtcatgtagaattgttgctagagtgtgattctcctagctgatatctccaaaatgttgttgttaatatatcggtattgttcaatcttcagtgttcatcgatctccttcatgaaagcagaggatgcctcttcctctgttcagttcatcttcgatcacaagcaaatctatagaaaatctttaacatacttatatattaaccacgtcattcaaaatggaacaaatttctacaaacataatcgcctgcctttctgtgcccgcgtctctcacaattcagccattgaaatcgcgatgcatatccatgctggattgagcccttcccgttctcatccgatctcgatctctgtatttccggcggcggagcgccacgaattcgccggaggccgtcgtcggagatgaacgttgaaggatcgggcatagacgtcgaagcgtctgtaattcgaatcctatggaaggccgattcggccataagcggcggcggagcagcgcgaacggcgagaggggggacgtgcggcggcggcgccgttcgattaagattgtgtggataagataaaacgaggcgaaacagtagcctcaggccatcggcccagtcaatgtgaacagctactagcccaacctatgaaggcccacaaaacgtgggccgctaccattattgggaaaaaagtccaccgttttttttattaacgaacaagacaaccccgatttcattgaatatagcatgagaaaaatctaggcaacatatacggaatatttaaaaaaagagagaaaaagctcgagtcattagggaccaggccacaaaggctctttgctcccgtcagggtctaagttcttgcctcctctttgatctcaacgaccaaatttgttaaaaaaaacgagtaggacaactcctcaaactaactttcttaagttcactttaacttccttaagcaggcagaatctaatttttacccattgagttaaatagaccgggtagggcgactgttcgaacaattgaaataagtgtaatttgacccccccccccggcagaggttttagaggacagtttcgctgacatggtgcttacgtgattatgttgacctagattttattccacacggtgcttatgtgactttagaattaaaaaaaatatgtgaggtctatttattgtttacacacaaaaaaaataatggaacccctaacatgtagggcccacatgtcatcctccctccaacccttattcttctctccctcccttatctctatctttctctccttagcccgtctacaaggagcggggtcgggaggacggacgctcgagcgacggtgtgggcggccgagagctgaagcggtggcagcagcaacccaaatccagcccaccaagtttggactgcccaatcaggcccatatgggagcccatacaactgggcctcggcccatcacaaccagagccaggagcccagaaacggcccaaaatctctctctctctctctctctctctccgtgtcgtcgggccagctcacgcaaccccagaaacggcacgacattcatccccctccaacggctaccgctgcttccaacgcagcgccgccgcacgcggcctcctccttcccctcccccctcaacaacccaaccgcctcctcctccaaacaaatccacggggaaccatctctctctcctcgcccccgccgccgccgctgctcctcctccgatcggtggagcagcagccttcatgtacataccatttctttctttcttttttattcttgtttttttcaatttcttgatttcttgatcggtggatttattatttgtttgtgttcttggaggagcaggaagggcgaggcgggtctcgatcggtggagggggaaagatttctcctccagttttcctctagttttgatcctggaggaggtggctgctgcatcttcttcttcaccgaagattggaggagtggatttcgtgtggttgttgcggccgaccgctttcttgctctcttggctcgtcggcctccgccgccgatgctgcgggatgccgtcccccgacgccgccgccggcgatattgagagcgccctcgacgacttcgcccgcgccgacgccgactgcatcgccgccgccctcgcctgcggccgcaccagcttctcctaccgccgcctccccgagccgcgccgcctccgcctcaccgtccgcaagctcgacgactcctacttcggtataccaaatcggctctcttccttcttgccatggaatcccctcccattggatttggggtgacgcgttgctgtgttcgttcgtttcttgctgcttgggtagatgtgcaaatcgcgaggtcagccgcggtgtgggagctcaaggcggccatcgaggacgtgttcgccgcgctctacgatgaaacggacaacaaggccatctcttggtacggctgcatgcacatcaatcttgatttgcaaatgtaccaacaaatgcggcgaaaaaaaaaagtttcccctctttgcattacattgtgaatttctaatattcattatagtttcctatcttggtttgtgaaaatgatttcggtggttcctgagattttttttagtttagtctgtgtgttgggttgatatattggtaactaagcattgttttgcttgttttaggcagcacgtgtggagccacttttgcttatgtttcaaggacgagaaattgacagatgacaaggcaacattgcgtgcatttggtataagagatggtgatgaggtatatgcatgatctctatttgtgattggctcatggatgaatctttagtgccgactaattctcctatttttcttgagtatgtgtcatgtttatgcaattgtgacacattagtacacgatagattgctgtatttgcaaataaaaataggcataatttctttgttcatgcacaagatatgcctatgatattaggcaattttcagaatagacactattgcgtgtgggtaagctctctagtcaagtactaccattgatttgtctgaattcctgttgacttttcatgatgccatttgtggtcctctcacatcaaattattgtttcagttttcagaaatagggtaagagcaaatctaattcagcaaaatcttgcactacttttgatctcttctatttcttggtcttagagatttaggtggttaccgagatcttgcatggtctgttttgtgtaaagaacgactaaactaagaaaaggatccactcttacagctcacatgggtttgactggataagcacattcaagcatgcatgtccactaattacatctgttcgagtcttaagaaatcctttgtaaattgagtcatgattctaaataactctccttgtgtttaccgccttcaatcttttgtgcaggttcattttgcccagcatctttctgttgaatacagaccctgcaagtccctttccctcagaaggtaccctgagcttcaaacgcccctgagggcttttcgtctatttgatctacatcttccattttgtacaactttattggatgttcagaattgatgacattcctaatgatttcttatgttaggtcaaggacttcattggatgatttcagtgctaggtcaaggagtttgttggacgatctcggcgaagatgatggtgataagtttatcgacacgaggcattctactagtgttttggaggaagggctatatgtttatcagcacgatgaggagcgcatggaagagagtcgcaagaagggaggcttctttagcggttggttctcctattctagattgaggggcaacagtaggacacattcagaggatgccatccaatcctcctgcgaaaagagagatactcgaactcggccaaagctggggagatggttgtcttccaaaaaaactaaaggcacatagcaatctagattgccaactgtatctcacacgtgttgctttgttcttctgaaatgaaaatcaaaattacattcttgtcagcatgatatgaatgcttcttacttcaacacgatgagaagtggctcctggcataacttggaatatatacctttaacttagtcaatatcagagttttctctgtatgtatatatacgtatgtgtactgtctgactcttgtgcagctatgcttggttgaagaaaaacaatgacaagtcctactatgtggtgcaaccgtgcaatgaaatatttctcctctctactgaatctttcgttgcataagagataagagacatgcttgatgcctaacagattttcacggaacatttagtgagccaactctctcaaattttgatgctttacaacttacaatttattgtcatcctacacatagaatgaacccaagacaacttgggccaaaaaaaaaaaactatccatactaaaatgaacaaattaaacatttaaacagcagcagcagtagaagatcaaagtgtagaagctaactgagaagaaagtgtagaagctaactgagaagatcttgattatcacacagagcttgagatccccagggctatgtctccagttctccacaacacaagactactaatgcccagggcctcgtggactcggtccggccctggcgacggcgaacaccggcagcctccccaccgagaacccgccgccgccgccaacgtgatcacgcagaggcctcgagcactccaccgccgtgcaaagcagcaacaccaccaccacaagaacagccagctgcatcagcgacaacgacgacgacgaccgaaaccccatccccaactccgccgcgctgccaagaacactcgaacaagctagctatcttgaagatgaagaagatcgcggtcgtaggagcaggagtagtaagggtgtttgattggcagaggttggccatggctgggaggaagaagaagatgtgtatataaatggaggaggcatagcagaagtgcaggacaagagacgtgcgttgaattgaacgcgcggactttggatggatgaaaagcggagaggagttgacaaaatggatggaggaaaagtggtgaagtaggcttgatcccgttaaccttcttcggattctgaacaaaatcttcttccttcccctctccttttcatcatcgtctttttctttttcttgctgacgttgcatttacacctcctgtttgaccaccagtgcagtgcagtgcaaatgcatggctagtttggaggtctggtgttttaatttgatttatttaacatgatgcaaatctgcatgcagttggtgctggtctgaatgttttgtgctggaatgacacattcagagcttttgcttggtgctttgataatttaatagaggaattctaaatgtaggggaaactggtgttgcggtatgttcaaagtttcttttttgagtcattgttacggtacagcggtcggtaccagtaccgcccggtaccaaaatcctagccgttggatctggcccgatccaacggctagtagagtttggtaccaggcggtaccaattctatccctatccagtaccacacgaagaactgaggtagaagggcaaaaacgtaacttcgtgtgcaataaccagatcgggagggatggacgggcagctcgaaccctagaagcggcgggattctcgatcgccgctgccgcctcgtggatcgacgccgctgactcctggaggtgaactcagccatcgctgtcgccgccgccgggaaggacgacatcgacgccgccgcctccgggaaggacgacatcgacgctgccgccgtcgggaaggatgacatcgacgccgccgccgccgggaaggacgacatcgacgccgctgcctccgggaaggacgacatcgacgccgccaccgccgggaacgacgagttcgctgttgccgccgacgggaaggacgacttggacgccgacgccgccgcgcgggaaggacgacatcgacgccgccgccgccgagaacgacgagttcgctaccgccgccgcttgcttcaacgccgccgccattgggaaggacgagttcgatgccgccgccgtgacctgcttcaacacatgccaaaatccgccgctcgccgccacttgattgcttcaacgcatgccggtgtcactctcttccgatcctacccataccggaacaaacggcagatttgtactggtactgagcggtactagtaccaagcggtataatttgctggaccataaaaaaatctcttcttttttttccctacctaatgttatgcagtcaatggaattctgagtgttgcgttgcttctaaattgcgaaggtaaattaaattggagtacctcctactcaaagtaaattcagcagtggtgttttctttgccagttagcaaagcacgcactaaattcgtcgtcggtaataatcaccgggaggtgcactttcaaacgctttctgttacatatttgaatggaatccagtccattcattcaaactgttgaatgctgaatcttttaccaaaggcgtccatactggttgttgctatccccgttcggtcatttatactacatatttttttcagctccttttcttttcctatccctcccgacagatttatcttagatctcgtcactcgtcagacgatcaactgtcatgcaaccttttggaaaattttcccgcattgttgttcgtttcttgtgccatgcaaccttgtgtcggtcgggtgtggcagaagccatgtgtcgccgatgtttagttggtggtttcggattaagcgacagaccatagcggtaggcggttccgagcgaaagcttagcccaatctttaggccaacagtgactatgctttcgggcgtgagggcattgttgaggtacccctcctccctcggtaaggagctctgggtgaaaaccttgtcccgtttttgggacggatgacgacggcgtctcttggagtcgcgaccctcgtgagggcgtcattttagagtctttacgccgttgtggtgttgttggcccggtggcgatcggtctcacatagcgacggccagttcggtactcggcttccctctctgtagcgtgtgtttgggcggttggtacatggttcggggtgtgtgccttggtgcacttccttcctcgacagccagctgtcgatgtaaaacttttcttctaatcttaattatattgaatgacctccttcggtcattccggcaaaaaaaaaaagttgccgctgttcaacaaaacccctcacaatgtgagtcctaaaaaaaatgtaagtctgataatttatcctgtcaaacaaattgataccagtgcccctattccttgcattttgtttggaagttcctactatattggtcccttcgaaccttagtcagatcaagattaaataagagcatgtaaaatgagaaaaccattaacgtatgataaattgtgttttaattattataaatttaaaaatatatttatttgatatcttagaacaacttatatatacaaagttttcatatgaactgtatcatttagcaattaaaaaaaacatactaatgaaaactaaaataaagtcgatatcttaattagaaggataattttaccatacctagaggtaccatatttttttatgtagaatttaacgaaacgaaagaggcatgtgtgtggcaaagcagctggacggctcaggtgcatgctggtgaagaaagccttggagctaaggtggcggccgaccaccacccgtctgcgctgctttgcaggactccgcggcgcgtatgcactgtttgcagctacgaaatgagggtgttgcattcgcacgcggcgggcgacgtacgacgacaccgacacggcgacacccgtgcacgaccgaccaatgcaccgggagggagagccaaatctgccaaagaatatcgatcagtagagatcagatcactgtgtgtgttgacagggaaacaaatctgttcagagaggtttcatcccgaaaaaaacaaatctagaactggatattatatattctagtacaataaatctgaacataggtatatccaaattcgtattactagaatatgttacatttagcataggttagttttttatgggacaaatggattacgagttacaaccggaccggggatgttgtcgtcttgatgaaagcatctgtgcactttgccgatggaaaaagaacgggaagaaaaggctcctgtggattttcttttcttctttttttcatttttcttgcataccgcgcgcgcaggttaggcaggttacagcttacagcgcgtggttgtgccgctggtgaggaggcgacgattgtgcgtgtcgtcgccgtgtcgcaaaaattccttgcttcggcgtgtgcatggcgtttgacccccggggcgtcttgacaccgccggcgacgtggctgacttcctcaattctcatgttgctttcgtcctttctccttgtgggttcggtaggttttacatcactccgattttttttcttttaacattttgatatttttaaaatttgttttacaaataaacacttgaaaaaaattatttcagaaataaacatttttcgtggctagagttattggcgttattcatgttaagtcattagcgtgaagagggtcgacaccaaagaccaatttattttttcctgtttgaaaataacttatttgtaataaaaatatatttataaatagattctagacatcagtttcattggccgataacctattttaaaaaaagatatatttacatgtttgtcctttttatatttttttacaaatatgtcatttgcgcagatccccttcacattgatggcttagctttctgggggataaggggaacggcgctggcgttgtcatgttagggtaagacaaactatagagatgttccacaaacatcttacttgaagctctgtttcgagtgcactaagcgaagaggcaagtgatgagtacaaatcatggaaaggtcagtatagcttgaatgaactacgtagtaaaggtttagtacagagcatgattaagtcacggtaactaagtacccgtaacgtttaatagatagaagtaagtaacaagatcatggcaccaatgatctaataagtttttaagagtgtatttgtaaaataagtttttaaaaaggtataaaatgtaaaagtaatcagttttacatcacctcttcatctcttcctggcctgcgccagcgtgagtgcgcgccaagaagaggaagatcgtatgatttgtgccacgaagggagggggacctagattgattttacatattcagaaattctatttcactaacctgagcctaaccttttccaggttgtttgccttcagaattcagaaaaaggttgtcgatttgcaatttcacagacaatcttcagctaaattttccggtgattatgagtttctggctgcgtctctgaaacttctagtgtatctgatttgaacaaggtgaatacggatgcacagtcatccttcagaattttatcatctgaagttatcttcaggttctggtcttctgaataactcttgagcttggcacttctgcacctctcatatattcagttcttcctcctcttgtaaatgagcacaaaacgttgtttatcttcatccgtgtaagcgcacgccgcgtcttcatcaacatcttcaatcttcatccgcatgaacaaatatgttttagattttttttagaacgaaataagttttagataagtctacttcaaaattctgcctccaaactgtgaaacgagattataacaaggaaaaacgaactactactgaagtactgattaactcgatttcgggtgtgttctttcccgactcaccgctctcattttgcacgcgcacgttttccaaactattaaacgatgtttttttcgaaaaagttttctatagaaaaattactttagaaaatcatattaatctattttattttaaaaaataactaatatttaattaatcatatgctaatgagttgttttgtttcacgtgcgtagagatagctcccaacagcacaaaacgaaagcagccttcggattggtctaaggcccattctccatgttgtgaatgggctcttgtatatcgtagcccacctaaaacaaatcgcatgtagggatttggaggattttactaattacttatcgtaaattcgctaagaaaattaactatccgaactatcctgaaaaatcatgtattttaaatgagctacatactataaccctatatactatcggatgagatacagcattttctgcttgaacaatatgtttttctactctttttaatttctgggtgggccttcaacaccggtttcacctttcgttgataaataaataatgttttgtcttcctcgcttggtgcccaaagtgcccaagccgaaaatctttcctcgccaatgggccaaaataatactgcagtatgaaatggactattaatattagccgtgctctatgtattactactagctattaatatttcaaaattagtattagctccccctaccctaaaaaaacgaatacatccacaattatatatacatctagaacatccaataaaaccagatctagcattgaatatattttgataatatatttgttttgtattgaaaatactattatattttttaataaactcaattaaacttaagtaaatttgactatgaaaaagtcaaaacgatatataatacgaaacataggtagtattattttttttcgaacggccaatcaggtgattggcattatattaatagagaggagtttaaatatagtattaatatttcaaaattagtattatctcctcctaccctaaaaaggccttacacatatatccacaattatatcctatgttcctcgtttcttcaaaattcattgtattgtttcgtgatgaaaaaaattacataggatacaatgaagggatcacctatacatttgttaaaaaattttctcctaaaaatttgacagatataattataatacaatcgtgatgcaattacactgtaacttactccctccgtcccataatataagggatt

SEQ ID NO: 1787 - DNA, 1077 bp, Oryza sativa
aagtaagttctctttttatactccctccgtgctataatacaagagattttaggtggatgtgacacattataatacaataaatctgaactacatctaattaaaattctatatattattaaacgcagggattataacgcactagccgtcctagccgagctagaggagtcgtggagtggggcaaggaacggcagggttttggcgtcaagtgcaggcggcgtcacggctggggtcacacacgtactcacgcgccgtgaagactggtaaaacccagcttccagccgcaagacggatggacggacggacggaggttgacagcgactacctagtacgacgagtggtaggggcataggcattgctgggttcgatccctaaacatcactgagatccgcagcaggggatcacgagtgcgcgcgagccaggaagagaccatcatatatacgggagtaattccattctttttatttaaaaataaggggaatgccaccagacgataaacgatgtctcttctaaggtattgcctgatacctgatatcatcccggctaatatctaccaggtatcacgtgatacctcaaaggtatcatcccgtccaaacaggtatcaaccgatacctacctaccagatattaggggataccttaaagatatcgtcccgtccgaatagaatatcattttgtagtattttactttcaataatagaatcattaatttatttataaaagttttcagattatttaaaacttttatgtaaacattaaaaaataaatcatgcttaaaagtatttcataataaataaatccataataaattaaattaaatttattttttaaaaaaatatgacaaatgattaagcatataaaaggtcaacaatgtctgatatactactttctttttttaatatgtgatgttttaactttttacatcatgtttgatcatttgttttattaaaaaatggaagtacacatttttcttttgttgtagcttgatttattattaaatgaacttaaagcatatttttaagatttcctcaaaattttaaatgaaacacacgatcaaagcttgtaataaaattttatggtg

SEQ ID NO: 1788 - DNA, 8090 bp, Oryza sativa
  unsure (1)..(8090): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacatgcaaagatgccacatcatcatccactaattaacaagatgccacatcatcatccactaccaatcatcacatttaaatatcatgcaaacatgttatatctttatagtttttataatttaagagctttcaaatacaaacatgttaaattatcatccaacataatttacataatgtttcaatatatatctttattatgttttatgatatcctatatagttttatagttcatcctcatttagttagtgcttaaatgattaatctatggtccaaattatctttatcattttttcctctaattaagtcatatcacatcaattgtttttagcctttagatgattaatctactttccaaaccatctccttatttttcttcttccaaaaagtcataccaccttactctttacgtttgaatcaccattgtacatactatttaaatttaaattatcataaaccacattaacttacttaatctgatgttatctagctatcttacaacaggttatttttttttattgttatcatactaaatttcccgcagcaatgcgcgaggtttcacctatttttttaccacttctttaccactgcaccccattgtccaaatcagtgccacgagatacgatatcaggaaggcagtaacaatgattgaacacatttttcgttgatagttaagaaattcgtaggaagtgccagtaataatgatctagaaagcattaagcatcactgccataaaattcacaagtttgtaagataacatagcatgtcaaacatcacacaggaaacagtaccagtaaatttcatagagctccccagcattaatcgatatttagaacaacaattcagtatacggcaggagtcatgattttacatgcccgtgcttcgaactgtccaacattcgctctctttcctgcatcccagcctttgaagaccttcatctagaccccattgagagtgatcacaattttccgggaggaagcattgtcacgatgttcacagagccatataccctacacaaaataagtccatgaaataagtgctcaaaatttaagaagtgtgctctatgatctagacgggttttataattagttattttgctaggttacagctttgcaccggatattatcactgaaactatgcctgaatatgggatacaaagcaccgcattgccttaaaagataagtttaaactcgcgtgcaacataatcaacacaaatttcacatgcacgattgcatggtctcctaaaacttcatgacaactttttatctcctgtatatagattcgagaacttcatgatgaacttaaggtcgctatataaaacaacgaaacatttagtacttcaggtttaacctagtggctaaagtggtacttgttaggctctcaaaccatagagacaagtttatttggaaagttaacaaaaccagaatattttcggttagctccatgtataaatgattatgtatgaggatgtagtgccaaggaaggatttaatttggaagcttagaattcatttgaaaaacaaaatcttcctctggtatttaaagaagggagtgattctcacgaaggacaatctaacaaaaagaaattggaagggcagcactaagtgttgtttttgtaaccacaatgagacgatacaacatctcttctttgattttcatgtggctagatttgtttggagtaccctttttataacatttgggataaatccgtctaacaatgtttctaatatgtttgggatttggctaaagggtttacaatctaggctaaagcaccaaatctttatagggattgcggcgttgttgtgggcaatgtggatttgcagaaatgatgtggtcttcgacggctccaattttaactcttacttgcaggttattttcagggggacatactgggctcgacaatggttcttattgtgtaaagaagatgagcgtgatgtgatgaatgaaggatgcaaactgttagagacatctgtcatgcatttctttggtaaagatggatggaacatgagaaagcggttaaaggagttatgtggtcgttggtttgtttgggaagtcttttcactttgaaaggctttggagtctttgtgctcttttagttttataaattcccattatctaaaaatttagtactgcaggttgacaacaaaataaccagaaaataaaggatagtcaattgtgaaaatgatatcctatatgtttctattacctgccaagtgcccatattgagatgcccatcagttatagggatcctgaagcaatgcaaaagaagaatctaatttaatattttgttggctcacttgggagaaaattgacatggggaaaagaatgtagggattagggaacacatacgtcagggcacaaccaaacattgatgatttaatatgtgctggcatgtcatcaggtcctgcaatttgaacagcacagttatgactattgactaatatggcctgatctgaagaatagtacagtcttgactcttaacaaatcaaaaaaccgtatgctagagcaatttaataccatctgctactagttcagtacagcctaactggataccaaaagtaacctcttgtttctcaaaaaaaaaaaaaggaagtaaccacttaaataaccttctagagtgtgcttccaaggagcagatcggccctgaaaatagtgaacacacaatgaagtggctcttacatgatcccttgtttgatcatgatcaaagacaagacaaattgcaaccactgacctctggtacaattcggttaaggaaagtttcggtgtcagcttgtacatcggagtcatagttctcattgatggttagggaagcgcttgtgtgctgcactgtatagtgaaaaaaaaatcaatactacaatcgtacattcgtacattgaaaacatgtgtttacttggacatgcttatcagcttacgaacatgcatataattgacattgtcattactttaaagaaaatgaggatggtctattttcttatgatgccattaattgatgttgaacttatattacttccttgtataaattggttcacacggattcaaaacgattccagtcaaccacaaatttattctctcaagtcaatcccatgcacaagataaaaacaagtttttaacatatcatcatatcagaatagtttgctaaaaccctcgcaataattaaatcccacttaggccatattcggttaatccctaagagagagggagggattggaggggaataacttcacaccccctcaatccccttcaaaccgaacaaggcctgacggatctgaacaagcacgcatcacatcagcatcagcatgttcaggggaatttacctacaccgtatgcggttatccataaagtactttcagaaaattgcctagcacagcaatcgatcaacaacaaaatcgagctatctaagcaagagcgatgatgaatgaatgaaccgatcatgagttgagttgagtgtgtgcatctacatacagaacagatgcgccaagccgcacttgaacccggacaggtcgccctcaatctccctcagaatctgcaaaaggtctcagtcaagcaaagcgctggagcaaagagatgtacggacatggcgacggggagggagggagagaccttgggggtgatgaggtggcatccccggcgctgggcggggatgacgattgtcttctgcgcccacttggcggccatggaggagtgcgccgcgggcgggccggcgacggccaggccaggggatgcgaccggacggcgcgcaacggcggcggcgggttgtttcgcagtcgccggcggggagcagcgagcgagcggtaatggactggtggtggtggtggtgggccccgcgctctggaagcttcggatgggtgaatgccaacgcactagcattcgaggccgtcggatggatgatcaacgcttcacagaattcctggagaaaggtgcggaaaaagaaaaatactaaaatgagtaaatttcacgggattcctgtatgtttaaatccttagctctaattttatatttgagttataaatgttcacattttgtgattaggatcccgtttgtttctactgaaaaagtggatgaaaatttgagtactcatgacacgttttttaaactactaaacgatgtgtttcatacaaaaagttgctctaaaatattatattaatctattataaagtttataataattaaaacttaattaatcacttatttacagaagaaaagaacaccacctaaattgatatcatttactatatttcattttaaattcgttgttctatgataaatttaattttatgatacatcctattaaatacgtagttctataataatttaaccaaagtacacgtagtttttatggaatttacctttctcaaaagaaataatgtccgagcacgatgggccgcaatcttggcccagtcacagtaaaaaaaaatctcgtaaaattgagggggttttacgcattttttggaaaaaaatagcagtagccgcagcggaagcggacagcagcatcacaatcagcgagatgcaggcggcgctcctactcccagcgcggccgtcggcggcggcgccgcctacgctcttgcggcggggggcggcttctgcgtcctccgcgcgcgctcccactcccctccctgcggggcgcctcagcggcggcgtgctgagcgctgtgcggcgccttaccgtggcggcggcggggtcgtcgtcgtcgtcgtcgggccctctctacccgacgcctccccccaccgagcaggacatcgagcgggccaagttcgagcaggtgcttcgctaatgccgcacccccctttgatctgtctgtgcctggtagaggtgcctctgcttgaagtagggttaatcgtgtgttcgctgatattctcgagaaaactcatgttgctgtaccacttggggattggggatgtatctagtgttggattatgtagtggtcgcgtgttttccgatgtgcatttgggtatcatgaggtttagggttcaggcatcgagcgattagtaatctgatgtctctaagacagggaattgttacaattaagcgaaggtaatgatttttttagagatatcgtctgtaagcgactcgttctcttttctgtatattgtgatgacgttaatcgcgcataattgttggattcacttctgttagtttatcaaccttgctgcattaagttttccttatcgtgtgtcctgtcacatctattgctttctgattgaagtctttgtgaagcatctggttaaacaatataaatatataatgtgtcattcttcgctaggatatgatttataccttttggttactctattatcctaaagacacggcatcattggcatacttcgaattttgataccagcataccaccacttcttcctacttgtataacagaataccttcctgattatgaagctacgccaaggccatctttttgccttttagtttgatatgccatactcaatttggtttgtaaagatatttaatattcttgatggaccttgttggttaaccttcatgatatttttttttaagattgggaatttgctatttcttcatgcttgagaattttacataataatgtatacgccacaccttttaacttctgtatatgcttgttttagcctaattgacatttttttttgcccatttccgtggagtaaatggcaggttgtcaagagactggggaaaacagcgaggtatttcaagaatttgggtactcttgggttctggtcccagttggtgtccacagttgtttccgctggaattttgtcattttctacagttattactgggaaggtgacagcaccttttacattctatgcaactgctgctggtattgccgcgggttttatttcagtcttctggtcatttggttacatccgcctttctgaaagacttagaaaaacagcaagtgaacctgctaaggtactctctttctcaaccccattccctgttttataatgtctcaacactgcccttaactcattttcgtacttgtctgacttctattggacggctgaactggtgctttcacataagtgtgttatatgtctgcttttggagttatatattttaggtggttattttgtacggcaagtttgatattcttcttatttgcctttttggtaataaaataaaactgtgaattgctttccaggctcctccacgtgctgatgtaattagaagtctgaaaaatggcattgtgctcaatatgctcgggatgggtgctgcagttctcggcatgcaagcaactgttggggctttggtagcgaaggctcttactacctctgcagtaccttactatcaagcaacttcccctggtcaaagtcctgttttggctctagatgttttcctagttcaggtatttgatttgcacatatcctttctccccttgaaccattttctctccaaattttcagttgaaaataagcaccatggttcactctcatttttctgcattcaacattctggtgctggttttcaagtacttaactcatttctactaggaagtaatacgtttgtacacttgcagtttttttaagggcccctttgaaatggaggattggcaaagattcatttgcctaacgaattttcctatagagccctttgatccataggaaaacttccataagataggaaaacttccatagaatagctttcctatggtcaattccataggaaaataagcaagaggttagacctcttgtaaaactttcctttggttgagttttttctgtggtgcaatcaaagggcttcttgtgctctcaattcctgtaggattgaaaaaacatactaattcaattcctgcgtttgccctattcctacaattttcctatcttgcctttcaagggggaacctaaacgacatatatttgtttatcttggtaaagaacgctcactgagaggttcatgtttacatgatattctatactatcatctactttaaatgatttgtctgattctatatatttttattaacgttaaggatcatgtatgtgtaatagcaacgagataaatccagcgtactatgcctcactctgaataacaacaaaatataactaccctaaatatttccaaactttccctgcttttaatcatataatccttcttccatgttgagtagaaacttatattataaccatgttatcatttgctatgatggaaaatgaactactgaattgttgtttttggtcatcattgcacactccagtttatgatctgacccgttgtagtgccattaatcatgttgaacaatcatgatacgcaggcttcagcgaacatcatcctgtcgcatttccttggcctggcgagctccctggagttgctgcgctccgtggccatccctccagcagaagctgctgcggcgtgagcatatcagcgcatatgccaaaggcaagggctcccgttgatcatcttgctcttcatttgctgcttcgggctttggtattcgctaggagtagcaccgctcgtccgcctgtatgtttcttgtccagacaaaatttaaaaaaaatctagctttcactgcgtaaatttcatcttgcttgatgctgagtagcagcaggttcacatgaacagcagtacaccggggagctggtggtggtacacgtacggtaagcacacaggctttacgagttgaatttgtgagcgtacaatcgctaaggttgggccgagttgttgggtggtggcactgctcaccaggctgcaggctacggcacgggtggaccatggaatgggctgggccctgctcccgcccgtgcgactgtgtcctccccagcgcagcacgagcggcggttgcgctcacgcactagagtagaaatcaatgaaacccatgatgccccccccccccccccccaaagtgaaagaaaatta

SEQ ID NO: 1789 - DNA, 1406 bp, Oryza sativa
gtttatctaggagtacttaattttgaagagtccgtcgtgtcaaaaataattggaagagtccgtacacatactagtggttgtggggttttttttttttgtgctctttgtacacataaatgtgttgcactgttgcttgtttggtgcctccaacgattttgcagtggttatatagtagtagcactactccgtctattgttagcatgcacttccaattatgcaccttgacaatccaaacagttgtttaaattaaaattcaaaatttcattgtactacacgtactactcttaaatataaggtgttagagaaaggtacataaggagattatcgccctcattggatggcaaatgctttggctgataagccatttaagcaaaataagctaaccaatttgtattgaagtttggctgaattggaggtagctttggctgatcagccaaagtatttggccaaccgatgaggccgtataagaggatgttataattagttgagaaaataaaataaataaagaattaatatagtaaaagattatgattgattgagaaagatgagtgctagtccctttaaatttgactaagtttatagaaaaatatactaatattttcaatacaaaacaaacatattatcaaaatatattcgatactaaattcaataaaactaatttgatgttgtagatgctgctaatttttctataaacctagttaaacctaaaaactttaacccagaaaaatgttaaacaaatatattactaactgcactctactgtgtccgtttgtccgctcgcgggggcgccggaatctctccgctctccaccacaggcagacacacacacggcacccctccctccgcccgaccacgcccaacacgtccgctcccgcagactccacaaccgcagttcagttcagttcagttcacgcacgcacgcgctgacgcgcccgtacaccaccagcccggccggggagagagagaaatcccgagagaaaacgagaatatcccgcggcgtcggcagatcggcagcgggtggttgagctggtactagtacgactagtcgtcagtggagtgccggcacgtacggattggaggcagacagaccgggtcgactcacctcataatcatttctttcaaaaaatctgcagagatcgtggctgtccgtcttgtagtgagaagcaaaaaaacggtgagattcgattcgcggctttggttggttggttggttggttggttagctactgcaaaaatcacaaaacaaaccggtctccggaagttgcaaggaagctgcgaaacgggtggctgctctggttgtatagtactcccctggatctcacgcacaaatttatgggcgtgtttagttcacactaaaattgaaaatttatttgaaattgaaacgatttgacggaaaagttgaaagtt

SEQ ID NO: 1790 - DNA, 28792 bp, Oryza sativa
  unsure (1)..(28792): unsure at all n locations
cataaacttttaatttttccgtcacatcgtttcaatttcttcaaactttcaattttagcgtggaactaaacacagccatacacaaccgagatcggtaagctacagtataactcaatcaaacactaatttcgttttttttcttctcttgcgtggagttggattggatggggggtacagcgcagtacagtaccggcccggtgtcggtgcggtgggaggccgttaaagccatcgccagcctgtccctgcctcccagatccacgtcccctttcgccctgccatgattccccctcctcctctgacttcctttctccacactcacacactctcgctttccttgcgccttcgtcgttttcctctccccgcatacgcgtcgacgcacagcagcagtagcagtatgagtgcctgggtgtggggcccacaggtggttgtgtacgatagcagtacactacaccctctcttccaaaatacgtaggtttatttgtgggctcgatcattaatatcgataattactatttatgttttatcatctggtactaatcatataaaagttttacataatatcgataattaaatattgaatacagacgattataaataaatttattttgggaaggagcaatagagaacgtatagatcgacggggagacacctgcgctgcgggtagtgctgagctgtgcccataaactgccgcgccatgcgtccctcccctccccacgaaatcgcgccggtttttatctaccagccacgattttgcgctccagcctggcgcccctgtcgttttccgcacgggctaacgatacacccttctcctatcgctgccaggtggggtcggtgtcgtgctggggcccacgcgtcagtggcgttgggtcttcccgtcggcgcggggggtgtgtgggcgagcaaactgccggtcgtacagtccggcttgtacacacacggtacgggcggggcccggcggcgggttggacggttgcgattgaattcggcggggtgatggggggatgggctccggcgcgggctacgccttcggctttcgcgattgcaaccaaacaaaccccaacccccgtcgccttcccaaatgcccacttccaacaccaagggggatggatggatggatggatgcactcatgcacgcttgcatgcatggctggatagatggatgataggtcgatctatcatccacccgagttttctccttcccaacctagcggatggataagctcgtcgtcgttgtcgccaccgccgctctcttttcacattctctttgcaaaatatctatactgtttttattttaaaatacaataatttagtatgagatgtaatacatttagtgctgtgaatctaaagacagtgatgaaaaagaaaattagcataacgaaaatataaatatgaagtactttctccgtttcagattataagactttctaacattgataacattcactttctgtgaatgttatcaatgttagaaagtcttataatatgaaacggaggaagtatgtacgaaatccggttttaaaatgtaaactagtatgatggcccgcgcagattgcgcggctagcatcattatattttctctcatataatagcatatatgttttctcattatattattcaaatatattaaaatgataacataattttaatttttgcaataactttacaaaactactaatgtgtaatattcatattatattttatatacctgttagttattaattatttttaatatcaaattttagttatttgtaaattatatattcctatatagactttagactcgtcttttaatatttcatttttttaatttcgcattttctgtaaattgtatttctatatagactctatgcttttcttccagtattatttaattttatttctgaatttttattatttctaattgtatttatatgtggactctaaactcatctttcaatattctttaatttttagtttcgaatttcagttacttctaaattgtattcctatattgactttaaactcttcttcccatgtttttcttaatttcgaattttagttatttgtaaattgtatttttatacggactctaaactctacttttaattttattatgttcattccaaattttagttagttttaaattcctatacgtactctatactctatttctaatattccttatttttaattccgaatttcagttattttctaattgtatttctatatggactctatactctacttctaatattccttatttttaattccgaatttcagttatttcctaattatatttctatatggacttagtctcctcttctaatattccttattttttttaattccgaatttgagctatttctaaattgtatttctatatggactctagttttctcttctaatgttacttattttttaattccgaattttaactatttctaaattgtatttctatatggactctgttttttctttttctccgattaatgtaagaatttctaggccatgagaacgaacgtgggagctactttttctattactttaataatataatagattttgttggcagctcatgagtagtaaaattattttggcactataaactgaaaaataaaatggatggagacaccgttctcgtcttgggttaaccgctccaacactttcataattgagttttcaacggattttattttttttcctctctgtgtgtgtttgactgtacggaatgagaaggattattcaaatttcaaacggcacagggacccgccggcccccgtgtaacaaaccaaaccaaaacggccttcgtccacactactccagctcgaggaggaccgcgtggagctccctgacacgtgggacccaccaaacctcttgtccccacccgccatccaggtaccgaaaatgacgcgcctcgccagctgtatgccaccgtctccttccccccaccgcctatataatcccctctccctcttcctctcgccatcgagtccgacacgtccacatcgccattagagcagctcgaggaaggaggaggaggaggttgattcgatggggatggaggcggagtgcgataggataaaggggccatggagccctgaggaggacgaggcgctgcggcggctggtggagcggcacggggcgaggaactggacggcgatcgggagggggatcccggggaggtcggggaagtcgtgcaggctgcggtggtgcaaccagctgtcgccgcaggtggagcgccgcccgttcacggcggaggaggacgccgcgatactccgggcgcacgcccgcctcggcaaccgctgggccgccatcgcgcgcctcctccccggccgcaccgacaacgccgtcaagaaccactggaactcctccctcaagcgcaagctcgccaccgccacggacggcggcgagatcgaccggccgtgtaagcgcgtgagccccgggccggggagcccgacgggataggagcgcagcgagctcagccacggcggctgcgaaagcggaaccgccgccgggcaggtgttccgccccgtgccgcgccccggcggcttcgacgccatcagcgcggcggacgtcgtgcggccgccgcggcggcgggacgacaacgacgacgacggcgacgacgacccgctcacctcgctgtccctctccctctccctcccggggttccaccacgacagcgcgcggagccacttccaggagctcccctccccctcccgctccccttcgccgccgccgtcgccgccggcagcatctccatccgcatacccgttcaacgccgatctcgtctccgcgatgcaggagatgatccgcacggaagtccgcaactacatggccggcgtcgggctccgcgccggctgcggcccgggcgccgtggccgagtccttcatgccgcagctcgtcgacggcgtcatgcgcgccgccgccgagagggtcggcgtcgtgacccgccaataaaaccccccaaaaataaaaaaaaaatcaaccatcccggttcaaattcaccacaaatgcacggtgaaaaaccacctgttaattatgagatctgtgtagtattattagcactagaattttcctggttcatctttgtattttactttgagtaaaattcttctgctgctctgaaacagagcagcggtgaaggggaggtaaaaaaaaaatcagaagcgaaatgctagtgcattgctactaccagcacagcagcagcatcacggacaggttggccgttttctgtacaggaacgaggtgatggtgagatgtagcgacaggtttctccttccctttgaaccgtccgtgcaacgaagagtcgaagactacttgggcatcgatcagatgtgcgagttgaaagtgatagtagtagcagcatgctgtactagcagtacgcatattggacatttcagagcatctaacttttaaatgtggcaattaaggatttaccaaccacaatctataacatatgggtaatctttaattgccactttaaatagttaaatatttttattttggagctatatggccgtactcgagctgtaaataaccgatgatcttttctttttggaaaaaaaaaagcctttgtttcgaatgtataggaattttctgagaatctgaaagtacttatattcctcagaaccgtaagaacttgtttcttattggccgctttgcgtcgtttaaccgttgggcatttgtctctatcaactctatgtgcgtatagaatggatggattccgatctcattgtctctttccatcagtctatgtgtcacgtgtgtagagaatgatgaattgatttatactccgagtagaactcttttgctaagctaattcattcctattcccaaagaaaatgggcgtatgagtctcatagtaatacgagacaattcaatgcccaaaggaaattgatttctactgtagtgagctgtactgtccagcaaaacggttgtgtactgttgaccattcgaatcgatcgttggtgcagcgcacggtacaacgaagtaattcggccgcagcggccagaggagcagggagccaatatgagctggctcgtagtaaatcgagtgcaggacgagtagtagtaggagtgagctgtgacagttcacggttggcggtatttataccagcaagtgatgaagctagctgtacacagctgacctgaccagctgctccccccaaacatccctttcctgtgcagaacagtagcttaaaggattcctgacactgttgctgcagcagcagcagcagcactactagtagtagtactactagcaagttaattgcaaatctgcaatttgttcagcagcttgaaagcagatgcttgtttgttgaggccgtttttgccggtgatggttggtagtctggtgtctctgcaggaggcaacataggcctcggtaattctcacccatcgacagttcaggcccggcccaaattggccagatgagcccactgatcttaagcccaatgcaagtgaaacgcaagcatgattttgatcggaaatgcaaaatggtccatatattgcgaggccgaatttataccggaaaggcacacggacgttacatggacaagtcgtcagagtctcacacaaacaagttcaagaacggatcatacggatgctgccatgagggtgcacggcggcgatcaggcgggcggcgcgtcggcgtcgtcgatgttgctgccggcgacgtcgacgacgaagcggtagcggacgtcgttgcgctcgaggcgctcgagggcctggttgacgtagtccatcttgacgacctcgatctgggaggtgagccccttgtcgacgcagaagttgagcacctcctccgtctcggccatgctcccgatgaagctgccggtgatggccttccggccgagcatcaccatgggcgagatgaagctcagcggctggttgatcacccccatcaggatcagcttcccgtccagcttcagcagcgccaggtacggctccagcgggtggtgcaccggcacggtgtcgatgatgtagtccagcgagtcgccggcggccgccatcgccgccgcgtcggagctgacgaggtaggcgtcggcgcccaggtcgtccatggcctcgccgcgcttcctcgccgacgagctgatcaccgtcacgtggtgccccatcgacttggccaccttcacgcccatgtgccccacgccgccgagccccaggacgccgccgcggagacctggcgacatcagcccgaagtgcttcagtgggctgtacaccgtcagcccggcgcacagcagcggcgccgcctgctccggcgctagccccgccgggatcttcaccacaaacctgcacacaaattcattactttttttactagtttcttaccatctcactaaccaaatattttaatctttttaagacgtgacaactttcagattaggcaggtggatcaaaaatcacgggatgttttggtttgatgccagaatttgccctatcaaatagttggcactttaaatagtaccatgtatatgtttgtaatgatgtcaaaatttaccaaaggtaatacaactcttagagcaggtacaatagcaggctaatagcctgcttacctaatattttaacatatatgatagagagagggaaagcagagagagcaaagcggacgacaatccagtcaccggctcaagcacgagcgcctaggcgctctggccccctgcagctcgggacaaccaatcgaaaattagaacttgaacatgcagaagttaccaacacctgacaggatgccttggttaaagcatgggtgtagccaattactgtatctaccattgtttagttatctcttaaataatgtggtgaattttggagccggcagttaactttactattgaacttgctcttataaaccaactatactaaaatattggtagtgccaaatcttgaccatgatttgacgctaccaatgatttggtagcgcaccaaacaaaatgagcccaacatttcactgtctctgctagtttaccaactgactacaacgacgctatgcaacaatccaacttttgctctgttcaagaagcaattcttccaacaacaaatggactaatggaccggggtaggtgaggacttatcagttaatcaacactttatacctaactttggtgacttctcactttacactcaacacagtaccgacttctcgacatctctttcagtctcagatgacattttctccacaaaattttctaacagactggactttactttggatgttcggaaaagtccagtctagttttctctacctagaacactgacaatatgataatatgataatgatatcgtgatcagttggttggtgattacttgttggagtaaagctgtgtttagcactcacttctggtcgacgaccatggcggaggcgaagccgccctgggttggccggccgtcggtgtagacgtcgttgtaggaccaaatcctcttgttgcagtactgctccacattggccttgcacggatggcactcgcggcagcagccgacgatgacgccgacgccgacgacgtcgccggcgctgtacttggtcacctccggcccgacctccaccacctcgccgaccacctcatggctgcagacgagaagaggagagaattttcttggtcaccgacaaaatccaacacatgactgaatattggtacgacaatggaagtgtactggaaaaaggaattcttggtcaccaactaattaatccaaccaattattgttgcatacttagtacgacatgcagatggtgtagtagtactaaattactactaattaggcatcatttttcagcctggtgttggggatctatcgtgtgcttatttaaagcccatcagatcagggaaggttctcgctgaggttttctttacacgtgtctctgaaactgatggtgcatctaatctgtactatacctgtcatgaaaggtgttgatcaaaaaagaaaaatgctaaaagcgatgcactaacttatctttctgttccaaaggagtgtgatatagtggtgcatgtgcatctatgccttttgtaaatctgaaaaaagcactgaccagatttgctagttactagtgcctactcttttctgatatgtttgttatcccaatcagttaataagtttatcttcagtctactatagaatacaccatcaaatcaattgctagtagaagatctccattgacatgagccatgatccatctagataactgtgaataatcttacccagggaccatggggtacttggaagcaccaaggtggttcttggcctggtggatgtcagtatggcagataccacaatacaaaaccttcaccaccacatcttcaggcccagtcttcctggtaccaccacatacaggaaaaaaaaagaacattagttgatctgttgcataagatgcttcttcagttattccattctacaagaagacaactcaaggaaattattgatatatatataatcctccttttctttaaggaggcatggcacgagaattgcatagcaaatatatatattagaaaattataaagaatgcttctgaaaatatatatatgtggagccaggcaactagccaaaaagaactccatgcattctgtctgtttgccacaactgctccggattcagggattctgttcctttcacccaacaaaaccaagacgtgacgatgattgcaatagccaattggcggtaggtgaagcagttttggtagtacactagtactacaccactatactcttcatgttggacttatactaggagaggagcaggaatacaaaatagagtcaaactcacgtgggaagtgtggaatggatcgaatggaggagcccaaaaaagaaaaaagaaatccaattgctctcttcacctcttcacactttggccaagaggcagaaacaatctgagttgtactcgaggcagatgacatgaacacaaacaaattaaaacacgggggcatctaaacaactaaagcactggaacgccatcagttttcagaaattcagaaacgaaccatctgaacaactaaactgtagtagaacgcatgtaccagagtttcagaattgagacaaaagagaaactaaaacctaatccctccgtttctaccgaccttaagcaaaacttgcaagaacaagatcgagaaggagagggtgatcgatcatatcatatcatacctgagggtgtagttgtagggggtgaggtggccggaggcgtccctggcggcccacccggtgacggtcttctcggcggcgaggctgcccatcgtctctggacacgaacacgcgacgcacgaggcggcggcggcggcggcggccaatggatggatcggattcgggaggaggaagagaacaagaacaagaagtgcagtggctgattcgctctctctcgctgaattctggagagggggtggtgcgtcccgcagcgagtatatataattaaaggaaaacatcgcgttggacgggtcgtgactgagagggggaagaggggttggtgaaggctggctgcctcggagatcgtgccaggatcttctgtggccacacggcctcaatttgattcgtttttgtttttttttttgttttcgtgcaagacagtttttaaattgaaggggaaagtgccaaagtgggtatcgaaatgggaacaaaaatgttagtagtaggacaagtagtggaaatgtttggtcgcgtaggttttcctaccaaggttgggaagtggttaattagctggtgcgtacgagtatggatggagtagctatatcagctccttcataatgttttattccctcattattaatgttaaaatgattaattacctattcaactactttatccgtatcaaaatatagtaagctatcatactgggttagataccatttagtaccataaattcgtaattcgtagtactgaaacatgtcctggttcgtagtctattaagtggtgtctaattgactttatctagattcgtagtactgaataagatttaatcgagtactcggttattacgttcactatccttttcatatttggattctgtcgacatttgatgtcgcgattccggtatttgcatagtatggggatctttgatactaggatatacgcgagacttaggtaaaagagacggaaacagatttttatacaggttcgggcccctgaattgtcaggtaatagccctacaacctgttggccgaagccggtcgttgctcttattcaccataatcacaccagtacaaatattggggtagcctatctaactgttgtcgacatggcggtctgaagttcttactcatagtcgacaacagggtagccttcctcctcgaatccgcatccaacgagatcagagacagcgctatatctctcctaacagtagccataggtacctaggggactagctatgcctatctctgaagtcgatatctggcatcttgtcttggcgtatattggcttgtatgttgatcttctgtcttgatctattgttccgtgtcccctctcctcctaggaggccttgtatttatacccataggtgtccccttgtccaagtagaactagggaaaccaatatggatacaatccgagtagttcttgtcgtttccatgtagaactttggttgttttttcttatccggaactcccttcatatccgaagtcagttcccgtataagacatggtatgtggtgggtcatgccgagatttagtcaactactattaggtatgtggtatccataaccctaacagattccctttatacaaaagcatggatatactctatatagaggtgcaatttaatttagattttttgagcagattatcaatttgactacaaaataaactatattttgtaaaagtaactttacaaatagcttaaacaagttgtatacaaagcatatttttcagaacacggagcaaataattcgatttaataatctgattaataagcagaaaagaacataaccttgttaccatagggtaaactcctataaaataaaaacaatatcatatttattaatagggtgtaaccaaataagtcgccctacaccatttgtatgcttgactattactcctgatattatctccgtgctattagtctcaaccttatatagtgagctacaggacaaaaataaaatacagattgagtcacaaatctctctcttgctcacacctacaaatcgaaaattcaaaatgctcgaaagtcagaacaaacataaccatgaaaaagcgactttagttagtagcttgactacttcccctctaaactgtcacacctatcgtggattagtcgtggatttatggatgattttgcagtgattaattttacctcacaaacagtagccatcatgtccttgtagaagatctcgtttggagaaaaggaggaggcacgcaaggcacgcgtgcttcgcatgcgaagcgaggtgacgtggcactgtgccagtggctgagtggactaaccgggaggggagaaaagttgcagagaacgactccggggttggtggccgggcccatcgcggtaggtgggtggggcccacttgccatgtctggtgacgtcacggatacgtcatctgaacggctgtctgtgaagagagagactgggacatgccaaccttcaacagcacgagtggttcatggtcaactgaggatgatagaaaaagagaggataaaattaagctttgatttttattattatagtactagtacttatcatttgcgtatgttcccaaaaaataaatgttaaaatttcctcttgaatgaatgctaaggggttgttcagatgataatattgctaaaattttggcatgatttcttatgtattaaccaaatttgacaacaatttaaacgtatgtttttttttgacaactttgctaaaaaatagtatggttgaaaatggcatcaaagtaaatatgccctaaattttcatatgaatgacgagtgatttttttaaaaatattttgaaacgaggcgagtgaattggtttataggcacaaattgtggcacttggtgacgaaacaatttactaaaccaagcatttttgttttaatttgttgccgcgtgtatagcagttttcgtagtgatacaatcatacaaaagttgccttttgtgagggactatcagttgtgacagcaaatacgatatgatttcaacttcatatagtgttccacatttgatattaaaacatcaatttcggtttctggttttcagtggtgacacgttgtttgtatgcttgtggttgctacttgtgtacttacaagaaaaaaatttagacttacaaatttgcaagttgcaaccacaccaaaatctcaaaaaataaagaatcataagcacccaaaactgatagctacacatatgtgccggtatggattaattgtcgatgcttgggatcgttggatgcaacatacaactctgttctggtgaaaggtcaatttcagatcgtaacatatatcatatcgccaactaattcggccattctttgcacaccacagctagtttaatcgatcaatttgagtcgcacagctagctgcatacgagccatttcgctcttatccaagtagatatggaagaagatgcttatcttaggtagttcatggttcatggagatttgttgctagctaagtcaaggatgtgatcactatcataatcatatcaagtaggagtaacgataaatatattaagaaatccgctctaattatacctccgagcccatatatgccaccaactcgacattgctaataatgagaaggggtaggagatgccgatggacggtggcctaggcgcaaatagagagagggcgagccaaaggataacaataaaagcctattgggagtttagtggggcttctccccctccctcggtttaggagagtttttttcatagcaatcattttttacttttgtttttcctttttctttgttccctatccccggcaatggccttcggctgttgcgttgtaaaaatcaattttttcttcttctaatatagtagcgtgcaattcttttacgcgttcgtgaaaaaggacaacggcagcgtgagcctcctcccaactataccctcatcacataacctatcattattggcatcgttgtgccacctcctcgatcgagctctagcatcagttcgagttgtgatgaacaaaaactttcatgactccatcccccaatccctgcgtcctcatctacaaaggatgtactccatacattcaaaaaaaaccaatcctagatttaaatctggatatacatgtgtatatgtgtccaggtttaattttagaattaagtattttttttagcggacggagtagttgacgagcccacgaaggacactagtggatcggcgagcttgttggagagcttgataatggccttgagcactcatggtcgtggaggtccatcccttctcttaagcagtgccacatggcaggtcgcatgctggggagggaggagatggtaaatgaagcatgacaagtaagaagcatgtatgttttttgaaaatttattttctcaacttgttaactggattagcatgaggccaaaccaccgtcaaatgtgcgtatataggactgataccgccttaagataggtttgagtggggagggactagggtaaattcatccggtttgaagagtttccgtatataaaatgtttttgtctttcatttgtggggcatcaattggactagggcaaaagttaacgaagttatggaacctcttttaccatataaaaaagtattcacttggtaagcacggaagaaaaaaagtttgtcttaccttggtacggttattgaatgctaggtatatatgactccatccattaacattacgatatccatatgtattatagtctcttttattttcttttttttttcagaatgacaagtgcgtcggatcgcaggccaatagctcaatagcaaatttagatcataataacaaggattaagttcacttcagatccctcaatttgtcgcctagtccgatattcatccctgaattgcaataccatatatgatgtgtctctcaactcctaaaactagtgaaaataaaatcccaacaactcctaaaactagtgaaaataaaatcccaagacggtttggacaacggtctcgactgacgtggcacatacatggtgttgatgtggcacttaaaacagaaaaaaaagagattcacatgttaatgagtgtttggttaaaaataacaaaaattgcaatggactcatgccatcactccctccttttcccctattctctccctttcctcctcatcgtcggtgacaacattagtggcagggccggtgaggcgaaggtgcgcgtgagcacgggcgggggcggccgagggcatggagggagttgctcgatgcgacaatgttcttgcgcctggagagctacggcgaggccaaggcatgggtgtggcagaatctctcctacttttgcgccaactacgcgggaggagggtgtcatcacgacaattgggtgtccacggcgcgtgaggccacagagtgcaagcggtggcgactggcggtagcatggagaaggttgtcggcgttgacgcgggaggagggtgtcggtagcgtagtcatgcccttgacgaactcgcggaggtcttcgatgatgccatagtgctcgagctttgcggcgtctggcttcggcgtgacggcggaggggatatgtgggatcgcagggatggaggggacggggaggtcggtagtgaggtgcttgatttggttgactaggaggtcagcctgcttgttggcctccgctgtgatctcctgtgagttggttgtggtctctgagaagatctccttgaacttcttcgccgtctccaacatcattgccaacgagtgcgtggctgcctccgccgtctcccttctcccttactactgctacggctacttggtaccacatggcatgaccgtgccattgacgcccagtcgccacaccagcgccttgctcccatctgtgctaccaagaaaaaaagattgagagaaaaagagagaggggaaggagatgacctgtcactcacaggtgaggtcccccaatatttatatttttatttagaccgagttgtcctgtcatgtgggcctcatgcttgactcaagtcaccgtgtcaactaaaaccgaccactatgctgccgagagaccaaagttaacacggtattaagttgggagacggattatacctgctatttcggttcaggtatgaatttcagactccgcgacaaattgagagacctaaagtgaacttattcctaataacaacccataaacgcctcgttcgagagcgcatgatttaaggtccattcgctgccaaaccaggctaaaccctaaaccctaaaccatacaaatgcccataagcaaggcccatttagaaccatacaaagagaagcccagttacagcatttctaggtccatggaaatagctttgcacctgtgctgattcggttcatgtagcccacaatcttcgatatatgggctgcatgtattgtcaacgttttgcatatgcgcacgatatttttttccctctctctaactctcttccattccccagtcaagacaacaatcacgcctgtcttttgtttcgcaagtaaacgtacggtcctaattaacgattacgatgtgtggtgttcgcttatgcgtcttaattgcgaaaaacctttattttgacgaccttcatggtaatgccattttgttctcttttttttttaaaaaaagaaagtctagcagtgtcactccatatatgcattgaatcatagtagtcatattctgttgcatcatttatatacaaaattccaaatttagaccatatatataactacaaacatgtccaaactaaaatgagagtacagcaagtactaccactatactaaatgttgcgttctgacgtgttgttttttttggcggtttgtctaccgtgaaaaccttttatatcaaagtttctttgaaaattcaaactaaccccctcttaactttataataattaatattcgattaatcatatcataatcatttttcttattttgcatgcaaaacataagctcatcataaactccatatcgaatgcagtctaacacctgtagcagcgtgtagaatttggacattgcaatccaatgaaaacagagcaaaatccgaacgaaattatgaactctgatcgggcccatacatggccgggcgaaacgaaggcagcatggccctccacgagcaaccaagatctggtcactgatgcaacagtagtagtagtagagtaggagagacaatagtacatgtgtttggttacgagtactccgtagtagtccgtactaacacacacatgggtccaattctactgttactgaactggaatactccagctagtggttcaatactgatcacctagcgacagagtaaggtatgggtttatttgtgaggcacatgtaatcagtggcgcccataaggccagcatcatctatatggatccggatccgctacagtcgctactgtgactacaacttattctctccgataaaaaaaaacaaatgtaggactgaatgtgatatatcctaatatgacaaatctagataggtgactgtccacattcgttgttttatgatacatcacattcagaatttgtatttttttatggagggagtaagcgatagcagtgcacatcattggatgtaaatcggaaggtctacattacacattgtactgttcataacactgaagcaaaactactgtttgcaccattactgtaacgtggaatcttgaccgttgataggaaaaacgaacggccaaaattatatgcggtggttaacttgcagttccaactataactgcacttgatatggattcaatcgagatgttccaattataactgcacctgatatgaatccgatctatatgtagctcgtcagtgccaatgttaatatcaactcaactatgatgagtgaatattcatgtgggtagaaagatacatgtatgagttaatgagtagtcgagtatgccatttttaaataaatgacaccggaacccttcaccatcaaacattgtattctcatccttttttcaagagagttataaatagatgaaaagatgttgtaattagcagtcaaaacacgtgtagtaatccacactgtcaaatattttaaaatagagggagtaccatatgcatcaaacaattcaataagccatataatatgaacatgttcatttgacaacccttgaactcttcactttgtttgaaacacatccgaattcaaaagccaggtatttgacaccctccaactttcaaaattattcaatcgaccctctttggtccaaataagttgcatattttttgttgatatggtggttcaataagccaaaacataagataaaaaaggttggccctgcatgttaggtaccacctcatctctcttctccctctctttctttcttgtctcctccccgagcaaatgagattggcaccaatgagcttgagctccaccccccttctcggcgcgttgagtactggcaagcttaacctccaactctgtctcctcaagagccttctcgatcctccataagatcatgatagtgagctcgagcttaagctctccattcctaggcgcctacatctccattagattgcaccgacgtcatttcaagctcctactccctaccgcctctctccaagcttcctttcacattgcctatgtgcacctattctccacacgctgcctcctcctcaagctatgtcgcaccgcaatccacatcgacgccatctcaatgagctccaccgactcgttgtcacacaagctcggtgcaatgattgctcaagcttgagctctaccaccttcgttcttcataagctcgctgtagcagagtttgatctcaagggaggcagagcttgatggactggagtgctcgaggggcttggaagagtcaacatggaggcagttcatcgcctccttccatcgttgcctactcgcactgccttgagcactagatctagaagaagataatctattgcagaggtggatgagaaggagaggtgatcaacaatagtggaggagctatagctcaagctcacctccactgagatcatggggccacaccatgtagattagagggagtaaggtgagagaggaataggaagagaaaatagctaaagtgcactacaagataattgacctaacgtcaccaaattattacaacgaaaaataattcatggcaatatattatactattgcaatgataatttttcagtggcaaataactatattttattgcaacgatttacattcattgttttattcaatatttttgttgcaatagaaaagagctatcgccacaaataacattactgttgcaaaggtatgttctatcgccacaattttaatttttgtgacaatttgcataatacattgttgtgaagttacgtttcactattttttgttgccacgaacaacaaatttgttgtaatgacatgagattcttctctatctctcccccgcttatgtgacatctttgtacaagtgacccaatataccaaaactaggttaaaaccaacgtggtgctagggttgggtggagggggggggggttaatttgtcaattcaacggtagaaagttgcatgatattagatatccggtttcagagttcggagtgcattttaaacaaaccttgatgggtgaaatcttctactcagaactctacaacatcactgattcaccaatgcccccctttaataaaatatggagagaaccaagggaatttttataaagcggatgtgccaaattttcatgtgcagaataatgatttgcatggaaatatccagggatccgatctccacccctagcccagcgttcgactatgttcattgtattttacatgttcataattatagtggggactcactttttaagtacattttgcaatcaatgtgattaattgcagggtcggacatagaataaaaattgactgggggcatgcataactcatattacaagttaattagaaagctaagtgaaactcacaggcatgcataactcatataacaagttagctagaaagctaagtgaaacttcacctcataacaacttataaaaactttgagatattacatgataaaaatcgtccactaactcccctatcagatcatgacaaggatgattagatagagcattgaacctagagagtcatcctcatcacttattgactacacgagagggagatatcattatgtaccgagggagatagagagcagcaggcccgacgtgccacaacttcttcatgggatggagtgcgctgtgcgcaacaacgacgatgatgagcgatcaaggaagtggcgaaggtgaagtgcggcctgtggaagcactacaggtggggcgagatgatgggctcccttgtcttcctgttttctaatccctagtttgtggatttgctagttgggggatcgatagaaggggaacggacgttcgaagcttaaacgcgcacacatttgcgtcacggaaggagcgaaaaaaagggagtggggtccttctttccaattagagtggggcccataggtcatacaattagggacatatctaatgagtgtaactttttactggggtctaaggccccaattggtttgtacgttaaatccgcccctgattaattgtgtcattttctcaagacaaaaaaataaaatggctagtgccgtcttgagcaatagtactcataaaatggaccaccctttgtacagcttaaacctagagtacatgtatatgtatatactactccctccatcccaaaatataacaatttttagccctcaagatttgtctcaaaatataacatcttctccaccaacattttcttcccaatcaatacaactctccaccattcacttttccaacctacctccactactcaaccaatcacaatcctccaccattcacttctacctactttcttaataaccgtgtctaactctaaaaatgtttatattctaggaaggagggagtagtatatgtagattatgcgatctattgacatgagtgctaagcctaacatgatcaccctaatgcggaattcttaggttactgaccgttgtttgaagccattgatgcggttctccctgttcttgtcggtgtagaggtagtagtggtagcagtagcagcgtgagcactggcttgatcccgaaggggtcgccggcgatcacttgcgaggtagtggtggccttccggtcgccacctacactgtccctgaaccaccacacgttctccctccagcgctcaattgatcggatagggttttttttgggattttcggggagaagaaggtcgtgaagagatcgtcatctcaccacgacatcggcctcccctattagtatggcactgagggagatcgggggcaatccaaaatatgaaaagatttggcgctaccgatcaatgcgcgtaatcacgtaattatggaaattgaatcgcattaatcccgtaggcactgggtggaaaacggccatccgagatttcctctcgatttccatgccgagagataaactttcctaacagtatgtagggcttgtttggattagcttctagcaactacaacttctcacaaaatctttaactcctacaaatcatcactcagattttaagaatttgtggttgtaaaatttagaaaataaactagaatcaaaagctaaaaatctcaagttctttggatttttagactaccaactaacaattcaaacttaaactcccaagcagggtcatatactactatatagtatgcatttgagagtagcagcacgccgtaggacccagcagcaactacccatacattgacattagagtattcgacagcttcctaattagtatttaataacgtacgatgaaacaacgacctgattgtttcttggaaataatcgctctttttcttggttggcttggctagctgtttaccgctctctccgtcctattttaaatgtaattataagttaccgtgttcaattttaatcgtttattttatttaatttttttataattagtatttttgttattatgagatgataaaatatgaatagtaatttatacatgacttatgtttttaattttttttagaaaattttaattaagacagacggttaaagttgtgtacggaaaatcataactgtacttaattaaaataggacggaggaagtaaaattaatatatacatgaggtcgtccaagctagcgaccgctaccttgtgattgattgacatgtaataccaatttataggttatttaactaacttataattaatgtttatattgaacatgtatattacaactttacaactcgtatcaacttggtctcgctgtttccactaaaaaaatttgagcagcaccgataagatggttgtgaatcttttctctaattatctgtgagctaagcttgatagctagatagctagataggacaactcgtgattatataaaatttccatatgttagcgtggacctataaccgttcaataagccacttgttttacgtaataaaaaacaaaagccacttgttcgatcctcttgtcgtgaatgcgtgcacaaaactcgccggctgcctggcacattttcacccagttatagttattattgaggactaattgaatgattgtattttgctatggataaaataaatattataatattatataaaataaataaaacatatttttatgaaatgtattgtctataagtttgtataagtttatcgtagtgaatgttcacattaatttgattttatatgccactaatttaattgctttaataataagaagtttaaaggaataatttataaaactataacaggagtgatcgagttgacaaattcactaataacactactaccttcttctaaaacagtatagatatttattttcaaactatgtactaatctgtagctatagagagagtgcatgcctttgatatataaaaagaccatttcttcctcgtgtgtcttacgaagtgcagcagttgagtactgtgaaggtcgaggcaaagttgatgtcccgttgtcctgaagattgtccctttagcaaaatagcaatccaatcagcgttgtcttgttgtcaagcagacaaatttaatcatgtggacaagaagaagagatggtgatgaacaatacggtaggcagccatcaggaaaattaatttattcgtcttatatcagaaaaaaaaagtgagaaagatatctgtggaacaacgatggtgaagatagctctcggactgatcggttaattgatcgttcaggctttattattggtatctctattcctaaaaagataggatatatacttaggctgcgttccttacattgggttgggaacattacccccaagcacgaaaaacggagcagttcattagcacgtgattaattaagtatttgttaatttattttcaaaaatggattaatataattttttaagcaactttcgtatagaaactttttataaaaaacgcatcgtttagccgtttaaaaaacatgcgcgcggaaaacgaggacatgggttggtaaccccttgagccgaacacagccttactaaggaatttagtattaattatgtaaagagaaaaaaggttaatcgttcaggctttattgttggtatctctatttctaaacctaaaaagataggatatatactcgggaaggaatttagtgtcgtttatattaaaaaaaagatatacacttaggaaggaatttaatatcaattattaaaagaggaaaaatggtgagaaaattagtgctaaaggaaatagaagattggccaactggagcaccttgtagttccccaccatcagaccacgatgtcattaccggtatttatggcgaaagtgtatgtaaaacatggctaatgaataagaaataattcctccgattcacgatgtaatactttatagcattgcccagattcattaacatctatatgaatatagacaatgctagaaaatcttataaattacaatatgaaacggagggagtgctacttattgtgcttgctcggcggcgtcgccaggtagggtttacattaccggttgatcactaaatttcgagccccattagtatcacggttttcaataaatttcgatcggttttcgataaatttcaactgaatctactgtttaaccttcgaaattccaatcgaaagttaattccgagccgtgtcgaaacgttgaaatttcacggaattcgaccggttttcgtcggaattgacgctaggtccgttaatatagaagaatttgcatgaatcaaatagttaagaaaaaaaggttattaattttgaatttgcaaaaagaaaagttcatgtacatgatcttgaggacacgcatcccaaaattcatgcggtttgaatctagtctcacatttccgtgtttcttccaaaactgaattcttgtgtgctgggtaggttttgaaatggactgaattgtctatacacgtagcacgtagccatcaaaccttcgtggcccgtacgtctagtatgcaatgaaaatggtaacacgtatatatttttaactcgtggttgaaatttgcaaaccacggcggacaccatcaatctttttctcttttaccattttgcttacgtgtcagcgtgcattgtgtatgcctaactacaaaacgacgaattaaatcaaacaaaatttggacgaaaatgacagcgccactatttttatttactacgacgcttaggtaaaatcaaaccggtggcaaaatacttgtagcaattaattacgccaatggcacagtttgcatataaattgcgagacgaatcttttgagcctaattacgtcattatttgacaataagatgctacagtaaccatttgctaataacggattaattaggtctaatagatttatctcgcagtttacaggcgaaatctgtaatttgttttgttattagtttacgtttaatactttaaatgtgtgtccgtatacgttaaattttattttgccaaaacagctacacaaatcaaacaaaattttgacgaaaatgacagcgccactatttttatttaccacgacgcttgggtaaaatcaaaccggtggcaaaatacttgtacgaagtagcaattaattaaatctgtccctgccgcttacttaataactaaacgctgcgatttatgattccatgcgtgacgtcacgccttagccgctcgcgccttcacctcctccacgaacgcctccacgtggcggtccgacgagccgccggccgccacggccgcccgcgcggcggcgctccacgctgcggcgctggaccgcatcgcgccggcgtcgggccccgccacggcggcgtcgacggcgtcgcgcacggcgccgcgccgcacggcgcgcggaggcggacgcccatcccgagctcgtcgacgaggaacatggcgtcggtgcactggtccccccactgcgggaacgccaccaccggcacccccgcggcgaccgtttccgcgtcgaagttcaaccccagtgcgtgaagaagcacgccacggcggggtggacgagcacttgctcctgggggctccatggcaccaccatgccgcggccggcgacggcgtcgaggaacccctccggcagcagcgcgcggctgtccggccgcaccacccagaggaacggccggccggtggaggcgagcccgtgcgccatctccgccacctcgccggcggacagcaccacgacgctgccgagcgacgcgtacacgacggagcgcggagggtgttcgtccagccacccgacgcagtcgtccgctgccctgatcatgtcgccgcgcaccgcggcgtcgccctccagctcgatcagcgggccgacggggatgagcggcgggcggngcggcgacgtggccacgcgcgtgagcgcgtccgccacgtgccgctccagctcggtgaaggagttgacacacacccacgtccccttgtcgatggtgcggatctgctgctgtatcgcctccgtgaggctcatgtaggggttcgacgggaggaggaaggacggcacgtcggcgaccgacatcgccgggagccccggcagcgtgagccgcgcgtcgaggtcgtcctcgggggggaactcgacgaggccgtggacgcggtggtagtagagcgagaacacggcgcacgactgcacccacagcacggccgacaggatgccggcggnngcggngacnnnnaccgnnnccacgggggattggaaacgggttcccgacgacgcacgccaccggccgccccgccgcctcctgccgcgcgagcagctcggcgaacgccgccggcccggccgtcccgaggtgccgcatcagctcgtcgaggtcgctcccgtcgaagccatcctccaagaactcgaacctgatccggccgccgccgagcggcacgccgtcgccgccgaccgacacgccggacgactccacgagcttggcgccgatggcggacgtcgacgagaacgtcacgacgaggcccttcgccgcgatgcgcttggcgagccggagcatcgggttgacgtggccctgcccggggaagcagatgaggagcaggtgcggcgcgccgccgctcgccgccgccgccgccgccgccgtcaccgtggccgccgcggcttcctcgcccatggctaagcaagctaacttagctagctgcgagctcactattttcttctcgccttttctccgagcagctggcgtgcagtgatcgatctctcgatagctttggtctttgatactgtggcaagtgagatgaggcaaccaaatttataccaaaaatttgtgacttgcagatgaacacgatgacgtctgacgtggcgtcacacatgtaaatacaaggcagcggtttatgggctacctattttattttctttacatttaaaattgaatactatctggtcccgctgtatccaaagataaacgtgagtgtaggggaaaaaaagataattgttaattatcatacaattaaagcttaggccattttgtgtatcaatagtcatgaccctattaaaaacaaatagttcaaattaaagaagatattgtgggtttttttttttggttgtgtatcaatttgtcattaatgtgtgcaatgttagattattgtagttgcaggaatagactacgagtggctagtcactgtctcattgttttggtaaagggacatggcaccaaaaaaataatctactactatagctaagggcccatttgaatcgtaggaatgaaaaaacggaggaataagaaaaatataggattatgataggaatgtaagtgtaaaacagaggattgcaaaacacaggaatgatcgtttgattggaccacaggaaaaacacaggaatcggataagagagatagactcaaaggatttttaccaagaggttggacctcttgctaagtttcctccaaaacctatatgcaacaagccattccataggaattttgtaggatttggaaaacttcaatcctttaaatcaaagagctatataggaaaattttctttagaatttcaatcctatgaaatgtcttcataattcctttgattcaaacgggccctaattaattagatgcacaactgcagcaactgtcaggacatccatgctgttttgctgatattactgtcacattgagctgggtgtttatgatagacattttagaatggatccttaaaattttatcgggttttaaaattaatttgtttaatagaaaaacattttcaccatccaaaataaatatactgccagatacacgcatctgctttcttcacaaaaactgaatttagttttaataaccgtcctaactattccctatgtaaaaaatactctatatatatatatatatatatatatatatatatatatcttatacatattaataaaaataaaaaatatatcttcaactttcttaaactccaatacatttgtcctctaccttctcagatcaacctccaaaatattatctcctactatctcaaacttaatgtattaattgcttttaaaaaaagatcttcatagaacaaatggaggacagaaaaaaataaagtttttttttagggaccaaggaagtactactctataattaagtaactgtcagaagtaaatgcaagccgttcttcttttcactcgaaggagactgcagactattggagtataagggggtgtttacatgcaggggcgaaaagttttaccatgtcacatcagatatacgaacacatatttgaagtattaaatatggtctaataacaaaataaattatagatttcacttgtaacctgcgagacaaaattattaagcctaattaatctatcattagcaaatgtttactgtagcacatcattatcaaatcatagagcaattagacttaaaagattcatctcgcaaattagtcgtaatctatgcaattagttattttttagtctatatttaatacttcatgcaggtgttcaaacgttcgatgtaacagggtgaaaaatttcgagatgggatctaaacaggcctaagtacagcggaaagaagcatgtgcttgtttcccaacttgaaggacctcattaaattcaaatcaagtggtacttcggcggtcatgctatctcggtcaagcgaaagggcacatagttagattgacctgagtaactcctttaaatcctaaatcctaagtttaaatccttatagaaacgaatgtcagctgattagattgtttgatagctaaattatcaattcaaaaggctgtatatatatagttggatatagaaacctatccttctgttaaaaaaaaatctcgttcaaaaaagacttgattttttcttcacatctgacgcataccaaataaaaacaaaaaaaaaattactcatcacactgttagattccaaatttccaatagatttgtcacacactttcttaaactctaatatttttatatttatcccctactatttcaaacttactagtacgtattaattgctttaaaaattaagtaactgtcagaagtaaatataaccctttttttacatgcagactgcaggcatgtgtgagggaatcctttggggaaccggtttctagaagggcgatggagaagctagcaaagttgctattggatccactagtttcggcatgaagagcgacctcacgagctgactgaaaatttgggccgactcgattggctgtggaagaggataaaggatacgtggatgcgagacgccctcttttgtgttctttttagagttaattttagtttgggccaccttttattaccgatgtttcgctttagatcatcttaggactaatgtttttattttggaccgggtatttttacctttgtttcacattggaccaccctcactcttttatccatctacatccaacttgtaatatgtcgaagaaatagtcttacatatagctgtggtagttcattgacgagtagaagacggcgtaatcgagatcgttcatatgcttgagaagagagttgggtggtccaaagtgaaacaaaggtaagtttatccagtacaaagtgaaaatattgcttaaagggtagtccaaagtgaaacataggtaacaaaaggtggctcgaagtgaaatttactcttctttttattttttttcctgtacacagggagtacaccctagaccttaaaaaaagaaccttgctatacgtccgatttatttgttcgaccagtgtacgactaaacggaacagctcggcgcgtgatggcgtgaggcaagagcatgggttggtcatacggacatcgacgccatgcacttgcgtgcgttacagtcgtacaagagtcggacaaagtagtcttgtgtatagcatttttctaaaaaaaattacttcatccatttcaaagtataaaaagtctggacataaatgagatatttcgtaggacttcgaatttggacataaatgttccatccgattgtagatccttatattttaaaatggtggtagtaaatcttagctataaatttaaacatgtgatc

SEQ ID NO: 1791 - DNA, 4683 bp, Oryza sativa
tgtgcatctatcgtgtactccctccgtactcgtaaaggaagtcgttttggacagcgacacggtctccaaaatacaactttgacttgtttctataaaaatattatttgaaaagtaatatatgtatatttttacgaaattatttttcaagacaaatctattcatatagtttttatattttcaaactcaacaacttgagagttattcatgaactcgtaaaggaagtcgttttggacagcgacacggtctccaaaatacaactttgacttgtttctataaaaatattatttgaaaagtaatatatgtatatttttacgaaattatttttcaagacaaatctattcatatagtttttatattttcaaactcaacaacttgagagttattcatgatttatattcccaaggtttgacttaaatattgtcctaaacgacttcctttacgagtacggagggagtataaaatagcattgatagccaacaacataataatatgtgacttgtatgtgtccagctaagcacaataaaggatcaacccgatccatgtcactataaattctatggttttaaatactccctccgtccctaaatatttgatgccgttgatttttttaaatatatatgatcgttcgtcttattcaaaaacttttataaaaaatataaaactatatatatatatatatacataaaaatatatttaacaatgaatcaaatgataggaaaagaattaatagttacttaaattttttttataagatgaatggtcaaacatgttttaaaaaatcgacggcgtcaaatatttagggacagagagagtattacttaaaggatgctatcataattttagatatgtcactacttatacccttcaaagcattataatacttttttttaacaaactaccctctttattccttcttcctcttcgttggatatgttcctccagcgcaaccgcctcaggaaccgaaaaaagagaaaaatttcccagccgcccaacgtcacgatgtcctcacttccaaacccaaacggcaaccggcggctaccaagcaaagcaacgcccctgctccaggacaacagagcgaggtgaggatatggtgacagcggcgccatcatcgatcgcgccggtagacctcctggcaatgcaccctcacctccctatcttgtcgatcgtcgtcctcctcgatcaacagcccacctcttcttcggtgatggataatgtcgctatgcatgcagcgcgaggcagattagttagatgggactaaaacttcttttaaagactattaataaaacccatccataatcttaaactaattcacgagacgaatctattgaacctaattaatccataattagtctatgtgatgctatagtaaacattctctaattatagattaattagacttaaaaaatttgtctcgcaaattatcttttatttatgtagttagttttataaatagtctatatttaatactctaaattagtatctaaatatagagactaattttaagtccttgatcgaaacaccactctggtgtgacgagaggataagagacgagtccaacacaccccggtggaagcggaccgaggaagagtctgacggaggaggatatctccgatcgatccagatcaagctcgtaatggagcagaggctacaccgtccagtgattgaggacagtggggccactagaccggtggctccacaacacccggagccacgaaacggcatatttacgaaagaaaattaatttgtgaataaaaattttagggagtagttatatttatggcgctatatttttcaaaaaaaaatagtcggtatgtatttacattgtaagtccctaaattacatatgtaattttagtatatctacaagtatgtactaaaattacatactaattatatatgtaagtggtgtgtaagtgtggtgtaccagtgcaatgttaaactttaacgctaatcaaccaagaagatttgggcagcaatgtcgcccggcgtgaaaacatccaacgaccagcgaatactcgtggagcaatcgtacggccagcgacaccgactaaaatcagcccaaaaaactgtcgacatatttttagcaattctgaatttttatatatgtgttattattgatctaaaagtaaatgctgaaaaataaacttcgatgaaaaaaccttaaaattatttagattgaaaattcaaataattgacttataagtataagcataaaaaaaaagtctgccatccccaacactgccgccatggctgctcccgcttgctagtctctctggtcactgccggtgtaatcgatgctacacaaacattctcccagctccgagctgacaccaagctcctcttctccgactccgagcaatcaccgtcgacggccactttcctctctagaggaggaagggaaggaatgctctgagctcctcttgatctgtttggcagcatctagtaggacaggacaggagaggaagaaataaggaggaggacaatttggtccaacattttaatataatacattaaaatggtaagtagttacatgcctccaatacatataaagttgtaaatatgcaagttacaatgatatattttaaaaccaaaatgtttatagtggtacaagtataattaacatgaaatcttatcttatatagtgaaagcaaccatatttcttacacgagaacacgtcacatcatcgaaaacttatcagccgttaaataaagagtttagataaataatagccattggataaaaaagttacatatgcactgaaaaaacaacaattggattaatgtatggaaattttcggaggtttctagtgtctccttttagacacatggtacaaagagagagaggggcaaagataatgaagaaaacaaaaaccacgaagcttctagtgatttctcatatagtatggtttagttaaatctatagttagctagaccaatagatactttgtaaataaattaactcatgctaaaaccttctgtaactaatagatcatatccaataaatagttcttatacaaaataaaaagtcgcgcaacgcacgactacgtggcttgtaaatatgaaaatttcacttagatatatgcctggttatgtaacacttcatctattccaaaacaaattaatctagtatgagatatgatttatgaaactggacataagcatgtattaggttaacttattttggacacatagagtactacatttgtatctttagggcttgtttagttggcaaaaaattttgcccctgcatgtcacatcggatatacgaacacacatttgaagtattaaatgtagtctagtaacaaaataaattacagatttctccaagaaactgtgagacgaatttattaagcctaattaatccatcataagcaaatgtttactatagcaacacattattaaatcatggcacaattagatttaaaagatttatcttgtaattttttggcgaactgtataattagttttttctatatttgatactatatacatacatgtatccaaacatttaatataacaacgtgaaaatttttgtttaggaataaacaggccattactcgtccacgcaacaatggccaagacttctgaataatattttcggggagtaggttaattaagagtgtatacactcaattaatttcatggtataccgacaggttctcggggtgagcttattttatttcaggataatgatgtgcaaccaagtcaaaccatcttggtctcccaaacttaatcatatccaaagtcacgtggtttctagtgactgtcagtcgatggggtgcccatgtcaaatccggccattggtcctggccactgtaaccgcacatatcactgacatatgtgtctcattacttccatactagtcgtgtggtgtttggattctgacttaactttaatctttatatttagacaccaatttagagtattaaatataaactatttacaaaactaattatataaatgtaagctaatttgcgagataaattttttaagcctaattaatttataattagagaatgtttactgttgcatcatataggctaatcatggattaattaggcttaatagattcgtctcgcgaattagtccaagattatggatgtgttttattaatagtctacgtttaatacttataattagtgtccaaacatccgatatgatagggacttaaaagttttagtcccatctaaacatgggctaatagtcagatgatacctttccatgattattttctttcattttttaaatgtgtcagggttatggataccacatacctaatagtagttgactaaatctcggcaggacccaccatataccatgtctcatacggaaacaaccttcggatataggaggagttccgcataaggaatgatgaatagagttctacatgaaaacgataaaggactactcggattttattcatattggtctccttagttctacttggacaagaggacacctatgggtataaatacaagaccccctaggaggagaggggagagggaacaatagatcaagacacaagatcaacatacaagccaacatacgccaagacaagacgccggatatcgacttcagagacaagcatagctagtcccctacggtgtctacggatactgtcaggagagacataccgctgtcattgatctcgccggatgtggattcgaggaggaaggctaccctgt

SEQ ID NO: 1792 - DNA, 1711 bp, Oryza sativa
taccgaaaaagcggttggcgtcgtgggctttgtaaacccggccattgttccccctcctacctcgccaaggtgataccgatgcgaccatgtacgtagtacctctcgtcctcttcaccacgcacacccgcgtagcgacacgcgcatcacgtccgttccgcccacgacaacgactagcaattgcctagcaatctactcctactagctcgctgtctcactgtctcctcactagcttagcttaaattagcttggcttctggtatttttggccgtgtttagttgtttggtcaaaatttcttttgcgtccgtatgcatgtttgaaatattaaatatagactaatagtaaaacaaattatagattccgtctataaactgcgagacgaatttattaagtctaattaatccgttattagcaaatgtttattatagcatcacattgtcaaatcatagtgtaattaggtttaaaagattcgtctcgcgatttacatgcaaactgtgcaattggttttttttttccatatttaatactccatgcatatgttcaaacatttgatgtgacggaaaatgtgaaagttaaaaaaaaattaatctaaacacggcttgtattggatccctgggtctccatctggattaattaattttactactatactccgtcaaatggagactttgatctggatcgcgacaaacatataccgcctgcttcttcggttgcgtatgtagcagatgaaatttgacggaatatgctcgaattctaaataatactccctccgtattttaatgtatgacgccgttaactttttaaccaatgtttgatcattcgttttatttaaattttttgtgcagatatgaaaatatttatatcatacttaaagaacatttgatgatgaatcaagttataataaaataaatgataattatatattttttttaataagacgaatggtcaaaagttaggtaaaaaggtttacggtgttatacattaaaatatggagatatatatactagtagtattacttgttgctgctgcggcctgcagccaacttgtgggaggagaattcgacgacgacggcagcggcggtgtggacggcaaatcgttgttggctttcccatgttcgggaagaaggcacgcgatttgttggagaccatggagagagaggtagagaggaaagaacacacaccaagtacgcaagaagtttctgcgtcgacgtagacactatatatattctggccagtttttatttttgttgctcttgtgattacgccatttcgattgtcttttgcttttacattcgtttgatctggtatatgcttgcgtggattcaagagctggcagagctttactatgcggctatgccgtgatgacttgggtcgttcgttggatagatgtattcccacaaagtgttaactgtacccatcatagcaattcatttttgctatatatctgtcgacaaattttctcctgaaaatttgacagatataattacaatacaatcgtagtgtaattaacttgtatgtaattacactataacttgtatgtaactttcacataattttaaaccgttagatttgtttcaagatttgtacaagtgaagaaggaaaaaagtcgctgcgtgcacatatgtgagaggatccattcccacgaccttcgtttcatcgaaatagcctgttatagagagatttttaaaagttacatataagtagcgggctgcagg

SEQ ID NO: 1793 - DNA, 291 bp, Oryza sativa
gccctttccaaaaaccgtcctaattaatgtaatcctgaacgatacgacgaagagcaaatggaatggaaagcttccaatgcagtctccatcagtagttggcctgaacccggtaaattaagcttgcttcacctctcttccccggccggtctccggtagctcgccgacctctccaaaagcgactcatggcgagccaagaaaacctgcacgccaccagcgagctcgctcaacgatcgatccgatgcgttcgccgcgtgatcttgtggtggcggtcgccctcttgcagctgtccgt

SEQ ID NO: 1794 - DNA, 581 bp, Oryza sativa
aagacggtccagggaacaaccaaagggaggggaaatctcgaggggagaaatggattgattacctgctcgacgtggttgagccgctgcagcgagctgctctggctctgcgggagcatcgccgccgccgtcgacgaggaggacgagggagtagggttttgggtttcgccggagttggaagcttcgagaggatggctaagctggtatatagggtccttcgatgtatatgggcctcgcgtttgtttcggcctgtttacctttctccttatccttggattactttcaggtttcagaccgtttgttattattaataagatttatgttcaaattattttgatatttttgaactttttaaaatatgattttaagatgaaatgctcaaaattttaatttttttatatggttttcaaagtgatttttaattttgcaagcatttggggaaattttttttaaaaaattttaaattttgggggggaaatttaaaaatttcgtacaaatttatttttttaaaatatagtttttaagtgatttttttattttacaaggatttggatgcgggtctcgagcttgtggcatggctaaaa

SEQ ID NO: 1795 - DNA, 972 bp, Oryza sativa
tgataaatcaagtaagcaaattgaattgacaaaaatcacactctattattatcatagtagccccccgactgaaaacttcaaggaaaaacttgaagttagcagtcaaagaggaaagatacaaacgaaatgcctaagcataaaatcgacgaaggtgttcaatattccaagaattgtcgataggtgtaccgtcttcacgctttagtcaataagaacctggccgggtgacttcagagattataaatggcccttcccataaaggagataacttgtgccgatcccgtgtagtttgaattttcctcaaaaccagttctccgactaagaaagctcgtgatcgaacgttgcgattgtgataacggcgcaacccttgcaaataccgagtcgactgaattaaagctgcttcacgagcttcttctagtcggttgatgtcatctactcggccctgttcatagcgctcctcgttgaagttccgaaatcgtagcgattcaaattctacttcactcggcagcattgcttctgcgccataaaccaagaagaacggcgtctggccggtagcctgactgggagtggtgcgcaaagaccaaagtacggacgacagctgttctgcccacttgccagcatagggacgcagtcggtcgaaaactcgtgctttgatcccttgaagtatcatgccattagcacgctcgacttgtccgttactcatggggtgtgccacggaggcgtaacaaattttaatgccaaagttttcacaaaagtctttaaatactccgccggtaaattgagtgccgttatcagtaatgatacgattcggtaccccaaaccgatgtacaatattgatgaagaaatctctagctttgtctgcagtgattgtaacgaccggtttggcttcaatccacttggaaaactaatccacagctacaaagagatgagtataaccgcccactgcctttttgaatggaccgaccatatcaagcc

SEQ ID NO: 1796 - DNA, 4189 bp, Oryza sativa
  unsure (1)..(4189): unsure at all n locations
tcgccgacgaactttcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaaatgcatccctcgggaacaaggcgtcgagcttctcgccgatgtccatgaaggagagtgcggagcccactccgcctcacgcaccttggttggcaaggcctttcgccagggtttctattggccgacggctctcaacgatgcggtcgacctggtccggcggtgcaaggtgtgccagttccacgccaagcaaacccatcagccggcccaggccttgcagaccatacctctttcgtagccgtttgctgtctgggggctcgatatcctgggtccgttcaggcgggccccgggcgggttcgagtatctgtatgtcgctgtcgacaagttcactaagtggcctgaggcttatccggtcatcaagatcgataagcactccgcgcttaaattcatcaggggcattactgctcggtttggggtgcctaaccgtatcattacggataacggcacccagttcactagtgagctcttcggtgactactgcgaagacatgagcatcaagctctgcttcgcctcccccgcccaccccagaagcaatggccaagtggagcgtgccaacgcggaaatcctcaagggcctcaaaaccaagaccttcaacatcctcaagaagcacagcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggtcaccatttattgcgaggctgatcaagatcagcttcgccaagacgacctcgactatttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagtaagctctcaccaatgtgggagggtccgtatcgagtgatcggcgtcccccggccgggctgcgttcggctggccacgggcgacggcacagagctgcctaacccgtggaacatcaaacagcttcgtcgcttctacccctagtgggggtcgggtgtcatgtctcgggctcgggccaaccccgcacccccccgggcgtgcagggttggccgggggctaccacatgcatatacttatctcttttctcttccgtatttcaataaaagcattttcgatttcctgaggaccgtgtctgtgccatcgtttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccagcctggccagtctcgacacgtggatctccccaggcactagccccgacccgcgccgcttgaggctgggacctgggcatgagcccttgttcaagctaagacacagaaggaccgtggcacagaccatcctcgtctcatacacacaacaaacagaactgacgcagaaatttcctctttacttgattacagattaaatcagtctatacaagaagggggcccgaaggtctcggaaaaagaagaaaaagctattaagattggcgggggcctgggggctcactccgacgcgcccgggtcgccggcctcgtcgtcgctgtcgtccgcaccgtcgtcaccgccctcctcgtcggagtcgagggcgaacgcgagccgaggggccgtaccctcgaagctgtggacgatgtggtcggcggcgtcccggacctgcgcacgcgcgccgtcctcggttccgggagggaactcgtccagcgctgcccacggggagaagtcagggtccctggcctggtagcttgccagtacgagctccaccgccccccgggcgaggtccctcgaggatgacttgatcgtctcctcgagctcctcggggagtcgctggagggtcccggccatctctgagaggcgctgggcgaggcccccctggttggcggcgtacttcgcggtccgcccgccccagaggcccgcctgccgcccggcgcggtctagacgggagacggcgtcccgaagcatgccgggtcctacctcgctcgccaaacggagggccttgacctccccggcgaacgagtccagtgcgccctgcagcccggcgatggtgtgttcggcggctgcgaggcgggcggcaggtcgccgtcgcccgcggccgttccgccgctgtgcgctctcgcgtccagctccttcgcccgcgcctcgagctcagcggcccgctgatccagtgcggccctctcggcacgggcgccttccagattgtggcgcgcctgctcctcccgcgctgcttcgcggaggaacaggctgtccgctagccgctgcgccgcggcctcggcctcctcaagagctcgctcccgctcggtgagcgcgtcctcgcggaggcggagtgcggactcctcttcggcgcaggcggcctcgtgcgccgccagtgttgcctcccgggtggcgacggcggcctcgcggtccgccaggtccttctccttcgcgtccagggcgcgggcgcgctcctccagcgccgtggcgcgagcctcaagggcctcttcgcgctgccgggacgccgcctcgatctccgccgcccgccgttcccgggcagcggcggcgtcaaggactccccgggcggtgtcgagcttcttctctagctccgccgcctggctcccgtattggaggcggaggtcgttccgcacctcgtcgagcacggcggtggcgatgagggcagtctcccgctcctcctccacctccctggcgatctccgccaggtccctacgacgggcctcgagctcggaggcgtgccggcggtgtgccttgcggcccgcctccaccatggcctccaccgagcgccgcccctcctctacgcgcgcccacgccgcgtcgagctccgccctctctgcgtgcaggactcacatntcggcactaaacccgtccagcaccgtggtgttcgcggcggttaaggcctgcaggaggggctccgcgctcagtggggcagcggaaggcagaggggagagccgcctcggtgtgggtgccgcgcggctcggcccgccgatcgacgtgccggacccgggggcgtcccccgaagctggctcgtcccaagctcgcccgaggggtcgggcccgagcggcgcgtccgcggcctcgtcgtgggtggcctcggaagtcatcgtcgcctcgggtggagtcgggtcgggggcttggcaggccgcctggcgtgcgcgtgccgcctctgcctcccggacggactccccggcccggcggagtctggcctcctcccgagcggcctcctcagcctggcgaacccggacggcctcctgggcagcctcctcggcttcccggaggcggtccgcggcttctcgccggtcagcttcccgcctccgggcttccgcggtcgccgtctcctcggcttcagaccggccggacatggaatggcggggggggggggggtgcgatgggatctcgctgaggcagaagaaaaaccagaagacaaaaagaaacgggtgagtgaaaactcgccttgggagatgggataatgaacacggccgcggtgggcgcggggacgaacctgcggggaggtcggctaaacgaccacctcgggggcgagatgaggttcacccggcatggctcggtcccccccatcttgcggagccgtttcttctttcgctccccctcgggctgcggcgtcggcacggcaccctccgggcgcctgctgctggcacgcaccg

SEQ ID NO: 1797 - DNA, 1364 bp, Oryza sativa
gacgccccgacctcctgcatgatggtcaggatgttggcgcgctctggatcgcagcagagggggaggaccccttgggggatgagggatgcctccacggaggtgagattcagcacccgttggaccaccatcctgaagtcctcagggtcccagtcccatttgcgcccctggtgggtcctcatgtagtcctcgggcccagtgtactcccaggcgccccgggcacgccgctggagcggcgcgatccggcggcgaagtagtcaccgaacaccatggcccccgtgagcccctgggatcgcagacccaccaggcggtcaagaacggcgtcgtagccgtctcccagatctaccgccgcctgccagctggaggcctgcgccggaggctggctcggaagtcggaggcgcgcttcgtcgacgaggggggtgtagaaccaatcactcttccagtcgtcccactttttgcggaggacgcagggaatgtagcggttcaacacctgcccccgcggctggaagtagcagccaccgactaccgtcggcggcgacaccggctgtacggtgaagaaccaccggaacaaccggagagatgggctcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgtgaccacctcccggccggtggcagattccggcatgaatcggcgcggcagcccggcctgcctctcgctcacgatgcgggaaggcggcagcacgctaccgtcgagcggtgcggagccccgtgccatgacgccggtggaggaggagcttgagagcgagcgagtatggcaagggtagggcacaggaaacgaagagttagagcgcaagtggcgaaggcaaggggaagaatggcgagaggaaggaaacgaatcccttcctcggcgtctttattcccttgccaacgctatgcccggctcctcgcttcccgcgcccactaccttgccccctcgtttctcgctcccacgcctccactaaccccacccgcccgtttgcggcgcacgcagcagatgtgcggccgtggcggttgagatggggcagatcgtgcgcgcattaaccgcgctcgccaaccgcgaaaagcgccatcatcatgtctctaggcgaaacgaaccggctcgtctcgattcgcgcgctgctcgagtaatgtagcggtcttaaagaggccgctcattattgtcggtcggttttcccttgccgatgcgc

SEQ ID NO: 1798 - DNA, 20315 bp, Oryza sativa
  unsure (1)..(20315): unsure at all n locations
ttggtgacccgaagcggaagagtgtatcatttcaatccttggaatgaaaggcgaaatgctgaagttgttgacattcgctaccacgcccgagtctgcattgaaggtatcccgatgcatgcaagatcagaagacatggcggcaaagctcataggctgcaaaagctcagtgcactacatagaagaatactcccgtcgccggaacttcaaccgtacttttgatctttggatttggagcttagacttgagcaccatcccaaaggccacccagttcacaatcacaaggccagatagagaagcaagggctactgagatcccttttcctgacctggagccatcccagccggctccaactgatacaaagaaaggcctcacttatccggtcatcattcacatagacactgtccaggacctcttctctcgacagggtcgggtcttcatgtggcactatggagtgcctgatgatgtcacccggatgaggtcgatggctcacccaattcaagcctgcagaacccttccggcgccggagagaaggtctgatgatgaagacgaccacgagcagcgttcaagaaggaggcatagaagtcgctctctttggaaccgcttaggcggtcgttcgtcaagcaaaagcagagagcctggtcttgacaaccggagttcatacaatcaagagacaaggggaagacagagagaacgagctgctgacatcaatagaagtagaagccgacatctgtccaggtcggtcaaacctggagaaacaagaatcaggcgtcaatcggcgacacctccgcatctctctgaccctgctccagcagacaaggtttcctccccctgcaaacctttcagccattcaagagatagcagccctgaaaatgggcattgctctgcagttgcttctcctcctctcgaacctctctcacctgacatattgcctgtgtcacaggagcaaggggcgttgctcatgcttaaaaggcacctagatcctatgctgcatgaggctatggtgggaggttcaatttattcccctgacactactctgccacgccctgcttcccctgtttttgttctttcatctgctgcagaaccacaagagaacttagtggatgaggcccagcatgatgtggagacattcctagcagaggtgaccacgcccattcagcagccactgctgtctgcgccaggaacaaagctgcgtcgaccctgccgcaataaggtgaccactcctattcaaaggcatagtgcaagattggcactgaaagtcagacgcagtacaaagcttgaattaattgcacaagaaattcttgcaaagcaatttggtgttcttgatgataacaagcttttaagtgatcaaattaagaaactctatttgcagcattacaagaagccgctctccccagcagacatgaagacaatcacgaccctggtggaaaacggaggctgcaaaggagttcgtctgcgcgctaagaaggcggcctctatggtgccgatttgaagcagttgtcgcgtcaaaagttgccctacgtgatgatgatgttaggctgcttaagtagaagaatactgtccttgttctctgtattgcaaatgcgcacctcttcgtgtttctgccaatcttcctggctgtgtttcagaggtcgtcagctgagctccatcccaaccatcgcatacaaggccccctcagctgttgtgtcttttgtttatgtcgcagctagactgtttcattctaaactggaatgttagaggcttgaacaaccaagctagaaaaggaagtgttaagcttttggtagaacaaatgaatgcaacaatagtctgtcttcaggagacaaagatgaatgaaatcactgatgttgatgttctacacantcttggtaatcgtttcagaaatgattttgcctatctccctgctgatggcactagagggggtattctgcttgcctgcaatggcaattttttcagcctctccaatgttgttcagaagcagtttagcctcacagcaacagtaaccatgaaaaacgataatgctagatggtccttaactgtagtttatgggccacaacaagatgctcagaaaattgaattccttgctgaactccaggaagttgaacagatggtttcccttccttggcttttaattggagatttcaacctaatctacaaaacctcagataagaacaatagtaggctaaacaggggaatgatgcagcgtttcaaaggtactctggacaggttggggataaaagaacttcacctttcagggagaaaattcacttggacacaggagtgtgctaacccaacccaaacaaaaattgatcgtgctttctgttgtcctgattgggatgtcctctttgactctgcgcacatgtctgcactctcttcgtcctgctctaaccatgcccctttattcataactggctgtatggaaagagaacaaaataattccttccgctttgaatcttattggctcaagctcccagatttccggcaagtaactgcagagtcctggaataggccactacagactaccaatcctttcgtgcgactccatttaaaattaaaaaggcttgcaagagatcttagaagatggaaatcaaccagaataggagatataagattgcaattggcaattgcaaatgaagtagtctttcaactggatgttgctcaagaggatagagtattatcggaggaagaacagtgcctccggaaactcttaaaatcaagggtgcttggactggcagctttagagagaatacgactaaggcaaagagccaggatcacttggttaaagcatggagacgttaactctaaattcttccaaatcaaagcaaatggtagaaagagaaaaaatcacatacagatccttcgaactccagatggctttgctgtaactaaagatcaaaagcaggaagaattgaagcgttacttcacacaaaaattaggagcctttgctctcagaaatcagagattaaacttggctgctctcaatctccctacgcttgatctctcagatctcgatgataacttcactgaagaagaactcaaaaatgcaatctctgacttgccttcggaaaaatctcctggaccagatggatttattggagcctttttcaaacaagcatgggacataataaaaacagatctcatacaagctgtttccttctttggagatatgggatgtgcaagactgcaagaactcaattcggcacatatctgcctcatccctaaaaaggcggatgcaacaaaagcgaaggatttccggccaataagtctaatgcatagttttgcaaaaatagtagctaaattactagcaaacagacttgcaccaaaattagatgagctagtctctcaaagtcaaagtgcattcattaggaaaagagcaatacatgacaatgtcctgtttgttcagaaaaaaaagcctactcttttcctcaaagttgacatatcgaaggctttcgacacagttaattgggcatacttgctagaggtccttcaaatctttggctttggacataaatggtgcaactggatttccaacctactaggtacttcctcttctgcggttcttcttaatggtatcccaggtcaggaaatagaccgtgctagaggtcttcggcagggcgatcccctttcccccatgcttttcatccttgcaatggaacccctgcacaaattattcaagaaagcagaggatcttggccttctctctagtctgcaaagacagcggcgcttcagatgttctctctacgtagatgatgttggtctttttataaagcccattcgagaagaaatgctagtccttcgtggaattctttctgtctttgcagatgccagtggacttcacacaaacatggaaaaaacatagatcttcccgataagctgtaacggagtcaacctagataactgcctttccatcttcccaggtggaatttcaaacttcccatgtaagtacttgggcctgcctttgcacacaagaaaattggggaaattagagcttcaacctctggtggacaaagtgggatcgagaattcctggttggaaaggtcgcttcttcacttcggcaggtagagaggtgctggttaaaaacactctttcctctaccccaatttatcacctaacaattctccagcaaaataaatggctttacaaaaggatcgatcgccttaggcgagctttcctttggaaaggtgacgatcctgaaaacgttagcgggggcagttgtcttttgaattggacagtcgtctgcaagcccaaacctttgggcgggcttggaattctcaatttagagaaattcgctcgggctttaagacttcgatggctctggtacgaatggaaagaggaaaataaaccctggatcaatatggaaattccatgtgatgagatggacagaaatctcttcagagcaagtacacaaatttccctgggaaacgaaaagaaatgcaagttttggtcagacaattggctgcaaggatacgctcctaaagacatagcgccgacattattcagattagcaaagaggaaaacaaactgcgtagcctttgagctgcacaataatcactggatcacttccttaagaacaatcacttcaataaatgagatcaatgagctggtgcacctaggcagtaagctgcatgagatcagattacaccccaattctttggatagtatcacgtggaagtggactaatcatggtgaatactctgcaaaaagcgcttatgaaatgcagtttgtaggatcagttgccaacacaaattttatgccactttggagagctgaagcggaacctaagcatcggttctttggctggttaattttacatcaaagaattctcacagctgaaaacctccttttaagacattggccatgcgattggatttacagcttatgtacagatgcttttgaggacgcaaaccatttggcaaaggagtgcagtttcactaacacggtttggtcccaagtttgtagctggctggacatcatgcagaccccaaatcaactacaggatgcaaacattttagaatggtggacctcaatcatacattcaacttatggaaggagaagaagaaaactgataggggcacttcttataacctggtggcaggtgtggcttgagcgcaatcgaagaattttccatcaaaagcaactaagtgccacccaagtagctttcttagtaaaggaaaatatagatgccattcagattttgcgccatacataaaggcttgtgcttagctctagttgatagcattatgtatgtaaatctctgaaaatgaaaactgaaaatgtcacctagtggtctactctttcttgacctctctaactgcttctccttctaatatatccggcagagctcctgccgtcttttgcttaaaaaaatatatttcatcttttttagttaagttattttaggtcggagaaaatatatatctgacgtgcctatcaacaagacaacaacgtagagttgtcagcattagcttgccacaggtttgacttgcaagttgcatgtgagtgtagcttcgacgcagcaacctggtgacctggattcgtggagagcaaacgaattgggatgtgcgagccgagcagccacctagcaaggtgtcgcgtcagactactgacacatggcccaaacagccaaacgcacagtcgtctcagcccacctaacctaacgatggtcggcctacgggcctcattgctctccatgctcacggcccacggtagagggaggcatgggccgccccctatctacgccggcctttacgggatcaggtgggctctggctctgaagatcgagctcgacaggcaccgctcggaggaggagaaggcggagacgatcgaagagttcgccgcgaggttgcgcagtggccgctgctttggcaattggattggacagtggatgagtggaagaggaacaagatttactagtagtagctgatgagtatagctcagtgatttaataatatccattatcttatcaaccgcaagcgcatagagccatagaacggaacaaatttacaccggattaccgggttagaaccatactaggttttacagatttatcgtcagattcgtaatatccgcgtgcacagcaattgcctatcatatctaccgtcgaattcgctatggttatcatatcgttttccttaaaataatgcagaatacaactatacatagagataatggaaaattacaaaatcaaatatacggaaagatcgcggttgttggcaatcgtgcaccaatcggtttcacgctccatatattccgtgaaaatttgctcgacttaacaactatacaaagcgatctgatcctgcgagggttttacgtacgcggcgcttggttgaagcaggcaacaacatgggcaacgccgccgccgtgccgtcgtcgtgcgcttcggcggacgcggcgccgtcgacgacgccgaccatcaagctgctcatcgccaaggaggcccaggtcgtgctcttcgccgaggccggcaaggacgtcgtcgacttcctcgtcgggctcctcgccatgccggtcggcgccgtggtgaactgctcgcgggcgagaacgcgctcggcggcgtcgcgaacgtgtacgccagcgtgaggaggatggacgccgcgtacatgcagagcgcggaggcgcgcgacgcgctgctgaacccggcgccggcgcacccctgcctcgccgccaccgccggtggcttcccgtccctcgtccagcccccgcgcgtccaggcgccgtacgttgctcctcctcctcctccgccgccgccgccgggccacccggcctaccagtgttcgaccatccggccgacgaccccgtctctgccgtctctgaaggcggcgttcccgcccttcggcgcggggatgtcgtcggacacgggctgccgctgttcgacctgcctcgccgccgcccagactggcaaagggttcgtgcgggacgtggtgacgtacaccgtcatggacgacctcaccttcatgcccatgtcgagcatctccagcatcgcgctgctcagcaagctcggcgtcgaggacctctccgcgctcgaggaaaagacggtcaagatcggctaccaagaggtgataaattaaccagataaattcttcatcgaattctccatactaatttactacttagggtgtgtttagttcacgtcaaaattaaaagtttgattgaaattagaatgatgtgacggaaagttggaagttactccctccgtcaaaaaaaaaaaagacgaaccctggtttccgtgcccaatgtttgactgtccgttttatttaaaaaaataatgaaaaaaattaaaaagacatgttttatcatctaacaacaataaaaatacgaattataaaaaaatttcatataagacggacagttaaagttagacacgcaaacccagggtttgtctttttttttaaggacgaagggagtatgtgtgtaggaaagttttgatgtgatagaaaaattagaaatttaaagaaaaagtttgaaactaaactcggcttactttgttttgatgcgaatttgcagggtttggagattctgaaggcatcgttgcagtccaagaccgtgttgacagatgtcttcctgaacaggaagaagaaggctcgtgccggcgacaagcaccatagatccggcgacaagaacgtcgacgcccgagcaacgagcgagaagaaagacgccgccgccgcagtccagatggagaagagcgcgccgccgatgccacatgattttgacgtctagttcagttcagattaatgtcaaaaaaacagatcctacttttgaaagaactttaccaccaaacagaagcataatgcgttggttgatttctgcgacgttcttgtaggaggcctttaaaatttatgtagtctacgtcatgctcatgtggaaattatttcgaattcagtccaaattcttcattaaggagaaagaaatttcgagttcttctgagcattgctgctgcttgaactgaaccagacaggaacggcgaaagacaacagcaagaggagagttcatagattgctcgagcaaaagagatgcaagcctcgaccggtccagtccaaaaagcaaaggaaaaccggacaacaccggatcaaattgagagtttcagaggcaagcaaatcaagaacagtcaagcacattagaaacagcggtagcattagaaacagcagtacagtagtacacatggtgattcttaccagcggagagtcctgattcacacagattaagggggacttctacgcacactactatacgggtattgcttgaacatcccaaattgcttcaggcttaaccttcatcatgctgcacttcagctactagctagcaaaagatctggggcgcgcacgagtgcacgacggcacaagatactactagtagtacgcattaatttacaggcatcactaaagaccaatacagtcgtatagttaactacttatcgatcgagatggcttgcattttgacatcgccagcgaccagcgttgttgaagtagtagtagaattcaggcttgctttgcaggcctcctggcaaggaaaacgtcgctgagaacggtcttggactgcagcgaggccctcaggatcgccaggccctacaaaacacaaacacaacatatatgcagcatcacggacatggcaacgtgtacatgcaaagcactaatataaaacagagaaagagaagaggagtggtgagtgttgactgatgaatgatgattagtagataatttagtttatcacctcagtgtagccgagctgcacggtctgctccttgagcgcgcccaggtccttgacggcgaacgtgttgagcagcgtgatgctggagatggacgacatgggcgacacggtgaggtcgtccatcaccgtgtacgtcacgatgccctgcacgaaccccttccccgccccttcggctgcagcggcctgcagcttctgggcagcggttggtgcggcatacgtgcatgccgttgtcatctggttgccgcaggacggacacttgacgccgctcacgtccgtcacgtagtagaaacagtcgtaggagcggcagctgaagaagctcttgggctgcgaagaagacggggccggcaagcggaggacggaggtgttggagctggccgccggcgagagcacgacggggctgagcagcgcgttcttggaggcgccgggctggacgtaggtgccgtcgagcttctcgacgctggcgtagaggttgccgacgcagccgaccatggagtccttcccgagcagcttgacggccgtgccgaccggcagcgccaggagggagaagaggaagtcgacgacatccttgctcgcctccgcgaacagcactcgctgggcattggtgtcgacgagcagcttcatgctcagcgcggtggtggaggctgccattgcgcgagctttgccaactgcttttctccgcctacactactactggtagtacactagtactagcgcttcagcaagcgggtgggtgatctgaggctctgagcgactgagcagcacatgtctcggcggcggccgcctgctcgtgatacttatggtcgggggtcggcgatgcacgaggggcagcgcctcttcgagcttaagagcatctccagacagcctctccaaatcactctccaaccgtctatttagccaaatctccatttaattagcaattcaaatttgttatttactccaatagtctctccattcatcctttctattctgatttctattctgagccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaatattctctaattatagattaattaggcttaaaaaatttgtctcgtgaattagcttttatttatgtaattagttttgtaagtagtttatatttaatactctaaattagtgtctaaagacagggactaaagttaagtcctggatctaaacaccacctgagtgcatgacagtaggatccgcatgtcagcctcaactttttcttcttcctcgttttctcccccttttcccgtccccggtcccctccacgcctcgcccctcctcccctatgtccttgtcctcctccgtctccgcctcggccgattcgtgtgtgcgagtcaacagcggtggcggcggcgagaagggagaagccggcgacggcgaattcgttcgcgcgaggcaacggagatagcggatccactccttgccgagaaggaagaagatgccgacggatgtggccgggaactgaggcggtggcggaaacacgcttctctctccattccttgacgccggcggccgacgagcaggaggccgcgggtgcgctcgccgtcgtgctgccccaccgccgcatcctcctccttcactgctctcaaccgacgcgggtagtgctattgcgggagggaaaagcctcttcagcgtgggatccaccaatggcaaggcaggttgggctaaccaaatttggccatgaggggatgagtttggctaatcatttagcttagccatcctaatagagaggttgttggagtggattttttttggttaaaatagccaaatttagctgctctaagccaaaacatagggggtgtttagactttagatccagggaagtaaagttttagcgtgtcccatcggatacacagacacacatttgaaatattaaacgtagtataataacaaaacaaattacataatccgcctgtaaactgcttgacgaatttattaagcataattaatccgtcattagtaaatgtttattgtaacaccacgttgtaaaatcatggcgcaattaaacttaaaagatttgtctctcaatttacacgtaaactgtgtaattgatttttttcgtccatatttaatactcgatgtatctatccaaatattcgatgtgataaggtgaaaaatttcaggtgagatttaaacagggccatagtataaagtttcttcgccttctgcgtgcggtagtgggttttgagatgaggtgatgcgagagggcgtcgtacagcgtgcagattacagacgcagatagtacttgtgtcattacagatttattacagtgcgtaggtagcaatgcatacagcagcgttagtgcgtgatgagcgcacgaactgaacgcatgacgatttttattttgctgtcaagcaacctctgagcggaagcaaaagattttttacggctctaaattttttttggaaaattggtcggtaatcagatgcaaccgaggcaaacaccaaactagttaagcgcctggaactgcacacatactagttcgctacaaatacaccttcgagctgaaccatcatccatcaatacagccatacagcatacaggagcatataccgagttaccgaccatgcccgatcgaagttgggtagtagatacgaagtacttgagtagtagtatactgaagtctaaaggtataaaagcaaaataaaagacgatactccttgtagctagggatgcatcatgcatggacacacacgagcaatgcatcacaaaagctcaacttatcctaaacatatcgatctaaaattctaaatagtccaacttaccatcttcatgtcagtcgtcatccgtcaggcgtccatgacctataactactctaaggcagcgttcgttcggaggacattgagggagaaagcacttcgtttttcgcacacacgctttccaaactactaaacggtgcatttttttgtaaaaaatttttatagaaaagttgctttaaaaaatcatattaatctatttttaaaatttaaaataattaatacttaattaatcatgagctaatggctcacctcgttttacgtatcttctcaatctactcaatcccattcttctcaaacacaccctaaagctgtgtttagttcagcgtaaagtttagattttaattaaaattggagatgatgtgactaaaaaattgtgtgtgtataacaggttgatgtgatggaaaaggattgaagtttggatccaaactttggatctaaacacagcctaagcttgaattgctggtttcttgccaacgaaaacgttgaggactaggctttataaaccacgaacaacatgtacgacttttttttactcaaattatttctaattgcctcatacaaatttttctactgtttatcagcgtaactcaacagccaaatagcttgggcacttgacaagctatccgacaatagtcacgaagagattgatctgctttaaactttttattggattcatgagatggacaaccagcctatccatggtcaaaatttctcaagagcagaagcacattcgcaaaaggtgaatgtgctgtgacaggttgggtgcccggtgtagacaatggatgttcctatataactcaaaccttgttacaagcagtgcactcacttcacgtacggaagccaagatccttcaattgctgtggatctacaggagatggcgctttggtgagtgaacattgagcagttgtagtctttgggaaagcaatcacatcccggattgaattttcaccagccaaaagcatcaccaaacgatctaacccataggcaattcctcctgccatggtataaaaattaggtggaatttgagctcaacattccaaaactaaaagcagaatggaactagacatactataacacatgagtacatggcaatacgcaggtacaagcataaacgctgacgtttttttttcttgaatatgcaagaagcatatcactaacgcttgcatttattaaagcatcttagaatcaatatgctgtccaaaatctgatggtgtggttataacaagaagtaggattgatttgaaagattgctcttgtttgtggaaaaatactgtcttaatgaaacatacaagcatatagtagtaatagaaagttcagtatgcgatccaaaatctcaaatctaatccaaaaatatgtacatggagttcagtggttgaacatagcataccatgaggaggagcacccatgtcaaaacattctaaaagatagccaaatttttcctctgcctgcattgcaatttcggtattttagagctcagcaaaatgcaaaaggtacagcatgttttctatattaacaagtttgaatagaacggataaatactggtattttttacataattcctgcatccaaatgtctcctaataatgaaaataagtgacatcaggtactcaaaactcacagtaggattttttttaacgaatcacagtaggatattatggtcattaactgccagatactatatcactgcatttgatgtttctttactctctagtcttgacactcaacattgaacctttctagatgcatccagcataatttatgatcatttaccttgaatattaaggcatgcttgaattgagctatagataaaaacactggcttatgaatgacagcatgcacctttgccacacaaaacaagactacagtctcagacaatctaaatctggaggtatttcttcacaattatgccattccatgtccagtgaataaaaagcatgcacatatggcctaatgctcttatttcatctcagcataacattaattacttttaaaaaaattatcgatcaatctacaaattgaaaattgaaagcatggtactctcaatagtatgaagtgtcaaatataatacctgctcgggtgagataccgatgatctcaaaaatcctttgttgtacatcacttttgtatatcctcaaactgcctcctccaatctatatttatagcatgcagaacaaaaaagatgcatgttatgattttctacatagatctttacatgaattccagtacatataaagatacacaacttttattgatgtatcagatcagactctgcagtctgcacaccttgtttcattggctattattacagaaaaagggtctaaactcaaaagaaaccagccaaccagtcttacgaattaatcacatctatctgtcatggtcaatttgagatgagtatttagcatctgagattttaaatcacattccaatgaacaaatacagatagacttgtagaaagggctataatgttatcataatccatatttaaactagaagaatgtcttcaataaatgttgaagagcatgtgccatgtatggatacagtccacatgcattacaatacctcaaccccaagactttattaagacttgtgcttcaatgcttacacaagattttgcatcaaggagaatatgtgctaaattttctactatataaatcatgtaaaagagcatgtgcaatcttggacccttttctgaactagtatgtactgaacaaggtagcaagaaacttgatgcagtgaaagtacctccactccattgtaaatcatgtcataagccaaggctcgagctgatggtagatcattcatatcttcaggatttggtgcagtgaaaggatggtgtagtgcctatgagaacaatggagatgctcagagcacgcaaaacacaagacaatctttactttgagttacatgtcaattctctgttttaccagtgtctaaatttcttacatttaactgtttttccttctcagttgttcaggagagcaatgctcattcactgtaagcattaatgacagattacacattttgtaaattttgctattggtatccctatgaaaatttagattgaacatgtaaaactgtgtatgtttgcctcaaaccttccgtgacattgcaatcaaatttgcattctggagacttgtcaatgtccaaaagctcttttttgaccagaggaagtaccaaaaacaatctattatctgatattggcccttaaatttgtttgttaatactatataacctgttcgcatgccattaacaaatttcaggacatcattaaccaatggtctgcattctggtgatactgtacagtatgttatttcctttttgaagaatataactcagtatcctaatttagtaatgtgcattaatggtgtgctttagtaactactacaatcaacattctacaaaataattgaagtctgagcagtcagcaaaatggcagttctttaaatagtgtgatacagctatgcttaaagagtattcattctggttttggaaaagagtgaaggagtaatcagttgtaatttttgaaagaagatacatagaagaaaatctaacctcgtatctctgctcatcactgttccattcaaacattggaaaatccgtcacccaaagaattgaatgtgctgactagcataaagaaaacagaaaatgtagatgaagatatcaggagcataactaaagcagatgatcaggactgctctcagaaggtaatacagaaaggcgaagaggcacagaatctcaataaaatagcattcatattcacagacttactgtatctatcacttccagcttatgagcaataaataatcttaatctgccaagaattcgattagccgctgattgctcacccagtgcaaacaggataagatcacctgattttgcatctagatgtttcaacaactgctctttcttttcaggtttcagacttgccacgagtggaccaattccttcaagctctcctgtgagcagcagaccaattaaaccacaaaacaaattcattggccaggccaaaaagtttatcaaccaaaagagtgcaaaaattattttaccattgtccataactttgagaaaaggcaggcccttggctccagctttggaagcttcagtgtagacagttcctttctttaggtcagtatttgaaaattctttggcaccaccaggaacacataatgccttgatgacacccccgttttctaatgtatctgcaaaaatcttgaagctactgcccaaaaatgcatcactaacctgcattttaacagtaagaaaaggatgaagcgtagctgtgaatttattattttagttatcacagtaagatgggccattcagaaaggataaaggtactcacatctttcagctgccaatcaaaacgaaggtcaggcctatctgttccatagcgattcattgcctccgtataggttagccttggaaaaggatttggcagcttgatatcaccaacctcttggaaaatctgtgatatgaatatccataattcaatcaaccatgagcaatagttaaagaaataatggcatattttctgagcaataaactagtgaattaagagcctgattactactaacgatctgatgtacaatagctaaatgacggaaccagtgacagacctacagtcttgtcatgggaattgagccaggaaggaggctggggcctgaggcccagaaccagcagcaaaacctggccaggtatagggggaggaggctcagcccggagcacacgcgtgactacgtgagggctcatgcaaggaggcacttgtctacattgcagggaagaaggtttttttatatagggatatgtgttcaaacgtctcaggcatagctattactgtcggtatttactaatagacaggggtgaagaacaatgctaactcaaatacgaaattaactaaaaagataagaggaaacaagttaagtatttgaaaaccaacttacatgtctcattaattcttcgttcaacttcaacatatcttccattgatgtaaatgcaatctccatatcaagttgtgtaaactctggttgcctatctgcacgcagatcttcatctcggaaacaccttttatgaagtggttcaatgaatcaagacaatattgcagagcagcattggagataattgtttgactggttcaataatacttccctccattctgaaataagttaacctagtacgggatgtgacacatcctagtactacgaatctggacatgctcatgtccagattcgtagtactaggttaactaattttaggagtgagggagtaatatattccaggaactgagcagtgtacagtgagcaatttatattgagaatattcatgcaaacaggaaaaaaatcaagaacccagctaaacaggttacaggggaaagagattatgcaacagagaatatagagcaactcatgcagagttgtaagataactggaagaaaaattatatccaagaaacaaacatccttcaaaatgttgtacctactaaccttgcaatctgataatatttttcaaagccagagaccatcaacatttgcttgaacagctgagggctttgaggaagagcatagaacattcctggcttcaaaaaccatatttnagggcatcaggggaacatgaagctcttatttgaagaagtttcaaaaattcactgcagaatgattagacctaccgccaaaaagcactagatatatatttatgatactcaatagagttgtactttcataattgtcactgtttatagttaaaataaacccaccagagaatgcaaaagaaatgtagaatgtagtgtatccccacaagaacgtaggcacaagggaagtcttacaaaaaaaggttcttacatttatttttattgcagttttcaaaagttagttctagccataaagtttttcttttaattggaaaaaacaaggagataaaggaaattaactacatccatctactggaagataattgtgcttaacgatggtaagacaattgatatttgagaaagcaattattacaccagtgaacccaaatatgatttgggtaattaggtctttgaaagttgccacaaataaaagtgaacgaaaaagcactgcgcatttttcaacagaagaaataaacgtgttataattgtctgtttaagtgaaaaatagttacagacaacttacctgaactctcgatgggacaagatagtcccgagcaccttctggtgtagacttagataaaactggagtctcaatctaccttggaacatgcggtaactttggatcagacacaatagaaacaataacagatacagacattataggcattgcaaggtactaagatattattagtcattgtgatgtcttatattctaatgactcgctgtaaaggagatacaacagcaaagaaggcatacatgacccatctatttcaactgatccaagttattttaactagcaaattgtacaggaaatgattaaaaaaaatttcatgtacaaagcaaacaaagcatacatgcactctgtaaaaaaaaaaaaagatgattaaaattggaattagagccctaagcccaaggtgcaacatgaccttcaggcattacatcatgaaagcaagtatcttgctctctctactgcaggcactgcatcgaaaagaaagtattttgccgtcttgcaaatttccgttcatctataggaccagactacttggatatattgcattccatagtggaacaaaatgagaagcatatagccaaaggcagattatgttagaggtgcaaactcagcatgaagtaattaatgagtatataattggtatacagcatacctcaacaaaatcatgtctatcctccaagtatcgacgaatatgcttgacaacattatggcgcaacctcaagtttgactgcatttgtggtcggcgtaagtccagcacccggaatctagacatttacaaatatggaagttaaagaaaaagattggtccttaatatatggaacttaaaacccataatataactatattcaagtacaatggtcgcctgctgtgaaagaagacattgagaacagggaaaagtgctttaggcaaactattaaaaacattatacaaacagattcaagcataatggtcgcctaaaatcttgaaagaaggcaaagagaacaggtaaagggctggcaaacacagaaaatgtacatcttctggcaaggatggttaaatctggaacaaatttgtggtcaggattgcagaatgtcatgacatggtattgcaacagagtaaagggtggtttaacagcagtatgtagttaaaaacattcctatacactagcataatccaaatgatggtagaaaattccaaattaaactgaatatgacagccttcataatgaccgccaatatatcgatctagtgaaaaaatattggaaccttggaagaacaaagatccatagaatatagcaatggccatagttcagcgtaaatcagtaactggggtgaatgattaataaacaaagagattgcaaccctcacggagtgaatgatgtgccatgtttcacagtatctccaaagccactattcacagggtaaacatgtgactccccagaaaatgggttaacacctcaacaagttgtgtcccagtagttagtgtcgtaatgcaacctaagtattattttggcacctaaaatcttatgcacaactttgaatgtgcaatgtaatcccatttatgcatgtattcaacaagcctaatcaggcgttaaccaacaatcaaccaccatatttgaggtattcaatactagtatttcttttcttcaggatacttaatatatgagcataaaaagagtgcagataacaatgtattttacctcagtctaatttcttctggaaacttctcttttacagtatcagcagtggtgattggaaaaggcaatgaacgagttactgagttcagcacatatatattatctgcagcaacctgcataggtcagcatgtaatatcatagttagagagcattttgctgtatggaggaacacaataaaaaaattcaggaagtccgcaacaatgaaagaaaagaagtgttagaattacaaataatgttgcacgggctattccttatcctatatattagctcttatagcatctatgtgctccgtacatatgaacagcaaactttaaaagtgtggaatttctgtactagatagtttgaatttcaaattcttcacttgacatatcatctcaagcttctctctctaaactgcaaaataaagtaacatacaaccagtcaatacctctatagccccagtcttcatatctgtgttgatggcttctgttgggcgtgaccgaacaaccccctcgaccgcaaccactgactctactcttagtttgttcaccacagcataaacttctggatattctggcaaagttgtcacctacacagagagaacaattaccgataagaccatgctatcttgtagatgtttatcagtctaccaatcactacagaaagaaaaaacaaatcaactcccccataacattacaaattgatgcgattatatgacttcattttgccttcgtaagttattagatcactcaacatcagtttattgggaatttgtagctgcaaacgttgctaaaaccactcaatagaacaggaaaacagtaggtaatgtcagtgctacaaatactattatactccctccgtttcgaaatgtttgacaccgttgactttttagcacatgtctttgaccgttcgtcttattcaaaaacttttgtgaaat

SEQ ID NO: 1799 - DNA, 7050 bp, Oryza sativa
tttcgaaacggagggagtacgtcattaacttgacaatacaaccgaccattcccgatgacacatattgagcaataaaaatgtggaaccaccagctgttacaaagtactccatctagagcattagcatgtagattaatttaatcactaacgagaacgatcaaacaacaatacacatgcgtgcaacaattagaatcacaggctcgcagctactacatatgggcaacaaacaaaaccgcaaaattatcagcaccagtctatcactaacagcgactcacctggaccgtgccggatcggtcacgaagggtgaggaaggtgaggccggcgtgggcgcggtggagagcgacccagccgcagaggcgcacgcggcggccggcgtcaccggcgccgagctcgccgcacagcgcgtccctcgcaggccactgcagcggctgcagcctctcgcgcttcgcctcggccgcgggcgccgccgcttcctcctccggcggcggggtcgccgcgtcggtggccgctagggttcggagcggagacggcgagcacgaggccgacgaggtggaggaggcggtggagagcagtaggaggcggcggaggtgcgaggcggtggggctagggttgagcggctttaggcgggagaggagggagagcggcgaggcgcggaggagagaggaagccattggattgggctcggagacggtgggaaagcgagcagaggaggacaagggcttgggttgggttttggaggaagacgggatgggatcgccttatcctcctgcacgaatcttacagcacaagtttttcgcctgcctgcaagcacaagcagatagaaccatcgccagaattcgaaatcaaaagctcttcgacaccaaaatcaaaagtgaattcgcgccggaacatttcatgagaaacgtaggagtacttctcagcttatttaatccaaagtaaactgcacgaccaccgtgcttcaccaaattggagcagcaataggcgtcaaaattgtgcttacaaattcagatcccgccaaggcagaaccaaattttgaaaactgcacaaatcacaaaacgcgcaacaccagtagcaggggggaaataaaattggcgcgatgtagagacaattttttttttcagagcgcgcgcgttcatcaggcgaaaaattcgtgaacatcgtgaagttatcgcttccaccgttccaggcgcataacatcaggacaacgaaagttttgaaaccatgaaatcaaacagcgcccagattcactgccagacttcacaacaaattcaaattaaacatcgaaacatgcactaaatgaaaatgaaatacagccccaacgaggctctggataggaaatttaagacaaaatattcagagattttcagataagcaaagacagcgcaggagcaggagcaggagcagattatcgtacaaaccacaggattggaggcgacaggggaataatcaagaacatgtaaaaggcaagcagattaagccatcatcatcataattactactttaccagatccagataacaatattgtcctaaatccaccaggatatttcttacatgaacccaagatagtcaaaagccagaataactacagcacagtaccataccatccaaaattccaacctaccacaactaccattagcagcaagacgagaaaggggcctatgagcctaagcggaggtgaacttggtcacagccttggtgccctcggagacggcgtgcttggcaagctcgccggggaggacgaggcggacggaggtctggatctcgcgggaggtgatggtgggcttcttgttgtagcgggcgagcttggcggcctcggcggcgagcttctcgaagatgtcgttgatgaaggagttcatgatggacatggccttggaggagatgccgatgtcggggtggacctgcttgagcaccttgaagatgtagatcttgtaggtctcgacgctcttcttcgccttcttcctcccagcgcggtccttcttcccctcgccggagcccttctcgcccttgccggcggggagccgcttctccgccttgggcttcttcccggccggggccttctcggccttctccgccgcgggctcctcctccgcgggcttcttcgcggccggcttcttctccgccttgggcgccatggatgctgctctcttcttctcgggaaggggaaacggtggtggttcttttgctgtgtgtggatcgcaagatttgcggttgggaagaggaggagacggggccgattggttttatagaagaggggatgtgcgccctgattggtggaaagcatgcggcgcggatcgatgacgtggaaggattcgtgtcgttcgccgctgtttgcggtgaacgggtgggatgcgtttcggcgcggattgctgacgtggtgaaatatctgggcgcgaagagacgagcgcggggcgggattttctcgcgcgtgagcgaaattgtggaagggcccatgggtcatagggacgcgacgatttttgtgtatcgagaattacaattttttttagagtactggatttttttaagttttaatgtatacataagaaattttgaccaaatattgatttcaaaatgtttcacgataaatgcgcaattctataatagattctaccatggtttttatgtggtactattatgctattatgcaaaggcgtcatgctgaactctttattgttgtaaaattcaagtcaataaggttctgataaaattcttgggtgaaaaatcgattaattcatttagccactttatttggctttccaagatatactaggtgtgattttctgtgaggttctagaccgggctaggcaataactatatccgcttccaaatacttttttatttgtttgacaagcgttgttttaacttcgatcatggctatttttaagtgattagactatgatgaacaaatattaatgcttaggttaggcttcaacacgccctaataatatgatatattataagtatttaattttaaagaaaaaacaaatggtcaaagtttaaatatgaatattttgtgacaaatagaatcttggaacaggtggagtacaaatgaaatagaatggaaagcttgatgctaaaggcacttgagacatcatcaaatgtgaatcacttttcaaaatgaaattaaaaactcagttaaacattagcagaaagttgattttgacatagcttgtctttggcctacaatatattaaactatgtttgttgacaaatatatcaactcattggcaattccctatttttcaagtctaatttaatctactcaaccccgatatcaatatcctcctcgacccagctttgttctgccaagtgccaatgccttggcttccctcactgctgctcttgagttcgcgaccatgtagtcgttgtcgcttcagctgctcgtgttgatctcttagctcgatgctgcaaccaagataattgccttcacattcgtttatgccatgcgccactaaaattattctaataacaagagaaaatcccttgcactcccctgatatttgagtcgatctctaacgtgtccttcagttttttttctttccatggtataattatattatttttttgaggagaacgacggtaggagatctgccaaaatttaacattaggagagagaaattacaaagtagcacagaggttcagaggttacaagccaaggaatggaaagataaatacagctacaggaaaagctaaaaaaaattattggggtttaaaggccaagcagcgcatatcaatagcttgcttgataaaataagctacttcaatctctgaacaggaagagttttggaaaattcttctatttctttctaaccaaatattccagcaagtagttagaagagtttccctgaccaactgcacatccttcttagagcctgcaaatttggttccagaccaccatgttgacacatccaggacaggatttattccgaccgaagtcaagttttggaattgacaaattagggtctacacttgtctgacaaacacacaatcactgaacaaatgatttgtatcttcaaaggcacaaccacaaacgcaacatatccaattgcaaggccaatgcctgtggagcagattttgggcagtcaagttttttgatggagaactagccaaccaaagaatttatttttggttcagtcggggaatttccatagagaatcaaactcattggtggcaaatgagccttcgaactggaaaaggtaagcactctcaatcgcgtgagaagtggcagattcagatgttctccatggtataattatggattttgatttttggtctctttccatattcttttctttaattggccatttaatagttatgaaaagtccattttggcatcagcatgaaaggaaaacataatttagaattatctatatgagattatcatgtattcaatattttgttgtgtgaggtattattcatgacaaaatttgttttgcacatagacgatagagagtttaatagttattcctttaattatagcaaatctaagtagtgtgtttttggatgatatatacaatagatttcaatgcgccctatatgggtaaggtataccctctatcctactacttatgtaattttatggatacaccgcaccttcgtgtgtatggtaaagctccatatgcaataaggaaatcgataagagattatggaaataatcctcgcgggcaagtacataacaaagatctactcggaaaggattaggaatatactatatcgtgcaaggtcctaggtcttcgagttccaggggattcacggtgtaaatacatacccttaaggggtccaaggttttgagtcataagcacaagacaccaccaccataatctcggaggacttgaagcctattcaccgatagatctcgtcgagctaatctcaacaaggatttcatcggtaatctcataatcatttgttctctattgtactatgtgtttttccatatcaatctcatataaactgtaataggactattatcttgcgaggggcatgaaccagtataatccttgttttttgtttgcttgatgttgaatcgtgtagatcctcataccaacgtatcccaataccctcatcatccggtctacgggtatcccccgtcgacaaagggtaaattcaactggaataggactagattctatttaaaaaatatgtgtttgcataaccgtgggtactaagatatcaatattggagacattcacaagtacaccagaatagcttcaattcttcactaactatatattcttatagtttcctcgcactagattatctcatatgttaattcaatctatcttttctaacacgtatctacgttatcttattaaaaaaactaatataaatacataaaagtataagttaaggttatagtttctttgatggtaaaacaagtaacaacaaaataaataatatatatagttttttaataagatagatggttaaacactatgtgaaaaaatcaacggtgtcatacattttgaaatggagggagtatatccactaatgtatttggggataccatgtcattgatcattgttctcgaatgacaactgcttcacgtcgaaagacgtggtaaactcggtgagtggttggaatagtaaagcaatgtattaattgataaaaatttttgggatctccccattacatggctctaggagactatttataatcctagtacaggcttgtaccctttaggatttggttagtacatgtgaatttgcatagttacccttaccgtagggacattacaatgtgtatacagtgtcttttgcatttatgggccttgaggcaacccccttgggccggcccattagttgtcgaagggcctctataggccgctgggcctcctatgtccttagccgaaggtatctactacttcggggcgatggccttgtgcttcgccctacaaccttcgcccgtggtgactctccagttgaccgatgagcttggaggtgaacccttcggtctccattccatggcttcgcgccagtcttgatggcaaaacctacttggttctttgtcattctacttcgcccaaggactttggcccttggcttcactagtggcacatgtctgggacttagccaatcctcgatgttttgggtggtttcggtaggtcggccgaaggccctcatgacatacctccaacacttacagatatagaatattggaatagagtataccaaagtaccaacctatgttgtgccttaagttatctcatatatttgaatttcattttattttgttacaaacttaaaagcaacaccaatggttcccaaaatggtagagggatggtagtgcggagagagtgacgtgtaagcgaggaatcaagtgggagggatgggggagtgatttatgtttctatttccattggtagtatcgagagtcaatttgtactgttccatttttttcttacctaaaccgcttattaccaactaaataataaattatgggttaaacttttatatacttatccttaacgagtcaaaaataaatgttgtaaaataatcttcgatgaagaaaccataaaatcaactataaaattaagttttaaattttaaaatatggcttataaatataagcataaacgaaatgatggaaaatagatgtcttttagagagaagaatctattcacgcctcaaactttaattaggaattccaaaaacataattttggatggtttttttgttatccgttggacatgctctgattagggatactgttagagccacagcaataaaactattttctttagcgaggaatacaactatactaaaatcatggtattgaaatcacagagtattttgggtagtgatgctcgtgagcctatctgacgttgattcatgatctaacggccgttctgcacttactgcagtcatctactgctaggcattttgctcatcttcactgtcaaatctcaatcgctcgccgtcgccccccgcccgacacaccggcggccggcctgtgcgacggcgatcctcaccaccaccgcctccgatgcctccgccggcacgccggcgtatcgccggcgatcccaactccacgtcgatcacctcacatgccggcatg

SEQ ID NO: 1800 - DNA, 2831 bp, Oryza sativa
ccgcctccgccgcgcccgagacgccgccgccgttcttggcctctccctttcatcggggattactgttaaccaatataccgcttctcagatattgttctctcttgtcaagattcggcagttcgctcttgcccgggacctgtttgataaaatgctccagtccggtgttcatctggatgagtatgtttacacggcaggcattcgagcttattgcgagtccaggaatctggatggtgcgagagggttggtggtaaggatggaaagcgagggggtcaaggccagcgctgtgccttacaatgtattgatgtatggcttatgcaagaatatgcgcgttcaggaggctgtggaggtgaagaatgtcatggtgaacataggagtgacagccgatgaagtgacataccgtactctggtctatggtttttgtcggatggaagagctggaaatggcactgaggataacacatgacatgatcaggcttggttttgtgccatcagaggctaattgctcatttatgattgacgagctacgcaagaaggagctggttgaggaggcattcagtttagcttgtaaattgggtgatttgggcatggtaccaaatgtgtttgcatacaatgcattgattgacaaactgtgcaagaatgaaaggtttgacgatgcagataggctctttaaagagatggcgggcaggggtctggagccaaatgaggtgacttatgctatattgatacatgccctgtgcaagagagggatgatagaagatgcactttgtttgttcgataagatgagggataagggtatcaaagtgacagtttatccatacaattccttaatcaatggttactgtaaacagggttctttggatcgggcaaggggacttttgagtggtatggttaaggagggattgacaccaactcagcatcatattctcccctaatagctggtttatgtaggaatggagatctgtctagttgcatggaactccacagggagatggctgagaggggcatcgcatggaataattatactttcacagcacttatcaatggtttctgcaaagataaaaaaatggatgaagctgctaggctgtttgataaaatgattgacagcaatgtaataccaaatgaagtgacctttaatgttatgatagaagggtattgccttgttggaaatataagaaaggcattccagttatatgatcaaatggtggaaatggggctcaaacctgataattacacttatagatcattaataagtggactttgcttgaccagtggagtgtcaaaagcaaatgaatttgttgctgatctagaaaatagctatgctgtgctaaacaactttagcctgacagcgcttctgtatggattctttagagaaggaaggttcactgaaacataccatctttgggatgagatggcagtgcgaggagtcaagcttgatcttgtcagttttaccataatcgtgtatgctgctctgaaacagcatgataaggaaaaatcatgtgtctatttagggagatgaaagaacaaggtgtcaagccagatgatatattctacacatgcatgattgatgcactgtcaaaggaagaaaatatgatccaagctttaaactgctgggatcagatggttgtggatggctactctccaaacactgtaacacatacagtcttgataaataatctctgcaagccagggtatttgggcagtgcagagctcctctgtaaagagatgttcactgggaatgttcttccaaatgaatttacctataagtgttttcttgatcattttgaactgaggggacatggaaaagggcaagaatctccattcagccatgcttcaaggccatctagctagcatagtgtcatttaacatattgatcaagggcctctgcaaggctggaaagatccaagaggcaattgaccttatgagcaagatcactgaaagtggtttctctccagattgcatcagctattctacaataatacatgagctctgtaagatgggtgatataaacaaagcatttgagctttggaatgaaatgctctacaagggattaaaacctgatgttgtagcatacaacatttttatacggtggtgcaatgttcatggtgaatctgataaggctttgggaatatacactaatatgattagaagtggggtgcaaccaaactgggatacgtatagagctcttctctcaggaatttctctgatggtcagcaaggggcaggcattgctgcttaccacctgatgtctagggcagtgcatttcaggctctcatctaatggcataagttgctatcattcatctagaacaggatccatgaaatagttccctgaactgtagctacattatgacttcagttgcttcagagggacaaaacaatacatacaaatttctgtatatgagctcatggattctacacataacaagtaagcaatttaagacaattacttttctaccaaatgtatgttgtccacaatcttgcagatagtattgtaccatttgtacatttgagctatcagattttaatttgacagtacctttactgctttacattctttacttcaagaaaaagtgttttttgttaatgaatgtttttttttcttatttcatgccatcttactattgatgtttcctgttaagactgaaatagtgttattaagacacattcgtcttggtaaaagttctatagattccaagcttaaaaattcattatcaactgtttggactttacattcaacattgctaagacaacaattatttccaactttgcaattttacataaccttgtctgaaaatataaaaaaggagattacacccttttaagggatttatttt

SEQ ID NO: 1801 - DNA, 7813 bp, Oryza sativa
atggtcatcataacttgacagaaacgccgctgtaactaatattgttgcgtttctgattgcaggtcacataggcgaatatggtttgttgatgatcacaagtctggtgaaataatccttgagtttgatggtagactgaacaaatggggcgtcatcagcttccgttctgatgttaaagtcaagaaattgagtcctggaccgcaggtctctttccctacacaccaggttagttcatacaactatcaataacatatctggaaatatcacttagttaagatgcttctatcttttagcaagatttttcagggtacttcattattttcaaagggctgaaaaaaaactcgtttagctggcctggttcaaaattgctctgattgatgtgattattcttttaaaatgaaaactagtcaattttgaatgaaatgtgtttttattttggctcggctcattaacaagaaattatagaaaaataattttgaagaaagctcgataaaaagctgaccaagctttttcccatccctttattgttgtgctgtttgcagtctggctacatgcctacatcgccctcactacttctgccggtaccgtggatcatgattcatgaaagaggcaaggagaaagcatatgggagaaaatgttctgggattcttctaacagagagatttatcttggatgatcaatagaaaaagacttgctgtcctcaagttcaaggccactagtatcactgtatcaggattcgtatacatgcagtgatgctgtagatggactcaaagctagcagcagcgtagaagatggtgtagatacgtgcctatatgatttatgaattgttcctgttttggattctattgtgccgtctatttagttttattgcccattgatttgcactcgttctgctgtattgtctgtcaatgaaaagttgccggatgttatagaacgtattttctgaagttttagaaaagcttcaactctatagtatatttctaccaggctgtgctgatgcagtgatgcttctgcgagctgagtagctgactgctgttgattgctgatgatttattcggtgctttgagacgatcggcctcatctttcgcttatgcttatactccctccgtattttaatgtatgacgccgttgactttttgacaaacatttgatctttcgtcttattcaaaaaatttatgtaattataatttattttattgttacttgatttatcatcaaatattttttaagcatgacataagtatttttatatttgcataacatttttgaataagacgagtagccaaacgtacgttggttaaaaagtcaacggcgttatacattaaaatatggagcgagtacgtgaaagggcatgtagcctagtggttacaagagcctcagtagcacccgaagtcctgggttcgactccccgtggaagcgaattttccaggatttaacggcgttgtgctttcagtggtaggcgacgtacccgtcgacagcgaggcacctgtggtgacttcatcaatctctccaggatttattaccggcccagtcttcgaagatgctcataggggtgagtgtgcgtgcgttgtgagtgtctgtgttgtactgtgtaattctcaaaaaaaaaaggaggaagtacttatcagtcaaaatttaaattttcgatgttaaatttagagttgattttagagctttttcattaaagtttttttttcacctttgcttttacggcccgtttggttggagggaaattttaggagggattgtgagtttagagggatgaggctattaagagcatgcccaacagattacttattctattccctatcctcgaattaaagaaattttaaccaaaattctcatccaacagattccctaacctacctcccaataatgcaggttcccatatccgtatatctcgttactcatttgcagggaaccactttttcttcccaatcgcggtggtcgctgcttcgcgcgcgtagggggaaaatgttcccacgctccttttctcgccctactcaccagcaacaaaattcctcttcctcccaggcgtcagcggcggctttccaggcggcgaagcaacggccaaccccttcctcgcaggcgtcgtcgacggagttccacgtggagatgcagcagtcgtccccttcctctcagtcacaggggttggcgtcgatgttgctccaggcagcgatgtagcggccatacccctcctctcaggcgcaggcgccggcgttgctccaggcggctatgcagccgccgtcctcttcctcgcaggtgtcggcgtcggcgttgttccagggggtgcccgcacgtcgaccaccgctgccggcgcaagccccaccacctcctcgatttggggccgacggccctctgcgccccgcaccgctgcctcgccgtcgtcttcctcaacctccctactccagtatgcaggcgagagagtccatggggggacatgctccatgggagacactgaatcccctctcatacgaagctcctggcatcgatttctccacagcttattctgtgtgtgatgaagaattcctccatatgagcaatttcggtaaggctgtccctgattcgttcgatgtttagattaattttcagagtgttgcagcctgatctgatgtccattctatgactgacttccccggctagaattcaggaattcaggattcagaacacttagaggaaaatgtcagaaagtctgaaatttgtaccgtatcgaatggaagtctgaaatatgcaggatatgctctaaatctgaaagtctgaacacttataggaaatcaggtttcagaatatttagtaatgaaggatatgctctaaatgtgtggtatgctctgaaagtctgaaatatgctgtcaaatatttttgctatgtcaaatgtactcccaaagtctgaaatatgctctgaaagtttgaaatatttttctctcatcacagcatctttgaaatatgctctgaatttttgcattaagataatgttgttagataatttgatagataatgcaacaagatgcagtccatagtctatttttcaagataaaagaaccacctgcttttgccaatcagactttcagtttcatgaaagctgcaactacagaattataagtacaacaacataagtttagtaggattataataacttatacagttcttagctctaagtacaacagctgcttaattgaagtgatcatctgcatttagtatgcctcactttttagattagcagatgaacaaccacatgcttgtgccaaatattgaaaatagtgtctgaaagatgcaatttcagtatgtatgtgcctaatcactcactgtcgctgacatttattcttctttagttcccttctctgatgccatcatagacagtatgtgctctgaaatattgagaaactacttgctctgaatttttgctatgctctgaaagtatacaagtctgctttttttttttcctcaagtacatgctaacaaggttccccgattaattactgcatgacctataacagatccaccacgctttggaacttcatcatcgtcgaactcaccgtgcactatatcaaccgccgaagaaataaattcttcgtcaccatccgatgaaaactcatccaatagcatttggaggagggtgcttcgacgactcatctcctctttttgtttgccacggtgttggagcgtttaccacagggatgaagtgcaatggagggaactgatggcaggaatagaacaataatcaatctgcaaaattaattatcagatcaaacttaatattttccaacaatatatatccacatcaaaatactgacatagagattgactacggcacaagagattaatgggatttgctaaggattacctccttgatgacacgaattgctacgacatctccttggtgttccgttttttaacaaatcgcagcagtcaggacactggttggctggctggtgatgatggcgctaggtcacggcggcgcaagtgtggggaggaagaagtcgatcggcgctggtgcgggagggagaagacgtgcgcaagtaccgaactgggccccaccttgcttatgtggcaaactaacaaatgatagggaattgatttttgggcttctcttggaggagggggtcattgttgggcccaatttttattttggtattcctaattcagattttttgggaatcaaatattgggtgattgttgggcatgctctaagtgatttgtttggttgggagacatggaaaatttagtgggatagggatggtgaattgaggaaggaactccctccttttcaatacctgggtaggggcaggtaattgggagggaattcctcctttactttttctaagcaaatctgagccatctgtttttattaatgacttaatctccaactaaactccctatcaatttccattacctctaccaaacaagatattgagattaaaaatcaaattcccatcttaatctcattatcaattccctcgtgtaaactcccaatctccttccctcgagttaccaaacaagccgttagatcactaagaatacgtatataaaagttttattcacaaattttttccatttacaaatatgccgatgggtcctggtgatttacttaacaaatgtttgattagatcttcagttttatatacaaattcgttttgtctaaacagataaaattgacttattaatcttgggaaggccgttactcactctagactttactcctccttatctttttttttcttgaacgaacatttcatttcttatatttttgcatagtttttttaaggtagttatagacaaaagtgataatgattgggcttctaaataatgggtaagacttgtctccaacaagtgacccataagggcacctaaatctaaaatgggtttccgatagtattatttcagcctccaacagagtacctatacagaagacctattttacgtgctataagaggcataacctaaatctgagtatcctctctcctgaagacctatttgcagtaagggttctcttttaggccttattgttggagaagaccaaaaataggtattgaactcttttactgtagcgctatgcaaacgtgaaatgagtcttgtattttgggtttcattgttggagatagcctaaccaccacgcgccggaagccaaacccagttctccccgttcccgcctacattttcgccacgtcagcgatccgcaccgaaatgcatcgcagccgtttacggaaacagcatcgaacgtcacacgttcgtccacgttatcgatccgtggggaaaccactccaccaatcagcgcccacctcaagttcgctataaagtcgtcgcccccgtccccattctcttccccacatcgcagtcttgcaaacacacgcagcaaaatccacaccgcttcccctccccgagaagaagagagcagcatccatggcgcccaaggcggagaagaagccggccgcgaagaagcccgcggaggaggagcccgcggcggagaaggccgagaaggccccggcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggtccaccccgacatcggcatctcctccaaggccatgtccatcatgaactccttcatcaacgacatcttcgagaagctcgccgccgaggccgccaagctcgcccgctacaacaagaagcccaccatcacctcccgggagatccagaccgccgtccgcctcgtcctccccggcgagcttgccaagcacgccgtctccgagggcaccaaggccgtcaccaagttcacttcctcttaggctgcacctggtgctattgtgctagtagtaatattagtttgatctatttatctactagctgtagtgcatcaatgatgggaaatggatgttggggatttagtgactgtaagaagaattaggtggggctgcttttgaggaacttctgtttcatggattcgaaatacactagtaatgcttttgtatcatgtgaatatgtgatctctcctatgttgtctttggttgccttgtgctgaacttgtgtttgttttaattaatttatgtctaattttggggaactaatctttgtgttgtagtaactatttgcattgtcttgcaaattcctcgtcatgttaccggaattgattctggagcatgcatgtttggagtttggaactgctgatgtgctcatgtagacgttattatggaagattgctattatttttgtttctgattaccttaattagctaatgtcactggccacaagacgaatttcactgggctccttttggggaactttttttttttctcatggatcaggaatactctttgatttccttgtgcttgaaggtgaactagtgatgcttatgtctagttttgtggaattaatcttcatgctattgctatttttcattgtctagcaaatcatcaaatccctctgcttgttactggaattttatttcttgagcatctattttggagtttggtactgctcgttggattatgttagttttagatttatggactggcactacttttgtactttggaccgtttgtggactgagcatttggagttcatgatgtttgcattcgaaacaaaacagaggttgttagaagagattagaactttgaaaattgtagtaaactttgttttagcttcgtctggtactaattcaaagaaatctaactcaagtggaaatagtactgaaactccacatatattgcctttgctatttcactatttcaggattatgcatgcctgcccgtttgctacatttctgtcctgaatgtcttatggaggttcctctgttgaagattagctaacaacaaatatgaggtatgcatcttttatcaaaccttgctttgggctgttctgttctgtgcaagatgtgctgactgaagagtgaagatgggactcttgtgggacttcttgtaatgcaatccttttattttctattcagggagattatttgaggtgatcaattatctttaaggttctacagggagagcatcctgaatttctgtttggcttgttcaaattaaatattccatgccaaacaactttagctttaactgattactgtggatatgtactagtatctttttctcatgaaaaagctttatagtggctagtacaaatccacagcgactgaaatgatggatctcatatttcttgggtgaacaatccttcattcctatttggttaattgtttgggctattgttcttctattctataattgtcatggatttggtatcctgtgctagaactgtttagatgcgatcttttttgctgctttgtttatgtcgaatctgaaaactggttgcctgggtatttgagtcagggagttaggaaattttgctgctatggttctgtaggtaactaggaattggtattgaattattattggtgctgcgtaacctttatttaacctctaaaatgcacgaccagtaactatagttggccataaggcccgaggcccgaaggcccggcccacggcacgcctttttggcccggcccaagcacggcacggcccgacttgggtcgggcccgtgctggcccggcccgaccgtcgggccgtgcctgggcctccccaccggcacgctgggctggcccggcacggtcgggccggcccggcacgatgggccggcaggccaggcccggtacataaagtatggggactaaaaatagacatataaatgtaactgtctaaagaatagggaccttaaatagacttattttagctatttatataccccagc

SEQ ID NO: 1802 - DNA, 3593 bp, Oryza sativa
tataccagtaaccatggaaccttgtatgcagctgattattccaggtacagtcatcgatactacacatatgcatattgcccaatatttatgaatgttgctctactgttcattgcccgactcaacatttagttaagagtgctctgttcattttcaaccatccaagacctgagatattcatctctgattgcatgaatctctgatgcagcatctggtaacagcattcggtctctgggttgttgctttgagcaggataagccgagcctaagaacggacaccaaacactgttgaataattcttctttttgtgcttgcatttgtcccatctgtatcatttgcttcttcatgcagccagattgttcgatcagctatgttcatggcgctctcaagaaaagaagctgcaacaaacttgtgcagatccattgaatccctgaaaatgtcatcagtgggacttcttccattaaacatctcaagcaacaatatacctaagctgtaagtatcacctgctctggttactgcagaaccttctccatactctacaatatttgcagttaaagttagtttttcaccgtactaccgacatgtaaaagatacaaagttccagtccaacccccacccatgagggaggaggtggagaaattgtaggatataatacaaaaatataatatttttgacctacctggtgcaatatatccaatggaacctcggattccaattgagctttttgaatattgaaagttctagttgtgcttttggggaggatttttgatatgccaaaatctccaacctttgcactcatgtcttctgcaagaagaatattacttggtttcaggtcacaatgaatgatcggtggctgacaactgttgtgaagataatccagtgcgtccaagatatcaaccacaatgctgagtctctgcagaaaggctcagtgtattgctgggagtgggattgcttgacgtgggatggagccaactatctaagcttccgttgggcatgtactcaaaaactaatgccttgaactcctgaccctgtgggtcaatacttgaacaacacagtgatgatctttgtcagacaccgatggcgaactcttctcaaagcctcacattcagcctgaaagctccttgaagatcctaattgtttaaggtcgaacacttttatggctacaggttcaccctcatcttgtaaagtgcatttataaacagaaccatatcttcctttgccaagcaagtttgcttctgaaaattcattgcttcctcttgataatgcataatatgaaatcctctgatattgttcctctataaccggagatatctcttggctattttgtcttccttttagtttcctgtgctgtaacataatcagaacaatagctgaagctaacaccagaattgctcctgttgttatgaaagctactttaagatatttcatccgttcttttctgtcctttcttacagcaggaattggacatggagccaagtgaagccgaggtattccaccacacaacttgtcgttccctgcaactgatgcatacgtaaggttcctgaaagcaccttcatctggtactttgccttgcaaattattgaaggacacatctaagtgccacagctgtgtcaaattttgtagggtttctgggattgatcctgacaaattgttgtgagctagacacagctgttgcagattgcccatgctaccaatggcattggggatgctaccagaaaacttgttcatggttaggttcagtatggcgatcccttttagttttgtcaaagattgaggtatgcttccttcaaacgagttgctatctagcagcaggtattccagcacctcacaatttcctatactgtcaggtatttgatcagatagctggtttcctgacagttctatactgtttaggttaaccaaggtaccaacttctgatggaatgggtcctgagagagtattatctgacaagattaagaaccaagaaagtgacggcagctcaaaaatttcttttgggaccgaaccgttcagatggtttatggacaaatctagagcaaatagcttctttagcttcccaagggttgcaggtattgggccttccaaatgggcatcgtatgcggctagtatattcaaattggtaagatttccaattactgacggtatgaggcctgacaatctagtgctgtacagagtaattatggccaagtctgctagcttccctatgctctcaggaatcactcctgacaaagaagtggaccctagatcgagcgtgtccaagccaatcaaattgccaatgtctgtggggatgctcccggagacgctattaccacgtaagaagaacttttgaagtgttgtcgacaggttaacaatagagattggcagctgcccaatgaaagaattttctgcgatatctagctgttgcagctgactgcagttggcaagtgaagttataaattcccagcccttcatgttatttgcctcaagtcggttgctagacaaggatagacgcacaagagatttcaaccttcccacggtaggaggcacaaatccactgaatttgttaccatcaaggtatacgtctgtgagtgatgatagattgaataaggaagaggggatgactccgctaaactggttcacagacagaacaaagtgttgcatgttaggtaatttgtcgccaatgttggcgggaatgcttcctttgagcttgttctcatatacttggagaacagtcagttttgacagattccatatggagggcgggaattcgccagagaggctgtttccgtcaagaccaatcttctgcagatttgggatgtttccgaggcttgacgggatcaggcctttcaggtggttgaagtccaactttaggaactcaagcgatgataggtttgctagcgaggctggaatcggccctgtgaagctgttgtttccaagatggagcttctggagccacgtcagtgtgttacccaacttcaccggaatgtggccactaagttggttatagcccagggtcaggtttatcaagctgatgcaggagctcagattatcagggaacgcaccggaaaacgaattgcttccaaggtcgaggatccgtagatgctggaggtggccgaggcttgggggaatctccccgtggagcccattggagctcaggttgaaccaccggaggaaggtgaggtttccgatggcaggagggagcgttccggcgagattactggacggcaggctcagccccaccaccctcgtcggcctatggcggctgcacttgacgccctcccagttgcagaagctggtgctgctgttccatgaggtgagcgtccttgagctgagccccgccttgaaagcgggcagcgtggcctcatcggtgctgccaccggcgatcgtcaggacggagatgagggacagtaatacaagaagcctcatgtggtttctttctttggttccgtctgtgagagagagaggagggagggtctttggagcataacatcagcttacaggctgagatattgctcctatcctatgatcctatttggacatctccagtgtttgcttgacttcattgaccgaatggtctactgttcaatgattacttggctgggactggttgacttgacctaa

SEQ ID NO: 1803 - DNA, 8166 bp, Oryza sativa
  unsure (1)..(8166): unsure at all n locations
gattagtcaggtcaggtgtgtagtttagacatggaaaaaccaccgaaaactgtgttggtagtagaagtgttgaattccgaagtgtatatactcccataatctaactcatgaaacatacagattcacaaaaaatctgtcttctttctctgttccaatcgcgatggcgaagtgatgaggtgcgatagttggcgaagtggaggtgtacggcaattcacagtcgcaaattctcctggtctatattccattaattccagcagataaatatttcactgccatggtgatatatctcgacgagacgacggcgtccagggtcaagcaacaatgacgggggaaacttcgatggtcgacaatggtgatatataggcaacattagagcaatataatagaacggttgttgctggcattggctcggatcggcagatggcggagtccttgggcttgaagcgtgatggaagcttgcggggccaaaataagtgaacctatatatttacaaacgaaaaataatttatgaataaaatttttatatacgttttcttaactatctaaaaacaaatactgaaaaataaactttgataagaaaacgttaaaatcagctctaaatttaaggctgaaaattcaaattctagctgataagtataaacttaagcgaaaagatgagactcttagaatatccttgtggcaggaacaagattgtgtgaagattggagggagcattatgaggttgttaaaacgttagatatgaaaaggctttcatatcgatgtgtagtaagagaggagtgagtgttcgctgggaatcggcgcgcaccaccgcagaccctgcccactgcactaggcgcgattctcacgtgtatactttacatgttttaaacaattttttcctacaaaatttatttgatctacaattcagttacaccatcatatttggtacaagtaaatcttatatataggctgttacaccatccataattcgattacaggatgtcacatgattatatattttttaaaaaaaatatatccgtacttaaaaaatatataccatatactccctccgtcccataatgtaaggaattttgagtatttgcttccactatttgaccacttgtcttattcaaaaaattttggaattattatttatttttttgtgacttactttattatccaaagtactttaagcacaacttttcattttttatatttgcataaattttttgaataagatgagtggtcaaacactagaagcaaaaacttaaaatcccttatattatgggacggagggagtatgaaatatcaagttaaaacgaatgaaacattataaaaatacttcctgaaacatccagagaagctttgttcggaagttggttactgccggctggcagcagcagcttgaacaatatttttgctgctgattcagttgttgcaggcttgtagtacagcgttgtggctgcacaggaattgttgccgaacacaggccactatatacaattttcacaaataaaactagtgaaacatcgtaaaatacttattgaaacatccaaataataccatcagaaatatttaaaaagattcattgcaacgtaaaacttaaatgtgcaacggaattgaattttggttgaaacattgtttccaatacgcaaaacatcaattttcactaattgaaacatatgtattttatatgaaatcttgatgtagagttttaattataacgaatagaacaatataatcgaatcacatatttgataaataatttagaagaaaaatcattttgaagattgctaggtaaacaattaatgcatattacatgaaatatgcatactcctttatggagagacagtgaatgagcactttccgtggagaggaaagaataaagaacaactcgcgtacaatgtttttccctttgcattcccccaattattttggttgttcaggagcggacactgtgtaggttataggaattcacccaaacttttttctcttgaaaagaaatactatatgtaaatactagaagatataatgatactgcataagtaaatactttgctgggcctaatacctcgttcttaggcctaatactctgctgggcctcctcccgactcaccggcccaataactgcccaggacgcttcctccctaatcgtcatctcctcccggtccccgtcccccgatccccaatcattcctcccctgacgccgcgccgcaactcgccgccactccccgtcgccgccgccgccgcttgtcgaagctggtttgggggattcggggatttgacggattagaggtgactgaactctcgctctcctgctgaaatcataccgtatttttgtgatgatttatggggaggaacctaggttttgatgagagaggcgaacactgatttgattcatccaacgcgttatattcacatcctaacatccagcctttgcgcctacgcatcaggaatcgcagtcgcagatggaggccatggacgacatggcggctctgacggaggacatcctcctccagatcttctcccgcgtgggcagcatcaaggacctcttcaagttcgccgtgacatgccggcggtggctgcgccgcttcaccgacccggccttcctccgcgggctgtgcctggacagcggcgagggccaccgcgcgcgcctcctcggcttcttcttccagcagacgagattctatcgctgcgaaaagatgatcaagatgcgggtgacgcagcagagctcggtctgtccgcccaccttcctgccggcgccgtggtcgccgctcggcctcacggatcgcaccctcacctccttcctcgccgccgacgacgacaccttcaactacgccgagcccctcgcagcgcgctgcggcattgtcctgatgcggcttgtcccccgcaccgcgctgatgatagcgtgcagccacctcctcggcgtctgcaacccgatcaccggggaatgccacgttctcccgcctctgaatctctccggcctccatcgctacttgaccagctacgccatcatcacgtccaccgacagcgacctagatgggaagcagccgccatcatcatcatcgtcagggcgctccacgttctcgcagctgtacctcgtcgtccaacacaagaaagactgtaacgagtacttctactcctactctgctgctacgtgcagctggagcgctccccccatgtgcgtggacggccgccgcttctccctggtgggtgagagatccgccgtcgttcacaagggcgcggcgcactggctgtttattgatcgtgtatctagcgcaacccaagatgacatactgtacaaactccccgcggcggtggacacctcagaaatctccttgacaaggctcccctttggtgctggaggctcaccgctcctctgcgtcagtggagacggcaaactttcggtcgcttgcgtgtttcccatccacatgagagtttggactcagcaagatgacacccctgcaacgtggctccgcactgtgatcaggataccattggcggtgccttacccagactattcccatatatgtcagccccgcgagaagtggtttaacttcaacaggggatcaatgctcgtgctgtacaggagcaacggcgtcttcatcctcgacctcgagaagaaggtgatggaaaaggtcatggactgcttactgcccctattcagtgataaactgaacaggacggctgtggcgtatgagatggacttggttgagttctttgtgctccagctcagtggtctatgtagagggtctacaggataattacagatgttatgcagtgggaaaatatatgttctagaataagcaagtttaagttaaacaacagcatattacatggatcatatgcaaactgtgcaaactggcgagtgatatatcttgttctgtaacacggcattgtcattgtggatatgggttgacctttactgggttccactgttacataccttctctggaaaaacaaattctcttgatcttacagttcacaactacgcaggtggcattttgcggcacagttcacaattttctttgtttgcctgttacgcttgctagcaccttaatttgtcaacttattgctagtgttaatacttatacatctgatggtgtaaatcaaaatagtttctttcatctgagaatccctgattgatctgtttgtaagctgtgttcttgttttgtatggtctgagtaccagctgctttaggtagagtaactgactgtcagttcctgagaatgccgtaatgctagttgtattccatagaactgtgattccttgcagtttacattgtctttattttatattcgatttcttattattattcggctagtaaatgcgagtttcctctggaatctgaatgtaccactttgagctcttaggagttgaagtgagttggagctagattgttagatcctgacgtttttttcttgttactgtgaagaacctgtttgtgctttctctaaaattggacttatatgcacgatatccttgattattttgtctactgtcaaaatctgatcacccatttatcagaaatcatgcattagtcacatttgtgataattgatcgtaggcaagaagtctatattgatgtttgacatccttgagtagtggttgctgatttgtcagctattgtctagacatggaaaagctactgctgaaaggccttcgagttctgaaggttatatactcctacatcttacatagaatttggatagaatgcgtctgttttgtttgtagttagtggcttagtgcacactgttgaatttgatagtatttgcaatacagtgttatatgctgctaaactaaggctgtgttcgtttgtgtgagatagggtgagaaaacacctcgttttccgcgcgcacgcttcctaaactactaaacgatgcgttttttgcaaaaattttctataggaaagttgctttaaaaaatcatataaatccatttttgaaatttaaaatagtttatactcaattaatcatgcgctaatggctcatctcgttttgcgtatcttcccaatcttctcaatctcctatctctcaaactcaccctaagtgaaaatggatttccttgtgaagattgtagaaacttcactaattgccaggattggtctaatttgttccaaggtttatggcattttttgtatttctttactcctttaaacgtttctggtggcgccgccaccaccaaatgacatttgggctccacataactagttgcagaaaaaaatgtgagagtttgcgtgctcagtgatgtcctgaagagtatgtgtaacacaaagatgcataacagaagactagttatgatcacgccgttgccaaaggttatcatcaagttccttgtatgttgtccactatgacttattttggtgtatccctactttttaatctctagatataaaactatggccaatatattgatagaacacagctgtaactaaatgttgcgtttctgactgcaggatacatatggaaattgagtttgttggtgatcacagttacaggtctggtaagatagttattgagtttaacgattgaacaaggtgtctggaaataccaccaggtgcttcaatctttgagcaagatttttctgcgctctccattgttttgtgttgtgtttgtttgcagtctgaaccatgaaagaggaaggagaaagaatgtgagaggaaatgttcttggatttttctctagcagagagatttatcttgtacgacaataaatgtttgctgaattcttagtgtcatctcaaaattcgatttgtctaaacaggaaaaactgacctattaatcaaaatatatagagtttaccctgtttttaattattattttcttcttatttacatgctgtttatggttacagactccatggcaaaaagcccaaaacctgaacccaaagaaagaacagcccaccaccacagcgctccaaaaacggggcccactgcacatttttctttgcaacgtcagcgatccgcacggaaacgcatcgcagccgtctaaccgaaaaggcaccggacgtcacacattcatccacgtcatcgatccgcgggacaagcctctccaccaatcagcgcccacttttacccactataaactcaccgcacccgtgtcctccttccacaccgcaatctcgcaacacatcagcacacaccgctccaaagcaaaacccacggacccgcttcccctccccgagaagaagagagaagcatccatggcgcccaaggcggagaagaagccggccgcgaagaagcccgcggaggaggagcccgcggcagagaaggccgagaaggcccccgcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggttcaccccgacatcggcatctcctccaaggccatgtccatcatgaactccttcatcaacgacatcttcgagaagctcgccggggagtccgccaagctcgcccgctacaacaagaagcccaccatcacctcccgggagattcagacctccgtccgcctcgtcctccccggcgagctcgccaagcacgccgtctccgagggcacgaaggccgtcaccaagtttacttccgcttaggctgcatgccttcctctagtttgttagtagtagtagtagcagtagattgatctgtttatgtggtagtttaagtggaaatgatgattgcaaatgaagaattgtgcggggcttcttttggggaactcactgatctggaatagtaatgctttttatgtcatgtgaacatatctctggttgccaattgattttttgttttgtagaattgattacatcgttgatgtttgcatcgtcttgaaaatactctgcttgtgactggaatatgattttcggaacatctgtctgtactccctctcccaaaatttgaactggaaatttagctaggactccatttttggtactgctcaagtacccattggctcaatgtattttgtaggtttgatggaagggaagcttgatggccattttggttcatgatgttgcatttggaacataaaaactgtgtactattttgagctgataactttgaaatctgaaagtaagttttgcttcagcttcatttggtactgtttcaaatcgaaatatagaagttgaaatagtaactgaaacgccatatgtcttcgcttactgtttcaggagaatgctgttctctttactccttcctgttctgaatgtccgaatgggtgctttttctttgttactgattcgcttgtatgctagtaactgggaaacatgaggtatgcatctcatctctactgccacatcttctatcatgcttgctgttgtggtgcctgcagccctgcagtacataccatgcctgaaaaatgtgaccaaactcttgtgggttctacttgtaaattgtaatgttatcctttctattctctgtccagcatggttgtttgaggtgtactcaggttctactggaagattctcttgtagcagcatttttggcacgctcatataaaagcttcggtagctactgtggaatgtgatagaaataatgggtctgatgtttttgggaactctccttcatttctatttggttaactgtttgagcatttaagcgtttatctttttcgatagcataaattgttatggatttgatattctgtgtttaatctgtataattgcaatatttgttgctgtgtcgtatatgttgaatctgagtcagggagttagaaattctgcaactatggatgtgtaggaattggcaatgaaatcttactcacattgtgtaagaagccaaaactctcgtacttctacatcgtgcaatcaacattattgcattctgtatgcatctcttacactgacatgcatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1804 - DNA, 701 bp, Oryza sativa
  unsure (1)..(701): unsure at all n locations
ttttgtaagacttcccttgtgcctacgttcttgtggggatacactacattctacatttcttttgcattctctggtgggtttattttaactataaacagtgacaattatgaaagtacaactctattgagtatcataaatatatatctagtgctttttggcggtaggtctaatcattctgcagtgaatttttgaaacttcttcaaataagagcttcatgttccccnnnnnnnnnnnnnnnnnnncttnnnnnnnnnnnnnnnnnnntttgaagccaggaatgttctatgctcttcctcaaagccctcagctgttcaagcaaatgttgatggtctctggctttgaaaaatattatcagattgcaaggttagtaggtacaacattttgaaggatgtttgtttcttggatataatttttcttccagttatcttacaactctgcatgagttgctctatattctctgttgcataatctcttttcccctgtaacctgtttagctgggttcttgatttttttcctgtttgcatgaatattctcaatataaattgctcactgtacactgctcagttcctggaatatattactccctcactcctaaaattagttaacctagtactacgaatctggacatgagcatgtccagattcgtagtactaggatgtgtcacatcccgcactagggtaacttatttcagaatggaggga

SEQ ID NO: 1805 - DNA, 1128 bp, Oryza sativa
tcctggagttggtatgtcagtccgggtcagattcattccaggctgaagcgcaagcacggcaaggaagtcgctggccattaaatgaaggttgaaatgggcgtccacggaaaaagcgggcgagcggagcaggaggcgcgtgctctgcttgtcagaagtcacttccggctgtagactagccctcattgtaaaaagcatgtttcctttcttaggcagctagaggcccatgtggtgacccctgatcagataaaaaggaggcccaggcctaagagagaagggggagaaaaaaaaggaggaggggggctagagctggaactctctctcgctctcgagctctctgtattcctttacacacagatccaccagaacacaggagtagggtattacgcttctcagcggcccgaacctgtctacgtcgcccgtgtgttgtgcgattcttctcgctgacgttcctcagattgagggcgaagaacctcacttagctcccccggccgaaccggcaaaggggggcctgcgcggtctcccggtgaggagcctcactctccgtcaattagcaagcgcgaataatatgagcaactgtaagttcgacctcaacaaatatattttgtttgtgcatatttgattgttgcttgaatattggtttttcttgcgtattctagactgtgtatcggttagtcgtgaggcaacgtatgcagcttccaggaggtgaaggttgatcaagattatattaagaataagaactactctgagcaggcaagtcatcactattccttgaacatgttgatcccaattgcgaaattgttttgtttacaaataaaattgcatgcaatgatgaacatcccacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaattgttttcgactggggtggacggaggatttg

SEQ ID NO: 1806 - DNA, 964 bp, Oryza sativa
gcctccccccgcccaagatttcgacgagagggggacggtggggtgcgagcccgacggcgcgggttctgctccccgtcgtcaccgctagcgttcggagagaggctgtgcgccactgcccgttcggccattgggctgagcgggagaagcttggcgcacacgaaagagacgagggcttcgaaagacacgcgcgccccctatctggcgcgccagatgacggagcgtggggctcctcaccgggagaccgcgcaggcccccctttgccggttcggccgggggcgctaagtgaggttcttcgccctcaatctgaggaacgtcagcgagaagaatcgcacaagacacgggcgacatagacaggtttgggccgctgagaagcgtaataccctactcctgtgttctggtggatctgtgtgtaaaggaatacagagagctcgagagcgagagagagttccagctctagcacccctcctccttttttttctctcccttctctcttaggcctgggcctcctttttatctgatcaggggtcaccacatgggcctctggctgcctaagaaaggaaacatgctttttacaatgagggctagtctacagccggaagtgacttctgacaagcagagcacgcgcctcctgctccgctcgcctgctttttccgtggacgcccatttcaaccttcatttaatggccagcgacttccttgccgcgcttgcgctgcagcctggaatgaatctgatcgggactgacataccaactccaggagtcagcacgccagctccggctagggacgagagccgggaagccctcatcattccgacgggacggggcgaggcgtgtgacaggccgcctgttgccacctaacccgcgatctgaccggtctgtgaccggtcacacaccgcgactggtcacggaccggataagcgtgcgctgcgccgcattaaatgcggcgtggcgcgctcgtccaacctg

SEQ ID NO: 1807 - DNA, 709 bp, Oryza sativa
gcatcaacagattcacattaatgaatcagcatatagaagataatggtttttgaggtattgattattggtatcttcaacctcatttaaagctgagtccctctgtcttgccagttctgccttgtcattttccagagtttgaatctgcttctccaattgagatatcttggcaacttgcactacattgactctggttaatcaagattacaaagataacaacagaagttagttgggcggagtttgtgcgtaccttttgatgagccactcagttcaaaattggattcctggagctcagcaatccgatccctcagatcatgttcattcttcctggcaagttcttttgtctcgtgcagttgattcctgctggctttgagggtcccgagatgaggactaacctctctaaggttgtcgttttagcttcattcctaagatgaatcctctgcaagacagtttaattagcgcttgaactaaatggcaaacgagatggttgagatcaggcgccaaagagcttacatttacaatgcgggttgcctgaccaagtgcctttttcagtaggcataactcttcgtcctctttttgcttatttattacgatcccttgaggttgcatgttgtcatcccaccacttgaccagaatgggagggcgcgaatcctcagctgctcgtatccggaggatctcttcttcatcaccaatcattggccctagtgtaccc

SEQ ID NO: 1808 - DNA, 460 bp, Oryza sativa
ttggctggatgacgtggccgacttggtcatgacggcgcagcagcgcctaggcgccggcgggcggacctccgccaccgaggcctctggcactgccgccgccggctccatgtcgtcgaggcggagggcgcggcgagcggcggccgttgcccgccgttcgtccgccattccctcgttaacgcctccgacccaagaagatgtgcgtggggggccggatgcccgcctcgatatcgagcgccggcgcgacgttcgtcgcgccgcccatgcaacggagggcgcttcctcgtccggagcgccacttcggtccgggcacgggggccggccccccgtgtccccggttggcggtgccggctatcgagcctttgtggcgagccttcggaacgtccgttggcccccaaggttccggcccaccatcaccgaaaaatacgacggaagcgtcaaccccgccaaatcttgcataacc

SEQ ID NO: 1809 - DNA, 18789 bp, Oryza sativa
agttctagatgtgacatatttttaatactggctatattcggctgtcattatttcactgtggtgcagccaacaaacacagtatattgtttctcggctgtgacagtgcggcggtacaaaacagccgacccactatgaatctggatatatctttatccagattcgttgtaagattagatagacatcgagccgatgcgctcgtgttccgtgattaatctgattatatatcgtattgagctatacacgctttcaatgcacactcaccgaagtcaacgaccttcgctgcttaaaggcaccgcaaatgcacataccatttccgtccattcatcacacacaaccagactccgatcgacctcgtctcgtcgagcgccaagtccggctccggcgacgcagcgccgccgccacacgtcgtggaggacttcttcggcgtcatccagctcctcagcgacggctccgtcgtgcgcgccgacgacgccgccctcctcgccatgcccgaactccaggacgtccccggcgttcagtggaaggacgccgtgtacgacgccacgcacggtctcagggtgcgcgtattcaagctggccgccgccgccgccggtgacgatggaggtaagctccccgtgctcgtctacttccacggcggtggctactgcatcggcgccctcgaccagtcccccttccacaccttctgcctccgcgccggcgacgagctccccgccgtcgtgctctccgtccagtaccgcctcgccccggaacaccgtctccccacggccatcgacgacggcgcagctttcttctcctggctgcgcggcgccggcagtgcggatccatggctcgcggagtcggccgaactcgcgcggacgttcatctccggcgtgtcggccggcgccaacctggcccaccacgtcgccgtccgcgtcgcctcggggcgccaacccgtggttgacgacgtcgacccggtggtgcgcgtcgccgggtacgtccttcttgacgcgttcttcggcggggtggagcgcacggcggcggaggccaacccaccggccgacgtgtccctgctgaccgtcgagatggccgaccagttctggcgcctggcgctgccggcgggggcgaccagggaccacccggtggcgaacccgttcggcccggagagccccagcctggaggcggtggcgctgccgccggcgctcgtcgtggcgtccggcggcgacgtgctctacgaccgcgtggtgggctacgcggcgaggttgaaggagatgggcaaggcggtggagctcgtcgagttcgagggagcgcagcatggcttctcggtgatacaaccatggagcccagaaaccagcgaggtcatccaagtcctgaagcgatttgttcacaaggcgatacgcccagctgagggttgaaaaggacaaggcaaaattgagtgggatactttcaatttcaacatttgtgttttgtttgggttataaaagtgtttgttaaatatccattatctaaaaataaaaaatataaaagtgtttgtttaagactacggtgtgcacggttgccttgttcacttctccaagttattttcttgtttgaatggggatggtttgaacatttcatccaatttcctttttattgtgcttatatagctgggtggacctcatatccaggaatactttttccggcagaaagtagccattgaatgcctctctgtgtgtaacagatgtcctgaatcctgatagcatttttgtgtatgactgtatggtactagtttcatcgtttgacctaataagttttaaaacaatttattaattagaaaaaaaattgtctttcatatatatgtgcatgtgaaaaatgataaaaagcctcaaaatctattctaaattcactttaaaattcaaattttgattgcggctaataaccaataacaaacaatgtggttttagtattgtttaggacatccattttacatgcgacaatattttagtaattcgctacaattttctttcttttttcgagacatctattttttcaaactgctaggtataaaatcacttaaatttgaagtttggattagttatggcaatgtatgcgataagattagctcaagcctgttggtgtagcacagttacaccccttcataatccattagctagattgaacttgcgaaacaataatatgtacaccttgatgcttggtccatttggaacgaaaggaacaaccgtgtattcaacaattgcatacggttatggcctaaggttgttggttttgttgcagccatggtgcaagaaaccaccctttggcggcatgcccatcccttgtcgctcacactccctcagggtagtatactcggtcgctaggtcgtcacattgttagcgagagaatagcctcaagtattttttttaaccaagggcacgcgtaggacactagcttgcttgtgtgggtaagcagagtccaacacccagttattcaagagacatgtagatcgatctagccttcaagcttgcctacctaggaagcaggcttcaggccaatgaaaacgtcagtcaggacagtcttggattgcagggaagccttaagaatcgccagaccctgcagagaatcaacaaatacatgcataccgcctaaaaccaactgatattaagttccaacaatcaagtagagtcatgtgtacggttacgaatgtaatcacctcagtgtagccgagctgcacggtcttctccttgagcgcgcccaagtccttgaccgcgaacctgttgagcagcgtgatgctggagatggacgacatgggcgccacggtgagatcgtccatcaccgtgtacgtcacgatgccctgcacgaaccctcctcctttcgccccttcggcggcggcgttctgcgtgttctgatcttggccgccggcaacataggtgcatgccgttgccatctggttgccgcagttaggacacttcgtgccgctcgcgttcgtcacgaagcttctgcaggcgttgctgctgtagctgcatctgaagaagctcttgcttgactgcgcagaagacggcgccggcaagcggaggacggaggtgttggagctggccgccggcgagagcacgacggggctgagcagcgagtccttggcggtgtcggcctggacgaaggcgtcgtcgagcttctcgaaactggcgtagaggttgccgacgcagccgaccatggagcccttcccgagcagcttgatgcccgaggcgatcggcagcgcgaggagggagaggaggaagtcgacgacgtccttgcgtgcctcggcgtacagcacgcgctgcgccttggtgtcgatcaggagtgtcatgctcatcagatcgctacttgccttttggctggttgtttcagaagccatttttgcagtagttgcagtgtgcagtggcctgcgtctgaactctgaagtcgaagtctcgttttgcctgctgcattctggaatttacagcgtaacagacgagagcatcgaggttcacggggaagaagagagtaatttatttgcaaattaaccgctcattgtgaactttaattcctaatcaatcaatgccgtttactccattgccatgcatcgatcgcactgcttgaggccttgatgctgatcggttcagctccatcatgcacaataccaatcggttcagctccgtaaaattgaacctgaaacacaatgcaggccggatacaccagtccgtccatcatccatgcgcctaaccggctgctatacaagcaagcaagcatattcacgcggacccaaaatataatgatttttagtgtttaaaaacatctctaaaaaatcatccatcatttaatttttatccaattttaccactaaggaaagtacagtaaaccaatatccttcttgtataataaggattgccatgttggatttggatttgagctacgatttgtgaattttcatagctaactattggctataatatcaaacttcttgtaaccatccttataaaatgagggtcattaaattatttttctttataattagttacataaaaaaacaaagattcttattttagcccctccattcaagtttagaaacgtgtttcccttttgcacaaagactaagaacgtagcaaagtggactgaatagcactcaattagttagtgtcttaattagtcatacggtgaatactggtagtacgacgtgcatggatagattctcaatgcaatgagctgttaggaaacgctaagcgaataaacgataaaaaataatagatcaatcgtagaagacacgagatttaacgtgaaaaatccttttaaaataggagagaaaaaaccacgggcgccagccagcaaaatatattcactatatctgaggtgagattacatcgccgcacggcggcttacaagaggtacatatattgtggaaccctgaaagggatcaagcctcccggcgacgggcctccgctccactacggtagaaactggcctttattaaatgcaaatgaatttgtatcaacatgagcaaatgaccgtggtgccaaagcgatcgcgtgaatgtgagatacgatcaactgcactggtagcgataaagagaagattgaacgcactgattctagtcgtccgttcagcgaaaagcccatctggtttaccagttggcacagcctaaattaaatcacaacccattgatagcaattacgggccaggcccatctctccatcaaaagctcaaggccatctgtgattttgttctataactcgtacagaagacatcacataatcaacaccaatgtatcttgcctaactaggtaataagtagcagggctaagtagtaggtctttataaagtgggtcccacgagaaaaaaaatattgctttttaattgctttttgtccaactcagcatgcagtagtagcacatcttgtgttggaaggagagagtgaaagagattttaatgtttttttattcttatgagtgggtcataagcttactacctagcattagttactacccactttcacaatgcttattactaggtcataggaatattatattgcctaatacctgctttttcctaacattgtggatgccctaagagtttcaaatcgactggtcacgcttgcggcttgccagcaagcaaaataaacaacaagagaaggaccaacacaaatggccatttcttccgcttcttgccaaggaaaacatctgtaagcaccgtcttcgactgcagcgacgccttcagcatagccaaaccctgcagtacagtgtaaaacaaaatggttaataaaacacaaatcaaaatgtaccaaaacttcatatgataacaacctcagtgtagccgatctgcacggtcttctcctggagcgacttgatgtgagtgacaccggatttgaccagcgcgatggtggacatgggcgcgaccttgaggtcatccatgacggcgtatgtcaccaacccctgcacaaaccccgtgcctgcgattgcagacggcgcactcgcggtcgccggcacctcgccgccggtggatccagcaatggtggtgctcgacaccatcacatgcttcaccggcaaactcatcttgccgctgcactgcggcaactgacaaggcaagccactcaccgtggagacgtagttgcagcaatcaccgaacctactcgcgctgccccggtaaagctccgtggaggccggcggcggcgccgccgcattgatctccggcaggtggagaaaattatgaaaaaaattaaaaagacaagtcgcgcataaagtattaattatgttttatcatctaacaacaataaaaatactaattataaaaaaatttcatataagacggacagtcaaacgttggcacggaaacctagggtttgctttttttttgggacggagagagtaaagtgctaatgctaacatttcgtcatagataggtgttgttctgagacaaattttttgaacgaacaacgaattttacaaccacacgaggagaacgtccatgtatgtgcacatttctactagtgacacgtgctaaatactgtttctagtatttaaaattagatgcgcagattaacactctcattattatttagtttgttttcattaggaatttactgtttccaataggaaaattaattcgtgagacttgcatatctcttaaacatgtgttgaagggggccaaaaaacttcaaatttttaagacgaatactactggtgcgttacaaaattcgcgtgaagtacgacgttggctactttgctgatctgatcaaattggcctcgattcctcaaaccagcataggaccagcggtgtgcagtccgcctcgcgccgaggaagacatcggtgagcactgtcatagaccgcaacgacgccttcagccacacttaagccaaaatctctaataccgattgcagggttagaacccttgctattgattgggccacgtggcatcacgcatagctcacgaccagattctcggctggagaacatgccacgcattcgaactgtcccatagccgtccgattacatacgaacggtgagaaaaggcctagcggacctaaatataaattgcaagttttaagaagggtttttaacaaaatgcacaatcttatctagaacagtccagagtatatgaaaaaagacccagaatcagaaaaaaaaaaatccagcaagaacaatatacagtattcccctttcctaatcaccatgccgtcgcgtagatggcaaatacggggacgatgagctcgagctcgattgacctggtgctccttggccccgccctgccttgatccgtgcgaggcgacgatgcgcctagacgatacgggggaagcgaaggatccgacgacggagttgtagacgacattggagggagcccgctgagatagagagcgccataggggatacctccgcgctggtcctggagcttgacggcccgcgcggggccttgatacgcgcctgctcaccagctagcgctgcctcatatagacgagtagggacggcggcggaggtccacgccgtcgctacatccgcggggatcagctcggctcaacgccaccctgcttgtcgccggcttcctttaccgcctctgcgatcaaccgctcgcatcgtctcctcgatatcctccttgccgcttctgccaccatggccggtcgcaccgccccctcgacccttccgccaccaccgcgacctcacctcatcgccgagccgctcgtcgccggagatcggaggcggagacaacggagttggtggtggcaggacggccggcagtcaacccgatggcggggcctccggctcactcttaacccgctgccgttcgaccacgccacctccgctgcctccgtgatgcatgcagagctggccagcttgaagccttgaacccagtgaccaaagaagccagttacctcttgcatttgcaagcggcctcacccatcagttctttctcagcgcaaatccatgctggaaagtggaaactgaaaagcacaagccacaacaatagtagcgcagtaggtgcagtacagtggagtacgagagaagaagagtgaactgggattgaaagcagaggtgggttctcaaaaaaaaagaaagcagaggtggacgacggggcatatgcatgcatggagcacgtcactgctcccaattcccaatggccacctgctaacttacacgtgccatcaactcctaacaaattttctttttcacccctaataatatttttttattctatacttcactaaatacaaaatattttaaaaaatgcccctaggttagtactcatgtatttatgtttaggaccttagaagttttgacttttcaagacttgtttgtctgtctgagtctgaatcgtctgatgtacaaagagtaacataaacatattatgactctatattgagttgatgataggagtcatttacttaaaaaaatatgcattctaaattttgtaattttcatgtaatttgataaattttgtaaatcctactaatttaaaagacatatcttccaaagtagtatttgttaaaggcatacagatacacttaaagaagttaattatccgttacaaatcttttttaaaaagttgaaatataattattcaccggacaagtactgctagctaaatacgacacataagaattagccaggcataaactaaccatatttactcttattgttgacaatattgttataattgtattctattttatctatgattagctaatcaacctgacaatctctatattgtgagataaatataggtggagggtatatcatatactgaccatataggtaagtaggtggcactaatagtaaacaaccttaagctttcagtcctctaaccatatctaatcataccaattataaatatatgttatttactctgtctaatggaagagaaaaaaggtttgaaagtaaataggcaagtattacaaataaaataaaataaagttttttaaattttttttccgtagtaatgctttaacaaagcttaaaatctttatatgaatagggttactacaggttaattgttcctcaaccttttcaaaagtcattaaatagtttcttctaaatgaacaagtgtatatatttttttctaaaaaaagtaaaatattgcatttgaaactcttaacagcaacaacaataactattataaatatgtaaatatgtactagctataagttggttttccaacgggcacgctgattttcttgaataggaaagcagggaattggaaaagactatagaaggaggatttggggaatgtttaagtttgttgccactttcaatcttaccgaattttggcattgccaaattttggtagtaaacacacttcaactattacgatgttacccaattttggcagttccagaagctctctcttaaaggcatcaaaatgtagtaaaggcatcaaaccaaacaaagcgaatgttaccaaaatttgataataccaaaatgtgttaaaattcgacattactaaaatttgatatggtcaatttttcaaacaaagtgtacaaaccatttatatctatttccgattctaatttttagggtgttcaatgaaaaatgttggactacttattatcgaaaccattcctaagccattatgcattattgggtaagttgaatgtaaaattttgtgattatgtagccttttttatatatatacaaatttagttatgatcaattcgtaattaccaggcttcataattaacagtgtactgggttcatgtaattgagctggcctatgtatactaaggcgtggcaaagccgcggttattttctagtgtatatcagaaattaatctctattgcaaatatctaaaattaagtcgatcacctgtaagtagccgacctcgacggtcttctcctacaattccctgatgtccatcacgccaagcgccacgagggcggcgatggcggagacggtggacgacggcgcgacggtgaggtcatccatcactgtgtacgtcaccttgccggggttaagccgaatagtactagttagagcaaataatagtatagtccactactagctccaatttatctatagtcaatctaatagctaattcatacaatagttgcttactatattattaatatattgtcccacctgtcatacacacattacattttggagttcgtgctgcagctggctacagatctatagcccgctgctcttctctctcatcgtttatctcattaaaatatgtttacagctggctaatagtctgctattgtacctgctcttaagcgggcctgacctatctctccctggataccccaaggcccatatgttcctattcaggccccctttgattcaaaggaaattcataggaattttaaaggattttattcctgtaggaatttttcctatatagccctttgaatcaaaggaatgaatactatggaatcctatgaaattcctatggaataccttttcccatgcaagttttggaggaaatttagcatgaggtagaacctcatattaagaatcctttgagtctttatctctccttaaattcctgtgtttttcttacggttcaatcaaacggtcattcctatgtttttcctgtgttttgtaatcctctgttttacacttatattcctgtgagaatcctatgtttttactattcctctgatttttcattcctgtgattcaaagggtcgattttgttccggaaccggtacagatgattgaagaacatacgatatcaatacgtgacaaactgacaatagaacggcaataattcatagagttcggaactctcactccccggcacataaaacaaagtagcgtttagtgcgtgattaattatggtttagctatttttttcatacatggagtataattttataagtaactttcgtatagaaactttttgtaaaaaaaaaagtaccgtttagcagtttgaaaaagtgcacatgaaaaacgaggaagaagagttgtgaacggctgggaacgaacgcatcctagatcgactgacaaaagcaccaccaacacataagatagctcaatggccggacaaggaacatgaacgttccaacaaaagcaaacgaggctcccgcgcaggcgatcacatcacatcaggccttcctcttcttgccaaggaagacatctgtgagcaccgtcttcgactgcagcgacgccttcagcatcgccaagccctgcaatagtgttgtacaaaattgacaaacagatcggaacagagagatgagagtacgcactgcaagcaatacacattgctcgtagagaatagtagcactttacctcagtgtagccaatctgcacggtcttctcctggagcgaggtgatgtcagtaacaccgaaggtggtgagcagcgtgatgccggagatggtggacatgggcgcgaccctgaggtcatccatgatcgtgtacgtcaccaccccctggacaaatcccgtgccggcaacagcatatgctggttgcgccgcctcgccgccgctgccgatccggtagctgtagtgcttgtggttgacaccccaagtttcattgccaccgtcatcttgccagggcatcgagcgatctgacaacgcaagccactcaccgtggaaacatagtcatagcactcgttgtagtcgcacgagctgcagcggtaaagtttcgtggccagcggcgccgccgtctccggcagctggaggagcttgccggtgtcgaagccaccggccggcgcgagcagcacgttcctggcgtcggcggagcggacgtaggtggcgtcgaggtcctcgacgctggcgtacagctcgccgatggagccgaccatggagtccttggagagaaccttgacgacggtgccgacggggagggtgaggagggagaagaggaagtcgacgacgtccttgccggcctccgcgtacagcacgcgctgcgccttgctgtccaccagcagcttcatgctcagcgccttcgagctggttgtctccgtcgccatcgtagcaactagcaagtgcttgtggctagcttggattggcttgctgtgtgagcagtagaatttatagcgagcagagacgagcaggaaggattacggacgagaggagagtaattagccgcccactgtaaattttcttgatcgatcaagcttttttgcatgcaaaaattgcagtcccaatatatgcgcgcatgtagacggtcaaattaataccgatcggttcagctccgccgcacgtagtatcagcacttgaatgaatcacccatttatgcgaggcaaccgaagcatcatgaatgcgactaccggtgcgtagaggaggttaatttgaaaagaaccaataatttgttttttttttgcgagatgtagaagttgaatttaaacttgcatgtttatgaagtgatatatcacatgttaatacgtcttcttttttttttcaaatttatttaagtgacatgcaaataacgagatgatatcctctcgagggataaaaatccactccccgaattatgaaatcacttttcctaataaaaactttaatgactatttaggtgtcacgcccggaatttctatccaaaattccaaacgcttacatgtgtgtgaacccttgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccaaggctacacctaatcctccacaccatcagcatcattgtagaactcttcctctaatgaatgattgcaaggtgagtatatgacatactcagcaagccacgcagcaaatatgtaagtgcacatgataacaaaggatggcatagtagggtttcatttgcaaaagcagcatttagcaaacatttgagaatttaataaaacagttaagtattaaacaatatttgtcggtgatatgggaccaggagtatcatgaccagaggcttgaggcagacgcaatcgcccacgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatgtatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcgcgccttgccccatcccgtcaagacgaaagcctctaggcaactcgtctcaagccggagctagcgtgttatctcttagagatggcacgttagccctggttagatttataccaggcttcatcctaaccattacaggcaaggtgttacacgaagaagggcaaacatgcatcttgttaaactgacacatggtggacaaaagtgaccagtctgacactggtcgcgtcagcaacgggcagccacgatcccacgttgtgcccgtctccgccgggagtggaggtaggtgtgggctgtcccatcgaagtgtcattcgaacagcaaccataccaatctccgtccataaagagaagaaaagtccagtttggaaggaggagggtgcatgtggtatccccttgaagtataaaaggaggaccttgcccatagagaagggggttggttgattcttttccagatttagagcttagaacgggggagaagttggctgacacttggtagctcattcatacaccaatccacaaaaacacaggagtagggtattacgcttcccagcggcccgaacctgtatacatcgccgtgtctcgtgtttcttcctggcacgcgatctttccacacacagcgagagcttgagatctcaccctaagcccccggccgaactggcaaaggggggcctgcgcggtctcccggtgaggagccacgagctccgtcatctggcgcgccaggtagggggctcagtgtgtgttttctgagctctcatactcttccgtgtgcgccaagtttcccttgttctgcctaatggccgagcaagcaaaggcgcacgacctctctccgagtgtgagcggcgacgacggggagccaaacccgcgccgtcgagctcgtactcccccacctcctccacgccaaagtcctaagcagggggaggcgctcgagagggttgataaatccgcagcatcaccggtcgtgggtgatgcaggagaacggcgagatggggagcgtcgcctcctcgtctacggcgacggcagcacgcctcagggcgcgcttcaggctgctagcgcgctcctacgtcacccacccgtcgtccatgaccctgagtctccagctcagcgatggctggacgacgtggccaacttggtcgtgacggcccagcagcgcctgggtgctggtggacggtccgccaccaccaagacttgcggcgccgccaccaccggatccgtgtcatcaagccggagggcgcggcgagcggcgccggctgcacgtcattcggctgccactccctcgtcgacaccttcgactcgggaggatcagcatgaggagccggatgcccgcctcaacatcgagcgccggcgtaatagccggcgtactccccgtgcaacggagggcgcctcctcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcacggggttggctaatgaacctgccacccgcgtcggtccactcctgggaggatctgtgccagcagttcaccatgaactttcaaggcacttatccacgcccaggtgaagaagcggacttgcacgcagtacagcggggggatgatgaatcccttcgctcgtacattcagcgtttctgccaagtccgcaatactataccttgtatccctgcacacgcggtgatctacgcgttcagggggggtgtgcggcacaaccgcatgctcgaaaagattgcctccaaagagcccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccactcgaaaggggaggcctgcgtgcgacaaaaagaaagaggctggtactcccagcagggagcgccccgccggcaggtggtgctccgtccacaacacctccctccacgatctcgcggactgtcgcgcagtcaaaaacttggctgagcgaacgaggaagtgggaggaggacagaggcaggaacgccgtgaggacaagtccgcggcagttccctccggtaaacggcgaagtgaggccagacagaaggcccccgccgttgaccccgatgacggtgatgatgacctaggtttccaagaacctggggccaccatcgccactgtcgacgggggagcgtgtgctcacgtttctcgccggagcttcaaggctatgaagcgagagcttctggccgcggcccctactcatgaggcgacgcgtcgggcgcggtggtcggaggtggccctcacctttgatcagaccgaccacccaccgtgcgttgcccggggagggcagattgcgatggtggtttcccccactatctgcaatgtgaagttggggcgtgtcctcatagatggaggagcggctctcaacatcctttcccccgcggcctttgatgctatcaaggccctggggatggtgctccgaccgtcccagccaattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaatagggagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccagaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaagattaagttgatctatacaaaagaggcatgaaggccttagaagaaagaaaaagaaaaaatcaaagattgacgggggctcgggggctcattccgacgcgcccgggtcgccggcctcgtcgccaccgtcgtcctcaccactggcatcgccctcctcgtcggagctaggggcgaacgcgagccgaggggccgagccctcgaaaccgttgacgatgtggtcggcggcatcccggacgcgcgcgcgcgcgtcgtcctcggtcccgggagggaactcctccagcgccatccatggagagaagttggggtcccgggcctggtagctcgccagcacgagttcgaccgctccctgcgcgaggtccctcgaggatgacttgatggtcttctcaagctcctcggggagttgttcgagaacccaggccatcctgttgaggtgcggagcgaggccttccagattggtggggggcaccgacgtctggcctctccagaggcccgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgccctcgcgtccagctccttttcccgcgcctcgaggtcagcagcccgctgttccagtgcggctctctcggcgcggacgcattcaagattgcggcgcgcctgctcctcctgcgccgcctcgcgaagggacaggctgtccgccagccgtttggtcgtggcctcagcctcctcgagagcccgctcccgctcagcgagtgcgtcctcgcggaggcggagcgcgcactcctcctcggcgcaggcggcctcgtgcgccgccagcgtcgcctcccggagagcagcggcggcctcgcggtccatcaagcccctcaccacggtgccggcgtgttcttccagcgccatggcacgggactcaagggcctcctcgcgccgccgagacgtcgcttcagtctccgttacccgccgctctcgggcagcggcggagtcaaggaccccttgggcggcgtcgagctttttcttcagctccgcctcccagattgcgtgttgaaggcggagggtgtcttgcgcctcgatcatcgcggtggtggcgataagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcaacgcgcgcccatgcggcctcgagctccgctcgttccgcacgcagggcctccacttgggcgttgaacccatccagcactgcggtgtttgcggcggccagggcctgcagaaggggctcggcgctcagcggggcgacagaagatgaggaaaagagccgccttggagaaaatgcgacgcggcttggccccccggaggatgcgctgggctcggggatgtcccccgggcccgtttggtcctgggcgtcgcccggtgaggtaggcccaggcgatgcgccagcggcctcgtcgcgagccgcctcggaggatgtcgcctgagggccgcccgagggagtgggcccaagtgacgcgccagcagcagctgtcgcctcagcctggcgagcccgggcggcctcctcccgggcagcttcttcggcttggcgagcccgggcggcctcccgggcggcctcttcagcttcccgaaggcgatctgcggcttcacgccggtcagcttctcgcctccgctcctctgcggccgccggatcttcggcctcggactggccggacttggggtggcgggaggaatgtgacggggcatcgctgaagcagaataaaaaaccagaagacaaacaagatgggtaagagaaaacttgcttaatgggatagaagaaagacggtcgcaataagaatggggcgaacctgcgagggggtcggttaaatgaccactttggaggggaaatcaggtttccccgggatggttccgtctcccccatcttgcggagccgcttcttcttgcgctccccctcgggctgcgacgtcggcgcggccccctccgggcgccgactgctggcacgcgccgccccgccccctcggggaggagatgtgggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgtagagggggaggatctcctgaggaatgcgagacgcctccgcggagctaagattcagcaccctttgaaccacgatcttgaagtcctcgggagcccaatcccat

SEQ ID NO: 1810 - DNA, 1254 bp, Oryza sativa
ttcctgcacccctgccgactgcacggtgaagaaccaccggaacagctgcagagaggggcgcaccccaatgaacatctcggacacgtgcgcgaacatggccaatgtcatcaccgcattgggggtgaggtgcgccatctggagatcgttgaactccatgacatctcatgaagaaatgagaaaatggcgggaccagcccagccattgcgaaggggaggaagaagatggaccgccccgggtagtctggtgccgggcgcccctcgcccagcatcactatctcccgaccggtggcggactcaggcatgaagcggcgcggcagtccggcgtgcctctcgttcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggagcaatggcgaaaggaaggaagcaaatccttttctcgatgcttttatacccttgccatcgctgggcctggctcctcgtttctcgcgcccactacctcgctccttcgtatctcgctatctcgctccctcgtttcccgtccccacgcttccactaatcccattcgcccgcttacggcgcatgaagtggatatgcggttgaggcgatcgaaacggattgtatcgtgcgcgcgttaattacgctcgccgaccgaagcggcgttgccgtatctccgggcgagacgaatctgctcgcccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggtgtcggtgatatgggaccaggagtatcatgaccagaggcttgaggcagacgcaatcgcccacgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatgtatgggataagtgagcacagctgtgctcacctaacagcatttattacagtctggtcaagcgtgtcacgctgcatgtaacgcagtacagcacgctcttttatccggtctgtga

SEQ ID NO: 1811 - DNA, 10213 bp, Oryza sativa
ggcagccacgatcccacgttgtgcccgtcttcccccggaagtgaaggtaggtgggggctgtcccatcgaagtgtcattcgaacagcaacaataccaatctccgtccataaagagaagaaaagtccagtttggaaggaggagggtgcatgtggtatccccttgaagtataaaaggaggaccttgcccatagagaagggggttggttgattcttttccagatttagagcttagaacgggggagaagttggctgacacttggtagctcattcatacaccaatccacaaaaacacaggagtagggtattacgcttcccagcggcccgaacctgtatacatcgccgtgtctcgtgtttcttcctggcacgcgatctttccacacacagcgagagcttgagatctcaccctaagcccccggccgaactggcaaaggggggcctgcgcggtctcccggtgaggagccacgagctccgtcaatattaatccaacgctatataacataccctgttgtataggctcaaccattctgaacaaccatcccggctgcacagttctatctccaaaccaggaatataccattccaaaccagaagctaatcaaattattaccagttagagcaccttttattatgatgagaagggtgagactaatcacgaaagacattgttagacccgcccataaccgcgggcacggctattcgaatagttttactctgatcagaggtgtaccactatacccacaagacacaaccccacatcatgtcaccatgtgcctcaataccaccacagtacctcggaaaggagttgtgacaataccccttgcacaacacaatccattacggcacacctttcctggatcataatcacccccttataaacaagacatggactccccagcgacccccgtgggcttatctccgccacttctcagtctggtgctccgcaatgaaccatgctatacaaaagataaagccgttgcccacgctggcttgtggttggcatggttaatgtttcacaaccgaaactcgtgaaccggtccttaattgtcatgagcacgactctcaaaaccatgtgctcacaacccaccattatcaagttttagttggtaagtaattaattaacctaatcacgattgaccatcgtgaactatcattatgccatcattaaataatagtgagtcataagttatcccaaaagtgtgctaatgtttctaagcatggctaagcaactataaataacatctagctgaaccaatccaatatataaggtccatgctagtcaaattataacccataggaaaataaagtcatcttcggccataattaaatgggaaaggctcaccacccaatgacattcgaaaacaatgcataagttgaaataaatcaatagctttaaacagattcaacatgctcaaagggttgtgtttaggatctgtgtgacttgccttgctggccttggaactcttcaaactcttctcctgcgaaaacggactctccggaaacgacggaatctaaacagaaagaagcaaaatcaccaaaacagcacataaacaagcatgaacagtacatgtggatatttttatcatgtagatctcaattttagaaaaatttagagacttgaaccaactaaatccgagctaagatgaattagttatgaatttttgaagatttaatcggattaaaacacttatattgattttaattgaattatgacgcaataatgaattatttttgaaaaggaaaaatagatttattgcgtcagcggctagggtttgcggttgaccgggcgcacggcggcggttcacgcgaacggacggccgagatcgatccatccaaaacggacggccgagatcgatcggtccacgaccggctcacgggagacggggacgatgacgtcggcaatgacgtcaccaccggcggcggcggctcggcggctcgacagctcggacggcgcaagctcaccggcgaacggcggcgctagggcacaaacggagggcaccaacgggtagcggacggcacggcgaactcaccggcgaccaaagcgacggcggaagaggaacggacggcaccggcggcgaggttgaagcggcggcggtcttcgggtcgacggcggcaacgtgaaggaaggtttagggttcggaggagagagacgaaaccgattcgatctcgaatccaacgatttccaaaccgatttagccgatgtttccaaaggagaaaaggcggaggagatcccgaggatcatttcccctctatcaattcggccggagaaggaaagaagcggccggatttggaaggaaacgacggcggcgcggcgctagggtttcggacggctgcggcgcgacgaagacgacgacctgacaggcgggacccacctgtcagcgacagcgagggcgcggctgcggactgggccggactgggccgaggagagagagaacggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaaaaaattagatcttctcttctaggcttttaaaaataaattctaataattccaattaaacaacaatttatatattaatgattttcagggtgtgacattagataacatacacgacatgaggggatatcccctcgaaatagtatgtgcatgtcacaaattttaacacatttgttaatccatgcaccaaaattcctactttaaacagaaacttcatgctgaaatccctcccactatggctccatcctaatttaatgatccacaccaagaacaaggacaacaaaacaatgctccgttgattcagtccaacaaaaaataattcactgttgcatggcttgaaaccaataaaaaataattttgattagtactttgttagatgatgattatactaggaaaaggggtaaactacattttttttaagacgaatacaggtgctccacaaaattagcgtgaccatatggccaaaatgacttcatgccttcatggacaacaaggtactacaacgttggctacttgtttgctctgtaatctgatcatcttggcctcaaaccagcataggatgacgtcggtgagcagtccgcctcgcaccgaggaagacatcagtgagcactgtctttgactgcaacgaagccttcagcacagccaaaccctatacgtataaaaacacattcaatattgttaatcgaaagctcaaggtttaaaacaaattaagccaaactgtacatgagaaaataatttcaagtgtggatatctaatcaagtcacctcgtcgtagccgacctcgacggtcttctcctgcagtcccctgatgtccgtcacgccaagcgccacgagggcggcgacggcggagacggtggacgacggcgcgacggtgaggtcatccatcaccgtgtacgtcaccttgcccggcgcgtaaccagccttgctagagcttgcctcgccagacggcgccgccggcgacgtcacgaccttggcgccggcgccggagacatcgtccggctcaacaagactcacctcggtcgccatcttcctcttgcacaccggacacggcgtgccgttcaccttggtcacgaagttgtagcagcttctcgagcaggcgcagccgctgcaccggtaaagggcgccgccgccgttgtcggcgtccgccggcgagcccaaccggagggcggccgtgggcgcgagcagcgcggccttgacgtcgccgcggcaggcgtagtcggcgccgagcttgtcaacgacgctgccgtagaggttgccgacggagccgaccatgtcgccggcagtgagcagcttggtgaccccggcgagcgggacagcgaggagggagaggaggaagtcgacgacgtccttgctgccctccgcgtacagcacgcgctgcgccttggtgtcgacgagcagcttcatggttagagtggcagctttagatgtttttccggccatctcacggtcacacactcttgcgtacgagagatcagaagcaccaaactagaatggagaaggtttggattgcagcgagatttgaagcaacctcgaaatttaaatggtctttttttatagtggagctgtacgatgcaggcacatcaatgcgaatgacaccgtgcacgtcgcttcgtttcccggccgtgacatggaccggcgcacgaagtcacgaaccgccggaagagggggagagagagagaaacgagaggagactagaaagcagacgatgggacgagaaaagtcgatgatgcatgggtcctacctccatccatatcccttctttctataatataaagttaaggccaaaaactcaaaccacatgcttctacatcatcatcaaatagtgaaccgttggataaatgcattagatcgcttctcagatgttggatagaatgtagcatagagctcaacccattagtcaccgggtgagtctcttcgcctcttcagtgccaaatgtaacccacatgaacacattggcccatctccacacacatctatatgtatctagcccgtcaatctgtataaaagagctttatgactgaatgccccttcagttgacatgtgctacctaaattatctacaaattttggatagagctgctaaaaagaatttattcaagaaagctatttgtttcttctgtttctttttgagattgtacctcatatctaacaatttgatgttaaccaagtctcgcagcaacacgcggggcatcctctagttggtactatggctgtgttcgggaggaggggtctcctccccggcacgcaaaatgaaacccctcctccatctcatattactcgctttaagtttctgtttgtaacgaaaatgtttgatcattcgttattcactctattatttattttgtttgtgacttactttattattaaaagtgctttaattgaattatctatttttatatttatactaatttttcaaataaaacaaatgattaaacgtcgaagaaaaagtcaaagcgatttttattatcgaagaagatagtacgtcaatagaaatatttttttcaaaccatcaaaagcgtttatttgcattggtttttaaggtgcgggagatgttattggctttgaagatgccggagatgttatttccggttgtgtggtttagaaagacaattcaatgaggaagagtcaaaatagactttttccctccgataacgtgggcattcgtggtgggccgttatgtaaatgggccgagaggagtggtccgatttactacaggctataaaggaagcaaacctactgctcgtgctcatcgtcctcgccgtcgattccctcctcctcctcgccgtcgtcgcaggccggcggctgcggcgggcaggcctgcggcgggcatcaagggcaatccattgtgtgagcgagttcctcaccgtcctccgtgctgtacattctcctctcaccttacagattgctctctatttttgttttccttacgcgcgatgaatctgccctacctgattatttcgtctagtttagggatcctcgtggtggttgtttctccaccttattttcggttggtttttctcctaatatatatatttttatcgtcagccttgcaagcgcttggaggttttggggacggagggttttgagtatgtgggttttgggggagggaggttgtatgagtaaatacagatttttttttcacattttccatattggagactattggagtatggtgcgtgattgtccacaatttattcacacaactatggatgcctcattgattttcataactttttgagtatcgcgtgtgatttgtttctcgaagacgatatggcgtgtgattttccacagtttattcaaacaactacggatgtcccgtattgatagcagaccggagatctagcaatgcaaacgaaatgattatttgtagttgaatattctagtataatggagtttcctagcatgatccaactgtgaattctagcccaaaatataaaggactacccaatttgaatggaagaaataaaaagtaatataagcctgatctttggtatttttagtttgtgtctaacactatgttccactaatctttgtatgtccttacctgcttatgcaacgctgcaagcctgcaacctatgagtttgcctgtaagaacatttataagattgtggtttatccgtttttcctgcttttccaaatgacatgttcagaaaagcagactactgcactgaattcatttttctttcgcgaacgtgtaaaaggattgcatggcatcccatttagacgaaagcaagttgaacccatttttccatatcactatttggaaaatattaacaaactgctctattattaatacttatatgaaatttggaaattatgttatatatgcatgaattgttaccttactccgcaggagaatttgtatgtaggaggtcattttttccccttactttagagcagctatcaaccaatataatctagatgtttcaaactttcaatggaatacaatctggaacatgtttttgctttatctgctttaaattataacgctttctctgaacatttggacgataactgtagttaattgaaaacccatttaattttcttttgctggtgattgcagaagcaatcaatcaactcccaagaaatttaaagaacttcgaataaaaaggatcatggctgccgctaattgtcgatcaagctcgtgattgataccaaagctcacaaagtctgctttgccgaagctggcagtgacttcgtcgagttcctctccagcctcctttgtctccctgtaagcaatatcatcaacctgcttaccaaggaacatatggttggaagcattgcaaatgtgtttgacagcgtggagaagctggacgccgatcatgtaatctcaaacgaaagcaaggagccttaccttaagccaatggttgcccctggagcgctctgtcctttgcagcagctgatagatgcacagctagacaccgataccagcttcttcacatgtgaagggaaattgaaccattaccacggcattcgtgttgcttgtggatattttacggttatgaaaggcagcatttgccctaagtgcggctacgcaatggagaaggcaatggcacatgtcaaagccactgggtttgtggttgggacagccaggtacactgtcaaggatgatctctcaattgttccagcatccagcgtgtcaaccatcagcttgcttgcacaatgcggtgtcaaggacttgagcacgctgcaggaaaggaccgtgaagattggcaaggaagaggtttgtacatatctatcagaatcactttgagtgaagagaacagtcgtagtcgtttttcttaattggtgtggttgatgattttctgtgttacaatgtaggcactggagatactccttgcatccctgaggactaagaccgtgctgactgatgtatttctcctgaagaaaaaagttagttgcaagagggaggctgctacttagttagtatgatacatgtatgatacatgagcagttttaccaggcatcgcatctgagaaattggaaagttccgtacaagttacagaccttcattgtgagcatggagtaggtttccatttgtcttaaagggaaagcatcactttgtattgctcatttttagattagtcttaaatacacttggaatagtttttttttaatagaaatgttacaacccagccagtgaaatcttactgtcaatttgcgtctcgctataaatatgtttctgcttgccttctagaggtaaatgtaacaggtatgacttcattttttttaaaggattgattgcattcgagggtagaagcaccaccaaggatgaaggttgagatgcagcgagattttcacaatgacggatttaaaaagaaataacaggaggtctgaacaaagtaaacacttcctatctagatagaacaaaaaattttagtaagacctcgtagggcctctcatgattctcatgccgatagtggaggcttagccctctcatggttctcacgccaatagtagaggcttagcccccgtcgtcatcatgagttaatatttccgtctcaaaatataacaactttcggtgtatgaaatttattttaaaatataacaatatctatcgcatacatttttgtcccgatcaataacaatctttcctctcgacgaaagcgatcacaatcttttttcatttaattcaatcaacttttttaataaccttattcaacttccgactgacatcgtgcacgtcggttcgcttcgtttaccgaccgtggctgcgttggggagtgagggttaccaacgctactctctagcacgcaaaacggagcaatgtttagcgcatgattaattaagtattagctaattttttttcttaaaaatagattaatatgatctttttaagcaattttcgtatagaaactttttgtaaaaaacgaaccgtttagtagtttgaaaagcgtgcgcgaggaaatcgtgtagcagaggatgggaacagccacggccgaacacagcctgtcaacgtgcagctcctccgataacatgggccggtatctgtaaatgggccgaaaggggggtcccgctttacaggtcgtggtctgctcgtcgtcttcgactcttcatcgccactcgcctccctcctcctctcaggccggcggctgcggcagcggcggcggcggcggaggcgatccatcgtgagcgactccctttccacaattccacccatcgtgctatacattcaactcttaacttgcagattgctctctctcgtctgtagtttattttatttctggttctcctcacgcgcgatgaatccgccccacctgatttcgtcccatttcgtcttgttaagggatcatcgtcgttgttgatttctctcctttttttttctcccggttcatttctccttgaatttttgacatgatcgccatgaaccacaggttgtgagcgtttggggttttttgggagtgagggtttgggtacgggggttttggggagagaggttgtaaggatgataattataaagaagaaaccgacttgcgttttctatattggagagtattggattatgttggagcatggtgtgtgattttccacagtttattcaaatacggatgccccatcggtagcagaccagacatctagtgagtcaaacgaaatggcccttgtttagttccaaactttttcttcaaacttctaacttttccatcacatcaaaactttcctacactcacaaacttccaacttttccgtcacatcgttctaatttcaaacaaacttccaattttagtatggagtaaacacacccgtaaaatctttttctatatggttcagaataaatatatatacccatcaacctatgttttcaatacttttagggaccacggatccattgtgagtcaattctatcctaaaatagcccggaattctatcctaaaatacaaaggagtgattgatttaattaggaatagtaaatttaattgcagaaaaaaaaagtaagattaggctgctgttgaaggcttacacttcacaagttgacataacatgcatatacttgcatgtctgtagcgcttaactgcttgtacaaaactacaacctatgattttgtctggaagaacatttataagattgtgttttctaggttttgtttttttcccatgccttgccaaatgagatattcagaaaaccagattacttggtctgaatccatttttccatattaccatttggagaagattaacatactgctgtgctattacttatttggaaattgtgttatatgcatagattgtttaacttagtctacaggagaagttgtattttttgtatatacataggagatcacttttgctactttgagcagctgtcaaccaatctagatgtttctttcgatcatatatctggaacatgcttttgctttgccttccttaaatttccctggacaattcaattgcctgtataattttccactatgtgccattgtgctactcataactgaacatttggacctataatcaattaaaagcctgtgtaattttctttcactggtgattgtagaggcaatcaatcaactaccaataaatttaaagaattttggtaaaggggaaaaatcatggctatgaagacattatcgatcaaactcttgattg

SEQ ID NO: 1812 - DNA, 9057 bp, Oryza sativa
cagctccagttacaatgccactcgttttgcttgtggatatttttcggttgtgaaaggcagcatatgccctctttggtacactccaatgcacaaggcaataccacatgtcaacacctcaagggttatggctgggacaggcacatacactatcaaggatgatctctcaatgactccagcgtccagtgtctcaagcatcagccttcttgcacagtgtggtgtcaaggacttgaccacgctgcaggaaaggaccatgaagattggcaaggaagaggtatactatactactttgtacatatctgtcactttgagtgaagaaaaaaaaatcttagtcgttttttttattaattggcatggttgatgatttttgtgttcaaatttaggcgctggagatactccttgcttccctgaagtctaagaccgtgctgactgatgtttttctcccaaagaagaaagaaagttgcaagagggaggtatctgcttagttatgatgcattgatgcatgagcagttttaccaggcatcacaagtgaaaattacaacagcttgttattaagccgacagtagatttcagtaggtctttattgtgaagtgtcactttgcatttcttattgtatccatttagcaaaagtagtatttccttcgttttcgttaatgaaagcgggagaggtgcggcctctttttatcaaaaaaaaaaaagaagcaaaagtagtcttgcaaatagttggcttactagtttggtagtgatatgcaattatgcagtatccacccaatgaaatctttctactatcaatttgggtgtctcactagaaatatgtttttgtgttctttttgtgtcattatctaaaaaaatgtacctgtgtgccttctacatgcaaaagagacgggtgtgatttcggttcttgtagaattggttcagaagtgatccaatgctatctgtgtatatgaattccaaattcagatattttactgttagccgtcatagtccagatccattgccaattaacaagtgggagtgtaaaatagtcatctttgtttggatgagttctgggttccaagttctttgttcaggccttccggggctcactgtgagagcctttatctttatcccgcgatatggtttctgatctttccgtgtatttagtcttgaccatttgtatttactcattgaaaggattgacaaatgagtactcgggttataaatatttcatgtttagtataagatttggacaaggttttaaaaactttaaacatcaatattttctcaaatgcttagtttaaagaaatgtatgggtatatttgcctttaaaagtaatattatacatagatttttcgtatagtagtaacttttatcccaaacaatgaccggaggaagtatgtatttataattgggtatctaagtaatattcaggagagtggattcataattagtttatcatatattaatctatcttattaatttcttgataaccatttaagtgatatgtaaataatgatagcatcccctcggtctctcgagagtttagaatagtttgccaatattcagtacaagatcttttactctagtcaagtagtactttatatgtgattatttttttaattttttcaagtatgatggacaatcaaacattggacacgaaattccacaactgcacttatattgggacagaggtagtaactatcaaagactcaagggtccaatatgtcacgatcaatcataaagacaaccttcttttttttaatgattagtattatttattgctattagatgataaaacatgaacaatattttacgcgtgacttctattttaatttttttcaaaaaaatttaaaaagacatacgattaaagttgaacatggaaacttatagttacacttaaaataagacgaaggtgtagttccattcgcaagatgattacgtcatcatttccaagctgataaagtcacgtctcacgggaaaaggattgatgtacaaaataatattcagaataaattcgattgaaatgtttaaaccattatggtccaaacaagaaaataactatgaacaagccagctgtgtactctttgtatgggggcatttaactatttgccacttttagatttaacatttaactatttgtcacccatatgtcaataactcattagtgcatgattaattaagtattagctaaatttatttttgaaaaatgaattaatatgactttttttaaagcaactttcgtataaaaattttataaagacgcatcgttagcagtttaaaaaacgtgcgcacgaaaaaaagagaaatgtgagttggaaaactcagctgctgaacacagcctaagagtcacggcaggctgtgaataaagagcagcaaagaagagaaggaaagctgacggacgctggagggcgaacggatgggtagcgacaacaacgaaagagtatggacaaggacagcatgcaaacgaggagaagttggtagtgggctagtggctaatgggactttctaaacattacaataatagatggctatttttttctataaaatccttaaattttagcatagtaggataaggagtctcttggaaatacttagtcaagtagaaaatttactacttccttcttcctaaattataagcatttttagttatgaatctggacaacataatcaaaagttgttatatttttgggacagaggtaataccgtttagttgctttgtttatttatttcactcactcagaaataacatatcactgatttataaactctctctatccaagaaacatgtctatatgtatgcaatacgatatgttggtgatataaacatagccaacaaatctacggttccacaaattttaaagatgcaatgaaaaaatatagataaaatcatatcataacgtaattttattttgatgctaaccgcacaattacgcgggccctgaaacagcacacgaagtcaggaaacgtcaacgtgcagcacctccggcaactccgattacggcggcatcggggcgggccggtatttgtaaatggccaaaggaagcaaaccattaggctactactactactacccgtgctcatccatcatcgtcctcgactcctcgccgtcgcctccctcctctttgccgtcgcaggacggcggcagcggcagcggcgggcatcaacggcgatccattgtgtgagcgagttcctctccgtcccccggtgctatacattctcctctcaccttgcagattgctctctctctctcgttgatttggttttcctcatcgtcgttgatttctctcccttacttttggttggttctattgatatcggaccgtagatctagtgaggcaaacggaatggtatttttcagtttgaatattctagtataatggagactgctagcatgatcttgctgtcgaaatgaatctagcactcttgctgaaatatttttctatggttcaggataaaaacatttacccgtcttttcaaggttttcctagatcgattttttttaggaacattcgatttgacttacagaaaaaacgtaactgataaacctgatcctgaacattagtgcagtacatagtactagtttacacttgatatgttatgctaatatttgtctcaagtgcttcactgcttctgcaaccaatgagtttgcctgtaagaacatttataaggtcgtgtttatttattttttttttgttggcattgccaaatgagatagtaaggaaagcagattacttgcactgaatctattttcccgtgtcactatgtggaaaatatgaacatactgctctgccatttcttatttggaaatgtgtcatctgcacggattgttaccttacccggttaccccacaagtccacaggagaagttgtatcctgtatactaggatgccatttttgcttacttttgagcagctgccaaccaatctagacgcttcattggattacaatctggaacgtgtttttgctttgtctgctactctgctctaaatttctctggaaaattgttgcatagctttccactatgtgtcagtgtgctgcgcgttctgatcatttggactctaacgctagttaactgaaaacccatataattttcttttgttgttgattgtagaagcaaccaatcaactcccaagaaatctatagaattttgatagaagggggaaaatcatggcagccatcagattatcgatgaagctcttgattgataccaaggctcaaaaagtctgctttgccgaggctggtagtgatgtcattgagtttatctcctgcctcctttgcctcccaatgagcaccatcatcaacatgcttaccaaggagcgtatggttggtagcatgggcaatgtgcttgacagcgtggagaagctggattccaagtatgtaatctcaagccaaagcaaggaacgcttcctcagcccgacggttgcccccaccgtgctctgtccattgcagcagctgctgctggatgcaaagttaaatgtcaatgccagcttcttcacatgtgaagggaaatcgaccgtcgtaagctacagtaccactaaagttccttgtggatatttttctgttagcaaaggcgctgtatgccctgtctgctccactcaaatgcacagggcaattccacatgtcaaaaccgttggatttgtggttgggacagccacatacactgtcagggatgatctctcaatgactccagcgtccagtgtgtcaagcgtcagcttacttgcacagtgtggtgtcaaggacttgagcgcgctgcaggaacggaccgtgaagattggcaaggaagaggtctgtactgtactactgtgtacatatctctcactttgagtaaagagaaaaaaaaatcagtcgtttttgtttttttttaattggcactgttgatgatttttgtgttcaaatgtaggtactggagatactccttgcttccctgaagtctaagactgtgctgactgatgtgtttctcccgaagagaaaagttagctgcaagagggaagcctctggtttgttataatgcagttttaccaggaacgacacctgaaaattaccacagcttgctataattctgaaagtagaattcagtaggtctttagtgtaaagcgtcactttgcattgctttttttatcaatttagtaaaagtagcctagaaaacagttggcctactagtttgaaaatgtctctatatatgacttccaaattcatatttgttattgttagctgtcgtggttcagatcgattgacaaatgccaattaacaactgggagcgtaggtccgttcttttctccaataagagttagatcaagattaagatttccgtgcacgcttttcaaactactttacgtttcgtgctaaaactctctatataaaagttgctctaaaatatcatattaatctattttttaaatttgtaatgattaaaactcaatcaattatacgttaataccatctcgttttacatagtcatgtttgtttggataaattctgggttacaaattctttgttctggccttccggggtttctgttcattccgtgtctgtactcatgaccatttatattcgcctagtagaagaattgacaagattcgtaaatattttgacgtttagcgtaagatttagttaaacctttaaaacttgagataatctaaaaaatgccattgacaaacattcaaatccaataaatatcattgataagtgtgagttttaagaaatgtcaacgtacaaatgacttttcttaaaaatattatcgccgttagggttccgtccattctgcattgcttagtgctataggatgaacggaaccctaacaacgattacatttttgggacaaaatcgtttgtacgatgatattttttggatttgacgcttgtcaatggtattcttggattatctcttaaactttgaccataaatagttttcgtatgtgtagatttgccttcaaaagtaatatcatattatgacaaacttgtgcatttaaaaagaaaaaaaaagattgtatgagtagattttcctctagaagtaatattataaacttttagattttataatacaaaatggatggtgaaagtttgaaatgtttaaccaactcttatcctagacacagacaaataagaccatcaaatacttactgtacgaccgatggaattacatgttgatagtacttgcatacttactccgtccacaaattatgggtacaaactcccaattataaggaagtacttttccaatccatccaaagcatccattattgtatcgctaggcatgatttttctaagctgatgaagtcacatgaaaaggattgacatagaaaatagcattcaaaataaatttgattgaaatgtttaaaccattctcgtccaaacaagaaaataactggtgaacaagccagctgtcagctgtgtcctctttgtatatgacctccaaaaaggcataaatttgaagcagtaaaattaattttattgaaaatttcgggttcaaccatggcacatgcaaattcaataacacgagtgtggagattatggatacctcatatctacatgacattataatttagtcggatatacggtaccaaatatagatagaatatctctatgaggactcgggttagattctaaacttgtatgtcaaggaaatactcgggatcttagtcggttacgattgtatttcatctataatcccatattccgttaggatatggactatattttgtaaagcggacctcttcccctatataaggaggggtctgtgtgcgggggcgtgatcttttttccagtttatacaatcaataacatactcggcggaatcatccccggacaggagtagggtattactttttgaataagaaggcctgaacctgtataaaattccttgtcttcaaacccatccactttcctagcttgatagccaccccctttttattattgccgaaatcttgtttcgacagttggcgcgccaggtaggggcagcatcaagtttttgctgactaagtacgatgggttccgtctccggcatcgacgacttcgccttccctcccgggcaggcgttccggttcgatagccgcaacttcatcaccaacaacctcagcaagatctctctccttgactcggattcgaaccagtcggggagagaccatgtccccgcgccgttcggtattccgaactcggccgaggcctactccaagatcatctctctcgggtcggcttcaaaccactcggacgagatccaatctactcctccgcgaccagatcaagacgacgggtcctatccctcaatcctgatgagacttcctgatgatttggccgctgtctttacagccaagacatctcccactcgaagatctaggcgaactccggcttcggccccgatccaatctagatccagagaggttggcgttatactccaacctcttgggacagtctcgacggaagagttggatggctaccttagcttccctgacgtcagttctcgaccaaccgagatcctcgactgcgacgacttcggctaccactacgaccacggcgacttcgacgacagctatgaggataagtacacgcctctctttttcggcgtattcatggctgacaacgaaacggaggaacaacgccgagccaaagaagtggaggaagagcgcacacgacaagaaaccgaacgtcgccgactggaggaagaacgacaacgacaagagcgagaacgactacagcgtgagcaacaagatcgcgagcgagttgcaaaggaggctgaagatcgacggcaacgcgccttggaatccaggcgacgagcgagagacctcatcgggcaacaagacgtcgatgaaacaacggtttttcgcaccccccagcagaacgcggttgcagcaatcactctccttgacaccctcctcaaggaagacgcactcaaccaagctgatcatgttgtcaacatcttgaaccagacgaagaccatgatcgctgcctcggttccagccaactccgcaagcacccgcacccagactggtagccgagtccctcatcttcgatctcaagactatcaccaaccaagcctcagcattaccggcgccggatctagtcgcaagagcaagggacatgatgaacgatctgttcgtttgcctcctgaacaacatagggagcgccgagttgaacgaccacacttcccacatcgaagacgccccatcgatcttcgtgacaccatcaaccagcgccgcgcggcaagaggacatcattcaccggaccgctacgacgacgacatggacggagttgctgccttcacaaatgatctgcgtcgagtgaattggccagctgactttaagccgactggaatcgagaagtatgacggcaccaccaacccggaatcctggctcaccgtctacggtcttgcaatccgcgcagcaggaggagacagcaaagccatggcgaactacctgcccgtggccttggcggattctgcccggtcctggcttcacgggctaccccgtggcacaatcggatcatgggtagaactacgcgaccacttcatcgccaacttccaaggcacttttgaacgccctggtacacactttgatctctacaacatcattcagaagtctggagaatcccttcgagattacatccgacgcttctccgagcaacgcaacaagatctccgatatcaccgacgacatcatcatcgccgcctttactaaaggcattcgccacgacgacctagtcggcaaattcggacgcaaacctcccaagacggttaagcagatgtttgaaaaaaccaacgagtatgccaaagccgaagatgctattactgcgtccaaacagtcgggcaccacttggaagccaaggaaagacacgccgaccgcaggagggagtggaagtaacaaccgcaaggatcgcaagcgtaagcccgaagaacttgtggcaacaacctctccatcttcccgacaacgtccccgcgtcaacacattcgacaagataatgaactcccaatgtccgcatcatcccaactccaaccacgtggccaaagactacttcgtctacaaacaatttgcgaagcaatacgtcaagaatgcacgtaagccctcagacggagatcaaggcacatcaaagaag

SEQ ID NO: 1813 - DNA, 613 bp, Oryza sativa
tccagattcgtagtactaggttaactaattttaggagtgagggagtaatatattccaggaactgagcagtgtacagtgagcaatttatattgagaatattcatgcaaacaggaaaaaaatcaagaacccagctaaacaggttacaggggaaaagagattatgcaacagagaatatagagcaactcatgcagagttgtaagataactggaagaaaaattatatccaagaaacaaacatccttcaaaatgttgtacctactaaccttgcaatctgataatatttttcaaagccagagaccatcaacatttgcttgaacagctgaggctttgaggaagagcatagaacattcctggcttcaaaaaccatattggagggcataaggggaacatgaagctcttatttgaagaagtttcaaaaattcactgcagaatgattagacctaccgccaaaaagcactagatatatatttatgatactcaatagagttgtactttcataattgtcactgtttatagttaaaataaacccaccggagaatgcaaaagaaatgtagaatgtagtgtatcccacaagaacgtaggcacaagggaagtcttacaaaaaaaggtcttac

SEQ ID NO: 1814 - DNA, 973 bp, Oryza sativa
gtcgatttggattggatcacggagcaaaacgagattgggggtggcgcggcgagggggggacatacccgggctgataggccgccgctgcgcctacgcgcgctgccacgacggcgaaaagtacgaggaggaggaggcgcgcggccatcgtcgcggcggaggtcgtcgtcgccgccgtgctcgtcgcggctgctcaactagacgaggcgaggcgaggcgaggcgagagagagatccccttggacttggtggatttggtttggtattctcgtcgcgggctttcctgcggcttgtgggcttcgcgagcttccattttgtggggtttattacttggaataagtccacctagactccccgatatataggttaaatctaattcacgcccctcaaccgtaatacggatatcttgatccttaactgttaaaaccaatgtaattgactcacaagatagtatttataatggtatttgctaacgcagctcgtattcacatcaataccactatgaatactatctttagagtcaaattataacggttttaataattgagatgtcaagatatatatgtagcatatcttaatactagcaaagtcctactacttaaaaaataattagccatgaaagtctaagatttgagttcaagtaaataagtctcattacgaagaatctagctagataagttacgctgactttagaaaatcaaagttgtttattgccgaacgaaaattagattttacgccgttttctccttagattgttaaaagaacagctccatatgataaaaggataaataaatcgattttgatggaggcatatgaagctggcctgatttccacccatgccgatgacggtaggggagcggtatggcagtgacttcaaagtttgttaggtttaacggacaaaatatattgcatcatcttgccatgtcataagctactttctcaaatataaaaatactaaatctatttggttggacgtg

SEQ ID NO: 1815 - DNA, 20014 bp, Oryza sativa
aatttctctggttgtacctctcttgaggatcttcctgaatttgtagagcacgacgctggctgctcgatgttggaggttttggatttatcgggttgtgctaaactgcctgccctccctgagtcttcaactgaactccgtgaactccggtgtttgaatctttcaggctgttctaaacttcaaaactttttgaagttgattccacgatggaagtttggtacattagagtacctcaacatctcgggggttggcgcaaaaagtgattctgaggcaccaggtacctctgcagaagaccaaagttcacaagatcccattaaagagttagagttgggtatgctgcaggaagatatcatcacccaaggcttgtttcgtctgaagtacctgtccattggaggattcactctctactcggagcaaggtattgcaagaatggtggaccttctgacactgcccaattttaatgtacgcctgcaagatgatgggaggtgcagcaatattttgatcctccagcaaatccttgatgttacacatcgtcaactcaatatcaagtgcctagagaatgtggtgttttcagaggaagcgaagcagcttgaactggacaggatgcgacagtttcattcgttgggtttcgaatggtctttatctggtatggtatcttctgttaaacaacgagcagtgctgggtaatttgaggcctcataggaatttacagtccctctctataaaaggttacatttgcaccgaatttcctgattggattaacaagataaatgatacactcccagacttggtgaaacttgtattctctgatatcaatggttgtaactatatcccaattagtcaattaccaaatttaaaagagctagaaattaataatatgccccggcttaacaagatatatggtacgctcccaaacctggtgaaacttatattgtctcatatcgagagatgcgaccatatccctgtacttggtaatttaccaaatctacaagagctagaaatctataatatgccccagcttcatgatgcacgaattgggccatgcaataagctaagaagactgacactggtaggactaccaaatgaggccacggtacatttattttatgatatctgtacacacacagaagtacagatggtggaatcaagtcatggctgcgatgaagagatgacagaaacaggacaagagttcaacacattacctggctgttcttttcgtaaaaacgaagtgagaagaagtgaggaactttctagaggcccatccactgaaaagggcaaggtaaagaattggtttgacgctctattattatctattggaggagcaagggcaaagaaaacattggcctcagcattgtcccacatttcactagtgccagaagagtcccagttgtcaccaaaactgtctcatggttgtttggaggtcacaagtgcagcgctccccgaacttgattacctacaaattggaagttgccatgacctgaaactgcatcccactcccccaaagagcaaagagtacttcgtcaaagatagcagtctcagtctgcctgtagacaaggaagatacttcaagttttccatcacgtccatatgatcagtatactgaaggatgctcacattcaggacaaggtactgcgatccctccacacgaacatgctatgcagaagtcgatccctagattgaaatcaaaactgcatatcgaaggctcacgagatcaacttcgccaatggacagaacttctaagcacccacttggacgagttgactatcactgacccattgttttacaattcgaagtatttagaggaagagagcacagttagtgaacatgattccctggagagcatctatggtctgccacagtcatgcattgccaacttggagaaaataaatttaccgccatctcatcaatatggactagaagaatgttctaactatgataatattgtggactttgtaggtagaattgattctcaggttccgtatatcaatattggaaaggtatgtagtttctttgtttctagcagtaccaagcaaatttactgttaagtctagtagatgtcaagggtattagaatactttcccttctcttgtgtacataatatatatgctatttagggctaaatcaatgcactgttgaaaatccccaattcactaaaattaacatgatatgagagcaccggatttctttattccggctagatatggcaaataggaattccccgtcgaggaatgcatccccatccctgctcccgcgaaatacaatggggaaaacttgttcctatctccgcgggaattaatccccgtagggtctacatccctgcttaaaacaatatatagatgtgaaattctatatgcaatgcaacacatatattcacactttatattaatatagcaacttatacccactaatacatatgataaaaacacaagattaatcacataagataagtaaacaaattaaacttggaccgaaaattaaacttgaaccctatgcgggtctctgtaggggacggggacggggacggggaatggaggatcaccccatcccacgaaacctaacaggacatgattcctaccatttaattcccatgaactaattctaaccttccccctaatagagggatatatttggttgcaagggtgggatggatcaggataggttggaccttttttaggtttggttttgggatgggtgggataggatggttctcttaggtagtgtttggttggagggatatcccgggatgggatgggatgatccccaaaaccaagtgtttggttgagagattaagagggataggatggttccaaaaagagaatattcctccaatattcgggacgatctcatccgcgaaaatctggcggacggcgccatcccacttcgcacgcgcgcggtaaccctctggcctaccttttttttcaccgcacccctttcctttctccttctctcaccggcggcgggagcatgtgtttggtttcatgactaagtgggatgggatgaagccatccctggttttggggttggaatcatccactcatctgtttagttcacgggatgggcttatcctagttttttgtttggttgaacggatgagagagggatgggatggacaccgtttgcagccaccgtcaacaattgccaagtgggcgtaggagtggcgaccaggcagaggagcgtgtgcggcgtgggctcgcgacagcgggtgggcacggctcgcgagcaagcctgcgacgagaaggcggaggagtggctgacgctggctcacgagcaagcaggcagaggtgcagcgcgggctcctagcaggcgggcggcgagcgcggccgaggagcgcaagcatgcgggcgataagcaagcggaggagtgctcgcgggttggcggcgagcaggcgaaggagcggcagccggcggctgggtacgcgagccacggaggagctcggtgatggtcggagaagtgggcgagcaggcggacgactagcgacgaccgacggtcaagagaagctgcagcggtgactgacaagcaggcgacgatgattggcgtgcgggtaggcagacgtcgggcgggcgagtgaagtagcggcgcacggttcacaccgtgcgcccgtcgaagtgggtcgagatgatcagctcgattttgccgggcgctttggacctggatctaacaggaatattcctcgagaactccccgcgagacaggggcggacctaggccttgggccacctggaccgtgacccgaggcctaggtgtgaaggcccattaggatggtattttttccaccatgtaaacagaacacaaggcctaagtccatcatcttcattcttgtttactcgctgcactgcttgctgctgctgctctccagcacacagcttattgttcatcatgtcactacttctagactagtggagttgatatgccactgctatttgggccagcttggctattattctagctggtagcttctttggacatcctatcatgcatatctagtgcttcaaggctgatgcaatctgctggctgttacatcccactaagtatggcattctgctacaaacatatctactagtattccttctttgctaatacgttagtgtaattgagcatgctgctagtgttattcgctatttcaagtcaattacaatctactgaatccatccaagtgcactgcatctctactagtttacttgtgtcttttgctagtatgttgcaatgtccaatagtttccatcctgtctaccaagtccattgcatcatggtatttttgatggcatattattatttcaatatgaattatccctacaatcttcagctatgataataggatttaaaaagtaattagtgctccgtctttctacttgacaggggagccttctcagagtgtataattagtataggtattaaaaagaatggatttaaattacccaataacaaacacaaagatggctctgccatcactgctccggagatttgcggatagttgaagcgttgatactggtctcatgcataatcgatctatataacctggctaaagctcaagcgtgctgctttgaggatgcacacgtattacaaatacatgcaagcttccagccttccatgcgggtggtcacataaaaagaaacatataatgtaatgcctgcgcaggtgcataagctatcaaattgatgtgctttttacagcagatagctgtggctgctattatacttactagcaatgttcgtttgggatttaaaaaaatggtagttgtgtttacagattatgcctatgtctaaaaatgcaggtgggcactttttccgtaaaaccaattgaggaaggaggaatattctgctcaagtaacattccattactgtataaacactatgacggacaaagtagcagcctggtcattaaaaatcttgagaatttgaagggatcactgggtgaagtccaagagttggcgaagtatcagcaagttcgtttggtgtggtccagaagcaatttcattgaggattcaagcatggctgaggacaaggcagttctccaaaaactccgaccccaccacgacctggaaacaattgaaatagaaggctatcggggtgatgaattttgctattggatgatgaatataaattcttcccttccaaatcttgtgactgttaaactgtctaacatcgcaaactgtcaatgtcttcctccacttggccaattagcaaatctggaagtattgcacatctcagatatgcctagcgtcagaaaagtggacggtcatgtttacggcactgagaaaccattcaggaaattgagagaacttgaacttagtactatgaagaacctagaggaatggttaaccactacactactactaacaggtcacaatgaccatcagctttcacgaagcgaagaagttttccctaatctccaggttcttctcattgcaaattgtcccaggatgagatttgttccaggtttccctagaagtcgggagtgtaccctcgagaaaagctacagcatactattatcatttgaacagttcatcggaagctcaaacttggccttgatcgcactgaaaataaatgactctggctcatcatctgatatcgtgaaatttcttcaaggctgtgtaaatctgttgtatttgactattgattcctgcatcgatctaatcaccttgccagaacctatcaaaaactgccactgcctcaggaaacttgagataacgaactgctggaacttttctgtattaccggagtggttgggagaactaactttcctgcagaagctagatattcaagcaagcaaactggaatatttgccacaatccatccaacgcctgactgccttggaacggttggtgctcaacaagtgcaactacaaactgcgtgaacggtgcacatctagagaggataaagaaaagattaaacatatcaaaacaattgatatgaatgaggtaactccgactctggatcggtaaattattttgtagaggtgcaattccatcggtggagcagtgtggaactgtggatggaggggatagagagaagagatatgggagagttgacatgtgggaccaagggtatttctaacaattcacatgatttttttcctatccaaccagaaatgattattttaataggggcagtgtccaccatcaaatatccaacttgagagcgtcttcccccaaaacttcacttacagtgtccttcagctaaaactacgaagttacaacgccttgtatcaaaatttgccttataaaaaaatagtaatgcaaaaattttaaaacgtgtgcacaaacttctattatgtgctagtaggctagataaaaaaaattcacagctttttgaatcttccagtggtcaaccaattgtcaactcttacacgtatattagggcattttaggctttcttttagaaggtatttggtatatggcatattaaagaaactatggataaacttggtagtatattatagaagggacaaagttgatgacaaaccatgaatcagtgcaaactcaatggcatagtaaaaacatcattacatgaccggttgcaccggcctaagccaacctcaagctacctccagtctaactacgcctccttggtgttagatcgtggttgctctgcactacgcccactcaaacacttgttcacaaccattgttcttatttacaccttaggactttatttcatcacaactatgattaactatgtatataatcatggtgtcaaccccaacgtgtggtccagttcccgatggcacacatctgctttagttttttggtttagatacttggagtcttataagatttgaccaatcatataaccaaaatggtaaagtatttaatttgtgattggagtgactagcatacattgggtatcctatgctagatgtacaaactatttatatgcaaactaccatgatatatctctatggtgattcaacttcaactcatttattgattaataatgtttccaaccattctgtgtgtatgttaacattaaccattggaggtcatttacacctactcccttcattttaaattacttttcgttttagttctatccatagtcaaaacattcttaatgttaaccatcaagttctagaaagatatatagtttaagattcactatgagaaactctcatatgagtaatgcatatttcgcatgttgttaattaaactatgtaaatttctagaaattgatggctaaagttaggaatatttgactttaagacaaagaaaaacgacatgtaatttgaaatggagagagtatgtataaactaacttagatgcaggtcaagcttacatcattacggcaagttcaccatcatttatatcttctttttttcctaattgtaggtccctttgatgtacttgactccaagctatataatgcttcttcagcaagttactagttctcaatttatcgatctgcatattggtggtctggaatgtatgattggcttgagggagatggagaacttagaattacagacaaaaaaggagttatcctcgttgagtttggagtggtcatatgcctatgctgattccagcgataaatacgcctcttctgagagagggatgcagaatagggctgtttttgaaaagctccagcctcatgatagccttgaaatactttgcataaagaactatgctggtgttgatttccctcgttggatgtctttactcccaaatcttgtgcaattgaagatagttggcatgcaatttgaatatctacaccttgatcagtttcagaacctcaaagagctgtttctctccagagtgcaatttgcgcatctccacctgaatggtctgcagaacctcatagaattgtctctctctggcctaaaatttggacatctccacatcgatcagttacagaacctcagagagctgaaagtctccggtgtggaatttcaacatctccaccttgaacggttacagaacattacagagttgaaactctctgaagagcgatttgaacggctccatattgatcagttacagaacctcaaagagctgaaattctccagtgtggaatttggacatctccatcttgagcggttacagagcatcacaaagctggaactctgtaaaaaacaatttgaacatctccaccttgttcagttagagaacctccgacagttgtatctcttcaccgtgaaatttgagtgtgtcgttttgcatcagttacagaaccttgaggagctgcatctttcacagatagaaagccaaaagtctaacaaaccggtttgcatcgagtgtagccaaccacttaggaagctccaaaagattgtcatgaccaaaataataaacaaagggttacaaatatccgtgcaaggaggagagggtgacaaaaatttattcccgggtcttcagcatttggaaatggaattatgtgagaatttaagattccaaccatccatcccgaggagcacccattacatcatatcaggggaaatatatttcgataaatttaattaccgtagaatattgggttcgttcctgttcccatcgttcaagcaagtcatggggacatcaatccctggatcaacatccaggatggaaatcaagaacaccagtggtctatcttccgaaagatggaagagcattccgcacctcgagcttctaaacatcacagaactaacaatagacaaatgtgttgatagttgtccagtgccaaagtgcatcctgggctggaagtccctccagaagcttgagatacggagatgcgaggatattgaattgcttccagaatggttgggagagatgtcctgtctcactgagctcatagtggagacctactggatggaagctttgcatccatgcatccggcggctcacaaatttgcagagcctgacacttataacatgcttgaataggtttaaagaaagatgcaagtcaggagatgactggatcaatatcaagcacattccgcatatacaaattacagatagaaatgggcgtacggagatcatttcaccaagttgtacctaacttctaacatccgctgaaaacaaaggtacaccggatactctgctgtttttatacctcatgcttccactgtaggccatgcaatagctcaagctaagaattttgtataagaaaacaacagcagcaggaagttttttttttttttgtgtataagacaatgcgaaacatctacgtaccattgtttatttcttatgacggccttacgaggcagcaacatctcttttggactaggacattatttgtacccaatttaatacttgatactatatgccttgtgttttctttgtgcaatcatagatgaattttgttagaataaaaaaatagatgaactttgatctcttgtattaacatccatcatattgaattattgagtttgtaagcttttactgagattagctgtgttattttccattgacaatgtgacaacctgcagttcttgtgcgtgtttggaacgaagtaactaattgctatactacgttgcagttattcattaccaatagccactcaccaattgtttgataatctcatgcagcattagtttcgacagagagagaaaagaaaattgaggagctagctgatcagttgctgggacagtatatagcaggaagatattaaccggacagcccatcagcccagagtgtaagttaatggaataatcttttgccattaatatcatgtacacatgtaaattagtgatcatgcgtgacaatggtgctctgttttcttcagttgccgatcaaggatcttaactacatgtctacatggtactgtcaaggctctatgatgaatagattgtttatctctgtgcgtgcaagcctttctgctgcatattgtacaaacgaagcctcgctgttccatagtatgctgaggacttgtgttaggttgtatgctgaatagtgaatacatatactccgtaccaaatgttaaccagctggttttcccgtacaattacacgaaccatttgaaagtaattgtagctgctgtggaattatttctgatggacaacgtactcgtacattttcatctatcagcatacatggttgtaatctggtcatcatgctttgttctagattaatgccttactctgattagcgtggtgatttcgaggccttaataatgaacatggaggctccacagcattatttcctttttgtggccaagcatgatttaacctgaggacaaaatgtcaaaggcctaacgtacgtatggcaacagaggatgagatgaaggccttgtttagttcccaaatttttttcttaaaaacgtcacatcgaatctttggacacatgcatggaacattaaatatagattaaaaaagctaattgcacaatttgcatagaaatcgcgagacgaatctttttaagcctaattattccatgattagccataaatattagagtaacccacgtatactaatgacggattaattaagcttaataaattcgtctcatggtttccaggcaagttatgaaattagttttttcattcgtatcaaaaaactccttccggcatccggtcaaatgtctgatgtgacaccaaaaaatttctttttcgcaaactaaacaaggccgaagagcaagatacgaagcccatattccatgccttgaccgagaccatcaagctactccaccgtgctaaaatataaaagatattggatgatgtgacacattctaatattatgaatctgaacagtttttatgtccagatttatagtactagaatatgtcacattcacccaaaatattcttacattttgggacggagggagtaaaagagaatccacaaaacaacatcatcggtgcgaatcgctgtaatggctaatgatccatacatactcctttcgttccagaaaaaacgaatctatgactggatgtgacacattctattgctacgaatctggacatacatttatccagaatcagattcgtagcactaaaatatgtcatatccagtactagaatggttttttatgagacggagggagtacatgtctgtcgatactacaacaagttttctctcggagcagcttttaattggttcgtgtaatttcttgtcaattactcctttcctttcaggctgtcaattactccctccgttttaggttataagacgttttgactttggtcaaagtcaaactgtttcaagtttgactaagtttatagacaaatatagtactaagttagtttcatcaagtcaataattgaatatattttcataataaatttgttatgtgttaaaaatgttactacttttttctacaaacttagtcaaacttaaagtagtttgactttaaccaaagtaaaaacatctaataacctaaaatggagggagtaacttttgtcccaaagaaccgaactgccaatggaatggcagaaaggaaaacagggggcgaaaaatgtactatgtgattagggcgttcacggtggacttacgtgacgttcagcctcgccctccctagtctgcaaaggaaaaagcacacgccacgtttgcttctgggcccaaaaaaaagtttttgtgtccaaagtttgccaccgggttcttggaagaagctactcatttgtgtggagagaagctaatagtactagtactcatttgggtgagaagaaaaaggagagagataaaaagtaaaaagtttgtcaccggtgagacccactactagtatttgcactgtgaagtatgaagcttacgaggttctttatctacgtggcatacgagcaatggcaaaaatcggtgacacactgtgattgcccttagataggaaactgggtgtggaatcggcagcgtactgactgccaagtccacgacgtcggtcgtactggtttgattccacgaggcggccgactgggtcagtccacaataatcgtgtataatactatcgtgtaccgctaaagagacgcgatcacgcgaacgaagaatgacttgtcccgattccaggtgcgaaatcgatttcctgatatattttttttctctcgctggttgtcgttcatggtttcatcggagctgttgaacgcgtaatcgatggaacggaatgccatccgatccatccaagccagcctgctgcggacttgccgtgttttgtcaccgtggaatggtggactccaaggcgatggatccatcgtgcagccgtgcatgaggtgatcactgcatcttttggcttatgcctatactcgccagccaaatttaaaatttttaatcttaaatttaaagttgattttaagagtttttttattaaagtttatttttcagtctttacttatagattgataagaacacatatatagaagttttgataagaacacatatatagaagtttcatttcaggtctccaagtcgacaacggttagatgtgttattccaaatattgtactagtgtgattatgatgaataagagcaacaccggcttcagccaacagaagtaacgctattacctatcagataagaggcctgaatctgtataaaaatcattgtctccgtctcttttacttcaatctcgtatataccctggtaacaacgatccctacagtatgcaaaatatcgtagttacgatctcaaacatcggcaataattattaatgttttagacaaagatatagttttcaaaatatgtctttcactatacctaaatgtgtgtttatttttattataatactgtatttgtctttaaactgaatatttttaagttataaaaatttaaattaaaccttatctaaatcattaaaaattatgaaaccagaggagggagtagctcgttaactcctagccaagtaagacttttactgctgttaaggttaggacaaggagagtcgctcattatccactctagagttgtgcagaaaaagaccgaactgaaaagactgagattgagaccgagaaattgggtgaaataccaaattttgttcggtcaatttggttagtctccttaagtgaatagacgaaaaaaccgaattaacaaaatatgtctaaatgcaacctacaatccactaagttcaataggattaaactctaattttcatatccatacttcttctaggcatgcaacataataaaagtctttactcatacgtgcttacggtttttttatttttatttttgtgttgaaaatttccattatttctttgcatatataaaaacgttgttaaatttcggtcagaaccgagaccgagattgaatttatcggtcctgatatttttacattgaatcaaaatgaccgaaaaaccgacaccgaatacccaccctgttccaccctttccattatgcatccaacggtgatgtgctaaacttgcagtcactgtggggattttccttctttttttcagccaatcacagtggagtttcccgtttcaccaccaaccttcgtctccgccgcctccgcctctctccttccccctcgttctccgcttccacccaaaccaaacccaaacccaacttgcgaaaccccaacgaatcccccccaaaacacccacccagtcaaacactccccaactccgatccccacccccatggcgtcggagatcgaggtgctcgaggacaccaccaccacgatggccgcctccgccgcccccgtggcgcccgcgtccccatccccatcccccgccgccgctgccgacggcgaggagggggaggggccggcccctgcggcggaggacgactcgctgaagaacgacgtgtacacggcggcggcgtacggcgatctggagaagctgcagcggctagtggagggggagggccacccggtcacggagcccgacggcctcggctaccacgcgctccagtgggccgccctcaacaaccgcgtcgccgccgcgcagtacatcctcgaggttttcccccctcctgcttcccgcccgagcgtctcgcgatttggctggccttcgtgtagtcgttgtttgctagctagcgagggatttgggtgggggtttggtaggatgcgtcatcaaccaatgcactttatgagccgcaattttatatgtttttgaaccgtggactgtttgttgttatactgtgttggctaggtgtattcacttttagctcattggctggtgttttggataccaaattaccagtgcctgtggttgaattactccaggtttgtgaacaattttgttggtggccaactgcattaggtgaatatggagggtttgggactgctgcaagctgttatagctggaaattgatgtgcttttagtaggtttcggatgtttatatgacctggagatgatgccagtttttcagtatctcattttgtatgttgtaggcttgaatagaaatggaactagtgagactgtgctttggtttatccctgaattttcatatggatgtatgtttattttttccattggatcattgagaatgtggacatgcttactgctggataaagcagatgagaattcagctggcctgtgcagcgcccttgaggtgtttccgtttaagtcttcttttccttttaatcttaagatcatgagtgtatggtaggctcagtatagtctgaataagaaaggttactaattgtgtgcctactaagtgcatgaataaactcgcacataacatgcatactttgatggtaccaggaatttatcttgattgtggtatgtagtcagagtatgttattctctgcatgtagacgaagtatcactatgctattcagtgagcgcattctgcacatataattttgtttgaccggactatgattttgtgcttggtctttgaacagcatggagcagatgtaaatgctgtggaccacactgggcaaacagcacttcactggagtgctgtacgtggacacatccaagttgctgagcttcttctgaaagaaggagctaaggtggatgttgctgatttatacggttatcaggtctgaatttgacttcccttctgtattttggtccctgttttcctggtttgttgctttggttgtccaatgttggttcatgattctgaaagacaactaagtattgttggatatttgtttgccaagttaactgttgtatccacactaggggatcagggatttccagtatataaataaataaataaataaataaataaatttaacctatgaattctctaggtaaaatgaaaagcaagaatcaacaacttttgtctatggcagtgaatttgttaaaaactctatactgctgtttgcaggcaacacatgttgcagcgcagtatggccagacagcatttatttatcatattgttgcgaagtggaatgctgatccagatgtccctgataatgatggaagaagcccactgcactggtttgtaccttgttctctacatttatcattatcttatgttgcactggagtagtagtttctaccagtgcacttagtaatgcatgtccccataaaccttcagtgccccttatatttctttctctctctctctgtttttttttggcatattaccttgtagggctgcttacaagggatttgcggattctatacgtctccttttgtatttggatgcttatagggggcggcaggataaagaaggcatgtgctaaatttatctatttccattattacctgtactgctgtgcacataacagtgtaaaccaatggcttagccatatctccaattatatcagtacacttcagagcatgagatttacttctttactacaatgctgcccctaggttgtacccctttacattgggctgctattagggggaacctggaggcatgcactgtgctagttcaggctggcaaaaaggatgacttgatggtgaaggataagactggtctaactccagcacagcttgctgctgataagagtcatcggcaagttgcattttttcttgtaagtaacatgaaccatggcatttctgtttttgtattatagccattcttttgtagagcccaatgcattaagccattaacagttcatctactagagattctgccaagttacttaatatgatttgcgtaatgatgtttactaataggaaacatttttcttcatcattttaggttttatattccttctgacttataaattctttagagctgagtttcatgtctccatgatgaggtgttattggtgtaattcactgattatgcataattgcatacataagctttctgaactttgtagtttccctgtagattcagtacaagaagctgcaaaattctatgacttctacacatggaaatgatattattgaccagaaatgtcataaactagcataagacataaaactatgtaaccaaggaggcaaaatgctactctttgttgtgactttgctgatgcttatatgctcttatatatttttattatagattcgttgtgagtttgggaaccgaaatgatttcctgactttttgtgattgcacatgtagattaatatccttttcactaattcattattgttaatctagctaatgtcataagagtggtcatattgaccttgaggtgaaagaatattactggtatttcaagagagaatctactggaagatgatccttttgatgatgcttgtttatttagacagaaacaagacttgatttgatgattgcttgcaggacaatgctaaaagggtatatgatagaggatgtgatgggaataccaattttggaaagctatcgaaactggggctagctcctgtactttggtgtattattgttggcttgcttgctacatatatacactctgttatatcaggtaagtaccatttccaatgtcgctcactccatttgatctcccacgatgcagtatttactacatttcattctttcaggtcaatatatcatggatatgacagcaccatttgggctgtttgcatggtcaggagttttccttgcaactgctggcctagtcatgttctataaatgtagcaggtacttacgaaaatgaagattagttggcagttagtattaaaagttgaaaactcaagatagcatggggacatattgccagcatgttgattcttgttagatactgcttcacaaatttcaatatagtaacacaattcattatatattttttcatgttgacgcattttacatcagctgacctgcttatcagaaatgtggtagatgttttacttatatggttatgcccttctgttcttgcattctttatctgttgagcattttactgtgtgtaaatagcctgctattcttctgttacctacccccatgatcgccagatgagatatgcagcatttattgattatcctttagctgcatcatgacattggcctatgctatctgcaggaaagatcctggctacatcaaagcaaatatacgagattcacaaaatcaaagggatgatgtaagtttgaaatattagcttagttaatatagctttctacaggcacatttatcttctctttggactcgtgtgaatcttgtttgattcatttccagacttaaagccaaacaatatatccaaaatttcacaatcctaatcatgagtatttattcctttaggaacctttgttgaagttggagttagacaatcccgcacttctgtctggtaactggtcacagctttgtataacatgcaaagtaagtacagcattgtcgattagttttctctttgctaggttgatatttgggcctctgattccaagggttattctacagattgtgagacctgttcgttcgaagcattgttctacatgtgatcgctgtgttgagcagtttgaccatcactgtccttgggtatctaattgcattggcaggtacttacgttcttttgggtatcactgtgttgagtagtgatcaaacatggttgtcatctcttctggagatgaaatggataacttatgtcttaaaatgctgaacttttaatgcagaagattatgttgctatgtatatcttaagaaagttgctataacattatgaagagctctgtgctctacaatacaatctctcttttttggtagcttttcgtttgaatgtttttccctgccggataccttcttgtcctttggtctgatctatagtgcactgtaactgcagaagaacaaatgggaattcttcatgttcatcactctagaagtttttgcaatgatcattactggttctgctgccattataagtattgtctgctaagtcctttgtggttctgtccttaataatttggagtgaaaaaaaatttccataagcctcaatgctgtttttgtcacagggatggtaagagatccggcttctccagcatcctttattccttggctcagctattctgcttttaaccatactggggcactttcctttttcataatggacctcttccttttcttcggtgttgcagttctagcagtagtccaggcatctcaggtatgtaaaggttgaatttagcttgctacttgatctttttttttctcatgagaaaccaacctatttttgacctgataatgaaaaaaaccaggaagcatgtttattgtctttacaaccatcagtaaatgttctgtaatacaaagtttcatatagaaacttctctgctgattttatgagggtttgccccagaaatttatgaagccttgctggatttgtcaaatgaacatgtcataattatatagttcatgtgtgtatcccctataaagtttggatacagtagaagtaacattgaattttaggcaatgaaattgctgtgatacataattcagtagcaaaactgatattccaattacaagatagagttgaagtcagtagatgccaggtattatctggcttatttgatctattaattagttttctgtgatgtttctgtatacgacagatctttccatctggtagctataactttttcagaatggacacgaggacttgaggagcattttttctgttctgttttatgacgtgttcatgccttacttccatctcccatgcagatagcgaagaacattacaacaaacgagatggcaaattccatgagatacagttatctaagaggtccaggtggaagattcagaaacccatttgaccatggagcgcgcaagaactgctcagaattcttgttaaatggatacaatgaggacattgaacgtcttgatcatacgtcacacactgatgaggaaatgggaatgatacagatgacaaacgcagtctctcagaatggcgagggcccttcccaccatggtaacggcactggccattcttgtgctgaatcacatgctcactcaaaatctcacagtcaagtaagttcatctcagtgttgtgaccacagtaagaagaccgatagaacaccattgggcctagggctgggccttggacgaaacagtgcttcccggcagtatgtccggtctcttctcccattgtgatttgttatatgcagatcatgtgtgtgctctctgtagattgtatgtgttcatgctgaggctccattatttatttagctgcttgtgacataccacataggtttcgctagcttacgttaatattgttggggtgctagctgtgtgaaaattcagatctattagatccagtattttttgtggtgaatacataggagatgaaggtagcaaggtgctcatgaatatccgctgatccgcagttcagaaatgtcttgtcgctcctgaaaagagggcaacaattttgtgcagatgcagcagcatgaaacatcttcattgctgtgtcccttggtgtcaatataactccagcattttagcttctggatcttacatctgtgggaaaatgtagttgtaaactaagataattgtaaatttattagcaaattctgaatttagatactcttgttgtgatctatagctgtactgacagtccagaaagttgtaataacaaaacaaatatctgaactcttgacgtgttatgaactctcgtaggacctacgaatggatgatgcatccgttcgaaaatataggtacttgtgcatggtttttaaatgtatacggacgatatgcatatttttggaacagagagagtaatagttttttttttccagttattccccatttaacgtatctggcactggcagtacgacattgcttgcagcttgtatctgagtatctcgagttaatcactttttagcccatgaacattcagttcaggagtgaggagtatggtacctcatgatttttaagagaaggatggccttgt

SEQ ID NO: 1816 - DNA, 22019 bp, Oryza sativa
ttgtcggcttgtccccaccagtggatggctggctgtggccggagaggaccaaagaagtttgcaactcttccctgcttccatgttaccgacacttataaataaattcttaaatttaaaatacacaagaatttcaagttcatgcagaattttccctgtattgaaaactgaaatatctctgcctatctaatctaaaactgaaaaacaaataaaaagaaagaaactttagaactcgcaacttgggctcggtccagctccagcctccaggacccagatgccctcgtggtccagatcacccggcccggcccatcctacctcatcatcacgcaacgcaacaacactgacctacccagacagcgtccacccttccttctcccgccgccgctccaaaacccccacctctaaaaccctcgccggcggcgcacccccacccaagctgagcggccaaaccctcgacaagcatcgtcagcagcagcagccgccggagaagtaaccgccgccgccgcggtgggagagagagagagagggagatggggatcttcgagccgttccgcgccatcgggtacatcacggccggcggcgtgcccttctccgtgcagcgcctcggcaccgagaccttcgtcgccgtcagcgtcggcaaggccttccacgtctacaacgtgagctgctttctccccgctcgtctcccacccccacgccgccctaccaccgtccacccttggccttgtgtgctcgcgtctcaaatcggagtagcttacggggagcttggtggagcgagttgatctggtacaagttagaacgcgtgatttgagatgctttggagcggtgattgtgtatttaagtcatggttcgagctcaggggctagttactgattgtggtattagctcaatgcgatttgctcactactacctcgattcaatcgagctgcttcattgtacatatgagctttaacgctagcctctctcaccttgcatagttttctgatgtagctaactcatttttagaaactaactggacttatttcttgttttgcagtgtgctaaactgaatttggtcctttctggtaagtctgtttttttttttgggctatgtgaagattcttcatgtatagcttttttccttatggttttatgtgatcgaaggacctcaattgcccaagaagatccgtgctcttgcatcgtacaaggattatacatttgctgcgtatggaagtgatatcgctgttttcaaacgaactgatcaggtgagggcgttactgtgcttgcaatagcagatcttgcattatcgtgttagttactactagtactagttacttgtttaggcgattgaggcaaccattcatattattactggtaaaagcaggggcttggtgttcttatctaaatattattactggttcacttgaggttgctacattttggagatagtcagataatgtgctcctataatatttgaaactggaaatttgaatagtttctgaatgaaatggttctttcaaactcccaaaaaggatatccaaatgctacattttatgcccatcaactgctacaggattcctctcaatcagacaattcttttttatgttctaactggatctctttcaatcaggtggttacttggagcaaacatgaagaaaagatcaatatattatacccatttggagaatacattctaagtgcagatattaaggggaatgtatttatatggtccttcagaggatcagagccaaatagtgagcctgttgggaacatatcattgggagacaagtttacaccaacttgcattatgcatcctgatacttatctaaataaggcaagtggagtttcctttgctttggagatagtttagaggtcaaatttattgtgcattcaattccatttctggtaataaatctaatctggtcttacgttaggtcatcattggaagcgaagagggtcccttgcagctttggaatatcagcactaagaagaaactttatgagtttaagggttggaactcatcagtatgttgttgtgtttcttcacctgcccttgatgttgttgcagtcggatgttctgatggaacaattcatgttcataatatacgatatgatgaagagttgatgtctttcaatcatcaaattcgtggtgctgtgactgcattgtcatttcgaacaggtgttttgatcgacttgttgtaaattagaacctttattaacatttttcaccagattattacaagaatggaaatgtccaatcaaaatcctgatatattcatttttccttgcctgtcggtttagtcctgtaatctgttcttgactgtgaatactcaaatgacttgttagaaagcttgtcatattaagatgggactggcagttttggcaccacctaataattatatgttagattcagttcaggaaatgctgctgttgcattttttttctatgatacagatttcatacatgagctgaagtgtttcatatattcttttaccagatgggcaacctcttctggcctctggaggatcgtcaggtgttattagtatatggaatcttgagaaaaggcgccttcattctgttatccgggaggcccatgatgcttctatagtttcacttcattttttcgcgaatgagcctattttgatgagctcggcttctgataattcaataaaggtaagtgtcaagcttaaaagctgttgtacagaaacatgcaaaggtccaaagctgcatgcagctagtacttaaccagatgtggggcatcaactgtacacttagtagcggtgagaatgattcagcgcattaaaatcgtgcctttgtgctgcaccaaccagttgtactctcctgaatgtctatggtatttcagtgttagccttttattagtgaggtattccaggatcctcactagaaacaaactagccaggaaagatgaaatttatactggtctggaattggcattaccatgtcaaataaagttttatcagctgcaaaacgttatatcagtttatcttgatagtccagtaatctaatatgctgtttaccagatgtggatatttgatactaatgatggagatgctcgtttgttacgatttcgaagtggccatagtgctccaccacggtgcattaggtgacaagtgtttcaatcatgtcttgctttttttaaaaaaaatcagttggatattttattagtagtaaccatacttctgtcgatagattctacggcaatggaaaatgcatcttatctgctggtcaagatcgtgcctttcgccttttttcagttgtccaggtaactcactgtctttaacttttatatgaagcacatctcctactttcgaggaacttattaggaacatggcagtgatacatcatgattaacattctaggtgtacgtttttacatcaattaggatgctgagtctgttatttgtcatttcttcaatactctctggtctaataaaactgtataatggttctattctgatcaaccatgctaaggcatgtgaccttttataagtttattcatgttttaggcatactattgtttcagcggacttacacctttataactattattttattattaactggtctgctcccattttcttctaaaaaaattgaatttatcctagcctgcattagtaaggtggatatttctgtgtgacaacaatatgagcatagcagtgagagcataaatgaaacttcaattcctatcacttccgacattcttccttgtttttctttctgttgaggtgttgagtgaactatggaaatactattcatcagatgcgtttggttttcgctgaatcctgcatgtttacgttcttatcaggatgccttgcctctttgagaaaaaggaaacgttagcttagctcactatttaattctattgacacaactatttgttgacaggatcaacaaagcagagaactttctcaaagacatgtgtcaaaaagggcaaaaaagcttggattaaaggtatggatttgattactacatttattccctacctatttgtttttccttctctaagatgttaaaacttctctgtcatgcaggaggaagagatcaagctgaaaccagttattgcatttgattgtggtactcttttggtctttgcaatacttctgttgcttttactaatgacatatatagggatactgttcttccacttctgtttttctgaataaatacaagtcactggcagtaatgatactgttttctatttttatgctaccaataaatattctaccagtactatggccattgaaagtagcatcagacagggaagtgcacccttttttctccttggtagagaaattgcttgtattccaatggaaacaactacattctggaaattataaacatgccattacaaaggagcacatgtggagagcagcggcaacagaaataagagttgaagaagtggataaacttttgtagtaagatgtaggatgcctattgtacaacagacgacccccatttcatagtgcagtttcttttagttcttcagaactatctgattttactgctgctatgacctttgtcaaagtcaatgaaagtgtgacctctgaagattttccaattggggccttttaatattgcctgtcagtattcataatctattaggacattgcaatgtgaatattttaataaatgctttttatgtttgtggaatgaaaatggcacccagaaactatgtcctccaacatctttgatctggtcatttgcttagcgcttgtgtaacaaagtgtttcattatgtttggcagctgtgcattgtaaactagttgctgatttgcacccttttctttttatatttttgcctgtatgaaaaaaaaaactataacttaagctgagaaaccttctgcttctgttatcagctgagatacgctcacgtgattggtgtaacgttgttacctgccatacggatactccacaagcgtatgtatggcgtctacagaactttgtcattggggagcatattctgacaccgtcatcaggcagcaagtcaccaattaaggtaatgcatgttttcttaaattgcatgtatggaattttcattttagactagatcaatgtgacctttctttgaattagctttcacaagttggagtttacaagtgttccattattttgttttttaatctttttctgacaggcttgtgcaataagtgcatgtggaaattttactttcttgggcactgaaggtggctggatcgaaaaatttaacctgcaatcggggattagtcgtggcagttatattgatacatcgttggcaattaagcgtgcacatgacggagaagttgttggattagcgtgtgatgctacaaatggctctcttattagtgctggatacggtggtgatattaaggttccatgctctcttgctttttaattctattgtaaatcctgtggcatgctaagtaattatacaaactacaaacagccttttactgcacattttacagagtggtgttgtgcactttgtttcatctttatgtcctcagctgggtaatttgattcttaatgctgatcttctagtcctaccataaggaattgcatattgctgcaaacaccagctatttgtctgcatatgtttgaacttatctttacaagtataatgtgaacttttatccatgacaatattacttacctataggattgtcccctcttgcaggtttgggattttaaaagttgcaagctaaaatccagactggatattggtaaatctgtcaccaagattgcataccaccgggcaaatggtagtatttaacatatttgattattctcgtgtataattctatgcccaattaacagtcttatgctattttatgtcaggtcttcttgctactgtagcagatgatatggtgcttatattgtttgatacagtagcaatgaaaatggtccgtagattcgaaggccatacggaccgtgttactgatttgtgtttcagtgaggatggaaaatggctcatctcatcgagtatggatgggactcttagaatatgggatatcagtttagcaaggcagattgatgcaatgcatgtcgatgtatctataacatctctctctatgtctcctaatatggatgtgttggcaaccacccatgttgatcaaaatggtgtctatctttggtaagcttcttttgcatttacttgtgctcaccatgttcgttttgtagaccttttatgcagatctaagttaattttggagatatcatttagcaaaatattagataagctttccatctgttattactcccgcaaaatcatgacatggctcatttggcaaataaacaattttatctgtccatcctgtagttgatgacatggtactgaaattatgtaccatcagttgcaagtaaacaatcaaaccacctcagagtacaaaagaggatgaggttcatcctggaagatctacctttgtttttgaaatattatcagcacagcgttgagaaaatttgctctcgtaagtcagtctccagtgtgctggttttttagcacatcatgtggggccaacttaaccaattgcacattgttttccaacaaagtactttcttcccaatggtgtcttcccattcttgtttttgccactaacaaaccacctcagtattgacatcccatcaaattctgtctgcgtgtctgttcagagccttcaagtaccattctaccatccccatcaagttctgtctgttcagagcctccaaagtgccattctaccccttgtcttattcccttcctcaagtaccaaccattgtgcctctagtggcagccccttcctgtcacctccggtcctcagcagctagcatgccatagctggtcaaaaccccttgtccagatggggtggggtgaaaatggcaaagcgagaagttcccaaatggaccaatggaaaaaagtggcacagttgataactggacttctcttagtggcataatttctcgtaatattcacttgaaaatacgttggcctgcttgaatgtcggcactgtggttagaaccacttgaatgtggtagcttatagctgttcccttctactccataatattatactattatgaataacatatatagtatgcagtgttctgtattttattctttctgatatacaatccgctgtgtttctttctaattttgacagggttaatcaagctttgttctcaccatcaacaaatgttgataattattcaagtggtaaacatgtcagaaatgtgcgtttgcccactgtttcatcaacagaaaaatctgaggaagagcccattcatagttcagaagattcaaaagaaagtaaagttaaaccttatgttataatggatcaccaaataccaaatatgatcaccctctctttgcttcccaagagtcaatggcaaagtctggcgaatcttgacattataaaggtatacttttttacattgcaagtgacaattgtgtaacctgcatcactatgctactttgaattataatgtttttttttgtttaaaggaacaactaaataagttctcatcatatttctgcgtcttcaggttcggaataaaccaattgagccaccaaagaaacctgagaaggcgccttttttcttgcccacagttccatccctttcgggggagatattatttgagcctgcggcgaacagtaaagaaacagacagcagtactgaggacacaagtcacaaaaaaatggctgacctctcctctcactttagtcggctgttacaatcctgtggagatacaaagaattgtgagtgtttataggcatatttgctcaagtttaccttatttcatggtttagctcattgattagactacaaggagatgctgtccatactgttgcttcacatacttcacttgctgcttctattaagtcgttatgtagtgccatattttgccgacagaagcatggtcaaaaccgggagatatttgttagtgttgtggcctgtgctgctgatgcttgtcatggttgagatgctgactcttgatctgttttacagattcggcatttactgactacctaaaaggcttatcaccatcatctttagatatggaactacgagtgctacagttaatcgatgatgagccacaaaatttggagcagagacctgaacttcaatccatttcattgctgttggactacttcatacatgagctttcctgcaggaataactttgagtttgttcaggctgttctcaaattgtttttgaaggtatacactgttatatattgttcactctgttctgttatttttgtaaaagaataaaaaaactctgttatgaaaatttctcacagggtatatatggtatgtattttttttcctaaacttgatttttgcctttcctggaagcagatacatggtgaaacgatacggcgtcactcaatgcttcaggacaaagtgaagaagcttctagatgtccagagcttagtttggcagaagatagacaaagtgtttcagagtgcacgatgcatggttacattcctcagcaactcacagttttagtagcaggtgatttctttttcatttgatatgccaaatggtttcgtctctttcaccgatactgcttgttttgatctttgcttttgccaaaagatttactattttgtattaattagttggtgctaaaatattttcagataccggcctgccagcattatgtttatctagtagtagcgaaaggcggtttcttctgcagtttatcttccataactcgattatttccttgtcactcgcaggttggtgtggggcttctttgtggctgctgtaccattctcttctgtcttaccataccgtctgtcatggactcagggattcagggtaaagctacaaggcgtctgcgtgctgttaacaacgatatgcaccagcagtacttcaggatcatgagacaacaattttgtagttctgttatttattgttgcattcttttgtaacatattgaattactgatgtatcgacaccgttttgcaacaaaaaagaaaaggaatgtcatgattgatattttaatttttggtgggtgctatagcattcagcaaaactatcgtgacagacttttgatttctcgagaacaatggcgatggccctgataggatctctctattctctaacctacatgatgctcagttttcgtatccatacaactaatttggagagatctcaagagtacaatatttcggacatttcggtcgacgcttcgttgtttactttggttattaagagggcttgtacttccaaaaaaaacataaaaatgtgtgcaactcagcatttatcttaggttatgggggagaatttcattacattcaagcgactgcaaattaaaccagtaattttctggcctacggtttcaacggtgaaaatgatctccaggctctatactccactactcccgaacatttatgaaaaacgcctgaaaactcaagtgccaaacatatcgtttcttttcttttcatgtagtagacaggcaacaacctcgcagtacaacacaaccagcttcttatcatcttgtgctgccttaccaataaatgcaaatacatcaaagaatctgtcaatctagtccaagctcccaaaaacaaaaaccttcaagaaatgctcctgcacctctaaaggtaaacaaaatgtatctgagctttgctcaagtagtacctctgctgtcttctgtatctgaccatgctaatacagtctgtatgactgccatggcaatgcactaaccctactaaattgttcatcatgatagatcatgcagacttgctcctcaggctgtatacatttccaattactccaataatgctaacaaccatggccaaaccaagcatcacaattgacaggagcctctcacccttacctaaagacttgccttccttgtccaatctcaatgcaataagggccgggaaaatgaaccccagtgccaaccccgtcgtcgcaccggtgaacttgaaggccacccagatgtttggtatcatcgtcgagccaagatagatgagtgccaagagcaccactgtcaaggtgagcatctttttcctgctatggggcgctaactcgccaaagatcaacgagtccaccgtctgcctaagcgagaagtggacaaccgggaagacgagaaccagatggatgacatacccaatcctgacaatgaagttgaggattgagctgaatctgatcccgagatccttgtcaaagttggtgagcacatcagattcagtgtcttcgccgaacaagaggtaccctgagaccgcagtcagtgcatataccacaacacatagcacagtggtgatcctcccaatcttgtacatgttgtgaggtgtcttctccttgagctcattgtagattggctgaacattgaaatggcagatgtaggcgttcgtcatgatcggtatcacgacgagcaaatccagcattgctgccctcgagctaaaatccggccccatcctcggcatactgatcttaccctcaacaaccttcaccagcgcaatgatgcatgacacaaccacaaacacgacagcaagcgcgaccgatgcagcagacgacaagctcaacgaatcgatcttctcgagcgcgcacaacggggagagaaagatcacaagaaccaccaagatcagcagcctccggttatcccactcgccatgcccgatcaactgatccatgacaccaatgtgcttcagtgaccctgacatcacatctccgatgatgatgaggtacacgatgagcacgccggcattgttgatgatgacgcacatctgcgccacgatgctcgccggacggccgagcgccttgtgcaccacctcgccgtaggacagcgcgcggcagtacacggcgaacctcacgagcagctcaatggtgacctcggagaggatccccatgaccaggatggagacgaggccgacggcgacgccgagaaccttcatggtggccgggagggccataatgccggcgccgatgatggaggtggcgaggttgaacaccgcggcgggcacgccggagccctcgggtggcccggcggggccgtcgccgatgagcggcaggtcgtcgttctcgccgccgccgccgccggcggcggcatcgccgtcgaccaggaacgaatcttgcttggagatcttggcgtggccgttgtagccgacgccattggcgacctcggatgtgcgctggttggattggagctcgatggaggtcaatgggagggacgagtaattcgtgttcatcttgcttcttggcgcatcaaagattggatcaatcaatcaacaacaaacacgacgagaaattcctcgtcgaatggacaaaactgagccaagaaatggaaaaaaaaatgtataaccaatctacagctccaagaacacaatcttgcccccaaaaacggaacaaaattcgactgcaaactacatcagctgatcagccggtgagatctcagaggggcttggcacacattggtggcatctaccacacaagaaactcaaattttcttgggccagatttggttggagatcgaaacagaaacaagaactgaaattcgtcctccctccgaacaaaaattggaggaaagagagggaggcgtgtacctaaggattgggacgagagttgagagatttgaggcgttgaaactgtggagagatctggggttctatctctctctttattttattttattttcgattattttttttcttctccctcctctctctctctctctctgttcttccttctctctcataaaagtatccgataaactaaagaggatagtcaatttacgttaattccgagtacagttagctccaccaacccagcgattcaatgtacccactagattagcaaatgacatgtgggcccataggatcgtggggtccacgcaatcagtgggtgtgggtatgtgcttgagtaacatttggggatctgcaactcgcgcggtccggccacatgggaggcgtggatacatcccttcgatctgattggccagcggttgctggtgggtcccactcagtggctagtactgcctaccgcgtggcccacctgtctgtcagcgtggaatattcactactagccctgaactgcacgtcctcaaatttagatggattttatatatatcacacaaaataattttattatttcctccatcccaaaatatagcaattaatataaaatgggacacatcaggctcgttcagttctgattaagatgcaagttttagctcggtttttgttagcatgattttcaaaatgctaagtactttagtacatttaatgtgaaaatttgctttagaatatcatataaaactatttttaatttaaaataattaaaactcaattaatcgtgtgctaataatttttatgttggtacttaatcttcatctacattacaacgaatctatatgggttgttatattttagggtagatggagtaattcaatttaggataattggatcatgccattttggtaagcataggcaatttcgccacttgtacaacgcttaaccaaatcctgtgttgactaatggtgttcaccgaagatcttatcgatgtttggtttgactagaaaatgtatagtaggccaagtcaattcattgaaccattctacagttgactaaagtacagatcgaagtttcttggagaatagtttgtttagttctgtatgctttctaatggcattttgaagtcctcttatcacctttattttgcaaattgtactattctcaaataacataatcgcaaaagcaaatttgctctttatcatagcattgaaattggagtacatgctttttggcttagtgtgacaacttaacattaaagcaaatcccttgacttagtatgaacatcttacattaagcaaatcccctgtcttgtgttgccgacttgccgtcatctgcactcaagaaaaaagggaacacctttgctctcaatgcacatgatatttcttcacttcagagcaataccataatctcgcaatgaaacgatgtttgcacatgcacttttccgcatcacaagattttcttctataaacatatatcaagaaaatgttactgtctacagtttgacactgaaatttagtacttcgtttgcactagtacagaagcactcatcgcccgtaatgttcctcatgatcaatgttagtctgatgatctcaaacctgcttcacatgaatggataatatgctccgcgaacaacctataccattgttagcattgccaaattgccgttgcacccggaagatgattttcttcactgtctgatgctataacaatgatgcataatcaagtagcataagctgcataattatgcaatccatctggatctgggatgatgatctgagcttcttttggaagagagtcatcatccacagtggcttcagcttcagctagcaactcgttgcagtgaatggagagggtacgtttttcttgctgaaatagcctgcaagcagaacaggaaaatgagctcaaaacatgaaatggcgtaaagacaattgagagaaaagaatattgaaacttacggattcttgcaaagcattgggctttgaactgttaaaacatatttgcaggaagagatctccttaattgaactaatcactacagtgggttctgaacatacaaatctaacctgtagaaagaaagtagcaagtgcagtcaaacatactacttaatatgacatagaaacaaaacgtttttttttttcatacctctgtttcccggggcatatcagtgagatcgcagacagtcccatttgtgtacaggtggacatgatacctgaaacatgaagaaaagagattcattcaagtgggtttagcttacagatataatttgctttatatatccttatattcgtatattacctcttagaggtgtctatcaggttatcatcttcatcagcagagtcagatgtttgattttcatagtaagcatcagttgcatcagcatcatattcacccagaacatattcttgaataacctgcaaacaacacaaactttacgtggcaattcaagtgctctagaaactgtcggctgcatttattgtcaaagataaaatattttatttttcataatgtagtgtgtaactgtggccagaacttgtctctcctgtaaaaactagcaactcttggattgacgcatctcagatattttttagatagtgcataaagaggataaaatacaatgactgatctgagcaaagaaaataaacaggatggggcagcttaccttctcgccctctacgtggacttgtcggattttcccgtagtagcaaaattcataagaccaccaaccttcatgctgtgtcaaaatagtaatagcaataatcagtttttgttcagtcaatataaaatcaggcagtggaacacatgcagttctactgaccgcataaagaaagagttctatctcaccctgtagaagcactgatccttgagaatttccagcaattcatctggatcctttggcttaactctccgttcactttctatgataacattggttgcgttttgtgggattatcgacttcatggtttttgtttcctcaacaggtaggaagcatgtataatgtttccccacgtggctagtcattggtacagattcctggccattctcctgcatagtacaccatagaagtctttgattgtgataacaggaagtgttcttggaataaagtaaagagcgacaattgctgaaaataactgaaatttttgatgagaatggaatgaaaaacacatgatttacaacaaacataatcaacattgcttagatcggaatcgtttatttatcacagctaatcactaaatctcactacagtttagacaatgcctttatattaccaacaccaaggctagtaggctacattagcaggtatgaggattgttcagatcttgctagcttcggttctaaaagatgtacacatgatcaccgagtgtgcagaatttgtgacaactaaataaagctgattattcctgtaactgtaaaacagaggaaaatttagcaaaaacttactggattaaatggcgcatcgacaggatggaactcaacatggtacctcggctcacgcgaattccgcccaaacggcgcacctgacatcggcaacaattcagtgcaattctgctttgtttttcctcttgcagcaattagagatcgaaaagtaagaaaataaatagatcatggccaaatggagttaggtccagcaaatcatcagttattagcaatttcagatcatacaagcacacaaagaacagccttcaactacagaattctagatctaggcagtaaatgaacatggccaccgtgaagcaagcagcaggcaatcataatcgaacaaaatgaataatgaaatcgacaagtattccatcaatatacgccgagaaatcgcatcgagcaagtggtgaatttggatcgagaatgacatgaagagagggacagtccatggggggcgcacgacggatcttgatttcttgccgagactccgacgcgattacctgaactggtgaagatctgatcggcggcggcagtcagagccgcagccgccgccgccgccacgacgaagagcaccacgcgcgccccgccggcgagccccatcgtcggcgacggcgcagggttctctcgacttatctcttcagcgttcgcgtgttgttggtggtggcgtttttcagtcttagacctcgaagacgtattcgctgtttccgccttctcaccccgtatacacgccgtataggaaagccgttttccctacagggaagcgctacacgatggaagcccaacttaattaacgcggatggattagttcgatgaaaaaaactgtaattagcgcgcaaactaaccaccccgcccgcgccgcgctaattctgcccgtggcggaatgcgacggttttgctgttcgggcgacgcgacgcgacgcgccacgccgcgcgcgtgcgttcgttcgtccgcagccaacttccggcgcgcctccgcgtgagcgcgcgcgcgccaccggccgcaacgccgcgcgtcctcatccatccgtggcgccaagcgggctggcgggcgggcgcggcgccgcgtgcgacagccgatggccgcgggcgcgcgcgcgcgggcggagggagcgcctatatgtttagtgcggcgcccgcttctgtcaccgccattgcagacgctcggagaggctcagagcagcagcgaggaaaggttttgcgcgagataggaggaggaggaggaggaggaggaggaggaggagcttgatcgtttgccagttcgccatggaggtcgagcgcgtggcggcggcggcgggtggtgttcacggcttgcagcgcgcgcccggtgcgatgggtggcgggacgtcgtcgctgctctccgcggcggtgcaggagatgctgatggtgcagaagagcaataaggccatcaagaagccgccgcgggcgacgccgcgcctcccgcccgtcaccggcgagcgccgcggcggaagcggcggaagcgtggacaggggggaggccacggcgccagcgccgaagcgcgcggcgcgggcgtggcagccgccggcgaagagggtcgccaggagcatgctgaggcggggcgcgccaccgtcgccggaggagaagaggaaggtcctgacctgctgctgcgcgcgcctcccgccggggctacgctgcgcgctgcaccagtgcgctcccggccaatcgtggatgcggtcgcattgcggcggcggcggcgccattgccgccaccagcgaggccgtggcgccccgggcgtgcgggcgcggcgggtggctgttcagcgagtacgcccggtggcgcaggagcgtgtggatgccgagccggttctacctagagcgcatcgacgggcaaccccgtccgccgcccggcgagctcgacgctggccgccggccgccggcgagctaaccgcgcgtagatatgtaggaatgtagcaattgttcttagcttcgtagcaatctgatgcaaatatatatcaaatacagtatgtgaaatggtgcatggatgaaatgaaacaccgtgcactgctcctattgtatttgcaacaaaaagaacaaaataagctaaaaatagttatagtacatttgcagctatatttgttgtttttttacaatttgtagaagttgaatttagtcttacatatttgtggagtgatatattttatattaatctatcttaccatttttgtcaaaaaattttataactatttaggtggcataaatgaaacgagggatatcccctcgagggatgaaatcactttcccatgtacaatgtgtcatagttatggataccacatacctaatagtagtcgactaaactcggcagggcccatcacataccatatcttatacggaaacaaacctcgtatatagaaggagttccggataaggaatgacgagtagagttctatatgaaaacgacaaggactactcagatcgtatccatatttatctacttagttctacttggacaaaggggctgggtataaatacaagcccccctaggaggagaggggacacgccacaaagccacaagccaatacaaaccaatacgctgtcagatctcgacatcagagtttagcctagacaaacccaatccggtgcctacagaagccggcaagagggatctagtgccatctctgatctcaccgagtacggattcgaggaggaagactaccctgttgtcgtctacgagttggttatctagccgccaagtcgacgacagttagatatgttatcccaaatattgtacttgtgtgattcagatgaataagagcaacgccggctccggtcaacaggatgtagggctattacctgtaagataaggggctcgaacctgtataaaaatccatgtctccatctcttttacctcaatcacatataccctagtaccaacgatcctcataccatccaaataccgtagttgcggtaccacccgtcgacacaatgtgtactgctctgtcggtccaccaatccgccgtcatgtccacagaggttgtgggggagcatgaggaggggctagctctgcgactctactcccgagacttcttgccgaaggagcagggacaacaccatagctataggtccctcgtgctggcccgcctccaacgtgactcggcgtgcgccgtggcgatgtcggcccgcgcggcgatagcggcggacggggtgaccacgttcaacctgatgctggcaaacgtcatggtattcgaggcattggcgactaagcagtggagataccgggtgacgatagagttgtatgtattgatgttgtacaacaatggttgatgaccctgtccatgattcgtagcaacgcggtaggcggtttgatccgattagatttttgacgacagttgacagtttggagtagttaaattggaccctctactagccaataccccatctgtcccaagaaatagactaatcctacctacgaacctggacatgtgtgtccaggttggtagctaggaattcgtttttttagaggacggagtagtatatgttaagtttgatgacagttattgtttagactgataactttcactccctcatttttcatgcgcacactttttaaactattaaatgatgtgttttagtaaaacttttatataggaaagttattttttaaaaatatatattaatctattttaaagttttttagcttgtacttaattaggcatgcgctaatccaccactcaattttgcgtgaagggatgaagggttttcaacctctatcatcgaacactcaattaaaatagcagcccgtatggcgggcttgtggcctacaatgttaggggccataaggagattagctcttcgatcttgtgggctctaacatgtgatgatttaatcgagagatgagaagattgcaagattgagaagatacgcaaaacgagataggtcattagtgtatgattaattcagtattaattattttaaattttaaaaatagattcatatgattttttaaaagcaactttcctatataatttttttacaaaacacaccgtttagtagttcgggaaacatactcgtggaaaacgaaacaaactttctttcctttttccactgccgaagagagcctagtcacgaaaaaagtttacaagcattggattgtttttcgtttttcatatcatctaattagtcatgtaaaaaattgataaaatagatcaatatgtggtgataattgtatcattctacgaatatttacgtttaaattctgcccacctgtatcttaagcaacgtgtggtacatgaaaaacaaggttagattgaagggtgactcggcacaaacaagtgctctacacaataataatatcctcttcgtatctaaatatttggcaccgttgactttcttaaacatgttgaacagtttgtcttattaaaaaattttaaataattattagttcctttcctataatttgattcattgttaaatatacttttacgtatacatatagttttatatatttcacaaaagttttttattaagacgaaacagcgttaaatatttatggatggatggagtaatatatattatttatcatcagtaatcagttaagtatcatactttggggcacttgagatctcaaagctaagccacctttcatcgcgcttgacgcatttcctctgaacccaatcccagctgcgcggccgcagtccaggcaggagcccacgtaggatgcctttcatcagcttgtcgcagtcttctaccgacagagacttgctctcctcgtcccacagcctcggcagccggccggcggcgagctccaccgcgacgtccgagaggcggccgacgctctccacgcgcacctcgtcggcgaagcagcagcgccactcgaacacgcgcagcctgggcgcgcgcacgcggacgcacgagtagcgggtgaagagggcgcggaaccgcggcttcaggtggtaggcggcggggtcggacgtcgccatgggctcggtgtcgcagcgacacgagacgcggagctccgccagctcgtcggcgagcacggcgatcccggccttggtggcggcgctcatcacggcgacgtcggtgacgatgaggcgcctcagccgcggcatggcggcggacgtgatgtcgatgccgccgccggccggaagcgtgcacttgacgatgtgcagctcctccagcgccgggaagacgacgccgccgccggagaggaacgactccgggcgtagcaccgccaggccgttccgcgcgagccaccggagggaggcgacgccggggccgtgcaggccgggcggccgcaccgcgtaccagtacagccgcagctgcagctcggcggtcgccggcggcagctcgagcgaccactcgccggcgtcctcgtcggggagccccctcgcgcactgcacgcccagctccagcctcgtcgcgttggccagcgcgacgaactcctccgcgtacctgcactcgaacgggacgtccttccggtaaccaatgtgaagcgttttcacggtgtcgccgccgccgcagcagcgccgctgaagcgtgcgcgccatgctctgcacgcgcggtttgctcgactcgccaagaggcgcgagaagcccctgcacggacatgctgaaccgaacgttggggagccgggtgtggagatgctgccaccgccgtgaaaccgcggcggctcgctcggcgtcggcgtaggggcacatggacaggatgggcacgaggatgtcatcggggagcttgctgatcaggtcctctttgggtttctgttccgcgggtagtgcgttactgcgctgatttgcttgccgtcgttgcgatggcttcgacacgtctcctctctttttgttctgcctcttttttccagccatgatgagatggcagcagcagacaaattagagcaggtacaatagcaggctattagccagctgtaaatatattttaatgagataaaagatgagagagaagagcagcatgctacagatatgtagccagctacagcacggattccaagacataatgtgtatatgataggtgggaccatatattagtagtaaagtaatcaactattatataaattggctattagattgactatagataaattggagctaatagtgggctataatattaaacttctcttaagatcaacgattggtgtcacttggttgggtacacgtaccaatgagactgcacgattgtattcattggctggacagatgtgttcccaattccgactcggactcaaaattcgattcgtcaggtactggaatatgaacatccaaagctcccagacccatatatactctctatcaattttctccaaaccaaactggactcggagatcaatagatcatgtcttgactgccggtggatacgatgctagtacggaccatcgacggccagcacaggcgcccacggcggggtcaatcgttgttagatagatgacgttgttgagtttttatcacacatttaacgttcttattattaaaaaaaattatgtaattataaagttttggaaaaagataaataattaaatatgtagttaaaagttaatgatatcatctttttaaaaacggagggagtacgagtgagccagaagaaagccacgttgacccaagttgttacacgcatgtcatcatggaaagactctcgctcccgcacctcactccgattattattccctccaaatccaagctcagttcgatagagctgaggacaaatatgttgattaactaaataacaattattatatatttttaaaaaatatttggttttttaataaacacctacatgtattttttttagaaaaaacgtattgtttaatagttcgagaagtatgctcagaatatagcaaaatcaaaactcacttcccaacatagccttatgcaaaacaaaatagtaagaagaaaaatagtatttcagtccactctataaataaaacatcatactccgagagtttttttagaaccggtaaaataatgattaggaaagggaaaatggaaataggacgatgtttaggatcggatgaaatgagttacgagtgacttatcaaacagtcccaaagaggtcggatactgaattttcgcgtgttacaatgatgcacgaacgtgattcgagtattcgacaggagaggtagctaggctgaatgcacacattagccgcaggtacaattagcccccttatcgtttgggcatg

SEQ ID NO: 1817 - DNA, 4269 bp, Oryza sativa
gtaattagcacgtatgattagatgtaggaacggttaccgtaaaagtgaacagagtaaattgcgttatcagttcttaaatttataacagggttttacctaaatttacaaactaggcgtgcatcgagtttattaaacttggttttccacatcatccggtctaaagtattgtttgatcgtgatcttacctgcatgacatgtcacataaataatgactggcatatttgtgataaatagttaaagactttgttcattttattgccactttaaactctattaaattttaatgttattaagttttgataggataaccaattaaacataatgttaccaaaataccaatgctatggtacccaagtcgggtagttttgaaagttttttttttcataaagactgctaccaatttttgaaaagactttgaactaaatttcttgaacggctatcaaaaatctgataggatcaaactattattaaattttgccagcaagcactgaatcccccccgcctcccccgtgccgcgttcctgccctcctcttgagcgactacgccgtcgccggccacgctttcctcctgccaatctgccccagtcccgactgcccgctccccctcgcgcccttcctgctcccgaccgacagcaccctccccgcttcctcttcagactcgactgcttcgatgatcttttgtgagtcctttgagtttttatctctcctcgaattcctgtatttttcctgcggcctaatcaaatggccgtttctatgtttttcctgtattttgcaatcctctgttttatacttgtattcctatcaaaatgctatgtttttcctattcctatgtttttccattcccgcgatgtaactatattgtctttgttattaacatttatgttcatgtctaaattgttcaaatattctgccgaatttctattggaactatataacatataaacttgttattcctaaggctttttcatctttaagattatatagttaatctctagtatttacgtgattgttgttctacgttgaagttaaccaggagtactaacaacatgagttgcaaaattttacggtacctataataaaagagtaattttatcattcttgagaagataccagaggtaccatattgtattgtctagtgtaaaatttagtacctttagatactaggtattaccaaaaattttaagtagaatttaggtacctcaaatatttttttaaggacggtaaaatttctcataataaaatttatggtctccttagtggttttcagtttaacagctttaagctgtaatttgtttctatgtatttgtgtatattcttctttgcgtctgtgtaggctagctgtggcgttcaagaaggcacttgggtctagcaattgccaaacgggccatagtacaaggaaatggactggattgttttttttttcttttccactgggcgatgccggccggaatttatgaagattatgagaaattggcacatatgaacaaacaacaagcctgatgtattcaatacagtagacaacacctatcaaatttgcaagatacctggctctacctttcatccttcgtttttgatcgtgtggcttccaatttcgactgtcaattgtcatatagtcagttactatgcaggatagtagaatggagaacgtttattcagttatactagtatcttgctaatacctgccttttgtttgaggattctaccaggtcaaatctataatcgaagggtgtgtttagttcacacaaaaattgaaagtttgattgatattggaacgatgtgatggaaaagttgaaagtttatgtgtgtaggaaagttttaatgtaatgaaaaagtggaagtttgaagaaaaagttggaaactaaaccaaaccgaagtcgagatggaaggatgggccttttctgtcggccttaccagacggctgcgaaacgaggggagtgtgatggtagtggtttatatgtgtacagaaaccgagaaacaaaggcatgtggagtatccctccgtccttaaaaaaactaatttttagagatgaatctggacaagcatttgtttagattcatctttagaagttatttttttagacgaagtttttagatctgaaagcatatgacaaacaccaaaagaaaggacagatatcattcatcatccagataacatcgctttccagcctctcacaaatgctcagtggaagcacaaaaaattattctcaatgaccacttgtgatagtctatgatttgccctgtctttagccttgatatgccatttgaatgacattttctgcaccaatgacaaaaaaggagatgaattaggaaaaatgcaaaagaaattgcacatttggggaaaccatccgctgaatatgtacttacctcagatgtacttaaggcacctcggccttcttcagcctctcgacggtgaacttggcactggtgagaatcagctcatcattgtcgccgtagccctcgaacccatccttggagaagtgcaactcatgctgatccccattgacctgtcaacagagaaacatcagtgaacaatggatttcatcaaaatttctggagcttttttttttaagaaaatgagataaacccggcctctatgtctaatcggacgcacacagccaaaccaaaatttctggagctaaagtgctgaacttcaccttgttggcaatccagtagggtgccgggctgaaagcgatagggatgtgtccatcgcaatggattaacatcaccatgttcttggaatcaggggtgagggctttccccttgccgggtatgagggagactgagcccagggagccacagtccttgcactacattcaaacaaacagatggaagcaaaaatttagaaaccacaactaacagatggaaatgaaagaagaaaatgcatccatacagtatgtcacaggtcggatagcacatcacgaatgccatctgacctagatggtgagggcaggggtgatctgggaacagacagatctccttggcagtctccccacggcagacgtcgcatgtcaactgcagatcaaatgaaacaaatattaccacctaattaactgttaacctataaggaggatgttttattggagaatgcaaaatagaaatggttccagttaattagcttaacagctagatcaaagaaggttgaatatgtgagtgtgttgattatttttttgttaaactgctaaatttttggtactaaatataagtaacggaatccaccagaatcctacgtcccacagcacacaatacattaaactactactaccattcatatgaacaagtgaacaatttttttttctgctaaagataagtaatccatcagaaaaacgcggcgaatccaagcagctggccagggtgttcttcgcaactttttttttaacacgcgcttcgtatttttttttctactaggcctgtggaaagaaagagatgcaacgggccaaaatcagcccaaccaaacagctcctaagacagatcaaacaccaaatctttttttaaaacaaactaacactttgatcagccccaaaactaccacgaatcagtaccactaccaacgacgacatggcacacagggagttcatcctggaacggaaagaaagggatcgattattattcgtatgtacctgaagatagtaggcagtggctgtaccgtcgaaccctcccatgggttccacacggacgatcccatccatgaccacctcgccgaacagcgcgtagtacggcatggtgacgcgacggcggccggcggcgatggcactcatggcgagatgcttccaagaagagcgtgggctgcgtgacgtacgtgaccgtctcaaggcaagggctgttcttattttcaaagtttcgtggctatcaagtcgttggtcgagcagagggggtgaaaaggttacaaggaggttacatgttgtcagcggcggtcggcgacacgcatacagtgccacattaactgctttagagctcctttaacctgttaatcgcggctgttgttttttccctgcaatttggccttctcaacccagggtaaacccgttttcccttcagggacgcgtcacgtgtttgaaacccaacttaattaacgtggagcggatggattagctcggtgatgaaagaacggtaattaacgtgaatgcggttttgctgttcgggcgacgcgccgcgccgcgtgcagagtgttcgtccgcagccaacttccggcacgcctccgcgtgagcgcgcgcgcgcgccaccggccgcaacgccgcgcgccctgatccatccgcccgcgaaaacggataatc

SEQ ID NO: 1818 - DNA, 9545 bp, Oryza sativa
atctgggcgcggcgccgcgtgcggcagccgatggccgcgcgcgcgcctacgtatatgtttctgtcgccgccattgcagcgcagacgtgctcagagcagcgaagcgaggtgagattttgggcgagataggaggaggaacgtgatcggttgctcggctcggcatggaggtggagcacgcggcggcggcgggtgctattcacggcttgcagcagcagccgccgagcgcggcgtcgctggccagggccagctctggagtagggccataaggacgatggcctagggccaagctaaaatggggggatcctgtatagatatttagcccaataggctagaattgatccttctcactgattagaattgatgatccaatccatcgatccttctcactgattagaattgatcggttcttctaatttattttttgttccccgttaaattaccaagattagggacttagggttctaccgttctgggttcaaccgttcaagagattatacaaccattcagtgcaccataagtccataagctaattaaattaaggtatatggtggatcagttttcattaggcctaggcccttgattatatacatttttccctcactgattttaggtcatagtactttgtttctactgtgtgttttttaagttatcaatcatactatcgatattatttatcgagaacaaattgttatattgcaacttgcaaactgtttgatttattatttaacatgttagaaatgtttatttctgttactatagtatagatgctttatagatattacaagttaaaaaatagccttaacttcttaacttctaaagggtctataatgtgaagttcgcctagggccctttaaaatgttgaaccggccctagtcgctgctctccgcggcggtgcaggagatgctgatggttcacaatagcgataagaccatcaagaagccgccgcaggcgacgccggcgagctaaccgcgcgtagatgtaggaatgcagcgattgttcttagcttcgtagcaatctgatgcaaatatcaaatacaatgtgtgaaatggtgcatgaatgaaacgaaacaccatgcactgctcctattgtatttgcaatgtatatacggagagttcaaacaagattagccattctgtctcgtttcaaggtgacaacacgaatgaaaatgacttggaaaaacaaaaactcataaaaagtcgagctggattatagtactgacacatagcccaaaatgccattttctaaagcagctagcacagtactaattgttcaccgttaaccattgttttatcgtgatatacgtcaccatacttaatccaaatccaacatggtctaaaaatcgtccatcctaatatcctgtggacttgagatgatggtatcgcgcatcactgtgccgttatttcttgcaattttgaggagttcgatatgcacgattctgtagtgatatgggctgttagtaaaatatccaagtgaaagggcacccttttgctaatatagggtgtgttcagtttgatgccaaaactaaccccgccatttttttaatgccaacaattgataagatataactatacaacatgataaactaaagattattttaccaatgctacattgtaactcagaaacttctatcataataaaagtttgagaagagatcaacctaaatacatctaatgctactgtataatttggtaccagcaaaatatgctaaaacttggtattaccgaattctggtaaattttggtatcatatgacgtgttacagtatttgagacatgtttatgttgttacttacgaaaatttgggattgtcaatgccagagaaaatggatatttagccatgttcaaaacacggtttcgctagaatgccatcccgaaaatgcgattcgataaaatgccaatatgaagcgtgcgtctaccgccactttggcatttttgccattttattcattttcgaaaagattttctctcatctactaggtgatgagataaaattgccccttatcaactcagtcgaagctcgtcattgtcggggaaggtggcggcggtgggcaccggaggtcgcgccgttgcccgtgcccatcgtcgaagaagtggttggtagagggcgccgccgtccggctgtggatgcggctgcccaaggccgtggtggctctcagcggcggccttcctcactggctccaccgacgaagtcgtcaccaccgccccaatctcccactacctccacctcctccgctcccttcaagccgtccccaccgaccgcctccaccatgcggcgccaccgttacgttgcccactgccaccgcccgcggccccaatcttgtcgagctccggtgagttgcaagtggcggtggaccttgccatgcctatgctgcgcgtcgtcgccgccgccgccgccatgctctcgctcgccgcctcctctgctccggccacgtggacccaccatcgggacgccacctcgcactcctcgttcgtccgcctccaacgctcactcgcgcgatcccgccgcgtggacctcgtacaccgggcgctcctgcagcggccttcctctcggctctcctcgagggccgccagctgcacgcactcgccgccaagctcggcctcgccccgtcccacaccatcgtcgacgcccttgtcagcaacgaagaccacctcgccgcgctcgatctcgatcccctttcagccgacgagcaggggcaatttggtctcatcaagctgaattctagcgaaaatggaattgaaaatgacgaaaatagagaaaatgacaaagtggctatgattgcgtgtttcatattagcattttagtgaaacacgtttttaggatggcattccaactaagccgctttttgaacgtggccaaatatccattttctcgtcaatgccacggcatgtttgagttagcaaaaactgaacacgataaaaatagagcaatttgtacaaatgcgacaaatagaggtgtcgaaatgaaaatttcccttctagcgaagagaaggagaagcacgcacgcagcacgtgaacttccagctctaaacccttccccctctcttgttccaagcccctcctccccttacccccccgccgccgccgccgccgccgcctcatcacccgaaaccctagccccattcgccgcggtcgccgcctcacccgaaaccctagccccattcgccgccggggtcgcggcctcaggagcggaggccatggaggacgtctgcgaggggaaggacttctccttccccgcggaggaggagcgcgtgctcaagctgtggtcggagctcgacgccttccacgagcagctccgccgcacgaagggcggcgaggagttcatcttctacgacgggcccccgttcgccaccggcctcccgcactatggccacatcctcgcgggcacaatcaaggacgtggtcacccgccaccagtcgatgcgcggccgccacgtctcccgccgcttcgggtgggactgccatggcctccccgtcgagttcgagatcgacaagcagctcggcatcaccaaccggcagcaggtgttcgacctcggtatcggcaagtacaacgagacctgccgcggcatcgtcaccaagtatgtcgccgaatgggaggccgtcgtcacgcgcacggggaggtggatcgacttcaaagacgactacaaaaccatggacataaatttcatggagtccgtttggtgggttttctcgcagctctgggagaaagacctcgtctacaagggtttcaaggttaaatttctgatctcacgcctgattaggttttgagtctcggggtttgctttgcatatttattatgatttagttgctacaaagtggacaagctgaggcggtagggaacctgaaattttatggtattcagaagtatgcaatggttaactgtattttttattagaatttggaatttatatgtgtggagaatggaattgttctggtatgtctcaatgagaagaatgaatagcagagtttaggttacatggaagtggcttttcattttgtagataatgctattgtgattacatgaaataattgattggtttttatctgttgtttctgttaatggatttatttttatgaggaatttcttgaaagttaaagtgtcctgggctcttgttcttgtcccaggtgatgccttacagtacaggatgcaagactgcactatcaaactttgaggccgcacttgactatagggttggttattgactttgttcatgtcgtagctcataaattttctatgcaatttgtagtaacttctttttatgatgccatagactgtcccagatccagcaatcatggtgtctttccctattatcggtgatgcggacaatgcagcacttgttgcatggactacaactccctggacacttccaagcaacttagccttgtgtgtcaatgccaatcttgtgtatgtcaaggttagtacttctcctttatttccttgggctatttttccattctttaactttagactatagctgtcaagtttacccactgttaacatcatacatacaaaacttgattttacaaggaacagaactttcactgatgatatattaagcaaaaaaaccagtgaaatactcttgaggaatcttctcgctagtaaatccaaaatgtgcagaagttttgaactctggatgttatgtaaactaatgcatacataatgctatacacaatagatcattggtttctgtgttatattgcattaagtggctgtcttgtttatcctataatcattttgctgcacatacatgatgcttgtccttattttagtggatatctcctgggatcttatagtagtttcccagttcccgcaaataatttaattgctgcatccggttaatccatatttatcagtatagagaaccatgtaccagtcaatctagcagctgcaactgccctgttcttactgtttgcgaaaaaacattttagaccctttttgtttaacttaatgatgcattcttgcattacttatttctttttttgtgataaatcgatcaaattgattgtagaagaaagacattatcgactattgtttcctattctgctccatgtctagaccaccccattcatttagtcagaaaaaaactatacaactgtcacccttctctgcttgtaagttgatgttttcttctgttgaggatgtgtactgtgttgcgaacaggttaaggacaagtcaactggagcagtgtatgttgttgctgaatctaggcttgggcaattgccagccaaggctaaatcatctggaaagaagcaagcaccttctaagggaggcactgctgaagttgttcagggtggattggatactgaagcatatgaattattggcaaagtttccaggatcatccttagtaggcctaaagtgagtgctctgtcttcctaatcatataatactttcatagtttattattagtttcccatgacattatgaaagttaaatgcatgttaacactatctgtgctaggaagcatttcactgaactagtgaacagtttctgaaagtagatatcggagttatgtgtgtgagatgatgcttttccttaagttgttaaccatgtttggttttgttggacttgcttttttctgggcagggctgaataatccacatcacttgttatttgaatttttcatgcaacgtttatatatctctatgcttttggagagatcattttggttgctactcaaacaatgtgtaccacttgtgtagtttagttttataattggtgaactttgttttgtgcggtaatatcagtaatgcttagttggtatacactagaggattggatccaaaatctgcaattttccttctttttttttttggcttttgtctgttgttatattaataaaatcttaaccacgggccctcccctgctgtttttcagttttaaaaaaaagcttagttgattactcctgatacttgttttctagatgttaatagaacaatacggaacatgccatactgccatagccaatttggagtatatatctggggcgcttcctgtttttaactgttacttttcctacttgcagatacaaacctctgttcgattttttcttggagctccaagagactgcctttagggtgatagcggataactacgtaactgatgatagtggaactggtgttgtccattgtgctcctgcttttggtgaagatgaccaccgtgtttgtcttgctgctggtatcattgaggttggaaaaattctcctttactgtttgggtatttaaactaactatcatgctgccaagaccttggaggttgagacagttgacctatcaatctactaaatatgcatattctccatatttccattactttgtgttgtagtctagaatatgtacttttatatattttctgtgtcaagctttattaaattatctaagggcttttttggcaacaattgggaaagggagtgtgagtttagaggagggagtttatggtgggttagtcatgcggatttgtttttatttactccagtttttttcctgatgtctgtttcatatccaggccagtgggcttgttgtcgccgttgatgatgatggctgcttcattgaaaagatatctgagttcagtgggcgatatgtcaaagaggctgacagggatatcatcaactctgttaaggtaagctgttgtttcagtattccttggaccatttactgtatgtaacacatttacattttagttgcctacttgtttatgtggactattatctatagattttggatttgattaataaattagtgccgtaggacattgcattatatagattctcatgctagtatgtaccggaataatgtcaggacctgtatgtgcattttatgcattatcatgttaattgtctggatgaccttgaagtgggtgcacacaaaaggaaatcagatgtatagcataaagtttctcaatgtatgtctgcactctgtggattgcaccttcgtaaatcataactcataagcagttttggttgatattatagcagcatatttattgcatatgttggatagttttatatccctgaggatgtcattctgaagattataaactttgtgaacaggataaaggaagacttgtcagtaaagggagcattgaacactcttatccattttgctggcgctcgggcactcctcttatttaccgggctgtcccaagctggtaagcatctactgctgctaccatgcaaatttgttagtcggtgtcttctttaccctttgagttatatataattctctatccatctggttgtttagcacaaatggtaatgcagtccatcttatacttgtaacacatgtacatgatgtaccctccgccccaacatataacaacttctaacattcaaaatttgtcccaaaatataacaacttttgcacctacattatctttttaaatcaatcacaaccttccaccttttaatttctccacctacttcctttttttcaaccaatcacaaccttctctccatttaatttcacctgctttcttaatacccgtgtacaaccccaaaactcatattttgggacggagatagtagaagttacttcaatttaacttcatcatgttttaattccatctagatgaacgaatgtggctttcttttgaatctttgtggttcctatttgttggttttgttcatctgtcttttatggtcattgttgttttcctgttccattacctgtttttatttgagaaatgtatgcctgaaagagcttttctgtaggtttgtgaaggttgaaaagattagggaccagttgctggaatgtaacaagcagacctattgggttccagattatgttaaggtactctatcttttcttgtttgtcacacaaagtaattagctaatgctctattacaaaattggataaggtttgcactggtttttgttgcatatcacctagatttgccatcaatgacattgatagcttattttctatgatagttctgtttcatgtcttaccatttattgtttgcaatatttgcatcgaatgtctataattgaactggtaatatgaaacttgcagagtttacgttagcagctgttgcgagcgttgagtttacgttatcagctggtatatttaacttgatatatttgttaacaacaaatgtatgcaggaaaagcggttccataattggctagaaggtgctagggattgggctgttagcagaagtagattctgggggactccactaccgctgtggatcagccaagatggtgaagaaattgttgttatggattccattgagaaacttgaacggttatctggtgtcaaggttgatatctctactatgctatgatccactcttgcaaatattttttttagaaaacagtaattatattctcatatggttctcttttgcttggtcaacattgcttttggtcccttcaataatcaattgctatttctgcatgtcctgaacaaattattttctgaaattatatgaccaggttaatgatcttcaccgacactatgttgatggtatcacgattccctctagcagaggtccggagtatggggtgctcaaacgagttgaggatgtaagtcattgctttgtattttatacctacaactaggattcctactattgcagtaaatatcgtttctagtgacctctaaatatggatgcaatttggcagttatgttttagtactattcttgatttttcttatgaaataggattaaaccatattggtcgaagtccttgaaatattttttagggcttgtggcagtgcacacatttgtctaattgttgcccatttgagataatagacctgatggcatgtgagtgctactcctgcgtcactgttagtgatctctaatatgagtgaaatttgaaatatatcacagtttttgtcaccaatattctttagttatgtttgtaccagttaattccttgaattaccttttctttttaggatcagtgaaactgttttggtgagaaatccttgtgtctgattgcaccaatttgtcttattattggctaataaattgatgtagcattaaatagtaccttgtttttgcttaggttgtttctactctgtaggactcaagttcatttagaagtctttgagtttatgtacaaatagtccctccatttcaatttacttgtcgctctagcaaatctcacactaaactagaagctgtagcatattacattgctaccatcgttaattcttacatcctaatcatctttcccaaagcaagcattaaaattccttgtgaggagtgctagtactagtatgactgcattgatgaaaggtaggaagggaaagacgtatctaaaaatgctttggaatgtgagaacgacaagtattttgacaaaaaaaaaaagaatgctataatgaccaagtaaatggaaacaaagggagtagctaactgctgaatgccataaggtcactcgctatttctgcttgtttagttgcattgttatacatgtgatgtatgtgaacgtttttgcctctgaagtctgaactgctatagatatgaatgcttgtgtatatcagttcttttaaatgtttcttacttaacactgctgtgatgtcttcaggtttttgactgctggttt

SEQ ID NO: 1819 - DNA, 1204 bp, Oryza sativa
ttttagggtgcattttcttcttttgcagttcatttatgaccttggatgatatttcatgattatgtaccatgtattcttgtaacatacctatacagatcatgaatgatgaaagtggaacaattagttacacttaccttgaattcatttttgcttgttcagaaggcatgtgatgttattcatgaattattatggttgaccatggattgtctgtagtagttttgatagcagttttttctttcttcaataatattttacactttttgggagaaaaaacagtatcctatgctattttatgttttatctgggttaactggtagcaatgatctggtgttgattaaaagaattctgtaatgcttgtgcttttatcacgtttactttatgagattttggtgggcaaaaactaaattcagttcctgctaatgatattagtggaatccttgtgtattgtgttctaaaatgtgtatgatgctttgttatatgcatattcattaattatatctatcatatttatggtttgatgtcatcctgcaggttctatactttgatggtgttatcaacagctttatttgggaaacctgcatttaaaaatctgatatgcaatggtcttgtattagctgaggatggtaagaaaatgagcaagagtaaaaagaattacccttcacctgtagaagtcatcgatgaatacggagcggtatgtggcatatttttaaagatatgaatgctttattgtatattctgtatcattttctgtctgaagacacatgcaatgacttgaggcttgcaattgcatggtatgtctgagttagaatttgcaatttaatttattgttttcttttatttccaggatgctttgagactgtatttgataaattctccagttgtacgagcggagtctctacggttcaaaaggagtggtgtttttggtgttgtaagtgtcctttctcagtatattggatactatctgtctttctgaggaaaataacattgcttcaaatttgtgttgtttaaaattgaacaggtgaaagatgtcttcctgccgtggtataatgcgtatagatttcttgtacaaaatgccaagagacttgaaattgagggattctcagcattttctccaatagatcaagcctcacttctgaagtcatcaaatgttctagatcactggataaactctgcaactgaaagtctagtcagttttgttcaccag

SEQ ID NO: 1820 - DNA, 19043 bp, Oryza sativa
  unsure (1)..(19043): unsure at all n locations
attttataaatggacatgtttcttcagtgttgagtcttgacatactttactttccaatatacagtatgtcatggaagaaatgaatgttaagactgtcactccatgtaatgatcccatgttgtatgcttctctccgggcagaacccaattttaggtatgtgtacctaatagcgtgagaaactttgcatttttttttatctactgctcagcacttgtgttattttcttagtgtgctaggaaaaagactgggaaaggacatgggcaaagtgtcaaatgaagtgaagaaaatgacacaggaacagatcttagcctttgaacaaagtggagaaatttcattctttggtcattgcttgaagttagacgatattaaggtaacattccatgcttctgatggatgttaatttaaaggtttaaatgattgcttgcatgtcagttttgaagattaatatttggtaattgtgctagtatatgttctcagaatgatatgttagtaagattatattgatttgctttttacatatattgtaaaatacaaacacatcatttccaagttctgctttggcatttccagatcatatctgtctagcaaatggtttgcaagcacacctattctaaaaattagatttgacatttgttttattttgggggcattatttctgatcatcatgatgaatgacatgatgctacactttagtttgcacaggtttgcatttagtggacttatttttccaacctgctgcatctttaattctctgaaacattttaccctctaggtgatccggcaatttaaacgtcctgcaaatgtggcagagaatgaaattgatgctgcgggagatggtatgtcaaatatgtttccatatgagtagtttgtatgctatctgtctattttgtcatattatcattactttttttttcatgtaggtgatgtgttagtcgttttggatcttcgagctgatcaatcattgtttgaagctggagttgctcgagaggtaattaactatatgatttgtgtactcctgggtatgacaccctggagtactgagaattatgtgttagtagtatttttgcactggttgatgcctgaatttggtaatctttacctgacctatgtcatgtctgacttcatgttgctatgaacttccagcggctgtttgattgcatacgttttctctgttgtcagtcataagtttgatgttcatgatctgggctaataattcttgagcatttctgtccaggttgtgaacagaatccagaagttacgaaagacagcgcaacttgagccgacagacttagttgatgtatattacaaacctatggacgatggcaagaatactctagtagagattgtgcagtcacaggtcagctaaattggcataagtaattggttcttgtttcataaatcagaacatccttaatgaaagctactgtaattctgttcaggatcagtatataagggatgctcttggcaatccactaattccaaagatggcggcgccaccagatgcagtgagtttggatattctccctgtttcagtttactgttaactgacttttatctctatcaattggaggatttgatttttcttacatgaacaccaagttatatgcactatcatcaccaccaattggtgttgacacgagttgaaatggatataaaacatttaatctcattgtcatttgtctggtttggcaggtaatgatctgtgaggagtctcacaatgtacaagacatgtcgtttgtcatttacattgcaagggtttctccagtggtcacagatgatctccttgtccatgccgctggtaaatacaaccttatctgatagggtgtacttgtctattttcgttgttaatgtcttggcattctctttgttatattctgcatggtaacataagtgtctactttgatggaacaggcaaccgtgagcattttgatgcattaaaagtatatttactgtcaaggtctatttccagattgaagaatgaattccaggctgggaatggcaaggtaaatctacaacttctactgaacttttttcagaatacttgttcttcatgccttaaattgcctttgttcttacagattacggtggatttcattgaaggcttcccaccaattgatctccagctgggaaaacatgtttttcttagtacaggagatttctacctggctactcgttcttgatttttctttcaagcatcccaattttgagtgatttatctttttttttactgcaatcattttaccccgggccctattctatttgtgcccacaaagcaatgtatgtggtttcatctgccatgaaagaatgaaaggggtactatcatattgaatggtctaatcgaaaactcgtgtatgctgtactgaatactgatacacccgtgttcatgtggctacacaccgattatttaattgtgccaatagcggttaaagcattcagttaattgtctttactacaccaatatgagttgacgtgtgtgaagtgggaatattttggagaaattcatcgaacttgtccaaactatttcacctccgttttatgtcattctttgaagggaatcctgtgccgtctatgcctgtctgttgttaccaagctggatatatcctcgtaccctcgtggggcccttctctctgtcaagcattgacgtgactggccgttctgttggacagcatcataattcataaccgtcattttcagtagctttgccagtgatactggcctgccatttgaacatgcgctggctagagagcctgaccaagtaggcaatggtcagtggtcacccaacgattgtacccccaactgctgctatatttcgagctatactattttcttccaacagattggtgtcatccaagtccatgccatggcattttccctttttagtctaaaataatagcgcctttacatcgacggacatcattatataggagtactaacgatgtctgctgtgcaatgttaactggttaagaggggacaagcttatgcctttgtcggtcatcctgaagttctatttaagctcatgaggaacacaaatcatgcgaatgtttgttagacaagtccttgtaattcagcggttacttttcgcataatcttgcgatgaacaaacgttaacagccatgaatatgtaacgtaataaatcatgcatgtagcacattgcaggcttgcagccaattgccgggaacgagagagaattcatcagttgttaactttacttgatcgacagagatcctgccttgtgctaaaaaaaattgaaaaaataattcatagttatgcagtgggtattcgatcaatcgcgtacactaaattcctttgaccttcaattaatctcactcaaaacatttgcgctcgatattattatcgtctaaactcatggcaaatagacacgtacacattaccatcctaattaagctctcgcaccacaaagagagatgtaaaaattctctcacaaaaagctacacacaaactcgcgaattaatcaaattgcctcaactcaatcacgtcggcttcaggtcctggaacatggagtcccacttgatctcgacgtcggtgccgccgccgccgccgccgtcggagcaccgttcctcctcggcatcctcgtcgccgccctcggctccgtcgccgcaccgcgcttcctcctcgtggtcgtagtcgtcgtcctcctcctcgtagcagtcgtggaacatcaggctcgccttctgcgaccccgagaaccggccggcggcgaagccgacgccgcccctcgcggcggtggcgccgccgtcggtgatcatgagcaccatcttcttgacgctcctcctcctcctcgtcgccgccgcctgcactgcccccacgcggacggcgtcgtcgccgctgcatatcctcggcaccacggtcaccgacgaccccctccctccaccgacaccccgcggtcgcgccagccgccgcgcgcaccgcgcgatgcacctcccggccttgcgcgcgatcagctgcgcgtacgacgacgacgaggagtcgccaccgcctgcgtcggcggcggaggaggagtccttcttggcgagcttgaggatctcgaggcggtgcttggcgacggcgatgcccatgctcttgaggaggtcgtggtcgaagtgcgcggcgtcgccgcgctccagctcgttctggttgaagaggcggccgtactcgtacgccagcgccggcgccaacccggtcttcgccagccacgcgtaccaatccatctccacctctctcttcttgcaccttagctcacttgcagtttcacttgctcactactaccaaattatactactactactactgctcatcgtgtgtgcagctcagctgcatatatagcgaaggaggaagaagcatgcagctgcagctgcacggctcggctcacatgctatactactattactagtttattactgcacatcgttgcaatggcagctactaaataaattgggctcgtatttatatctttaaggcaaatcttgactttttttttatactatttggagtttcatggggcttggccggtttcttgacaagactacaagatccaacacaaccgtttgggtctttggaccggtttcggggagcctctgttaggtgcaggcctgcggcttcttacataatcagaaacttcaccaaacaatctaacttttcacgcagattttgacaaaaagaactacttactccgtttcacaatgtaagttattctagcatttttcacattcatattgacattaatgaatctaaacgtataaatctatatagatttactaacattaatatgaatgtgggaaatgctagaatgacttacattgtgaaacggagggagtagttactaacaagcaacttctcagaattttagactatcttaaataggtcatttaaactttgttacactgtaacctttctcaaataggccatttgaactctggtacactggacagcagcgatcgatcgaggtgtagaagtagtagatcttaagccaaaaggagacacaaaaacgccaaagctgtcagcctgatccgatgcaaatcgctcatcacatgcatgcccctgcaaaaaggggagtactatacgatatctgatggctttcgcttctaccgcgtatcagtgcagagatgtttgttagtaggagtatttgttaattaaatgagcacttgcattagttgcattggcctttatggttcaagttcgtgatggtttcatttaagacctaaattaatctcatctattcagttgagattttcttttcttttctttttggttgtaataatgtcactacttgagagtcgatatggaggcaggatgatggccgatgtgttatgtggaccacgcatggatacgtaaatgctgaaaggacgcgaataaagcggtgacaaagtgtggcaggttcagaagatggtagggactgcatgtttgttactactgttgctgttactacacgttcacgtcggattggcagtaataaaatcacagagagaggccataaattacatgaaaggatgtagtattatttgctgatactactacagtattattataccatcctagtactactccctccgggttgataataattatcgttttggacaatggcatagtctcaaaaaaaaaaaacttcggccattattttctattataatatgtataaaaatattaacaaatatatgatcttattaaaatacattttaagactaatctatacatgtagtcaccatatttgaaagataaatattttaaaaatgattgataatcaaatattctaaagtttgacctcacccttattcaaaacgacaagtattatcagtccggagggagtatatctcaagagactgtatagactcatggttttaggatttgtcaaattcaacttaatttttttatattttgggatttatggagtagcatgtatagggggagaaatttaaactgagcaagtctttggaatctctccatgtggacctttttcttgtctgtcttgtagctatagctcggctatgagcgttcaaaaaggtcacaagattaggtcattaggcatgggtaaaagggcaattaagtgtgcagtaaacaaagtttgtgtgtggtggtaaacagggagtggttggaatcttagggtgatcctagctgcgtcaaacaaatgctactaccgctctactgcaagcttgtttttgtatgcgtgatgtctgaaaaagatcttacctttctgagtttcataattctgaaaattgcgtagtactttgtactattttctcgaggctatatatactctaaacagaataataaaagatactagtagaattcgagagtcaaacagcaccctagtgctacgtactagtgttagtaaatgttaacaacacatataggttgcgacttttgtatgatcgtatattaaagggtagtggaatagctctggctttgcaatggactctttggccgttgatcgtagaaacttattgcctggtggctattcacatgatcaaatcacaggaaaaggataaatcagacctggcttttcttgtccgagaggtgaaagacttgttagctggaaatagggagattagaattgtcaagggccatcgtaaccaaaatcgtgtaagccataccttagcaaataaggcacgatgtgagtctatgtctaaattttggcctaagaatagttgtaatttcatctcacacattgattgtgaggagtaatatattcccttttccccgcaaaaaaaaatagtggattccgtcattcatgtatttttcttcttttaaatccaatgtaaataatgttacaaacttaatttttttaaaagaagataatatagagtatagttgtatttagcactccactaaaaatcaagtttaaatttgacctacacattaagaaataaaaaaaatctgtgtatctcaacgtgtgagttgagtttgtactaaaatgctacgaactgatatgtacattttgtatgaatgttattaaggctgtgtttagttcctgaaaaaagttagaagtttggggaaagttgaaagtttaaaaaaaaaagttggaaatttatgtgtgtaggaaagttttggatgtgatgtgatgtgatgaaaagttgaaagttttaggtagttgggggtgaactaaagacggtctaatttttccttagaatttttcatgatagcagtacaagctctgaaggcccctcacttggcgcatgcagtcaagcgatgacgcgtgagatgaattaagcctactagcgtgcctgtcctgtcgtctcccacccacacacctaaggtccgtgcccgtggctagcttatagctgcaggtacgcgtcgcgcaccgtgagcccccgtgtttcgagtgatcgatcagcgccaaatcctgccacccatgcgcatctaccaacaacccgcgcgcgagcgagacttgcgtgccgcgagagtcgcgcgacgtacggcttcggcggcgtacgtgttgtattgtgcgtaggcgcgtcaaaattaaggcgggggcgtcgcgcgcggtggcttcccagaggatcattgcgcccgcgcacttgctgtcgcgaacgctggccggcggcccggccccggcccacacggctagcccaccggacgtacttcctccggttccataattgtttacgatttaaataaagttaagatacctttttataatttcaactatcaataactatctatctatctatatctatatctatctatctatctatctatctattatattattaaaacaactttgaaaggaggcaccacgttcgctgtaggggctagaaattcctacattaatcgaagaaaaagaaaaaaaaaagaaaaggaaagaccaagtagaaatacaatctaaaaatagctgaaattcaaaattaaaaataagcaatatttaaataagagtccatataagaacccaatacgagattaatcaaaattcaaaataaaaaataaaataaaatccgaaattagaaaaaaaaatagagtccaagtagaaatacagtttaaaaatagctgaaattcgaaattaaaaataagcaatattaaaagaagtttccatataagaaacccaatacgagagattaatcaaaattcgaaataaaaataaaataaaatctaaaattaaaaaaaaaaggatagtccaagtaggaatacaattttaaaatagctaaaattcggaattaaaaatatgaaatattaaaagaagagtccatataagaacacaatacgagattaattaaaattgggaataaaaataaaaataaaatccgaaattagcaaaaaaaaaaaagagttcaaataggagtacaatttaaaattagctgaaattcggaattaaaaaaaataatattgaaagaagaatccacataagaacccaatatgtgattaattaagattcagaataaaaaataaataatatccaaaattaggaaaattaagagagagttcaagtaggaatacaattttgaaacaactgaaatctgtactattaaaaattgaagatgtttttgccggtataaaagaacagaaaaaaaggagaaaaagaacttctatgtaaaaaaaaacgtccgactccataaaaaaagtccgactatctgtggagaaaaaaaggcaagaaaaaataaaaaaaagagaaaaaaaaacttctaccgtataaaaaaataaaaaggtccgattcctgtacgattgcctcgaaaaaggactttttgtccgtaatcttctcttctcttctacttctactatttttttaaaagaaacctctactattataaaaaatttaagatgttcttttgtcggtattttggtatgtcatccgtgtatgagtcggtttataaatttgttcgcttttgaaaaaatatatatcctttgagttgatttttaagttcgtccgcttttggaaatataggagtcgtataaaaaaattcgcatgctgactttagacaaacagactcctaaccacagcttatgattttatagaaatatatagatccaagcgaattctcacagtgaattaagactaaaatagttgtcacccgttgcagcgcacgggcttttctcttgaaaataaaaaataaaaatattaaaagaacacaatacgatattaattaaaatttgaaaaaaaaattctaaaattacaaaatgaaaaataagttttcaatttggaatacaatttataaatagctaaagtttatgataaaaataaagactattgaaagaaaagaccatctaaaagacatgacgagataaattaagtaacaggcctataatagagtagagtggtggcggttgatacaacatataaaaactgttaataaaacaccaaatagaatactaataacgattaaaacaagggacggtagaaaggccgtgaagcaaacgaacaaggtgattgctgggacttctaaaaagtaaaaaaaaaaaccccaatgataatcatattcgatttttaaaatctcaatgataataaaaaggagaagcagtgggcggggtgtacaggagtatagttgcagagccgccaacggttgacgggacttctaggaaataaaaaatgaattccaacgatagttatgttcaatttttaaaatcacaatgacaataaagagtaggcggcatacgggccatagaggagcatagtggcatcgtgtgacgagacttctaaaaattataaaaaataaaacccaacaagacaatatactctaaaaactacaaggttcaatttttaaaggttcggaacttctaaaaagtaaaaaaaacaatgataatcatgtttgattttaaaatctcaatgataataaagaagggagacagcgggcgagccgtagagaaatacaatggcaaagccgctgacggtttggcgggacttctagaaagtaaaaatgaacccaaacaataattatgttcgatttttaaaatctcaatgacaataaagagaagagatagtggacggaccatagaggagtataatagcaacgtttgacgggacgcctaaaaattataaaaacgaaacccaacgtgacaaaaaaaactctaaaaactataagatccaatttttaaaggttccaagaagaatgaatagaaatagtggtagatcgaacaagcaaataaagaaggagatgtcataaggggtagcaactggtgtgacttttaaaaaactatataattagaaacacgggaatgataaggtttggtctttcaaactcttaagacaatgagatagctatttaataaattttaagtaaaatcatactaaaaatatatgattttgtttaggtgctagccgcgcaattgcgcgggccacacagctagtttagtttattaaaggcactaaaccaatatcatatatagatttatcatcttagggtaaactgcattttgaatcaccttttattacctaagttttattttggattaccctctatccaatcttttcacattaggcttggttattttacctttgttgtgctttagaccaccatttttttttgaatggttattttttttttacggtagaccaccctaacacttttgtatagcaacatcaaacctctcatttaataaagatgtgaattgcacgtaaatagggaatattgttgccatgagagtgtgtttgattctgttgttgtgctcgcgaagagagtttgcacagtccaaaatgaaaaatggtaaaaaaaataaaactagttcaaagtgagaagattagatagagggtgatccaaattaaatgaaacttaggtaaacaaaagtggcttaaagtacaattcactctttatcttatgagtattataataaaaataaaaacgtattaatttattatatatatattataatagaaaaatatatttaaacacatatttcgaagatcgtgttactatttaaagcgtcaagaagaattatggaacctggttactagtacaagtggccggtcttgtctcatgagatggagaaatatggagtgttatggtgtctgtggttgtggatatgttatatatactcctaacgtacagctgcatttccgtcaactattgagcgacacatgtattaatttatggtggaaggcccgtccctaattaaggtccctaatctggcctctagcattatcagattatccatgctcgctacatctcctggatatgggtgggggttggggttttcatttctttcatccacaaagggccctagctgctgctgctgcatgccgcctttgccgctatgatgcatcctgccgtccagtttacatgcgtgttgagcgtacattaccacgaatgttcgtttcccttccccctaaaaagcaatgcatttttttcttcttataaaatgctacggttgctacgcattttcaggcataccattaattaaaaggataaagaaatcgttatatctatcattattatattatgtaaagagaaagctactgaaaaaaaacggtattaccccgtccaagaatgtaagaatttttaaagttcgaaacggtcattaagaaagtagttagagttaaatgataaaagattatgattgattaagaagtggatgtaggtgaaaaattgaatggtgaagtgttataattggttgagaaaaaaatgttgacggagaagttattatattttggaacaaattatgttgttatattcgaagacaaagagaggagttgctaagagtctgacatgggaagggtctatttagcacaactccagctctagctcccaccttttctaagcgaaactgggtagagtgttatcataaaataagctagagagatagagtagagtatagacctgctccacaatttcactccaaaacccaactctcctgaaacaaaatttaggagttggagctcttaaaaaacaggcccgaatgtcacgggtttcccgtctttcgtcaacgagcccagcgttgtcccgtgatcacacgaacgcgaaaagggccaagtcctgccagctacggcccacgtctagattgatccaaagcaatagagcccacgccatttggcgagaacgccgaaaagctcgaggcccacaagtcagtcgagtccaaattttcgcacctccaccgccgccttcctcgatctggagaagctttccccttctcctccgccatctccatgggagcgcgcgaacgggggcggggttaggtttccggcggccgatcgagcgggctctccgtataggaccgcgcggcggtggcgatcggcgaagtgccgtcgccatgtgcgttcgattttgagctctctgcttctgtttgattctctttcgccatttttcgggtgcgagttggtctcgatcgatctcgacgcgtggtgtcccctgctgccggcgatagggttttgatgtgtgggtcctgcagtttctgaggccgtctccggcggccgccgccgccatgatccggtccaatcttccgcggcacgactgcgaggagaggacgcctttattttttattttttattttttaggtggagatcatttgccactatccatagttcacgtctgcattctttttattttttgttgctgattcccgtagtttttgcgatgttttgggctaatgattcaattctacgtgtgatccatggtgtgctgctttccgatcatcgcaatgggcgccagatcaatcggataccctgttgtgttttgttgtctagggctaatgaataggatcggcgaaatgttagaaaccaaagaggcagtgcttctcgacgtgggcgagcacgatattgcattttctcaaactacacacttctttcacgaaatcatttcaagctgtacaatgtataacctgtatggtcgatggagatcattaatcagtacaatataataatcatcgaagcactaaacacatcctaaactgctcaacacgcgtggcagcgtcccaaggtgttcgacactgtaccatccatccatccatccatggcgatgtcttcttctacctcgccatcctgccgctgtcgcctcgccggtacggccgccgggggctcttgagcagcgacttctcctcgatggggaacctgtacggcgacacctggaaccgcctcgtctcgctccgccgccgccgctcctgtgagtgcgccacccacgcggccacggcggccgccacggcgacggacacggcgagcagcgcctggtacaccctgccgctgtgccgccgcagccccgggcagtgcgccgccgtcaccgcctggaacgcgcgccgcacgtacgagcagtcggcgaggtcggcgaggacggggccgtactgggtcagcccggcgctggcgttggcggcggcgaccatctggtcgtacatcgtcggcgtgaggcggccggtggtggcgcacacctccgacgacggcgccgcccccgtggcgcggcacacgtagccccgccacgcccgcggcgcgtcggcggcggcgacctcgccggcggcgcaggcgcggtcggagaggtcgccgttgtaggggttgcagaggagcggcacgggggtcccggactggcggtagctggccggcggcgacggcggcgacgacgcggggacgttggcgttggcgacggtggcgaggaggttgttgagcacggagacgatctggtagttgacctccttgctccggcggagcgcgtccgacgtcgcggcggcgtcgacgcaggggaggatgtcgtcgagcgccgtgtggccctgcgggtggagcacccactcgtccatggccacgcacgtgtcgcccaccgcgctgcgagcacgacgaagcagagcagagctcgtgttagtgtcttaatgattcagatttaactgatatctgctatcttaaaatatagtcgttctcctctcatcccaccgtcctaacgtgttcagtgcgtacgtgaaaagtaatactccccctacgtttcagaatataaatattttaaaagttagacgtagttattaagaaagttgatagaactaaatggagaagtgttgtgattggagaagaaatgaaggtatgtgggaaaattgaacggtggagtattgtgattggttgagaagagaatgttaatgaagaagttgttatattttgaaacgaattctaaaaactaaaagttactatattttagaaccgaaagagtatcatttatctctaattatatagacctagcctattaacacaccgacataccgactcctaatctacccctaattatatggggttgacccattataacatacaagcatgtaactagtcaatgtaaagactgagatgcaaagtgttccagtacgtctggttcatacaaaaaaattttaacttttcagaagcagaatattccacttcagtaaatttgtttttttttgccgactaaatttactcaatccattttagaatatcaaaatctcacctttttttcaaattatatttaatcaagcaatatatttaacaagacagtaacaagggagaacaacttacttgtgcaagagaagaaaagtgccggacagtatgaatgttgcagtaactagaatccatccaaaaatcaccaagctgcagaagaactgaaggttacaaacttgcagtaaaaaaaaattttgtactatatacaagtctatgtacgttctgtgatgttgtacttacgtgtatactagtgatttcagcccgcacagggagaacactgcaccaaaatcgaacaagaatttgtcaattatttactcgaatacagaaacaaacgaatttgacaaaattcaccaaaaccagcaaagaaatctttatgctcaccaagcccaagaaacgccaaggccagcatcacggcggcaacaacgatgaggattgtccttctgcgatcacgagaagaaggcaaacagaatgtcaaacgagatcttcttgatgatggaagtgacgaggtcatggcgtccaccaagaaaatctcacacatacatggtctccagcgcggtgcggatcttgcgggagttagtggtggtgcgcgcggcgaggtcgtcggcggaggcgtccacccggcgcacgacgtcgtcgaccttcccctggaggtcggcggggagggtggccttctccacggcggccgccttcgccgcctcgatgaaaccgctgaagccgcgcaggctcgccaccgcgccgtccgactggttgacgacgaaccgcagcgtcgccgtcgtgctcccgtggaacttcccctgcccgtcgtacagcacgatgcacccgattctgcacccacagcgacggcggcggcgtccaaaattagaaattactccgtccgtttcgtattataggtcgttttgattttatttatcaaacttatttaaatttaactaaatttataaaaagatatagtagcatttccacaaacaaatatattatcaaaatatatttagatttgactaaatttataaagagatatagtatcatttctaatgcaaaacaaatatatttaatgctagttttaatgaagcagatgttgctaaactttttgtataaatttgatcaaacttatactagaaaaaaaatctgaacagttttgtactttgtaatatgaaatggcttggagaggagaaatggttttacatggcgacggcggtgaagacgaggaggagcgcgagggagacggcgaagatggcgcgggagtaggagtaaccgccgttgccgttgccgccgccggcgccagagcagcagcagcggcagcagcaggcgacgaacgcggcgagcgcgagggaggcgaaccagacggccgcgacaacgaacaccggcgccgcgctgaacccgaccgactgcgcgcgcgcggcgacaagcatagcaaaactcgacggcgtcagcatcaagaaccaggcaggaagaacagtagaacaccaaggtgatcgcattgcgagctgaaatttatcacggaaatgaggagctcacggcgaggtagtgcttgtcgctgatgttccagccgccggtgtagtacctcagcccgcggagtggatccttccgccgcgtctgcgccgccgccagcacgaacgccgacgacgagttcgtccgcgacaccgccgctgcaaacacggcacgccaccatcgatcgatcgatcaatctccacgccttccatttcatcaaagaaacaaaactactcaagaaccctctcacctgcagcgctggcaaagaacgacgacgcgaagacgaacagcaggaggagagctcgccggcgaggcgacgacgacgacgacgacaccatggctgctccggcctacggagctcgagctcaagctcccgagcaaatgctttgtttgatcagggatgcggggtgacgtgagtagaacaggtcgcggactcgtggaattgtaatgttttggttgtcgcgtgcatagatatggtcaattggtcatatgctcgtgagatttaagcccaaggacttgccaggtcttcgtctactactgccattatttttttactaaaagcaagagaataaaattataaaaatggtttagtcgtgagcagccgcgtcccgcgttaagcggtgctcttttggagtagacaaatgcatgccagtttgctggttcgtactgctagatgctagtacacgttttagttgttttttgtactattatattagatgtgatctgaccatgcaaaaattgagtatctgggccattatgaaattggcttggactaagccgtcgttcgttgtcatgatcggacggtccagacagccctcgtacacttcaaagattttctttcagctaagagcatctggagcaggtgcttcagagctagggaattgttgtatagtttacttggcaggtcagcatcttaaaaattctatactctaaactcaactcctcttgagccatcagtacattcagcaagtaggagaaagggacttgattgtttaatggatgattacttgttgttctgttgctacaacatcacaaaccaaaaaccaaaggtatgaaactatgaactgcaccatccaatgatatcgttgagcggtgaatactcattcaaagcatgcaacatcaaatacatcatcatctggcagcaactcaaacaacttgtactgccggtacaccatctctcacgttacagttacaattacaggttttgacttcgcatagttgcatggtaagcctctaatcatgcaggatttgaagggaccttcaccaatcaggttagaccgggtacaacctttagcacatgctttgacgtgttgcacctttgactcatggttagatgccattcacataggatgtaatgctacaacatcagaatttgagacacccaaggccatggatatggacaaaaaattacatcgctacatttttacagcaagaggccaatagttacagtgggccctcaatgtctaacctagagtttgtgtacattccaactcccaactcccaataccaacaagaggcaaaatagttggaattggggatcccaggtataccatagccagagcctaaaatgaaaaattctacaggtgctcttcccccctcctacaggtcagcattacagcatctaagttagaatatagcaagatctaaatgccatatctggttagtgtgcactagtcctcgatcgcgtattccgcatcatctagcacatccgcgctttcctcaagaagataatcacacaactccaagagctcatcagcaagcggagggatgtggggatggcggttaagattgtatgtatgtgcattcagtgctatctgagccacatcatgcctaaaatcctccctatttttatactccatctttcgcaccttgtcccttatagtaccaagatccattggacgctcaattatgtcaaagtaatcaggagcctctttcttcgtcaccggtttacggaaaaggaatgaacagctcattgtccgcaagtggtcaactattttttccaatatgttggagagctcaacctgcatcagtatgcaaacaaataaattaagtttaaattcatagtcttgcaaaaaaaacaacaatggattatctgcattatccgacctatatctcacaaatgggtatcacatcccttgtagcaaaatgcgggtgtctatatgttaaaaaactaaagatgaacgtgccaaaagagaattaataaagatgatgatgttgacggggatgatcaaactgaatattgatcaaaacaaactattttgttgagaacgcacaacacaatgggacagtttagttgagaaaaactagtcccaactctctaaaggtgaataacaaaaccaagcacgacgctggttgaaaggctatcatacaattattttgccctttctcaatttctacaaacaataagttgcagaaacaggtatctctggtggcggaattacaaaaaggtctaacataccaacattgctaaaacaatgcataatcctattaaaacagggttgagaacaagtacctctcctcctctgtgccgcttagctggtggtgtgtattctgtcatatcagctggggtacgtctctttgccgctcgacctctttcaggtacccttctgtcatttttgtatggcctaggatcaagtaggtcatcatctcgaaattcatgttttttctttttcttgtttttcttctttgccttctggagctcatcctctctccttgcatcatatatcctagcttcaattagtctctgttcttgtctctctcgttgctcctcaaaagctctccaggattcactactttccattattcctttgcttctttttcccaccagaccccaccccctatcatgtgaggaattgatctgaataggttgtccagaaaaaccattatcatcctctctgtctctcttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1821 - DNA, 471 bp, Oryza sativa
cgtcgccttggtatccacgcggggcggagaagttcccaactcctcctgaaatgatcttttcttgctccttagcatctattacgtaatattttgggggtactctatgcattaaaaaaatcctaattagattgtatgttttgctggtactttgtagtatttcacaaagacattttgttaatcatgaatgcaggcacttgtaacaacttgtgtggcgatggctccatttacacccttctttactgaaactctctatcaaaacctacgaaaggtgtcaactaaaccagaggatagtattcatttctgcagtttcccttccacaactggggaggtaattcttatctaaacctgtactatgctttattccacccgtattacttgtgacttcatgttgattttttttgcttcatgatcagagagatgagcgtgttgagcaaagtgtaaacagaatgatgaccatcattgatcttgccc

SEQ ID NO: 1822 - DNA, 3220 bp, Oryza sativa
tactcaacgatttaggtaatgtgccacttaggcctgaaacattcaagtacttcaatagactcaaatgactgatcgagtctggtagttcattgatggtgcatgcactgaaatctaagatgcgcaagaatttagtttctgaataattcttgggagatttcctgcaatccttgaaatgaagcgctcttgctgtattgggcaatatgggatctcgggaaaattcactcaaattcaagaggtacatgtagcggcagcaatttttagtgttggagctactgcagtcactggcatgaaagatacatacttcatcagctgcaattacacttgcaagatcgtgaactatatcatgcatcttgagtacattttgaggctcagtatatcgtgcagacatctgaaaaattaagtttagtcacttgacagagtaggataaataaaacagcaagacagacacattctttctatgcatgataacgaatgcattttatatggtgtgaaactaaccaaactcagcacataaaatggttagaagcttatccggagttcaaattcaatttggccgtcgtttcttaatactagatgcgtacgaccaaggtgcagccgtctacaacaggcatttcttcttcttctttttcattacacgggcacacaccactccaccagcacaccacactcacggacacaaaccacatctgacacctccatgaatacaccccttaacacatactcaaagagacaaagactagcgtcaactccctagcctcaataaaatcctattgaatgtgcgcccacatgtacataatacttaacctgatgggtggtgttactcatgactccatcaccaaaccactgctgcttgcatttgatgcatcaaatttatgtgctactcatttaatctcagtacaaatagctatgaaaaaactgaaaaaaaaaatagtaacattggtacaatattcatctaacatttcgcaagatttttaaatccaaatatcatagcatgtcaacaaaaagacaatattccaattatccaattagtttcaggattaaatttggattgaacttgttggtgcatgcatatgttttattctgatttcaagctttaggcttttttcatgactttgggcccaaaattttagcccaatggtggaagatctggctaggctgcccatgaataagtctattcaacagaagtagactgccaaagctaagcattttttgtgtcctgtgtgcatccaccaccatgttgtggacacctccacagcaaccaaagtgaaaggagggagcgtcaagcttatcaattccatttcaatattagccagagtagttggtatttatcattccactaacaaaaatagtatgcaacaagtgatgcgtctttccattctaaatattggtcaaatttcaattgggtattgaccattgacataccactagtttcggtaccattccgagcaaaagtgatccttccattgaattccgcttactcgattccttcaaattacatttatctataaactcatttttctctatcatatttgttccgattaccaccatttttacatataatatcatgtgaaattttgataaaatattgtataataatactatttggaaatcaatcgaatgggaaaaaagagagaaaaagagttgcggctgaggaagcataccgcagttgccgcgttcacattctgcaaaaaggacatttcaatgagttcttgcaagcagtactctgcgtattgttctgtcgggatggattctgggggctgaatgaatccaagagcaatccattgctgaatcaaactgctcttctgtatgtgggagcccttggggaagactgacaaatatgcaaagcacaacctcagagaacaaggcatgctgtaataactaagcttcaagttggctataactccgttatctggaaaacgatcatctttttcggcccatatattactatgtaggttttgttcccactcagtcggacgcattcttcctagaaagtaaccaagggattttacagctaatggcaaaccttggcatttctccactattgtctcccgcatcgcttccacgtagggaggcactggtgtcggtactcgtgcttttttcctgaacaaggtccagcagtcttcgtttggtagaagacccaattcaatttgcaaatctttgttcattcggtcagcaaccttcttgctacgtgtagtcacaataaccttgctacctttcttgcagagtctaagcattgcctctaactcatccagcttaaaattattttcttcccagagatcatccaaaacaataagacatcgtttttccgtgaggatagactccacagcaacattatgaattccagaatcaccatattggagcgtatggctattacattgctgtttgatagataaactgattgcattaagatcaaatttctcagacacataaacccatgctagcatctcaaaagctatctgtgttgtgcagtcactaaaagccatttgagcaagagtggttttacctaatcctccaagtccatatataggaataatggagtgttcttcatctgatagcagcagatccattattctccctttctccgcgatccttccgacagtatcctcactgctgtatcttctaggctctaaatgccgactgatataagaatcctgctcctctgtggcaccatctaccttaaagctggtgagatccatttctttctttattccttcaagtcttctcctcatcttcttcatctcccttggcaagttatatcgtgacttcaatttttcaggaaagctcgaccattcctgtcagttagcaaacacaaagttagactgaaaaatcgcatttaaacgagaaatcatgatcaggaaggatgctgacatgtctgagagaaccatcatggccatcgttggagctcgattcataaacggccagcctatcctctatgtcataggctacggccttgagtttcttcagcaagtcgcgaacgctgccatccgtctgcgatttcctctccgcatcgttcagcttcgcttggaggctgctcagcatgctcttgatggcttctagatcatctctgaaggtcacctgagacatgatcgtgttccaaatcggagagcccagcttccccgatagttccttgatcaccgcggaggcgataatctctccgaacccaaccatggcggcaaaacaggaacgaggaaagcaagtcaacgcgcaccggaagtctccc

SEQ ID NO: 1823 - DNA, 15667 bp, Oryza sativa
cccccccccccccccccccttccctcaggctccaagcccttctaagctagcgtctcggattcaccacgcactgagtcactgacctctctccgccttgcccctcgagcagccgctcctctaggcttgttccgcggctgggtgggctgccggggagacgacggcggaggctcaccggcgaagatggccggagggaaggtgtgggcgtgcggcggcgcttgggagaatggtggctgggaagggatgcccggcaccggcgacgccgtccgcacgatgaagttgtttgattttgagatgaatggggatcgatttctgatgggaagctcttcttcatcaagtgaagaagttgtttgaattttgagatgaatggtgaggagtcgattagttgctgcgattaatatccgagtcgccggcagaaaatcactactccagtatggactatggagtactactatttattcttatttttattgatggtagtgctgatgattggcaaccagggtcttcgattccgacgaaatccggtaagatttcgcgaaattttgatgttttgacgaggctcgaaagtaaaaaccgtatgagattttgagaagtttcatttaaattcaaatttgaattgataaaaaaagaataaatcaaataaaatcttataaatattatgatattcatagaacctattgggatataaattttcgaaaaaaataatgtattatgtgtatttactgaaacttacatcaggaaagaaaagaataaaaaattaaaccgaaaagcagcagtatttgacaagaactccatccgaaatttcgatgatttcgatcggaatttcgccaaaaccgaccagtttttgagaatttgtcggcaaatttagagaatttgtattcaaattttggtttatgaaatttgttcggaatttattggtttttcaccgaatttcgcgaaatttcaaattccgccagtggccaaaacgaaagggtctatcggaatcgtaaaccctgttggcaatatgaatgatagagtgtagatgtaattcctcgtttcaaaataaatttctaacaaacctatcaaaaaaaatgtgacactatctatcatatccagaaatttagatttatttatttaggataaagaaaatataagatactgcctccatttcatattattacctccgtttcatattataaaactttctagcattgcccacattcatatagttattaatggatctaggcacacatatatatttagattcattaccatatatatgaatgtgagtctgctagaaagtcttataatatgaaacgaacgaagcaagaaaggaggaaaatatagtatacaaaataatactataattctctatcttaaaacaaaagcaagcacacgcactactacgtcattttagctaaagtattttacttcaataattcaagacaactcaaacttagttggcacacatgtactccaccccctatcactagagttgttttcttttttgtacaagatcatcctaacattcccacaaggacataaagaaacagcagaaccttcccgggaaaatttcactgagacaggtgcattccgtgcacgtacaataatcatcaccatcatcgtatcatccaacctacaggaaaacgcaaattcaaggtactcttgtccaaacctgtaggtggccagtgatttgctcccatcggctacaactaccagactcaaaaaaactagacacaggtatgatgctaataagcttagcatgatcgactgatggacagacagtaataacaaataggaaacggagggaactatatgtgtcaactcgatgaactctataatatatggatgatttccagcgccctcctggcaaaaataacgtcctcgtaaatctatcgtcaccatctaaaaccacttgaagaggatgcctccatgggtggcgaagaacggggcaaacacgagcgactcgacagccatcagcttgatgaggatgttgagcgaggggcctgaggtgtccttgagaggatccccaatggtgtcgccgatcacagcagccttgtggcagtctgagcctttcgggcccagggtccttgcatgctcagatgcaccagcctaaaaccagggagaacgagagttataatgtttggcgaatatgggaggggaaaaaaactgcttgacgtcaagtgttgctgtgatggaagatggctgataagttcttacctcaatgtacttctttgcgttgtcccaggcaccaccagtgtttgatgcagagatggcaatctgaaaggaagcaacatggttatgaatgcaatatggcaagagtaagtgatgagagtgtggctgtgaaaaagaatgtgcgaacctgaacaccagaaacgagagcaccagcaagtagtcctgagagggtctcgacaccaaagaagatcccaacaatgagagggctgagcatgacaagagcacctgggggaatcatctccttgatggatgcatcagtggagatcttcacacaggttgcgtagtcaggcttggttgtgccctccatgagcccagggatggagttgaactgcctacggacttcctccaccatcttgagcgctgcgctgccaacactcttcatggtcatagcagagaaccagtatgggagcatagcaccaacaatcagtccaatgaaaactttaggtgtcagaacatcgacagtggagatggcggcacggctcacaaaggcaccaaagagggcaagagacaccaaggctgccgagccaatggcgaaaccctacaagtacaatcatggagatgggaattaactttaaaattgtgacatttgtaacaaaaggaaaaatatttacaagtgcaaacacaattttaaatttttaattgacttcagagtggaaatgaagcataaaaacaacataaaaacactttcgacaagataagcagttttaccttcccgatggcagcagtggtgtttcctgcagcatccagagcatcagttctctcacgaattctgtgactcatgccagccatctcagcaattcctccagcattgtcactgatagggccataggcatcaatggcaagaccagttgcaattgtgctaagcattccaagggcagccacagctacaccgtacattgcggcaaggctgaagctgaggaaaatactaaaagcaatagcaaaaataggaataatgacagatttgtatcccagagcaaggccaaagatgacattagtagcagctccggttctgcaggaatcagcaacgtcttggacagggctggacaagggaaattcaaggtgtgagggacatgagggactagaagcaaatatataagattacagacaacattgaatatgatcagacttataagcacctgtaggcgttgcttgtgtaatactctgtcacaaatccgatgattagtccagcccaaagaccaaccgccacacacaagaaaagttgcctatcaaaatcagggaaatgaggtcaatgattttaacaatgaagttctaagtaaaagatggaattccaatttaaatatgggcataccagttatacacagtcttctgggcaccaaagttgaatattgtgaaggaatatgggaggcctaaccaactgacaagtgcaatgccaaccgtcatcacaacggtggaaattataagttgcttcttgagggcaggctcaatttcatcaacagccttgatctcaaaaaaatcagtggcgaaaagtgtggttatcagacaagcaatgataccaactgagctaatcaggagcgggtacagcataggagtgaattcatggttaattccaaaagaagagattgaagcaacgacaagagcagcacaagatgactcagcataggaaccaaagagatctgaccccattccagcaatatctccaacattgtcaccaacattatctgcaatgacctgcaaaaggaggaagaaatgatcattcttgcatgcacataaattcctatcgatgttttaatgctttgctcaataacacaaatcattatgaaaagaacaaaacaaattatttcaagtaatattaagaaacaagtttttaaagcgtcaggaaagaattcttacagctgggtttcttgggtcatcttcagggatattcctttctactttcccaactaggtcagcaccaacatcagcagctttcgtgtaaataccgccacctacacggccaaatagggccatagaagaaccaccaagaccatacccagtgatagcctcaaaaagaccttcccagtcatcaccataataaattccgaacaagttgatggcaatgtaaagaacaacaaggccacttgcagcaagcaggaaacccatgacagcaccagagcggaaagcagtaatgaatgccttcccaacacccttccttgcctcaagggttgtcctggcatttgcataagttgcaatcttcattccaaggaaaccagatacaagagaggtgactgcaccaagcacaaaggcaacagtactgaagatagcatttgcaagggcaggcttgcacatcctatccttgctgtagtggcaaggttgactctttgtgctgaatccctcaacagatccaaggaagaggaagatcaggaccgcgaaaatgcccatgaatagtccaacatacttgtattcagtgaagaggaaagaagttgctcctgtttacagtttaaaaaaaacagtatttagatcatagacgcatacaaatatacaacaattagtcaatgacaagaaaaggttagcgataacaataataatagctgaaacataaaacaccaaagctagcaacgcataaatatgtttataattagaactgaacctgtttttctaattgtagtgtttgactggactccataaacatgagcaccaaaatatggtaacaaaggctaaattaaatagtgaaatagatgggactttggtcactggtcagtaacccaatatctcaaatatccaaccaattgaaaccaacaaaaatgtatttgattaaacaaagttccaatcctagaaagtttccacaaaaccagattcacaaattacaaaccatgcaaactattagcatatctagcatttcctgtgaaacagatcatatgcatagcaggactccacaagtaaggcacactaactgcaagccctatagtcttctaagaaagaaatgttgaccaaacaaatatttccaaaaatacgtttgaactttactagaaaaggacagaacctaacactttcacaatattaaaactcacccaagcatcgctagagatgaaacctgccaagaaagcaggcgcctaacataggacaaactacataaatcaccacctctcagcctgcaactgtccttgaattataaccttacatgtaaggtttatgattaatgaatggaccacaagatcgtcccgtccatgtgcgccgcatctaggattccttccaagctaggtggatacagtcaaaatgaaactattttctccctgcttcaataatgcaggtgcgcagaaaaatcgttatcttcttatcctcctaagagcaataagtaggaccactggtccaataacttgtcctcctccatcagtaaattctcctatccccacagcatggccaccgcagggctttacgtgagggcctctaagaactgagcaattcaagttctgatctaccccactaaaaatatctccccaataaaatatctcagcagacgcaacaaacgaacttaattgacccgcgattagcacgcactgactaagaattattataacatgtgctgtgtaaagtgggaacatgattgtttaatgtttctgtagatccaactaacaatgtaacagttcacatctagcatactagcatagttgtagtttcgaaaatactatgcatacgatttctgcgtacgattctagtatgatttctaactgatggtgaacgccgtgcgtgcatcactagaaaacaggagacaaacgttacgggctttcgctggaaatcgttagtcgtacaagtatcgtacgtgaaaaatcgtatgtgtagcagctctcgttatagtttaggcacacagtaaattcaatcaaactcagagaggaatctcatgattccacacaatagaatactactttagccacagtaaattcgatagaactcagaggaatctcatgatttcacacaataaataaagtaacacaagctcacaagcactactgctagacacgcaactccgcttgattaaaagcagcgccatcttaacctgagctttataatctcttcacagcaatataaaaatataaatcctgtgctgcaaattccccacaattatatcaatcttgtgctgcaaattccccataattgatgctcggataagctacttttgaacatgttcacgccacaagcaaccaaaaaaaaacaactaaattagcaaaaattagcgccagtaaccgctgcgacggcacgagatctacacaactacgcgcgtgctcagatccacccaaaaaaggccaaaaaaaaaaacacgaacagcacacgggggtgagtcagtccccctccctcaccttcggagatggcgtgctggatctcggagcacttctcgacgacgttgtgctcgttgagcccctcctcctcctcgatgaggtactcgctggcggcgccgccgtccttcccggcggccgcgccgggggacccctccccgccgcgccgctccgcggtcatcttcaccttggacaccagcacccactgcaccaccgcgaacgcgatgccgaccacggccgccgccgggaccagcacctgcgtcgccaggtccggcagtatcgccgccattgctacctgcgagatcctcgcgctaggattcatgtactctcctcttctcggaggaggattcgacgcgaagaggaggaggagaggagaggagaggaggtgggaggaggcggggttttataaggagaggaagggggagaagaagtgtactgtagtagtactactcctacggtggggaaggtggagggtattttcgtaatttttcagtcgttcggattcttgactaatttgactgtattttttagtgggtgatttctcgtgtttatccggatgaaacggagcaattcgggggttataatttaagctatttgattcaacggaaattcatataaattttagacgattttatttctataggaattttttctataaaactctttgaatcaaaggaatgaaccctatggaatcctatgaaatttctatgaaatgactctttcaatataagttttggaggaattttaacaagaggtagaacctcatgaaaaaaatcatttgagtctttatctcttctcaaattccggtatttttcctgtttttcctgtgttttacaatcctctgttttccacttacattctatcagaatcttatgtttttcctatttctctgtttttttattcatgtgattcaaaggggccctagtagtaccagtagtactttttataaacagtactagtactaagtgagtatggttttatcgtagtgatacgtagtgttgttttgagttgaagcacgtacgataggtttgtgggtttatcgtatcagcaatgaacatttgtatgaccttattttggcataaacgcgtaataagatcactggtctctcgtaaataatttaattaatcgtattgcatcagaattactttgtttctcaacttctttaacttttcaatatcaattgagttggttggtttgaactcctgccgttcaaacaaaccttgtactacgtctcacctaatctgacgtgtattagcgtgtaggaatactgtttttttttaccgtgttttaggataaggaagtggataatggataaacacaccggcaaagctcttccttctttcccggagatttctccctattttttttctctcgaatgacacttaacgaaaatattttactacgagagattacgagacgaagacatcggagtacgtgcagaaagcttggttaatttctctcgtacaccaactcgttgaataattcggcctaatagcctaaagaatgggagataatcatcgttgatcgaggtgatcttctggccggtgatgactcatcactgactcgactcgatcatgagttagtttaatggtgaaattgaccggttacagacatctggtttgaataacgaacatctttattttttctcatcaacctaaatccgcacacgggacacacggcacggtacaattttgactcgcattgttcgtgccgatttcgcgttaattacagtagtagcagtacaccatctccgttttaaaatataaaagtttctaaaattagacgtggatacttaaaaaaataaaattaaatatgagaagaatgtaattgttaagaggagaaagtagatgagtatttaaatggtgaaatattataatttgttgagacgagaatttaagtgaagaagttattatatttcagaacaaattttgaatattttggcatgagggagtagctagacagtagtagaactagtgtaggagtatagtcttaagaaaacgatagtactaatatgtcgtgatatattaagaccctctttgtttaggcttataagccaacttataagtcgaaaagtctaagcctaaacaaacaagcagcttttccgtttggcttttttgaagccataagccactctaacactattaagccaaaagctaggttgaagaagcttttttggcttatgtgaggtagatgtatgactcaaccactaaacttaggacattaaatccaccggcttataaatcatataagccaataaactaacttaaaagtctagaccaataagtctaagcctaaataaagaggacctaaatgtaaattagttccgggatcgacagataaaaagaagcataaatgatggacgaggtgagccggcagagcgaattaattccacgtggaacttcacccttcaatagtaattccatccattatccactatagtagatatcgcttttgcaaaagttagctgatgcacggcatgcacgctgatgtagcggcacttatctgagatgattgaaatgtcaaaaccagacctttgttaagtagattaagctattgtaaaatctagtacaggtaactagtaaatgtactgcagatgatggttataagtattatattcttttgacaccagtgattaaccattcatccctattatctataagcaatgcctctaagttgatgcaattttcagagagagaagaagaactgaaagctttcaccacctcctattgcagctttagtaagagtaaaaggcatctttcaattataaagagtggaaattactgtcaccaccaccagtaggtcgagtaaaaagcatttttcaaaaaaaaaaaagtggaacaattactgtcaccaccaccaatagactttagcaagagtaaaaagagcgtaattaatatctgatttaatctgtatggacatggagcccaaaagatgatgcatgcatggtccctggtgatagcttgccttacaactctgcacacacctacaatatgattgcattagcatgcagccaccagatggatgctttcatggagcaatgtgcatgcatgcatatttggttgttgttatactatactactcctactcaattatttggactctttgaagcatctcacaaatcaatgtcggtgctagagacgtgtaacactgaatatattttggaatccacttggagagctttgctgcagttcacacaaccatggatccatcaattatagctggatttggattaactattcctagctagttgaatagttaaatcaaagaagctatgtatgcaaaattaacaaaggccgggtttagttccaaactttttcttcaagctttcaacttttccattacatcaaaatttttctacacacacaaactttcaacttttctgtcacattatttcaatttcaaccaaactttcaatttagcgtgaactaaacacacccaaaaggtgtgagagatgtgcaagatcaagctcaaatggtatcctatacaacagagcatgtgcttagcttaatttaatcgtgtcttgttatgtaaccacgcacactagtactgtactgtactgtactggacagcaatttatttgagtattagtagctaggaagcagggggatcagtggttgttaaggggaagtagtgagaagagatgaaattaaaggatgtaatcacatgctgcatgctgctggtgaggagtaattattttacaaaggctgtcattggtttggtttgaaggaaacatcacttgcatagctggaattgaagcagtcgtcctaatattaggtagatctaggtccagatggaccagatttatgacaatttctttatacacattaagatacaaaatacaggcatgctgcaattatacatgacaaataataaggcaccaaaatagcaacctttacttctcttatacagaaagataatatgacacccacatatatccaaaccaaaataaatgccaattaaccatctccaaccttgcgaaaaagaaacgcttaactcaaactgctcaatgaaatcgatcggcacatgttcattaatatcagtgatagttttgttgctaatgacagcaggggcagatctacggttctaggaccgatgtcaggctacatcaacgactttcgacaaaatatataacaaaactgcttattcatatgttataatataattagcatactatgacaccgataggcacgttatgatatcaacgaatcgatttttccgccacttaatgacaggcaaaaacactacagataaaacaaagtacaatgaagctttcaaacaacctactggcgagcaaaaaacgttttctaaaatgataacacaaaaatttgtgatgcagatggcagtaccaatgaattcagaaatacagttggcactgagttgtaacttgtaatgttcgacaacaaacaacaattcgaatgcgactcggtggcgaatttgaaacaatagatccagccaacaaagaacaattcctgtagtatagtgcagctagctgtgcaaaagctttgctccataaatgcatattggaacacttcacatgtagttgggtgcaaggaaaattggatcaagaagaagatcccatttctcatgtgagcatatgccttgtgacttgtgagatgctagttaagtagtaacatgtaccatctcatagattaacacaaagtaaagcatatggttcacacttatgcatagagataatctctcacacacatcagcacacatccatggatggtaggcaggtctaagatatttttttccttgtttattgcatggatttggatttatatactaatcataatttaatctttttgcaatggtaggtgagacacttgatggtgatgttctgtctatactctctctagattcatgggagcaacccattttccatcacgatgttgccgacactttcttctctacaaggaagaataaagaaagatacagatggtaaatacagcacggcatacagatggtcagatttggagggaagcctaactgcaataattcgggttcatgtagagctgtatcagtatgactaaatcagcaagtcagaaactaagctgcttgggagaaaattttaaatacgagtactttccttgtcttctttagcggttatgaaagagagctggccaaaaaattgacaaaaaggacatgacaattgatcctaaaatcaaattttatgctgatgctttcccaacttcccaagcaggacatgtttttctacaaatgaatgaattaactcttataaagttaaaaaatagatttaaaatattttctaagaaattcatatacatagaaagtttatatcaaaatcgcaccgtttaggagcccacgcagcacgccactgaatggaatggttccatttcttagaaaataaggcagatcccattgtcttttcctatttgcttgctcctgttatgctccattttactgaagatttgagagtcaatataatggatggtcatggtctcatggaagaaaagagatcccagtaggtattttatccgtccattgtcagtactgatgagtagagtacagcaagtggactgaaggagcaattggtacagctcaattgctcaaatactatcttttttttttcttctaccactactatcttcatttgatcatttccttgtcacagccattactgctgctgcaagtggtctcctattttttatatattcttgtgaactttcttaaggaatatattccaggtttccagcaaaagaaaaaggtcaattgggacgaagaaaaggcagaaaaaaaatgccatgatcctttttgcacgtagcttgcatgggacgccatcgttgaagatgatatctttgcttgcaatggcaagctcggaccactataaacgatcagggtcccatgcatcatacctcctccaatcccccaaactcagacgaagatgacgatgacgaggccatttttgcgaaagaatcagtcgaattggctaaaatacaaatgccaggagacaaattagtccaaatccaaattcaaaatgatgggggtttgtgtctggttgttagaatttgtcttgtgttcttgattcttcagcacaaaaggttgtgtgattctgtgaatgggacacatcattttcatgaggtgcaaggtaggtgtgatctggttcaggcggctcctggttcttttggtgccttatctttttcaggccattggagagcacaaaatttcccatggttgtgacttgagtgtgaccagttgtgtgaaggtatgtagtgagactctgagagtatgcatggattgtactctagtggaacatgtcccatctggtggccacatgctactagcctagtatgctacacaagtgtcaaattaagcaggatttcaatcaaataattggtttccagctttctttcggcttaaaatctggcaagagttgtagtatagacagatacgtagacatgttaatcaagtgaagagcaagcaagcaatttgagtcacctgcatatggacatggcctaatgtttatcaagtcgagagtacatcataacgtcatgtgactaatagcaggtcaacatcaagtatgagtatagctatagttgattcaacaaggcgtgaaatatacgaacatccaaaattcaacacacttaactcagtctgggctataataattcaataatgcatcgctacttcagttagattcagaaggttctacccccacaaacctattacatcttaaagtacaataaaaatggagaaagagtttccaccttgtgctagggaaagattctattcaagtgtggtgttcagtactgctcttcatcccatcataaacttaacttaaaccatgcagtatccccgtgtagtatgtctagctgtttgctcttgctaataggccagagaaggatggaacaggggagttcctcatttgttcttgagcttgctttatctcctcgggatcttcaagtgtaaaacagagacagtcaggtagaatacatacataatatcaacaagtattataaggtaacatttattaaaaatatatacatcattcatatcaccaaataacataagctctttcagccctttcatgtcagcagtacataaatattttgtaaaatgcgaagctgattaaagaaacaaacagctaacccacaaatgttttgctcaaggagctcaagaaaggaaccactgtaaaaacatatcatagaatgaagcaacgaactgtaaataaaaaactgagaaggtacataacaggagtagacaatggcaactaaaaatatacacaaatacaagctaatttaaaaacaaaaaggcacttttaccaaatatatgctttttaccattatcttgcatcctaactacagtgatggtgtgggtattaattatatcgccttgctactttgtctttgcatggctgatttgttcttgattagatacagaaaagcaacgtaattaggtaactataatatgtcatgcttgtatgctgcatgcggtggagccccggcaccagactaggttcgctgggccttggctccacagctgcgtggagcaaataatatgcgacaataatctgatgagtaagcagaaaagaacggggcctaaatttacaaccaatggaacagaatgagagatgtggaatgaacaacacaattaaatgtaatatctttctgcaaaagtatgatacgagctacatggtgcaaaatgtctattgggcttgaatcctgttctgcatagctgctacttgtgggcacaaaatatagtgtaataactattacattataactcaaatttggacataaaaggctaaaagtgtgcagcatacctatgttctccatcattttgggcataacgaagaccattatgaccataaaaccaagcatcatacccatagggctcttcaaaagtgacataatggagaaaggctcccttttctaggaaaaagaaggggggaaattgactgcttattaaatattatacaatagaaagtactgaagaaataagaaacatgaggttagtattagtcacctcgtagtattgctcttctctgagaggttccaacacaagctcatttagaactcttctgttttcagtcaatgctgcttgaatgtgcccaggattcctggcactgatgtctacccgaacctatcacccagcataatagagaatgaatcttgatgcccatttaacccatgttacagaaaaaaaaatgactaatgaacacttactggtgaaaataagtagcccaatgaggagacctcaattaaatgagtaccagctggcacattgtggcttaagcatatcatgtcaaggaggaacaaaaagcaacatagtatgctcttctaacattgtggcattgctgcccacaaggaaacattggaaaaaaaataacaaacaagaatactacaacaacagagctagatttatttctattagcaacccagaggctatatctaattttcaggaataaggctacccataacagataggaaatgtaagatatgagacatccaacaatagagcaggctaattaaatttaatgaaaaatgactaatttccctaatccgggaactcaaaatggagctgaaaggttgtaaacatatggttttgcagattttgcaggatacaatgcaaagtagccatctggcctggcaaatgtaaccctctgaccaccgttaagtatcacttttgtgtttgatgtcttggctggaagaccaaagccctttgcaattgcacttgcagctataagcacataaaacagaaaaaaaaaacgacatcaactggttatcattataataattagtacaatttggcttcacgggtatggaaacttaattccagataaggagcaaatgcaagatccctgagtgcaaagaaaactaagacttgccttgacaatctgagttcacatgaaatatccagcactgaaaaacccatggttctatccacaagctaacaatgttttcagcaagagaaaatgtaaaagttaaaagcggtctgaaacactatacagcagccatttattattgtggtctgaattatttcaataagcatggttgggaaacgtgggcttcaatgctcatgccaagttgccaacatatctatcgaacatgttgtaacgcaggtagagactcgtcctagaaacaaaaagtgccggataaactatgatggcaatcacaacagtacaacacacggtttttgcattcaaaattccacgaaagctcactttc

SEQ ID NO: 1824 - DNA, 1102 bp, Oryza sativa
cctcgcctcgcctcgcctcgtctagttgagcagccgcgacgagcacggcggcgacgacgacctccgccgcgacgatggccgcgcgcctcctcctcctcgtacttttcgccgtcgtggcagcgcgcgtaggcgcagcggcggcctatcagcccgggtatgtccccccctcgccgcgccacccccaatctcgttttgctccgtgatccaatccaaatcgaccgcgagttgaccacggctctcgctttggtggttctccagatctgctgaggggcacacgatcgcgggccgcatcaagatcgatggttagtctccggctattctcaccctatggctcgagtgaattccgtggagcttttgtgccagatgcgtgcattgaggttgttgttgtgctcggatcgttggggatcgtactcgtgtagcttaggtgcatcagatatctttgtgtgtcagggttgtttggggataaaagccttttttaacattcgatttcatagttggctatggtcaatttgctggaattattttcgagatctgccgattaaagtgtccctaactttgtacttaaggtagtgactaacgagatttgatacactatttatcgagctcatctagttccgtcttagcgcaagccagcgctagccaactttgttagctatcgactacttagcagctttgagggtttgttaatttagttagtgatttttcaggcactcgtggaattcattgcatttgtgcaagctgtttttcagatcatgcactgatacagttcgatgagcccctggttttggttacttagtctcatggggtttgcttagatgacagttggtattcgtattgactgattttagctgagctttcattggtcagggggtatttgattatgaatatctgatgattttagctatgttttacaagagtttgaaagtgagctttcgtggaattttgaattgcaaaaaccgtgtgttgtactgttgtgattgccatcatagtttatccggcactttttgtttctaggacgagtctctacctgcgttacaacatgttcgatagtatatgttggcaacttggcatgagcattgaagcccacgtttcccaactcatg

SEQ ID NO: 1825 - DNA, 617 bp, Oryza sativa
ggatcccccagtggcttaaagtacaattcactctttatcttatgagtattataataaaaataaaaacgtattaatttattatatatatattataatagaaaaatatatttaaacacatatttcgaagatcgtgttactatttaaagcgtcaagaagaattatggaacctggttactagtacaagtggccggtcttgtctcatgagatggagaaatatggagtgttatggtgtctgtggttgtggatatgttatatatactcctaacgtacagctgcatttccgtcaactattgagcgacacatgtattaatttatggtggaaggcccgtccctaattaaggtccctaatctggcctctagcattatcagattatccatgctcgctacatctcctggatatgggtgggggttggggttttcatttctttcatccacaaagggccctagctgctgctgctgcatgccgcctttgccgctatgatgcatcctgccgtccagtttacatgcgtgttgagcgtacattaccacgaatgtccgtttcccttccccctaaaaagcaatgcatctttttcttcttataaaatgctacggctgctacgcatcttcaggcataccat

SEQ ID NO: 1826 - DNA, 677 bp, Oryza sativa
aaatgcagctgatctggcgatacaagtccatgactatggtgctcaaccaaggaagctatcgtgtacttgttatcagaacatagcttcacgtaaatgtgtgcatcacatccacatctagtttctttcaatttaatcttttttttcttcgatggatcaacaatctccttatcattcacatgtttccatccttgccttgagcacacaaagtgcttgcactgaaccacgccatccaacttcttttgctgcccaatacgcactgagaacccaacttggtgtgcatatgacttgtaaaatttttcaacagaggcaatatcttcaaatgtcatccctaccgcaggccttatcttatcatcacactctggtgtaaaaacggagcactgcaaaatcacatatacattgcaataagcattttaaagcacctcagtcataatttttaaattgccagtgtacttacattgagtggaattcttgatattttttttggtgtactggtgttgtcatcctctattactggagaagttatatcatcatttgaataaatatctgagttatctcgcacatccaatctatttattgcctccatctgcaaaaaaaaaaacagatagcaaacacctgagattaaaccttcaattcccttgagtgaacaattatgttggagccacctaccttaatatgca

SEQ ID NO: 1827 - DNA, 2165 bp, Oryza sativa
ttgctgcttggatagttgcattaaagcttagacaacgacactacttgttgtttatgtttatgtaaagtacccgacacaaaaatcttttattgaatatgttagccagccaggtgtttgcatggcagattagtgcctcacacgaataacatccaaaagcttccatccagatcacagaatcggtcatgaaacttgagtcttgcatgcagaatcaatcatgaaactgaaggaaaatcatcttcaaaattagcctagccattaaactagagtatatttgagagatgacctgatcttaaactttgggatgttctaccctggtttgttggttgcataattgcacattaccttaaagcttagacattgactctacttgctgtacaaggttatataaagtacccagcataataaagatcttttatttcttatgttagctagccatgtgtttgtatggtagaatagtgcttcacatgaacaacgtccaaaatcttccatgcagattgcagaatcagtcgtgaatcttgatagtaaaactcttacatgcagaatcaacaattaaactagaggagaatcttttgtgcagaattagcatagacatgaaactagtgtcttttagagctgacctgaccttgggatcattagttattgagaactgtattagtgtaggagcattgtatatacaatacaaaggactccccctgttgattttaataatccacggaaacagccaggcacttagtattctccacatggttaacttacttcatgcttggtgttccttgattttaaactcagacatgcttcatatatacttggtgtttcttgattctcaaactcgaacatgctccatatatgcttggtgttacttgattcttaaactcagacatgctccatgtatatttggtgctcctttattattaaactcagacatgtcacatgctccatatatgctctatcctgcttggtgttgtttgctttactatatttgtaaaagaaatgaacatgcaaactgtatagctcataatagtataagtgatatatcttccacattaagtgtttttaacctactctttttatttatttattattttaggtcactgttcacatgttggatgacacgatctcagtgtgtcgattgctgtacttcagcaagcatttcgatattgccttatttgaaactgtaggagggctaactataccgattatgccattgaaatctgatttggaatatggccaggatttctgtgtgctcaccagagacataaatatagatttgatttgcacaacagtcaaagtgaagtacttagatccgtatgagcaccaacacaatcactatatgttcattggtggttccattcccaaggtaatgatggtatttaaaattttaaattctaaatagttagttgcacttgtctataatctcaatgtggtatttaaattttgcttgcagtgtggtactggaggtgcattggcagatttcagtggaaacactgttgggatgttattctgcaccttgcccatggttgcattcctaccgagctccctgatcctcacgtgcctaagattgtggaagaagtttgggtaggcatttttatttttgttcatcctagttggctatatacacttgcttaattcagaaacttaggacattagtttgagatatgcacttatgctgccagcacaaactatttcccttccattcaacaagtttacatttaaacctgtacagtatgttatattttatataatataaaaatgagtgccaacttaatatgcatatgcacaatacctctgtccatttgctctcaaaaccaaatgtacggtagaattcacagacagatacatacaagtgaggtgctgaattaagaatgataggtgtgagactgttagattcaggttaagaatgtggggataggtttgtaatggcctctattcaacatcaacaagtactgactgagatgcaaagtgaaatgtatttatatgttttaggcatgcacttctacaaccctaaacatgtgatacactataattcttgtatattggacttattatgtggtatgattatgccatctgtagcaaccaagtggcattcagcagctagtataaattagtaattattaccatctgaccatcatgtttacagaaaacacatcaactgctgtttttttttg

SEQ ID NO: 1828 - DNA, 8932 bp, Oryza sativa
  unsure (1)..(8932): unsure at all n locations
ttcatataggcaaattgttcgacctcagcttggtttgaagtttaaaacagtggattttcaagagatgacgcttattgagttgctgtctcgtaaatacaatattacctctggtcttattgtaggagaggtaacttttttatttatgacatctatttatatttatgtgtatataatataatattttcatgtatatattgtattatttctggattgattttaggtttcagctgaatgtgctgctgagaaacttggcattcgagttggggatattattctctctctctccagggagaaagcatttcaagtataatccaggtagcaattgacatccttaagactttatttgaatatttcaaaatctaaattagctctttcaaacaaaaaggcataaagtataggtagcatgtgcattagtttatttaatacaaatttgactcaatccttttgtgttagttggagaatatattgctcagtattggtgagagatatcttgaggagggtaacgactccagctctaaggttgatatcaaggtaaatttccgtgtacttaatgaatacacttaaaaccatatactggtattaggattatttattactctataggctgtttatctcctagatagttaatctcctagacctttggtttttgtaactctctagcattcattgtaactcagcactagcattcattgtaactcagttatatatatgagagatcacctaccctcttttgtgtgtgaggcatccattccacttcttctacatggtatcagagcataggcccttaccttcttttcctctgctctagcacgtcgtcgtcgcaactgtgttctccaccatgtcaactgaatccactcagtcctctacctcatcatcctccagtggtggatcctcttccaacatcactagcgagtttcttcatccctacgccaccgtcgccgtcaaatcacacgtccccatcaccctggagaacaaccacccaaactacaacaaatggagggccttcttcacctccctgtgcggcaagttcgggttgatggctcacatcgacggctccgctcctccacgccctgacgacccggcctgggaacaggccgactgctgcatccgtagttggatcttcggatcagttacggacaacgtcgttgacctcgccatggagctagatcagaccgctcgggagctctgggtcgccatcgaggacatgtttcacgctaacaaagaaccccgagcgatcttcctcagccaccaatttcattccatgcttcaaggggactcctccattgccgactactgccagaagatgaagacagccgccgacgcccttcgcgatgtcggccacgccgtctccaagtcccaactcgtgctcaaccttctccgaggactaaacgaccgcttctccaacaccgccgatcagatcgcaagcgcggacgtcctcccgagcttcacatcggcgctcaacaccctcctgttgaaggagttgcgcatcgccaaccaggccaaggtggccgcggcgacggcgctggtcaccggcgccagctcgggctccggctcctcttgccctcccggcggctgcgcttcttccggaggtcaagcatgcactggcggcaacaacagccgccgcagcggcaagggcaatggcagctggatcggtggcgggaatggaggggccggaactggaggcggatggggtagcggcagtgggggtggtggcagcggctgcccgcttcctcctgctggtggcggtggctaccagggggtggccaaccctagctggaggccggccgggccctgggttttgtttaacccttgggccgggccaagcancaagngtggccaccccactcggcccactactctcaggccggccttcttgggccggctccggcagcccactactcaggcgaacaccactttcgctggcccatcgatgtcgcccacatctgttcctccaggctagccagacccagggcccggccttcttgggccggctccggcggcccactactcaggcgagcaccactttcgttggcccatcgatgtcgcccacatctgttcctccaggctagcccaattgggagcaagctggcctcattgaatccttgaaccagatggccttccaaagcccaaacaactaggttttggacactggcgcaacatctcatgtcctctactgacggtatcctcgttactcgattgcctaactcccacacttttattactgttggaaatggtcacaccatccccgttatttgtcgtggcacttcattccttcccataggcaccaccaaatttgcactaaaaacatccttgtcgccccctccttagttcgtaatttactttccgttcgtcagtttactcgtgacaataaatgttccattgagtttgatgaatttggtttctctgttaaggaccttctgacccggcgcgtgattcttcgccgcaatagccacggggaactctacacccttccagctgccactccctccagcgcccactgctccctcgccactttatccacactttggcaccgtcgactcggtcatcctagtgcagccaccatccagagtcttcggaatatgtcctccatttcctataataaaatagacacctctctttgtcatgcgtgtcagttaggcaaacatacctgattaccttttgataggtctttgtctcgcactttcattccctttgagcttgtccattgcgatgtgtggacatctccggtgttgagtacttcgggttttaaatattactttgtggtgcttgatgatttcagtcatttctgttggacgtttccactccgacacaaatctgatgttcatcgtcatattgttgagtttgccgagtatgtttccacccaatttggcttaccgctcaaatcccttcaggctgataatggcggagagtttgtcaataccgccaccacttcctttgtcactaatcgtggcacccagctacgactctcctgcccttacacctctccccaaaatggtaaagccgaacggatgctccgcaccatcaacaactccataagcacccttcttatccaggcttccatgtttccgtcctgctgggctgaggctctcgccaccgctacctaccttctcagccggagaccctcttcctccgttcaccactccttgcctttccagctcctacatctcaccactccagactactcccatcttcgggtttttggctgtctttgttacccaaacttgagtgccacgactccacataaacttgcccctcgttcaacagcttgcgtttttcttgggtacccggcctcccacaagggataccgatgtctggatctctccactcgccgcatcatcatttcgcaccacgtcgtcttcgacgaatcccgctttccctttgcggcgactcccactgctgcctcgtcttttgattttttgttacagggattccctccagcagtcgcttcctcctccgaggttgagcaaccgcgaccactcacggaggctccctcctcagaggtcgagcaaccgcaaccactcacagtggctcccgagcaaccgcgatcccttacggtggctccctccgtggaggttgagcaaccgtaccttccccctcttcggccgccgcttgccggacggcacggtcaccgcggtcaacgatgccattggtgccccctcggtcggtgcctccttggccggcactgcccctttggccggtgccacctgagccggcaccatcgtgtcacccttccaccatgtgtacacccgtcgccctgccccgatggtccagtcatcatcttcagccactgtgactgcgacggctgctgctccacagctgcattccatggtgacgcgctcccagactggctccctgcggccggtcgaccggctgacctacacagctacccacgccaccgtctctcctatcccggccaactatcgcagcgcgttggcttatcccaactggcgtactgctatggccgatgaatacaaggctttggtcgacaacggcacttggcgcctcgttcctcgcccccttggggccaacgttgttacgggcaagtggatcttcaagcacaaattccactctgatggctcccttgcccgccacaaggcccgttgggtggtccgtggttattcacagcagcacggcatcgactaagacgagacatttagtccggttgtcaagccggccacaatacgggttctcagcattgctgcatcccgtgcttggccgattcatcaactgggacgtgaagaatgcgtttcttcatggtcagctcaaggagaccgtctactgtcagcaaccctctgggtttgttgaccctgctgcccctgatgctgtatgtctgttacagaagtccctgtatggtctgaagcaggctccccgtgcgtggtactaacgattcgccatgtacattcgacagatgggatttatgccttcagcgtctgatacatttctctttgtttacaaagatggagatcacattgcctatcttctgttacgtcgacgacatcatcctcactgcttccaccacaccactacttcagcagcttacggcgcgccttcacaccgagtttgccatgacagaccttggtgccctccacttctttctcggcgtctccgtcacgccttcctttggcggcctcttcctctcgcaacgccagatgctgtggatcttctccagcgggccggcatggccgagtgccactctacctcgacaccagtggacactcgtgccaagctctccaccactgacggcttgcccgttgccgacccttcggagtacaggagcatcgctggcgtcctacagtacctcgcgctgactcgcccggatttggcatatgccgtttagcaggtctgcctcttcatgcatgatccgcgggagcatctcgccttgttcaggcgtatcctccgctacgtgaagggtagtctccaccagcctccacatcggctccggaccggttcagtccctgacagcatactccgatgcggattgggcgggttgtgccaattcttgttgttctacgtccagctactgtctcttccttggagacatttggtttcttggtcctccaagcgccaaactactgtctcctgttccagtgctgaggcggagtaccgtgttgttgcccatgccgtcgccaagtgctgccggttgcggcaattgctccaggaacttcatgtcccggttgctttggctattatcgtctattgtgacaatgtgagcgctgtttacatgacaacgaatcctgtgcatcatcgctggacgaagcatattgagattgacatccattttgtccgtgagaaggtggctttgggacaaattcgggtgcttcatgttccttcatcacaccagttcgcggacatcatgaccaaaggcttaccagttcagttatttactgaatttcagtccagtctttgcgttcgtcatcctcccgttgcgactgcgggcgggtattaggattatttattactctataggctgtttatctcctagatagttaatctcctagacctttgttttttttaactctctagcattcattgtaactcagttatatatatatatatatatatatatgagagatcacctgcccccttttttgtgaggcatccattccacttcttgtacatattgttttcgtacacttgttattgattacaactcttaacgataaatgtttttttttatttaataggttggtctatttcatgtgcgtaaatgtaccagaagatttatcactttatcagtacggttgtctggtgatattgaagtctttcgctgaggtaacaattatttctcatatcgtgtcattatcaattttcatgttttccttgttgaaccgttcatgaactgacaagatgtttgtgttagctcgatggcgacctcctgacgaacagaagagatggtgagacgacaagttagtactgcatgttggaaggaatgaagtcttttaagaggagtggtgttcaaagtttttggtctggctggttatactctgatgtctgcaagtctgttcgtggtcttgatacatgatttctattgttgggtttccaagtgtgtgcttgcagttgcacccattagtcccttgccacattcttgcggttttacacctatccttgtgtgaattttcggtcgggatctcgtcaggtgaaggaatcgcactgatttgcctgctgtggttcaaattgtttggtttgttgattttgttaatttattactcaatccgtcccagaatataagaagttttagagttggacatggttattaaaaaggtaggtagaagtaagtagtagagggctattattggatgagtagtggaggttggtgagaaaagtgaatagtggagggttgttattggttgggaagagaatacccatgtgttgtgatgggtgaagacggtacggacgaagctcaaagctgacaggtggtagaagcactcgatcaggatttgcactcgggcaaattcgtgctccgctatgtagagctggatcgtgctcagacacgacttcgagctagccgtgaggaataggtggcagcacatttggatgaagagcagtggtcgacgtggtacacgaccatgctaaggtatggttggaccatcggaggatctgaggtaatgcgtggagattgtcacgttgctcttgctgctcgacaacatggccatgtcgtgctccctttggacaacaattcaacgaaggaatgcagaaagatcaaacagagatgtttcttatctcgttttcattaaactttcataccaggttccttttctagcaatttagatttggaaaccctctatgaactgcgggagaggctctccctccccaggctactgtttttctctgattactattcaactatgtactcgtctctcttctggctccccaaaattttaaaaatgaagaatgtatttctgttagagagagagagaaagaaagaaacatcatcaccctgaaggaatttttaccatagcatgcacaatcaagagttgttcagcatttttaaagagcaaaagaccccttaccaagcaacagattgccagcatttgcaaccagcaccagcatctggggatggaagtgcatcattcacttgcggaaaccgttgcatcttgcctttggaaaaagaccacatattctatcatggaaaagtaaaaaaaaaagaaataattcagaaccacaaaattaccttggggcaaactatgaatatcgcatcaggataaggagttcaacgtctcacacactgacctcacgtggagtttgcacccttctttccttggattgggaccagccgcaccgcaccgcgacacatatctgagatcacagcggcgcggcgtatgcagcagcacggctacgatccgtctccggcatgcgcacgcgcgtgcggcccttgcccctatcaaactacgaggtggcgacggtggttatcttttccggttcagcacgcacgctcctccagcctgaccataatcctcgccatctgccgccaccctcgttgacatccccgagccgtgtcctgcgctcctgcaccagcgcaccctcttgagccggcggaaagccggaaaccgcttcgaggcgagatccgtagcttgctttatggcgctggcatatgtcctactacccgtttcgggttacaacacgttttgactttgatcaaagccaaactattttaaatttaactaagtttatagaaataataataataatattttcaacccatgacaaatttattataaaaatatattcaattattgatttaatgaaactaatttggtattataaatattactatatttgcttataaacttagtcaaacttgatatagtttgattttgatcaaagtcaaaacgtcttgtaacttgaaacagacgtagtagttttttttcaacggcggcaacctgctactggcctactgctatggcccgtgccctagcgtggacacccgaagatgaattggaatcaaagacaaaacaacgacggacgaaacctattcctgttgaggaagaaaacgaacactaccagcggcgaggattttgcaatgcacaatcaggaggtccatgcgtctccgcgctctgtgggattgtggcagagctcgtagatggcgccaccgctgaatatgctaccggagctgcacgcgcggcaggggtggcctgcacgccgcgctccaacgatgggtccagagcatctcaacatccctaataccttgtttggtttaaaggggattgaaaatgattagaggggattgatggagaatattttcacaccataataggtgtggaataaatcccttccaatctctctctcacaaggatctatctattatattataaaaaggatagaaaaaggagcctccacgttcgctctcatggcctagaaattctcacattaatcggagaaaaagaaaaaacagagtccatatagaaatacaatttagaaatagctgaaattcagaattaaaaaataaggaatattagaagaggagactagagtccatatagaaatacaattcagaaatagttgaaattcagaattaaaaaaataagaaatattagaagaggagactagagtccatataaaaatacaaataggaaataactgaaatttgtaattaaaaataaagaatattagaagtagagtatagagttcatatataaatacaattaggaaataatagaaattcagaattaaaaataaggaatattagaaatagagtatagagtccatatagaaatacaattaagaaaaaaaatagaaattcggaattaaaaaataagtaatattagaagaggagactagagtacatatagaaatacaaatagaaaataactgaaattcggaattaaaaaatataggtatttaaaactatctaaaattcggaataaatataataaaattaaaagtagagtttagagtccgtataaaaatataatttctaaatacctaaaattca

SEQ ID NO: 1829 - DNA, 17623 bp, Oryza sativa
aattaaaatttaaagaatattgaaatatgagtttatatagaaatacaatttacaaatagctgaaattcggaattaaaaaataagaaatattagaagaggagactagagtccatatagaaatacaattaggaaatagttgaaattcggaattaaaaaataaggaatattagaagaggagactagagtccatatagaaatacaattaggaaataactgaaattggaattaaaaataaggaatattagaagtagagtataaagcaaatacaattaggaaataatagaaattcggaattaaaaataaggaatattagaagtagagtatagagtccatatagaaatacaattaagaaaaaaatagaaatttagaattaaaaaataaggaatattagaagtagagtattgagtccatataggaatttaaaactaactaaaattcggaataaacataataaaatgaaaataatgtttagtgtccatataaaaatataatttacaaataactaaaatttgaaattaagaaaaacatgggaagaagagtttaaagtcaatatagaaatacaatttagaagtaactgaaatttgaaattaaaaattaaagaatattgaaagatgagtttagagtccacatagaaatacaattagaaataataaaaattcagaattaaaaaaaaagaaatattaaaatacgagtctagagtccatataggaatatatataatttacaaataactaaaatttgatattaaaaataattaataactaacacgtatataaaatacaatattaatattacacattagtagtttcgtagagttattacaaaatttaaaattatgttgtcattgtaatatattttaataatataatgagaaaacatatatgctattatataagagaaaacataatgatgctagccgcgcaatctgcgcgggccaccatgctagttaaccgaacaagacctaagacctaaggtgggggttgtggaagtggggatagactatgcccttttacggagaaacgcgaggcttgaagttgctgcggaataagcacaatccaatccgagttacggtataggcgtggacgacagaatggcgggatggttgggtcggttgggttgagttgagctgggaaggggtgtgtgatagttattttagattcacatcgatcaaatttgatacaagcgacttacaaccagctaaaaatcaaatcaaacacagactacgcaccaaaattttgataaaaatatctcaaatttttataatagtagagaagagataaacactctaagattgtgttctgcacggaaatgtggtggcttattaatgtatgattaattaagtattagcaaacacaacttaaaaaaaataaaataatacgattctgaaatcaactttcagatagaatttttttttaaaaaaaacatgcacgcgaaaaacaagaaatatgagttgggaatggaaagggaagagtacgggtggggatgctttggagttcactccaactccatccgaaggatttgatgaaatctctgtcatctctatataagaatggttgggatgaagtaactaattcctaatagttttttttctgcatcttaatatttgtaacaaatctaacgaatactatatatatatctagagaatatacaaactgattttacttgcataacctagaaatttcatggttcatccacagtataaaaatcgtattgggctttgtggctataatattttagcaacatttttgtgtgtatatggtttatgtatgtttgcacgtactaaatgtttaacatagttttttatacatgaccatagcttcttatttggagaagagagcgtgcatactttgttaatgttgttggcagaaacatactcactaggaacataaaaaggaagaaaaggtaagtaattttcattcaagcatatgtgattgagggagttaattaggacaagttaataagtggcttcatcttagccataggaaataattgatggtatggatttagtcaaatccacctggtggagttgtagctaactctagggggatctggacccggaagagcaacaccctaatactcgtaataaaatagcaatgtacgttgctaatgccaattcgagggtgcgatttgttttgggaatacgaaattgagccctataaattgtccaccctataggccgcagattcctcaatccttactgcaagcggcaaagccctcctcttcagctcttctgacggaaaagaccacagcgatggccaattacacatggataatacaatttaagtagtgcacgttggcaatgccaaatcaagagatgcaattgcactccacccaaccctacaaatatccacccgcagcttagctcgatccttgcccacttcaaagttcaaacaacaaagccgtcctcttctgaccaaaaagaccaaagccatggcgccttccctcgccacctcttccaccctcgctctcttcctcctcgtcgccgtctccatcgccgacgccgcgacattcgccatcaccaacaggtgccagtacacggtgtggccggcggcggtgccatcgggcggcggcacgaagctcgacccggggcagacgtggaccatcaacgtgccggccgggacgacgggcgggcgcgtgtgggcgcgcacgggctgcggtttcgacggcagcggcaacgggcagtgccagacgggcgactgcggcgggaagctgcggtgcacggcgtacggcgcggcgcccaacaccctggccgagttcgcgctgaaccagtggaacaacctcgacttcttcgacatctccctcatcgacggcttcaacgtgcccatggccttcctccccgccggcagcggcgccgggtgccccaaaggcgggccgcggtgcgccacggccatcacgccgcagtgccccagcgagctgagggcgcccggcgggtgcaacaacgcgtgcacggtgttcaggcaggacaggtactgctgcaccggatcggcggccaacagctgcggcccgaccaactactcggagttcttcaagcggctgtgcccggacgcctacagctaccccaaggacgacgcctccagcacctacacttgcccggccggcaccaactaccaggtcgtcttctgcccatgatcgaacgcgcgcgcgcgcgcgcggctgatcgatcgatctctgatgatcttgggatttgtatgatcgatgcatgtgtggatgtaaccgtgatatacgtacctaagaataagtttgcacgcgcaaacgaggataagtttatgttatcgatctttgaataagtaaaaacaactgggtttatgaattgatatatatgaacgatgactttcagtaagataaacacggttaattacgtgttcgatcagccatatgttattatgcgtgtaactatggaaactattctaactataaaaattaagaagatgtattaatatgtgatatatcaatcaataaatatgtaagtgtaaattcaacttctacaaatatcaaccaaaaaacaaattaaactatatctagacatctagttaatgtatattcacagttaaatttgttttttcattgtgacatgtagatgttaaattttaacttgcatatttttgagtaatatattacatgccaatatatttttttaaaaatctttcatgactatttaagtgacatgtaaataatgagaggatgtttcctcgagagtttaaaatacactatagtatatataactatgcttcggagttcaattctatgatttctccaacatttccaaattccagtcgaggacgtgtacggttgtaaattaattgagttatactagcatggcgcgcgattaatacatttggacgaacacgcccaacaaataaccatgaccactctatcacggcgcattaacaagaaattaactgtgaacagtagtcaggtcgaatccttaaaccttagcggtttggacaccacatgctataaccttagtgcttaagaacttttaagaataccatagctctgttaatagacctgatccagcactggatttatcctaaatccaatatccaggccaaaagcggtcagcttgagtggacccacccaatacttgcaacagcactcaatcgactacgcatgcatggaaagtcaaggattttgtaattagattccacgtgccaaatcggaatggaattaactaacccaagcagatatataccctatccatctcaaaataactcaaccgagaatgagatatgattcatcttaaaacaaagaatctgaacatcacatctcattttaaattaagttattttagaacggagggagtaaactacattattaaattgtgcgggagaaagtcatcatactttcatacattcaagcggtcaagagcctccactatcattatctagagtagtggaccgagcaagcatagatcctctagcaaattaatctgtcaaagaacttattattatatcacgaagaaaagacttccattctgcaaaaaaaaaaaaaattctagagacgtgcaacaactgagttagctggcacgtagtaccgatgaaacagcagagtggagaccgcacaaaacagaaaagagatgctcgcgtacgtacgcacgatgcacgcagaagctacccgtgcacgcgacctcctcctccttgttcctcgttccctcctgcccgggaaatgcatggccagcagcagcggcagatcgggtcatcgaggcctgcgttgcagccgatcttgaacggatgacggaaatcttaaatgaaattccattcaacgcgaataatgggcgcacgggagcacgcaaccgtccggctcgaccgattttggaattctaaattcttccttggttggttctggtcctcgccatccaagtctgaagaattcctcaccacgcagagtcgcagctcgcaggttcgaactggtatgtagagagagcactttgccttctgtttcgtttcgctccacctataaaaggaataagttcatctgagatctcttaacttgtcaacgaatccgattttcgtctctcaaccgaaaaaccaaacacaacggatttctcaactatcaaaactagtgcagatgaggtccctcggtgattttgagggcggttttggctgacatggcgcctacgtggctaatttgacctgatattcatctggcatggcactgacatggtgcctaagtggcaattcggtctagaaaaaataataaaacccgtgggacccacatgtcagttccacaaataaaataattaaaaaatggtgggacccacgtggaccccacatgtcatcctcactcctcactcctctctctctctctatccggggcggagcggctggccggcggagcagggcgggcagcggccggtgcagcggcgaggctggatgcggcggcgcgacctggcgaccgggccgaggcaacggcggtcgggcgctagtcagcccagcgcggcagaggcctgagggagagaaggccggcgcggtgaggagggagcttggcggcagggggaaggacagcagccgctggcggtgctcggagcgggcgcgtcgacgtggccgtgcccggctgacggcggctgggcggcagcttgccttgcctgaagaacaaattcaaagacacaactcactagaactgttgtattgatttgctataagaacctgcatgttttgagtttctgcaggaactctggagattcaattcctacaatgctaaaactcctcaagattcagttcaaatccaaagtggggaagaaaaaaagcgattcgagaagagcagcaatgtgggtcttagataagcacaacgatatgagaaaaaaaaattgaagaacagaagcagaaaccaaaattcaggccaaaaatcatcatcatcacagtgggaactctttccggcaagagaaagatttatgcgcattggctaatactagagattaacagggaagggggagacaatggtaggtacctaacctcagacgctgctgcttccatggtgatggagctccatctcctccaaaatttgcaaagcggagagcctctctctgttaatttggagtttggagggagcagagcagaggcaaggcaaaccaggtgcagaactgtggactcactctggtctcggcctctcgggtcaatccattcctaccactctcgtgttcccctctcgccaccggacacagtgaaccctagccggctagccgccatggacggcgtccagccacttcgtcttctgctcctccccatattgccgcatacaacttcgccggccggcgtggctggctctcgcgccggccttctctccccattcgcctgacactgcctgggctccctcaggccgctaccgcactgggccgactggcgcccgaccgccatcgccaaggctcgcgccgccgtcgcctcggcccagtcgccaggtcgcaccgccgcatccagcctcgccgctgcaccggccgctgcccgccccgatccgccggccagccgctccgccccgcccgtttcccgcttctaccagccgccgctggccccgctccatcggccggagagagagaagggagaggatagagagagagagagaggagggaggagtgaggatgacatatggggcccacgtgggtcccaccatttattattattattttgtgtgtgaaattgacatgtgggtcccatgggttttattatttttccggatcaaattgccacttaagcgccacgtcagtgccacgtcagatgaagaccaaatcaaatcagccacgtaggcgccatgtcagccaaaaccggcctcaaaaccgtcgagggacctcatctgcaccggtttgaatagttgagggactcgttgtgtctggatttccggttgaggaatgaaaattgggttcgttgacaagttaagggatctcagatgaacttattcccctataaaagggcagactgtacaacaaactcggcccgaataaggccgcatccagcgcaacctcggcccaaatctctactgtgtttttttttctttttcaggggaaatctctggtgtttcctgttttcacttttgggtgtgaaaaaatcggtgatgctgcccagcccttgccccaagcagtgacggagctaaaattttctcaaaagtagggctgaactagtataatttacattagtttatctttttatcttttaattgttttcaaattttaaatcacaatttcaatgggtatttaggctaaggagtagaggctctagccctaactaccctactcctatatccgttcctaggcctaagtgtggtcagacagtcttacagcttgttcgagtattagatataactattagtagagctcaagccagcagtgttttggaggcccaagagactgggggaattgatcgatgtgacatcctgacttaattaggatttggcatgtgtgaactataagagcagtgcacgcacatttaataccacgttgctagtttatcaaggctggaaccaatttataaggcatcctccctccaaccataccacaatcgggttaacccttttacacgaaacgaagatgaaaatgtaattgggatgatatgtgtaagtgggaccgtccatcggttaggctagggcatgtggggcacatggcatggcatatggcactagtattggatgtacgaacgtatacatgtgtggcaaccatactactcataggttaacccttttacacaaaccgaagatgaaagtgtaagtgggtctgcctgccggttgggcttggctacgtagttctggaggacccttttacacaaagcgaagatgaaagtgtaaatgggtccgctcgtcggttaggcttggctacgcagttctggaggacgagcgattacaatcgagaactatgaggatttaacaaaggaggcttcgccgagctcactagcatgacaacatccaacgtcttcccccatgcacaactgatcccttttatttgtgtgccacaaagcccccatagccacaagaatcttaatgaatgaaccctcatgtgtgacaaacaaaaacctataggtatgtgcgggagcaccgtcgtggctcagccgcagttggtaaacaacggtgtgcaaggtcattgcatgggaaagagcgtgaccagctaggacaatgggtagggaggttgctgtggtgagaagacggtggcgctattggccatagaaggtgggagggggtagaggaggagggaagatgagacaaatagctcacctagttgccatgactggctagccggaggagaggtcgtcatgagatttgttagcattgcatttgcgggaattgagtttgccaacttttcactgttgaagaagagaagatgacaagcactggagggtgagggtagagggaggagaggtgggagactaggagcggggaatgttttttatgtcagcaccatcgcaatcgccagtcatcttataatctcagctgcaacttacacgtgaagattgtcttgaactatggacaaaaagtataaggtggaggggctcgcgtgcaatttggtttactcacgcttgctcgtgtatttggagccccttataatcggtgattttttttctttgaacaattttaattttttattatagtaaaaaaatattttcttttggctatgccacttcgtctagcgtgacgaaacaacacaattatattgtcaatgtattttatatcaccacactaccacaccaatgagactggcgtgactaaaaggtttatattaatttttaaaattttaaaatgttaaaagaaattcataacctgccctgctctgctatatgggactctacacccacaccaatcagatcgtacgaagagaataattctccatgtgagctgataagtgaaaggattgatgggacaatatatttgttctaaaactaatcccaccaatagagtatagtactcttatacagctaatatgctgcagttaggccgagtttagggcctgtttagtacgcgaaaataaaatttttcaatgtcatattggatgtttgaccggatgtcggaaggggttttcggacacgaatgaaaaaactaatttcataatttgcctggaaaccgcgagacgaatcttttgagcataattaatccatcattagtatatttgggttactatagcatttatggctaatcatggactaattaggctcaaaagatttgtctcgcgatttcctccctaactgtgtaattagtttttttatttatctatatttaatgcttcatgtatgtgtccaaagattcgatgtgatgtttttggaaaaaaatttggggaactaaacggggctcttagttacaaactttttttcaaacctccaacttttccatcacatcaaaactttcctacacacaaacttccatcacatcaaaactttcctaacacacaaactttcaacttttccatcacatcgttttaatttcaaccaaacttcgaattttagcgttagctaaacacacccttagttttgttttaacttgacaagaccaaaagtccctgaatcacgcggagaaaacttcccaggccagcttctaatgtgactttttcttcgttgtggtacatttcttgctacactactagatgccaaggaaagagcacctaacaaatcgaaaacgtgaatcacagtaatcacaggatcatacttggattctttgctcctcttttgtccgcgccaaatcggtcaatcctacgaaattactgaaatctagcactaaatcatactcccttgatctttaaaacatatttcttttattatcaagattaaggagaaattaacttatccatcatataataaaaccaagaaactatatgcatgtatatttcttttatcttttattgactttgacagagactgaagatataaatcatcttcattatctaaacaatatatatagatgcaaccaatgagtattaaaataattttatggattctgatcaataatttaatttaacacataaagactaaaaatatatctaactcatttgaaaaaaccaaaaaatgaaatatgtttagacttttagatagagggactatgtgccgtagtgaatatacctttcttactgtagttaaaagaaaacctttctatataacttcatttctagacaccccgaatcaattagatatgcacaatagcataagccccgtaatgggctcgtggcaccaatgaattttacacatacctgtttagagcgaaacaatttgattcccgctgtggcatcaggaagaatttcctcgaacgtaccgtctgtttttttttttttgagaacactcaaccgtctggttcgtggtgaaaaaaagaatcaagagtagactttgaccagaagaagctgcgctaatgatagaaaattccgaataactccaaccaaatctgccgggatcaccaactctaccatatttcaacccacgtactacccaatcaccggccgtaactccatggagaagaaacgcgtagcccaagaaactccaagaagaagatgtcatgtttgtttggcgagagaagttataataaaccgctgacaaacatgagtgttgctgtgtggctaaactagaggtttccctccaggatcagtcaaatggcagatgctagtagctgatttcactttcttttttccgaacgaatattaactgattataaatttgcacaagaatgtcccctatcggcgtcagcgtctcagcggtgctgctaggttccctcgtcgatcttccaaatgtctgcaccagtacgtctctccgagccaagcagtccacagcaatcaacaaatgacgacggattcagaatttcagatcgcccaaggctgtgtgattagctgcaaccaaacggtgacacgcataaatcttctctttttatttttgattttttttctcatgcaattggggggacattcttgtgcatagacagttaacagtacggctggaaaaacgggcttcaccactgggaaaagtccatttgcgacttgcggcggcatgaatgccagtacaagacccagcacggagagtgacgagacacggacacacggtgccagcccggccgggtgcgcggctacgcgttctcacatgagccctctcctcgacggctgaggcctgaggcagaggcgagaagccgcgcgaggtggctttcaatttggtggtagcgaaaaactagtgcagccgaagcccgcgaaccggggcggctgctgcctgcctgcctgcctttgcttgccggctttggaatgatggcgctcccaggcttttcccctgcgcgcaggctgcagcattgtggtccacccggccgtcggatcagatggatcccatggagttctcagcttggatcatggggaccggccgggatgatgccgaactctgcagcttgtgcttgtctcactagccagcactattttactctacgaccgagtgaaacccataggccggcggccatagcagcagtagtagcccatcagtactcctgttcagtgggacggtgctgtgcaatccaatgcagcttctgatcatcgcaagtcgcaacagccatggtcgggatgggtgtgtttagttcacacttttagaagtttggttgaaattagaatgatgtgataaaaaagttggaagtttgtgtgtatagaaaaatttacatgtgatgaaaaagttaaaagtttgaagaaaaaatgacgaaaatgttcacgattgccacttgggtaatcgtcgattcgacggggaggggtgttccgttgaatggcagcgagaatattcttgcatcacataaaaaaaaaaagaaatagtgtatcatcaacaacactagtgcagccaccaacaacaccaaggtcacatttaaatcgcagaaatgagaaaaaaaacaaaaataaaagaaaaacacataattctaatagaaataaaagtgtaaaacagaatattacaaaacataggataaacacatgaatgactgtttaattggattgtaggaaaacacatgaatcaaatgagatagatagactcaaagaaaattttccaaaagtttgagctcttactaagttttcttcaaaatctttataggattaaccattccataggaaggattcaatcatttgctttaaaggcattcataggaatttttcctatagaattgaaatcctccaaaattcctatgtttttcctatgatcatgagaagtttcctcctcccgtcgctcccacctcagggctgacttggatggtgaaaacttgccacagtcgccccctcccccctcccattcgcctcgccaccgcccgagtggctcatcgacaaagccgaacggtcacaagaatggtaacagagaggtgcttccccctcccggagaaagcctgaacagctggggtccgtggttgcaccacccaaccccggttctccatcagagctagtgagaagtccagtggaggaggctttggaggagatgtggctgcggggtagagggcgtggaggcggtgtgtgcagagggacgggcaggaggtgggggagaggtatgcacggcggatcttgtgtcctctaccttagatccggtgcccaccccgcggttccggagatggcagcggaggagaggtttgtggcaggaggtggggaaggagcaggcgcagtgacaacggagcgtggatccggccccaatggctagatcgaggcccttccacaccagatttggccggaagagacggatgttgttgtggcagtgggcgagggggcgacggtggcgaggctaacccggtcggcgaggggcacaagtggcaacagcagaaggccacaggacatggctggtagcagtaggaggacttgcgacacgtagtcacagtcgacggcggtgcatggccaatggtaagagatcagtgcgcaacaggcagcgacgatggggcgccagcatgataaaggtgattgtcgagagtggtgtggtggcgggggctatgggagttcgcggcgggcgcacggcttgaggtgggggtgctgccatgggatatccagccgaggtagcggcgatggtggtgttgtgaggtgggtgctgtgggcctgcaacgggcttggatatagacgcttgtcctcttgcgacgacgctttgtcgtcataagattgccacgtcggtgggctagtgcaagggagggaggatccattcttctctctcaccctctccctctccagcccaactacctggatggattcggagtgcgtcagtggtcgagctccctcctgaaggctgactggcgacgaggcgctggcacggtggctgcgtgtcgaaggtggacgggtggtgggctgctgtttccggattgacctcgactcgggagagcagaaagatcacggacaaaagcccagccttggggccagtaatgaccacgtctgcgggcaccgcttttcccttgaggtgttgttgtatgatctcctatgctctccctgttggatttcttcgagtgaaaatcttgtcttggattctcacgacaggcggtggcgatacttttgggtggcatcgtctagaagattcttttcttaggggtgtcgtgttcatttacccttcagtagcgcgatttggttgtagaagcatgatgtggttgttttcttttcgaggctatgccttcgagggttatacaggcttgtaattttttctgctcaatcaatagaatcatcgcactatcggattgtttaaaaaaacaacacggtgcaaagaaagctgtaatcctaaggatgaactgcagacagatttcgggcgagactctaaggggatgtttggtttccagggacttattccaagtccctgtcacatcggatgtttggacactaatttggagtattaaacatacactaattacaaaacccattccataagcttggactaattgcgagacgaatcttttgagtctaattacgccataattttgacaatgtgatgctacagtaaacttttgataattatgaattaattaggcttaaaaaatcgtctcgcggattagctctcatttataaaattagttttttattaatctatgtttaatactctaaattagcgtacaaacatctgatgtgactggggctaaaaagttttagcccatctaaacactacataacgttgttaagttaacattgcacttcgagttccgattcagtaaggaatgaatgcaaagcacgaacgacacgagcaacaagaacaaatatttatgtatttgctgcttctttcttttgtcactcaactctcccctttcttctgccactaatttacatctttgggtttgatcctaaaccaccatgtaaagctccgatcgccgttgccgtcaccgcccgccggcaatctctgaaccgagctaatgaacacgccgcaaagcacggtgaacacgacggccgggagcttgccggcgacgaggcctacgagaacgacggcaacgacgaggagcgcgacggaggaccgggtccctcccacggcgtcgccgtctccggcgaggacatcggccggcgcgtcgatttctacccgcgtggcattgctgtaagcgtcggcgtccgtgtcgcctccgttcccgcggaaagacggcgaagaatccatcgatctggcgacgaaggcgtccgcggccttggtgcgcattccacggcgagagtccgaggaatccgtcgccgtggcgtcacctcggttgccttcgctgctgcggaaagaacccgacgaatcctccgcctccttgcccttcatgcccttctgtaacttgcggggaatcagcttcctccatgaccgtttcttggtcttgaccttggcgttgcttgagtcgtcgccgcctgccgcgattctctcctcaatggcgactatcgaatcgtcgcctacctcgcttctctcctcaatggtgaggatggataactcgcttcgcctggaggaatcggagaagcttgccctcgccggctccacctcccggatcggcgagacgtagccgcgcccgtccaaatccagcttgttgttcgccgccggccgccgcggccgccgggaaagcgcggaggacctgacggactcgagcaggaagagcgagaaggaggcgacggtgacggccgcgaccaccttcttgctccagatcacgaggagggcgagcgacaccacgccgacgagcgagacgaaccccagcccaaggccgaacacgcggcccttgggctggcggcggaggacggcctccaccggcggaagttccggtctcggtctcggctgggttggcggcgagaccgagacagcggccgcaggcggcggggatggtggtggtggtggtggcgaggaaggctgcggcggaggggaaggcgagggcgagggcgagggcgaggggggagcctccggcccgccgcgcttcttgcgcctggacgccgaggcggagggcttcttgaggcggccatggttcttgacgacgaggtcagcgagggaggtggggaagcctgtctggacggggagcgggccagcgcgcgccgggcggagcgcggcgaggaggcggccgagtcggccggcgggtcgctccttcagcgggctgggcatcgccggcggcgagcataggaggaggagttcgccggcgcgccggcccgtggcacactgctcgccgcggttgggcttctcggcgctctgggttggtggcggattggtgggttagttccgcctcagactttgtgcgcgtgcgtggcgtgggggccttggtagaggggagagcgagaatagtagtggacgacgcgatagccagtggtgcgtttcgacgaaaagaaaaataaaaaccatccaaatttcccccgtttcgcatgcgttttctcgtccaaaaaaagggacctgggagagtggaagagggtttcaattttagaacggctaaatttgaaagttttgttggataaggttgatgatgggtttagcaactccttgatgagaagggaagggattgtttcttcacatgacctgattaatccgtcacaagaactttgccaatttctacatactttctcgagattcatgtgacgtgaggagagagagagagagagagagagagagggagagggggaatgaattggtctcactgccggaaccaaccggcaaccgtaccgcttgactaatctgtctcgtgccggtctcacaacgttccagtggctgacagcgccctcgctaaccttccacgtagtcaattaatgcatcattgctttggattgattagtactaatcaagtgtatattaaatcgattggctaaggcgctaagcatttggggcctttattttggtgttttcttcattttttttggaggtttataggaccttttgggtctcaggaggttaaagtacgtactagtaaaaattaagcttcgatcatgactcttgatgtgaggtcaattctcttaacagggtcgtcacatgcttgcacgtgaaaataagcttagctatgcgaattacttagtttgttaaccttgtgtatgtctcgtaatctaattagttactagtttgttgatgctgtgtcttaacgagaagaacagactatattctcttgggacccgcggttgtactgtttgtctccctagttcccatcccatgtagctatgtaggcatgcaagcccattcggaaacccccaaatagtttctcaaaaaaaagaaaaaaagaaacccccaaatccttcttttaatactacaaaaatactatcttgttgctatctaaaacatatagtaattctaaggaaattcatcttgtgtgtttatttttttttcaatcacttctacatcccaaagttttgctctatttctttatagctgtactacctcacagttctcatccgtatgtacaaatcatgttagttgacctcattttagaaattttttgtagtttcacattttgttgatttggattcgtctaatttcacaaacaaattcacacaacttaaaaaataaccgcccttttaaggttttgacgtagggatcagggcataggtctaccactcaagttttataaagtaaatttcacataactacaattattttatcaaaactatcacttagctacaacttaagccaaacatttcataaaattacaaaaataacaaactattttattaaaaaactataacttttgttgcttacgtgtatttgatacgtgagactaacttacaagagtgcaagtaccacatatgtgctggacaagtgcacccaacctttttattagaaacaatacaaacagatgtgcacactcatccctataaaacgtacacacgcacaccatatcctcataagtacattcgaaagattacactggtggagaaaccatctttggacggtcgaccaaattccacaatagtcccggttgcaataaaaaccaggactaaagattatctttagtcccggttgaaaaggttagagctactttttgatctttagtcccggttggtagatcatctttagtcccggttaaaaaacggtaggtgatgtcaaacccctctaatatctttagtcccggttagtgttaccaaccgggattaaagatcaatctttagtctcggttggtaacaccaaccaggaaaaaagatcagcatgcgtggagagatcgaggcgcggagagatcaaggcgtgcgggatcgagatacatatctcctcctcccctcctccctcccggttctatctcttcttctcctccccttctcctcgctatcttacacgcggaggatcctctcctcctccccctcctctcc

SEQ ID NO: 1830 - DNA, 6690 bp, Oryza sativa
tcctccccctcctctccttctcctccccctcccccctcctccccgatctgcaggcggcggcgccacgcgaggctcctcctccccctccccccactcatccccgatctgcaggcgcggcaccggcctcgcgcggcggccggcgcgcggcgctggctggcggaaggcggaaggtggcggctgggcggcaggcggaagatggcggcttgttttatttttttttgagaatttgtgatccggatttgagatgtatttgatttgtgtgtgatatgaatatgtgatgtatttgtgatgaattttgtagaagttgtgatgtaatttttttaaaagattttgtgatgtatttggagatgatcgatttgaggatttggaggtgataattgatttgggattttggggatggggatggagtgaaatcaatatattaaaaacaatgaagaaaagaatataataaaggagcagccagggatcggcctggctctatctacaccaaccgggactaaagatagatttttactcccggttatttcacccgggactaaatatagcgatctttagtcccggattcgtagttccggttggaaaaccgagactaaaggggggttacgaaccaggagtaaaaactacttctccaccagtgttagcctgacatatatatcctgagaatgatgaagccaccttaggcatcttgttgttgacgagtacgtctcacataccgctgaaagagtaattaactgtaaatgcgagcactcgtgactaaattgttaatagctcaactggttaggtttcatgtggtaagtcttagacttaatacggacttgatagagtggtcaactagcagcactggtctagagagggtcatagataaaaactggaaggcgagcaaaactcatgtctgtgcaagggattgaacaaagaatcaagagaaggaattttcttagtaattctaaaaggacaagaaaaagcatataaattatcacattgataacaaatatagaaattcccaaaataacatgaaaaaaaataaagtatcaatttataacatttacatgagctaatataagatataatggaatgtatatacgaattagggaagggcgcaagtcggccacccgataatccttggaataatttttttaaaaaaaaacaacatgagaggctccaactgtgtcaatcctcataacacttttcaataaaatgaaggaaaaaaagttatgaattaccttcctgttctcgaaaaccaagcactttacatccttaactatgcaaactagataaactacccccgagcattgttttgggcggttttggcataaactggctgacgtggcactccggcgtggcaaaaaatatttttaaaaataatgggcccacatgtcggtctctatatctactctcactcttctacctccttccccctccatctctctctacccttgaactgagaggagatggagacaaaagaagcccaaggtggcggcgaagagtagtcccctgggatgttggcgacagagcgcagtcggccggagaagcctagtgtggtcagccgaagaagcctatggcggcggcggcggtgactagtcccccggggtgccggtggtggagtgcggtcgaccgtgtaagatcaaagtgtgttttgattcttattctgtgatgaataattggcatctatgattattggttttgatatttggagattatcgtcgaagtggttttggagataatcaattttcaggtgatgatcggattcactgttattttatgtgaccagtccgaccgggtggtgtataccggtgagaccggtggtgattaagcggtcagaccggccggcccacggtttgaccggccgacgctacgtcgatttcggtttcgggttgtttgtttggatatccgtgattgtttcatggttatggcttctagatggatattatacgtatgtaatactgttgtttgctaacaatgagtcaagttggggatagcttggtctcggaatatggtttctttgtttatttcatgtgtaggtgactcgatgcctcgggagagtatttgcggtgatggaccgggagtcggcttggtggtaagacgatgtccgtggtggttagatatcatgcgggatactaagactagagttgatgcacgtggttggtgaagattccatatggcatacgatggaggtattgtgtgcgtatgggatgcggagtcgaatttggaaggagtccaaatttggtacaattggttatgtaaagtttgtgtcttgtactatagggtttcctaagatgtttaggactcttagtatgagtttggttcgtggctttaggctgcctaccttatgtataaatagagggggagcgtgaggcttcccggtatcgcttttgagagcaattgagttgctagtttagttagggtttcgagtttagtcgagatttttgtaaggagtgctgttggtgtactttataaacacagacagaagtaataaagttgtcatctactttgagagttcttcgatttgtgtttcatcgggtttcagcggtctaaccggcgacataccggcggttagaccggcggcaggcggcggtcagaccgacggaggagaggcggtcagactggcagcgacttcacacgtggcaggcaatcttcaggcggttggaccggcggatcaacaccggtcagaccggcggcacgagctcggtcagactggcggatcaacctcagtcagaccgatctacatcgaatttgatggtaacttttatttccgctaaaagattgggtttttgggtatatcaaccattcacccccctctggttggcttagttcttgtgattcgatcctacagaccggacaagcctagggtggcagtggcggagactagtcccccgcggcgtcagcagtggagcatggttggccagagaatcttatggcagcaacgatgcgcggttgaccgaataagcccagtggcgatggtagactggtagacggcagtgggctcgtcgccgctttcatgcaagctccaactctgccaccgcagccatcacctttgtgcaagctccgctacctctaccgatgcctttagtgccctctccaaggcgagccatccacgagctctgtcgtgagtagagccccgccgctgtgtagctccaccccttggaggccactggctaccacggtcgccaggttatgggatccgccatctcctccctgctcagctcgattatagagagagaggatggggattgaggaagagagggatagagtagagagaaaaaggtgagaggggtgagtacgatatgtggggcccactgattttttaaaaaacaattgctgactggactgccatgtaggatcaaaaccatttcagattgagttaggggtattttatccggtttgtatagttgagggtgtaaaatatctggttttcgagttcaggggataactcggtcgatcacgatggttagggggtaatttatacttattttctaaaatgaactatgaatcactttttagacttcaaaaataaagtttagttaggccccgtttggtagggctctaaactctaactcccagctcccaactccaactgcagtgagagctagctcctataggagctgaagtgggtacgaaagtgtttggctagattagttagctccactctaccacgttccttgtaggcatttcgttgaacaccaggttggcatcggctgtcactgctgtcgcctgccgacgcccgcgcgcctgccgcgccaccactgcccgccgccgccaacgcagcccgtcgacgcccaccgctgacgccgacgtcaccgtccgtcgctgctgtagggagggaggaggatggggaggagagagaatgggaggagaggtgtgaaggggtagttcagtggcatttttatgtaaatacattaaaaatttaaagggtagtgggtcttttgaggtggagtggagttatggagcagtaaaacccagctccacccccgtagttcatttattaggagtagctatgccaactccactgccaaaaaagaaggatctggactgtttgacacagctccgacttcaagtaagttggagttaggagctggagttgtgccaaacgggaccttaattacagtagtatcaactaaagtgggccaagttttacctgcaagtcggttcttttgtaatgcatataagactattagccttattgctttcgttatgcttatcttatctgtatggtttattagtaatctatatacagtttgtgagtaaaagttttatatacttgttattagcgttttgaaaacaaatattgtaaaataatctataacgaaaaaaccacaaaatcaactctagaactaaaactaagctctaaaatttaacttttagcttaattataagcataattagaagtgaaataatgggcataagtgaattaattttttgcttaattataagcataagcttaatcactgttacatgttactccctccgtcccctaatataagtgttacatgttactccctccgtctcctaatataagggatttcgtcccctaatataagggattttgacattttgtttgcgctgtttgatcattcgtcttattaaattttttttgaattattatttttttgacttactttaacatccaaagtactttaagcataccttttcgttttttatatttgcacaatttttttaaataaaactagtggtcaaacaatgtaagcaaaatgttaaaataccttatatttgggtaagggggagtagttggtaaaaattgttaaatccttttgtaggaggcaaaggacacaatataaaatttaattcgaattgtacagtgcatcaacgcgtcgattttacctcgatttttgttaacacgctttttaaacgattaaacggtatgttccgtgaaaaactttatattttaaaatatcaaatatatctatttattaaatttgtaataattaaaccttaattaattatgtgctaatgattttctcattttaaatgtaccaacttaatctccattttcatccgtttcaaacacctcaacctggctagattcactctagcgaagatgaactatcatattcgtacatacgcatgggcagatcgactagctcgtcggtatttccactgttaattcttcacaatataggaatgcgattggacgagttgaataagactactgtcttccgtccaattgattaacactaattaagctcacgtattataacttcctacgaaacagattttcccttttattaactagagtcgacggatagatgtagcatatcattgcagcaactagcaagttctcccctgaccagccaaagcggccaatgtacgtgacgcgatttcgagggtactaccgtactactaccagtctactagtactactccaacttgcaaagtccccatcacgcgggtggttaggtagcttgtgaggggttcacgatctccgtgctcacgcagggctcgagtcgagcgcgctgtgcagcaagcaacgatgcatgctgtgcgcgcggcggcgccgcccaccgcccaccgatctcccggggcatagccaccttcagttttgtgcagtaccagccgtggcaacgcttttcacggtggaaatattgtttccaacttccaaaagtacatacgtgtactactctgtagtccgtatgctctcagtttttgggcggcacccaattaataatacttattcatacaaataaaaatataatgacgtttgtcataaaattctttacgtcccattacgttttttttcaatcccttatgtatttttgaattttgtcttgtccagtatatataccttgaatttttattttttggatggaacggttcaaatcctgttgcaaagttcgttagaccccgggctagggaccttcagcagtgagctagttggatttcgtagggcaggaacatggttcacatcttgttcaaaattcatcgcctaaaatttgaagctctccctcaatctgctctgttttttttgggtcaaatttcaaacaaaatttagtgaatttcaaaaattcgctcgaaattcatgaaattagttatctcgtgaaccctcggcaggaacgcgtggcgagagcaagtgctcgcttgatcattagtctttggagaaccttccaaatagcatgcgacagtgtgacacagtgatagcagtgtaaagtggcgtgcgatgctaaccagggttttccatagcatccgtggagaggttatcgtcccccttgctaagacggttattgcaataacatcatggtaactgtcaaaaaccatgtgaattccatcttaaaaagataaattcagaatattcaaatctcatcgaagataatggttatataatggttaccgcgaggcatggttcgtttgacttggaataaaaaagacgaggataaaagaaaaccacaacctcacactgacaataatgtaacaaactaacatggtggtccgcacagattgcgcggctagcatcattatattttctctcatataatagcatatatgttttctcattatattattcaaatatattaaaatgacatcataattttaaattttgcaataactttacgaaactacaaatgtgtaatattcatattgtattttatatacgtgttagttattaattatttttaatatcaaattttagttatttgtaaattatatatattcctatatggactctagactcgtctttta

SEQ ID NO: 1831 - DNA, 20569 bp, Oryza sativa
taaaactctcctttcagtcttaacaatatttgattggtcgtctcttcggccaacccggcaaaaaaaaaaaaaaaagaaaaagaagagagagagatgtcattcagtttggctggtcatattttttatctgttctgtactgtaaacattttcacaagagaggatatatctcggtttgcggcttaggatttgtagttgtactatataccgcatcttgttgtaaataaggagtagggatgatggaagagtatgactgtatgaggtcagaattcagtgtgcgctaggacaagaattagcctgaaagtcaccactaaacaatgactttgctttcagaatgccaaaaggtcacacctagtatattagcagtaccatctcatcatagggggtttcatttgggtgagagataggcacaacacgtaagacagaaatattttgggcatatatacacttaaagcgtcatgatgtggcttttagatcttactagtagatggataggagagagatcaccacatttgcaggaacaactagacctttttagatgggactaaaacttttaaatccctatcacatcaaatattttgacactaattataaatattaaacatagactattaataaaaacccatccataatcttatactaattcgcgaaacaaatctattgagcctaattaatccatgattagcctatgtgatgctacagtaaacattctttaattatggattaattaggcttaaaaaatttgtctcgcaaattagcttttatttatataattagttttgtaagttgtctatatttaatactctaaattagtatctaaatatagagactaaagttaagtctctgcattcacctaaaacttactttaaataaaaaatagtgcttccaacacttctttttttcgaataagaagtgcttccaacactaggaccctgtcttttgtttgtgccactatgacagtgacagagcaacgggcatcatgctagagccccctttggcaaagctctccaaatgcaaagctatcacagttgtagagtaatttaaagcggcctatgctgatacattgcagcaatgtgtaaactaacttttgcttatgtcaattcatgtctcccttcaaaacagagaaaaaccaatgcaggatggtaaccgatcgagaaaattgcaaataaaaaaactgcacattgagatgcatgatgaacacagtagagtttagtcccatgaaaatgaagtagataacatttcctaacatatacagagatagaaaagagtaaaccacggttcatgtacatgaataaacaaatttagacagagaacaacgatgacaacgaacgaaggcatgcaacaagtagtagcgcacagtacacaagcagcagcagtagcagcagacacggcaacggcacattgtgtgtttgtaccgatcgaaatatatgtagcgtagcgtagcagagagccagagaggcaaagcgggagggatcgatcgatcgatcgatcaggcctcgtcggcggcggcggcgtcgtcgtcctcgtcgtagtcgtcctcggcggtggcgtcctggtactgctggtactcggcgacgaggtcgttcatgttgctctcggcctcggtgaactccatctcgtccattccctcgctggtgtaccagtggaggaaggccttgcggcggaacatggcggtgaactgctcgctgacgcggcggaacatctcctggatggaggtggagttgccgacgaaggtggacgccatggagaggccgacgggggggatgtcgcagacgctggacttgacgttgttggggatccactccacgaagtaggacgagttcttgttctgcacgttgatcatctgctcgtccacctccttggtgctcatcctgccccggaacatggcggacgccgtgaggtagcggccgtggcgcgggtcggcggcgcacatcatgttcttggcgtcccacatctgctgcgtcagctccggcaccgtcagcgccctgtactgctgcgacccgcgcgacgtcagcggcgcgaaccccaccatgaagaagtgcagccgcgggaacgggatcaggttcaccgccagcttcctcaggtccgagttcagctgccccgggaaccgcaggcagcacgtcaccccgctcatcgtcgccgatatcaggtggttcaggtcaccaactacaacaacagcaaattgatcattatttccatcatgttaatttcaagcaaattacacacacaaggtcaaggtgcatgatcgcttcgcttacatgatgggttggtgagcttgagggtgcggaagcagatgtcgtagagggcctcgttgtcgaggaccatgcactcgtcggcgttctcgacgagctggtgcacggacagcgtcgcgttgtagggctccaccacggtgtccgacaccttgggcgacgggaacacggagaaggtcagcatcatgcggtccgggtactcctccctgatcttggagatgagcagcgtgcccatgcccgaccccgtgcctcctcccagcgagtggcacacctggaatcctgcactcacaaaattgcatgtcactcacgttactacatactccctccgtatcaaaacaaaccaactatccatcagtagttataggacattactcagattaggataagtatatgagacatcttaactgaaaatgaaaatgatctgaactctactgtacattgaggtttagacatttaaccgagctaaagttcagatgcccctgttaagagtcatgaaagtgcaaacaattcaagaaactagcaccgcattatctgtcctatcagatctccggactaatcatattcctgtagtactaatttgtgtttctaataatatgtaagttgaatccgaaaatgtgtttatattctgtttctgatgattacgtgcactaaaatccatctcccaaatacgtccaaaggcaatcatgctaagtacatatgcaagtaatcagaacatcatcactaatataatccatccatcgatctatcatgtaacccaaccaccagagactggcaacagcctgtctgagtgtctcatccgctgtaaccaccaccgacggctctgttccattagctgatacatcctcctcctccttcactctttcttgtgttaggtcgtacaacattgtcactagtcacagtatgattgtttttctactactagtagtacattattattgtgatgatgataacctcatgaaccttcaccggcaaaagaagatggtgagatgcgatggtgatgtatttctgtaccgaaaactcgcatctgaccgacaataccagttgtttgccacctgaggaactgatgaaaactctctctcaacgacaattctattcgccagaaagtagcagttaggggatttttttttttagtttgttgctgggttcaattcgtttgggcatacgttgtacctcgcattttcaagaaaacaatgataattactgattactgggtaacatttttaacatgcatatcttacatcttggcaatgaatgaatgcataatagtcagattcaccttttatgcatagagggaaaaatagtattcagcgcacataagcagtactctgtacctcaagtattctgtgaattttttgtgcacttgaagtttttagaaccttcataacatgtatccatagtgttccaatttttaagcagttgattcaactcgatataagatttacagatctaacacagagaactactgaaatttaaaccaacaatatatggcgcctcaatttctagcctgtgttgatcccgatttcccatcatgccaatggatcaacttgacacaggatgaatgtctcattccgacaggtggaagtggtgtaatgtgatggggactgaaaataataatttcatcttattcgattttttttttgaagatattcccaatttcaaccacgagtaaagatgttgtgcttctgtctgattaacccgatccaaccagtactactatgtatcatgtatggtcttttccatgtatgtccaaatttgggttcaacaactggtgctgctggtattcctattcaaatccaacctaaaatggtatgataagtttgcacactgaaattcatccttgaaatttgcagcactactggtttgttttgctcctcaaattgaacaattcacactctcataactggaaccaccaattcatttttattttattttttttctgagacccacaagcaattcataccagattgctcattatcaatgctgccaagttggcgtattactctgttgtctaacaaaagaaaaaaaaaactccagattcttttcatgcggatcttaacacgctgcggtgataggctaataatgtgtagcataatactgtcttacctaaaaatacacacagaaagtacaaaccttgtccacttttaggatgccaccgtctaaaatgatcttgccaaaaaaaaagttaaagaatcatatgatcctattctaaattttcagcgacggtttacagaggcccgagaaacacgtatgcagagaaaatgcagaggaatgccatgaacgcaaggattcgttttttctttttttaacgaaacacagtgaatttaaagaacaagaggatatgtatatataaaatcgacgtgtacgttaccttggaggcagtcgcagttctcggcctccttgcggacgacgtcgaggacggagtcgatgagctcggcgccctcggtgtagtggcccttggcccagttgttgccggcgccggactggccgaagacgaagttgtcggggcggaagatgccgccgatggggccggagcggagcgagtccatggtgcccggctcgaggtccatgagcacggcgcgcgggacgtggcggccgccgctcgcctcgttgaagtagacgttgatccgctcgagctgctgcggcgacgtgccggtgtacgtccccgtggggtcgacgccgtgctcgccgcagatcacctcccagaacttggcgccgatctggttgccgcactgcccgccctggatgtgcaggatctccctcatcttcgatcgcttgcacctcgatcgatcgctcgccgcgcgccgatcggtgatccgatctctttcttggttgttcttgggaggtggtttgcgatcgatcgatggagagagggtggagaacgtgggaaggagaggaggagggatcgtgggcgcttatatcccgcgtttggagggaaccgcttctctttctgggtgttatggttgtgcgtggaccaggtgtatggacaaatgcttacacgtattgatatcgcttcaatttatttatttttttacggttgtcttcgaattttaaagagacggttttctttggaactttaaatttttataggtgacgcgttatttttggtctgagtgtgttttggttattgcaaaagaaaggttgatcaagcgaagtacttaatttgtgtggacatctgttttatattataaatcgttttaatttttttcctaatataaatgcaatagtatttttaacataaacaaacatattgtcaagatatactgaatgttacactaatatgatgttaaagatgttatttttttctataaacttgattaaatataaagttgaaatgacttataatataaaacggagagaatactaaaaattttgttgtggatttgttgcaggtcaggtataaatctagttgtactaaatgttcgttttaattagcgatatggaattatggatgtgagtattgaagtacctgtgtagaccatgactccatgagtatgtaaagatgtgccagggtagaccgcatgaggtactgtggtatcaaaggggtgtggggacgatcacgttgtgctgtctattttttctgccacattttatttttggctgggtgcagtggcgggtcaccaaataatgggatcaatgctaatttactacggatcaatttggtacctgcaagcacacttaggcctagttacagatcagaggaagaaaatagcaaaatcatggagcactacttttctactacagtattagtatggggtaagttttttttttggtacaactttttttgaaagatagttatatgttattagagggcacattatattggcatatttgccactagtagtatttctgaatgtcaaaattttttaaggcgtgtctcaagaggaatggatccatattaattttaaaggcctttgttacctggtagagactgtcataaaatctcttcatttacacgtccacatgtgtacatcctttgggaattttgatatgtactacttccttcgtcctaaatataacacatcctagttctacaaatttaagcagtcctcctatacaaatttacaacactataatgtgtcacgttttgtagtaggtttattttcttaacagaggaagtagttcactagttctctacttgcacatagccagaagttggctttttttgggatagagggagtagttcacatgtgagagtacatagtactggtacttatatgtgtcaagattcattaacatatatataaatatagacaatcgtagaaagttttataatctaaaacggaggtaatactattttagaggaagaagaaccttttaaaatgaatttctttcgtacgtgaatatatatatatatatatatatatatatataatatacatacatatgcacaatttactactccctttcttttaaaataatttatattttttaaaatttaataatcttttgtatgtaaatctggacaagtcgattgattttggaacggaagaataccctaagaaagtacactcccctgccaatgaagagaaaatgagaaaacaagtacactgattgttattagtatatttaaaccaagtttggtatgacttattgtgtgctcgaaaaagtacggagacagcttggccaacaagtgttctttttatgattaatataaatagatatcaagagaaaagttagctgtcaacttgtccatagtgttacattgctctagccttgtcacgttcaaatactgtttgccatggcatttgcaaggagaagatgctgttcttgatttctttcgcatcattatcatgatgatcatcaagtcattgtacatacatatatatactcgatgattgtaaacgttaccataccaaccaataattatattccgagataggatccggagactggaggggactgttttgagtccatcagtccacatgcaccagcacatgttgtgtctgtcttaaaccaaccgatatcatatcatctaattaactattaacttctcttcctaacaggtgacagccatttttttgctagattaataccattgtttttttaaaattactccctgtgtacaactccaaattttctctcgtccaaaaataatgtcagatttctaaatggtcttttccaaaattgtccctgttgaaagcgacgtatatatcttagattcttgaaactgcgatcaaataatagcttagctataggcctgaagcttagtttcgtaaacagtttctggcccagtataaccaagcggcgttcttaacttgcggctatggttgggctgcacggcctgcaggttacccagaccagacaggtgtatagctgcagagctagagaacgaatatgtccacattgactccctcaggtatagctttaatctaattcttatacttcaaccgtaatacctgatatcttaaccccaactattaaaacttatgtaataatatgattcccttaatagttttggaggacagcttcgctgaattggcactttgacctggtccaaaccggctgacttagtatgtgggacccagtgcaaccgctagagaacgactaattaaagtgggcttggcacgataattttgggctcgacgtagtaggtcgctgataaagatggcctaggagctgcatgtatggtccagaggtggtgaaatggactagagcctagaggagtgcggagagacacaaaaaaggcccatatagaatagccattaacataaggcaaaatttgctacaggacatgtaattagccgaagaacaccggaagaatgtgtatatgctggagagcatcgtaaaacactggtaattagctgatgtacactcacgacattattttattatttctggagaaaatagagagagaaacagttgtgaaattatggttttacccttgaaccccaataaaggctcactctcctgtgggacccacctattagggaatattattttttttctttttctctcctactgtactccttcgtcttcctttcttcgtcatgtcttcttccatgatggccagcccctccccacccatcgcggctccagggatagagttcacggcgccgccgccggggcgcgaccacacgcaggattgctcgctcacctacgcgcagtggaaggaggtggacgcctccacgcgccaccgcctctcgctcgacgcccgtgccgcgctcggctacaccgctcagaggatcttcgcgcggttcatggccatcaccaagctcacgctccgctacgcccagggctccgggacggacagcctctctgacgacggggcacgccatgtggtcgccgcgctgccgtccgaatggctcgccaggctcaagctccgcggcctccggcagctcttcgacgacgggattgcgtcgctcgctggggccacgccggtgatccgtaaactgtccgtcgcatccatcagttttgggccgaaggccttcgtcaccgtcctccggtcatgccccctcctcgaggacctctccgtcaagcgccttcgcggcctcctgtaatctcacggcgtccggctgggagcaagagccagagaccacgaggagcacccaggcgttggcggtggcgaggaagaggcccgtggggccgtggacgcagccggaaccggagacgacgaggagcagaccgggggagccggtgaggaagccataggggcaaacttgtctttaatggatatttctctctccattttctctggaaataataaaataatactgtgagtgtccaacagctaattaccaattttttatggtgctctccagcaaatacgggttcttacggtgtcccctagctaattaaaggttttttggatgtcttgtagcaaattttcactattccaaccaggatacgcatgaaaaacagagcgatccattagcgcgtgaataattaaatattacttttttaaaaaaatagattaatttaagttctttaagcaactttcatatagaaacttttttaaaaaaatgcaccgtttagcagcttaaaaaacatgcgcgcggaaaacgagggagaggggttagaaaaagggtgtgccgaacacaacatattcctctacaatagtcacaaacccgtgcgttacaacggaacgggatctggtgaacgtggttaacggagccatcgtttcgcttattgacatatttgcaaagcaaaaatactttgtgaataaaacttttatatacgtgttcttagcggtctaaaagcaaatattgaaaaataaacttcgatgaaaaaaccttaaaatcagctacaaatttaaagttgaaaattcaaattttggctgataaatataaacataaatgaaaagataaggccctaaaattttctgttcttctgtatttctctcttggctagtacaccagttttgttcatgggatcctataatcttataatactatacaagtgatccccacttagtgcagttattagggattttcctgagctgtggttaaggcacgtcaccctttttttcagccgttcgatcaaatcctcgccaaccgttcgattgcaatccatcacgcacatccctccgccactgatttgttgccgccgccgccgccgccccgggtctcccccatcgcgcactgcttcctcccaccaatccccacgcgcgctcgcttcctctcccccatcgcgcgcgcaccagcgcgggcccgccgccgaacgccctcgcttcctccatcgcacgtgcgccaggcgcgggcccgccaccgacgccctcgcttcctctcccgtgccgcgtcgcgtcatccctagcgcgagccagcctcttcggctccttggcatgtaggaatgaaacaacaatcgtcctatctcccccaatcgttgtgattccatgccgtaacgttaaattctttgctcgccctattgtgccacaaaatcgaagcaaaattaggatacgaatgtggtatattcatggttgccttcataagctgtctttaaatcccaactcgatctgtgcctatcatgctatggaggattgatcactgggttcatcattcgtgaaggctattgcaactggcatgcttctgatctctatcttggttggattattttgtgcaaatcatttcatcgtttcatctcggcttcttcacgtgagacaacagctgatttgtgtattccgtctaccctcaagtggataaggtagcattttctcatccctcatcctgtcatgtttagtttaattatgggctctccatactgaaacagggtggtttagcttttggatgagttcattgactgtactcatctttttctccctgtacaaaaaactgcaatgctgtaggtgttctttcggtgaggcccctgcatgatgcaattctttttcgttttgtattattatgttattttccctgtaatgttaaatcattcctatttgctgatcgatttggcagaacagctcttgcggtaattgctgggaagataaattctgatcattaatttttaccttcaattttttttaattccaaaagagaattcagttctcttctaaaatgcatgaaagtgatttccgaaaattcagcactatattaattgattttttaaatttattttcttacagcaatatcatttatttccattctataaccccatctctatcatatcgaccaaaagaacaatgcaactattggtctctgttttgtaccaaagcaaagcgcaatgaacatgtattctttctttcaggcctaaagtccatatgtgttaactacaaacattacctggcctcttcctgcttacagtttgcaagtttctgaccaaacttttaagagtagttgattttgccgatttacttcatccacatgatctatataaggacatagactatttatgatttataaaggtaaaattaatactccctccgtattttaatgtatgacgccgttgactttttaatcaacgtttgaccacttgtcttattcaaaatttttatgtaaatataaaaatacttatgtcatgcttaaagaacatttgatgagaaatcaagtcacaataaaataaattataattacataaattttttgaataagatgaatggtcaaacgtttgttaaaaaatcaacggtgtcatacattaaaatacggagggagtagaatatagctgtaatttagtacactaaaaccaatatgagaggttagatcgattaatgttagcatggactaggctaatatatttttatgttagccttaattactttgctaattactttgttaatcaagcaggggacgtactactacacgaggcggagccccggtacttgcccgttgtggtcggcccttggctacacccatgacggttatttcctacccgtataataaattacccatttaacacatactcagaatacgtacccacgagcatgttctcttttggcacatggacactaaggatgtgtttagttcacactagaattggaagtttgattgaaattaaaacaatgtgatgaaaaagttgaaagtttatgtgtgtagaaaagttttgatgtaatggaaaatttagaagtttaaagaaaaagttgggaaactaggcctaaaagataggagagaaacgataaaactttgaacatgagagtaagtttaatagtatagtcaactactaactccaattcatctatagccaatcttatagctcattcatacaataattacatactacactattaatatatagtcccacctgtcgtatacatactacgtcttggagtccgtgctacagctggctataaatctgtagaccgctgcttttctctctctttatttatcttactaaaatatgtttgcagctggcttatagcctgctattgtatctgctcttatgtgcatagtcatacgtcaattactaacttagagctagcatctcaatcaaagtggttacatacggaccatccgatttgatatcctacgtgtgaattcgctcactaaagttgcacattcgcctcaattgagcttccaaaaaccactctcgtctgttccatttggtgctcggtgtaggtgacagtgtcgtaggtgacgttcttgaggaagatcttgatcacgccacatgttcctcgtagatgagcctggagatgcgcttgggcatgccgcgggtctcctcgtaaatgaaactagatgataccccgcgcgttgctgtgggatatcgtgcctaaataactttggagaaatgggcacatatatataataaagatctatacaaaaattaacactgcaagctagttttcagtggcatgcataatttctaatgtcaacctgcttagtggagcatcactgcgtacggctgcaatcacgtggatgaaataaatcggcaaaatctaacgagatctctaattttattgggtgcatgcattatatttattagattaatccaaactataaggtgataataattatttcttagtttttagctaaggtggttgtgctttatattttggaatggagggagtatgtaataattggttatagtttatttgaaataaagaccagaacaaaaatagtatgtgtggatggtgtgtatacacgtgtacaatcttctatgtaaccataaaaaagagctcacaaggtcgtacttaggcattaagagcccattgtcgacgtttgatgtcgcgattccggtatttgcatattatgaggatcattggtactaggatatatgtgagattgtaataaaagagatggggccctgaattgtcaggtaataaccctactcctgttggccgaagccggtcgttgctcttatttatcataatcacaccagtacaatatttggggtagtctatctatctgtcgtcgacttggcggccataaaaccatctcgtagtcgacaagagagtaatcttcctcctcgaatccgtgtccggcgagatcaaagacagcgctatgtctctcctgacagtatccgtagacaccgtaggggactagccatgcttatctctgaagtcgatatccggcgtcttgtcttggcgtatgttggcttgtatgttgatcttgtgtttgatctattgttccgtgtcccctctccttctagggggtcttgtatttatacccgtaggtgtccccttgtccaagtagaactagggaaaccaatatggatacaatccgagtagttcttgtcgtttccatgtagaactctattcatccttccttatgcggaactcctcctatatccgaaggttgtttccgtataagacatggtatgtggtgggtcctgccgagatttagtcaactactattagatatgtggtatccataaccctaacacctatcttttgggttatattcatgcttacccataagtcgtattagcaacttaaaaaaataatttgtaggtaaaatttatacatatgtactcttaactatgcaacagcaaatgctataaaataaattatgattaaaaaggaaaaaataactctgaaataagttttaaaatttaaatttaaatttaagtaaaaacatgaggctgtaacactagtacgacctatatagcccgtatacgcttgcaatatggatcagtggatgcggccacgtagggggagtgggccgttcaatgtggtatggccgggccgtccttcacgtcttgcgcgtgacggcgcaagtacagggccaacacagccagcctgagaggaccaacacaactctcttaagactgtgcaggtaaaatgccttcccctttaggttgtgtttggattcaaagtttggatccaaacttcagacattttccatcacatcaatttatcatacatataacttttcagtcacatcattttcaatttcaaccaaaatttaaactttacgctgaactaaacacagccttaatggctttctcttcggcctcgcgagggagcgaatacatagctacagtagctcgcacgacccgtgcggccctgccacgagtaactgagaatcctgactactcaaggacgacgcatcaatgcatactccagtatgagggaaatgattaaatttgcacggttcacttcattgttctgttttccgttcacatcgcacatctagatgaggaaattgttttattttcctttctaaaaaaaagaaaaaaacatctgtttgtaggtgcgagtgtgatacgcgtgcgtcccacatgtactcgaaaagataggttctcttcatgaaacaatcatgtcaaattcataaattttagtatgacaaactttctttggtataacttggcaaaccattaccaattcagaaatttcggacaagacagggaggcgatctccctctcgaccctcaaagtatctccaacagtctctccaaattccactctccaaatgtctatttagccaactctccatttaatttggcaagtcaattcgttgtttctttcaacagcatctccattcatcctctctattctgagtctatgacagcaggacccacatgtcaccctatatactactttctttctcatcatcctgctcccactcttccccaagcccccttttgcttgcggtagtggtagttactcgcggcgatggcggggcggcggtggccgtgagcagcaacggcgagacattcctgagctcctccccacctctctccctctgctgcggtggcgacatgcacacgacggcggacagcaaggggaggcagcgagtgcagggggctaagtccacgcgacggtgagtgcagggagctaagtccacgcgacgtccgccctttcttattcctcatacttctttctttcctccacacccctcgtctccgtgctagtggcgctcctctgcgtggcggtggtgtcgccggcggaggtgggggggcacggtttgtgtgcctctgctccggcgatggaggctgacgatgggggcgacggtgagggatgacgaagactgcggcggcagcgaaatgggagaagccggccccactgctgcctcatctcctatctcactagcgccacccacctccttcccccgctcgctggcgtcacgagcccaccacccccttttcgcctgcccccaccgcctccaacgccgagacccacctctccttccgcggctggttcggtggcccccttcatcttctcctggggtgaggccagggagggcgacggttgaggcggtggcggcggaggaggcagtggtgggctcgggggcgtcttttgggcaggcgcagcgccgtcaccaccggcagtggcggctgcggccgcgggcggcatcggtggatggatggcgcgaggccgacagcgcggaggacgatggatgatgcgatggcgtgaggcagacgacgcgaaggacgatggatgatgcgagagtggagatagggagcaggaatgtgtggggcccatggttggctagtcacttttggctggccaaatttggctagtggagggaaggttttagccagctagatgacttagtcattcggttggagaggttgttggagggtgtttttttggctagaatggagagtggaatagtgaggctgttggagatgctcttagctagcaatccccactaccgcgccagctgcccttccctgctcccacttcacaaccccttccttttttttctcttctttctttgccttcatcgtcatcgtcatgcgaagcttcccaggtgatgggattttgttgctcacgccatcaccgaatcacggcgacttccatgccacgtggatggggctcggctgaatggagcgcctccccaactaggccagttggagcattgtcatggcaactcattgaggttgtggacgacggcgcgcgggctactcgtcggcagggttttaaatttcgatttcggctaaaatttcgaccatttcagtagaaccaaaatttctaaaatttcagtattttttgggccaaaattttatgaaattttgacacaatttaattgaatttgactaaattcacaaagaacatgagaaaaatcgaaaatttcggctgagatattgacttgccgggggaccggaatttcggaaatttcgaaataaaattttaatccctactcgtcggtgctagggcaagaggcgttgtaggcagcatggcgcctcggtggggccatggtgttgacgacacaacgatctaaggggggtagatcgccgctgtttatggcatgtctggcttgcccgcctccagtgcgttgttcgtggtgtttccatgacaatggtattctccaatactcactgtgtgtgatgagcaggttatgggatggtgaaaaccttgtaggattctaactgggatttgatgacactctcgagcaccatttcctcattggaggcgtcgccactgtcccccaagtgaaaacattgctttgtttttctggacgagcggtggtggtgtctcacgccccgtcctctatggaggcattgctttggaggatttgtgcgacggtgactatttttttatcggctttgatggctgtgtcggtggcaatatctagactaacgatttatctactactcagttactctcagcattatcttttgcctcgatttgacttcaatcgtcaatagtgatataagcaaaataagatcaacaaaatgattggtcactgatttcagagatgctatttcctaatttcataacttgcaagccgctatgaaacaacggttatacaattcctcgctaggctacgttcggatatgggagatgggaactcattctctctgcacgaaaaacggagcggtctattagcgcgcgattaattaagtagtattagttattttttttcaaaaatggattaatatgattttttaaaacaactttcgtatattaactttttttaaaaaacgcaccgtttagtagtttgaaaagcgtacgcgcggaacacgagggagtggggtcaggaaccctttgcaactagggctgtcaacgagccgagctcgagtgagtctggctatgtaggctcgagcttgacagtttaacttggtgaaactccaaagaactttctcttgtataagagatattaatgcaaattatcggtagtcaaaattaatgggtgctacttgtcttgaatgaagcctcttcagctttcttatgaattcatgactttgaaacgttgcaattaacaaaagctagctactacatctaataggaatagtagtactattactggcagccggataattgctttattgagaagcatttataaggtcttgagacattagtaggtcaagcacgctgataagtatacattgacccatcaagaatatcttcctacatgtaatgcatcttatactaatcaagccctaccgagctattcgagctcgagcttgctaggcttgtgagcctcagcctaggcttgagcttggcttgtctagtatttgagccgagctcgagtcaagcctataacgaatcaagctcgagcagcttgcgagctccgagctttttttacagccctatttgcaacaaacacagcctaaccatagatgggagttgttttctctgtcttcgggttggtgtttcatgtagttttcttgtcttgcatcaagttgtggttttggaagttgtaatcttaccttcaacctccgtaaaagttggttgtagctttttttttagcaaattaaagtcaataataaatttcattattagaaaattttcaaataacttagtagtggtgcctataattatgtaggaggggtatttttaattgggtttaaacgaggatactgattaatgattggcctttttttttgcttaaaaatatgttaaagtgggtaatactaaattatgggtatgtacgtatacatatggtatccggtacatagtagcgtgtatgctatgtacgttcctgtgtataataggaaaaaattgctgtcacagtacgtgtaacaggactacaggagtaagtagcagttgagttattgtactcgttcctgttcattgcacggaactgaaataaaggaacggtttttaattgcttcagaaccctggccattgattaacatatctagcaatgattcggctgactagtcagtagaagtccatttttatttttattttgcaaccatcaaatatatcggtgagtttactagtagtagtagcaaagaggagtattttaattataaatcgaagaaatttgagtgactaattaacatcaatggcccacttgaagtacacaaatgtatagcacggatttttggtcagtactacctccgtcccaaaataattaccgtcgtggatatccgtacccaacgtttgaccatctgtcttatttcaaaaatttgcgaaaaatttgaaaatatttagtcacacataaagtactatttatgttttatcatctaatagcaataaaaatattaataataaaaaattttcaaataagataaacggtcaaacgttgaacgtgaataatgtaaaactgcacttattttgagacggagggagtagtatctttcaagattgatttgtttcctggcaactgagcatgcaaggcaataatcaaattaaatacagtattaattagtcgtaaggtcgtgtgtcaaattgagagtatgtgtgtatgcatgattcttttctagcagtatcattttcgaattgaatttgccggttgcttgcatacgcgtacctggaggactaatactgttctatcatttatggctttgagaaattaaaacaagactgccaaaacccaaaccagttcaagcattcaattcaaagcgtgtatttaaaggacccgcaattaataggtacatttaatccctacattggccgcaggaattgattgactagctagctagagagacagttccatgctctctgaattccgaattaaaggaccgttgtacagtaaactgaattccgagtactttatagtagtatagcataaaaaaaatcattgttccagttcctctcgcatttttatgatagtaacagtagaattgataaatacatttgacaatattaaggttagagcaaggataataatagagcccacttcctactattagctcatcttaaagtcaacatatataatagattagctataagagcaggtacaattgcaggctataagctagctataaacatattttaaagagataaaggaagagagagaaaagcagcgggctacagatctgtagccagctgcagcacggactccaaaatacaatgtgtgtatgataggtgggaccaggtattaatagtatagtaagcaactattgtatgaattggctattacattgactatagatgatttggagctagcagtgggctatactattgaacttgctctaaggttggctacaattttcttctcctctctctatctctcacttatacatttaatgtatttgtcttggagcttgtgataagctagctcttgcattagagccaacatccttaatttttcactacctctctcctccacctaagtttatagtaggcttatagctcactattatacttgctcttagaccctgtttagatgggactaaaacttttaagtccctatcacatcggatgtttggacactaattataaatattaaacatagactattaataaaacttatccataatcttggactaattcgcgagacgaatctattgagcctaattaattcatgattagcctatgtgatgctacagtaaacattctctaattatagattaattaggcttaaaaaatttgtctcgcaaattagctttcatttatgtaattagttttgtaagtagtctatatttaatactctaaattagtatccaaatacagagataagtctctggatccaaacactaccttagatgtatgttgtcataactagggagtatattaaaaagaaaagaactgacagctttcagccacatgaaattctcatagattccaatcgaattcttctttttctccggcgaacacttcttttatgaatatataagcacagttgatttaatttattctataaataaatcatgacattgcacgtataaactagtatattcgtatcatatgatctacacatgtaactagacagtatattgaatattcaaaacatgtatcgaagattttggatgtatggctgcacaatacgaagaactcgcagtaccaggcgttaacgatagtgtgcaacacctgagtgcagaggaagacaagccgtgctggacgaaaagcaagtagtcacgtgaagtgattttcaaaaatcttattattgccttctccctatgcaagacatcgaagacgaaggttctggaggcgtgctctcccaataaccgcgcacgccagtgagtgggacagagttgactacgagtaacgagcgacgacgcaatacggaggaggaggcaaatcctagcttgattccgcgtgcgttgcgagaaggtggtggttcggttcatatagagatatcaggacacgtgataagagtgcctgcatgatctccataccgtgta

SEQ ID NO: 1832 - DNA, 22010 bp, Oryza sativa
tttatctagacagtggatcccccatacaactttccctacaatcggcgacaccaaaactctactccctccgtccctaaatataagggattttggtaggatgtaacacatcctagtccaacgaatctagactgtcgattcgttggactaagatatgtaacatcccaccaaagtttttatatataaggatggagggaatatctaccaaagaacctacagaatagggcttaagggttgggaagtggtggaggtggtaaggggcggtaatcaaggctactttcttaattgatactactcctatatgagtactagtactctataattctactcgaaagcggataaaaacatgctttgttagtgcagcaagtgtcaaaatacagtaatctgatcgacctgatagatacattttcaatgcctaagtataattgatactccctccgtttctaaatattagacaccgttaactttttagcacatatttaacaacttttgtgaaatatgtaaaactatatgtatacatataagtatatttaatattaaattaaatgatatgaaaataattaataattacttaaattttttaataaggtgaacggtcaaacatatttaaaaaagtcaacggcgtcgaatatttaggaatggagcgagtatttatttagctatgaatttcgctggaggtaattgaggtctgcatgctgaacctgacagactgtactatacaatatctgtagctgccaaaacggctgaaaatccatggggaacatgaacatgatcttcatttcagagcccaaaatcaggatgagcagatgatatatataaacacgatgcaacaggaatgcacattaacacagctagttacattcaggcactgaaattgttctgatcatgcatgcaggggagcgctacaggaagatgggtagtgataaaagagtacttaaaaaaaagacaagcattaggtttccttgtccaacgtttaactgttcgttttatttgaaaaaattataaaaaaaaatttaaaaagataagtcacgcataaagtattaatcatgttttatcatctaacaacaataaaaatactaattataaaaaattttcatataagacggacagtcaaactttggacacggaaaccagggtctgtctttttttttttttttttttttacggaggaagtacttcgcacaacttcaatgacaatagccatactagctaggtcagtaaaggctaattaagccgctgcactgtgggcttgtcaacatctggacaagtacccggtgagcaatcctgcagagtagcagtatgaatcatctgctaatgctagcactaattaacatctaaacgggtcccgccgaaattatctccattaacgtagggtaattaatcaaccatgcatcctggctcaccatttaattatacgcctccttttattgccctgctcttctttaacctggtgcgtaggggtacaaacggtacactagtggtatctaatcttctgtaccaacttgatatctgcccagttctgaactaccataaaattgtggatactgcattgatcatcgtagccctgctcagctcagtggtggcgacatgtaccccatgatccaattaaaaacttttaatacaaattgtacccgttctctatttaagctcaatatgcatggtagcttgatagtactaatgttttccaaatttatttcgtttacaatattccttgatagagtagatgtgctcattaacttaccatcaggttttgtctcatggtacgagtcctggaagctaattagaggtatagctaggacggcaaaaggagggcacggccgaccttgctatgaaccgtgtgatcgtatttggagtagacgtgggccgctctatgtatatcgttgatctactgtcgtttaaactagtagtgtagtacttgtgtacgtatttatacggttgatttagtttaagatctagtatttcatcaattgatttttatctatgtagtgttcacacttctctttttttcttcaacctccaataggacttaatttagcttctctagaacactcctagataggccatcacgtgtcttaataaatcctgtaaattctgaaaaaaaaagaagataaaatttgtcccttaatttttatacttaaatgtatgggttcaatattctaaaccattagagattagattagtagatagattggtccaacctctcccctccctatttttaaggtattcatttaagataaaaggaaattaattaactagttacttgttgggtgctcatgagttgtaacggggaaaaatatacatcaatatcaaatcacagctgataaaatgatgtttaataatcattgagtgtaagcttgttgacattgttgtaacgagaaacattaacttccctttaaaatcttcttctgatataaagaccaatccataggaagttgataggattcttgcggtcctagtccttaatttcttccaaatgaacaaatagatcattttcttatatgatttaatcctaaaaaaatcatcaaaagaaacctttgttccattaatttaggtcctaattgagttaatgggcaccaaccaaatgacccattcctcgtgatcttttaagtacccggtccatccattctaaaatataacaatattatagagtagtccaaaatttatttcaattataacaatcttgttattttaaaagaacttttattgctaaactattcattctggctacctctactactatctaggagtattaatttattattgccaagtagtttgggcttacatacacctcaggtacctatcctgaaaagatagtaaagtatttacactcatcttcttaatagtcataaaacgtgcaatcgcgtatggttagaggaaagcaaggcacacaaacagtagatcgataattaaccgattaactttctctgtaaaaaaaaactaaaacaggtaaaacaggatatgtcatttctaattctaaatttgtttttttaccgagagacatgtaaaaaaaaaaacagcttcagctccttcatacctatttggtcctagagcgtactccctatagtcgtccctactgcaacttgtgccgctctctcgatcttgtactgtgctgctttgaaaagtccacatctaattaggcccgagccggccggagctcaactaataattgtacgagtctaattaggacctctcgcagtcttgggatcgatgacaacgatgcatgccggccgtcgtcctttcggccatgcacgaaattgatcgctccgacgacgtagtactgatctacgtacacggtgggcttgttcatgttttatctgtgccaataatgttaattaattggggtacaattctatgactgtgtttagatttaaactttcaacttttttcatcacatgtaactgttccggtcggactgcgtgctcatccgtgcacgttcacatggtacgtagtgtatacttttactgcagatttgtattgcgatataaaagtactttcattagtacgttaattaacaatgtagtagtacatgcattccccccaacgtacgtgcagtaatattattcgtatgtatatatatacgaatacgatggtaacagctatacgtactatactgtactccataagtgtagctacagtacaaccgattgatacaccaaggaggtgtcctttttctgattattaaggtacacattgttttcagatgtataaacaagccctaattatgtactctatccatacttgtaaaggaaatcgttttggacagtgacatggtctccaaaatacaactttgacttcttttttctataaaaaaatatttattgaaatgtgatatatgtatacttttattaaagtatttttcaagacaaatctatctatcttctattatatactaaaagtccattaaacttcctcaaaacgctctcaagtcgccacatggcgttctaataaattagagaaaatcctagaaattctgagaaaaaagcaaaacatctagcccttgattttcacttaaatttgtgggcctgttattttagaccatcagatcagatctattaaaaaaaactgaatatacaaacgtaacgggagatcagatcagatctacgtacgtactgatctatttcagactagcagaaaagtatgaacgtagtccttgtcaaaaaaaaaagaccgaatatacaaacaaacataatgtactaccggaaaaaataaagcccaaaaaacatagaagatatagataactattattattattagtgataataaacttcaaataattataatttttacaaagattatatattattatattattataattttcaccgccgcggatgacctcgcctccgccctcgtggctgcaagagccatgcctccaaccttgccgccacgggtgcccatgcctccgaccttgccaccatgggaatccacgccttcgacctccattgcggcttgctccggcggcctagctattgctgcgaccagtggtgtaggcggaagtttcttggggtagggaagaggctgagaagtggtggagagtgatgggaaaaaaagagaagaggggaggatggaggaagaagataaatctgacggatgggtcccatgtgcaaatggggaagatgatgtaaaacgtgacggcgattgcatggttccaattttgaaaatttcgagtaggcggaggtttcttggagtagggaagaggatgagaagtggtggagagtgatgggaaaaaaagataagaggggaggatggaggaagaatgtgaatctgacgtgtgggtcccccgtgcaaatggggaagaggatgtaaaacgtgatgtgtgggtcccccgtgcaaatggggaagaggatgtaaaacgtgacggtgattgcatggttccaattttgaaaaattttgagtggcacggctatgaatagacgaattgtaattgcatctatctgaacagacacatttacgaaaacacatatcaaattagcccttaaattaataataaagaatatttcttttcttaaatcggtggaccgttatatattattattttcaaataatgcactgtttaaaaagaaaagtttacaatattttatattttgaacccattaaataaacaatttacgatctatattgactaatttgtactgattcagtgaacccactattttagaataatttttaatgaaaatattttaccattgatttttatttaattagacaccgccagatctatcttttttttaaataataaagcctttgaagacctctctcggtccgtccgcactacgcaagcacacgccattgccttctacatgcacggcgaagtgtggtgcctgaggtagctaaagtggtctaccaaggtgatcacgactgccacaattcaaccgctttgctaaggtaaagacatatcaaatcattattgaatatgatcgggtctgttaataacatgaaaacaatttaaaggagtcagtaaagtatactaacatgcaatgagtagatagagaatataaacaaatagcttacaaacatatatgagtgattgcatgatgtgtcatatcgtgcaaagagttttaatagcgacaaagacatcaagaaaaaaggtgaatatgtgttaatttcaattgcaaaaaaacaaattaggcgaactattttttgttaattaagtagtcattaccctttttactaagtttcattagtactgatgatgtaaatcatatttaacttattaattataatcgaattacatgtaaaaatataatttactgcaaaacacttcaaaatttataaatgcactatacatactaattacatttgtataattcaggtcctattttaaacaaataagttccttcaaaccctgtagatatgtttgacctttagttttcagttagtttaggagtcttaatttctgaacaaactatatataatcttataatccaacaatacggatgcccgcgcatatgcgccggccaccttcctaggtcatataatttttatattttcaacctcaacaatttgagagttatttatgatttatattcctaaggtattaatggttttttttatgctcacacttaatctttattatgcaacataactcgatccaaggcctatggattattggctctctaattcttttcacatgaaacatatgatgattgcttcagcgaaacgcaagtctctcatcccatccaaatccaacatccagaaaagtccccggccggaggccgtctatagaaacgcgcgtcgatcgatccgtccgtccgacgaccccgcccgcattaaaaagggccgcgagacgcccgcgatggacggggactccaccgcagtttgttccccccaccactcctccgcgcggcctgcacgtacgcgtcgatccccgccgtcgacgcgagatccgacggccggcgcgcgtacgaaacacgcacgacgaccgccgggccgtcaggcttggccgtggcccacactactactagtacgcgcccgcgagtgtacggtgcacgtatatatgcgtacggcgctcgagtcctcggattggtctcaattacgagtaatgtcgatgatatagtcggtatattaattaagttggagacgggacagacgggccagttttctccgtatatatgggcacaccggcgcagcagccagcaggatatatcagcctcatcgtttcggtatacttgcaaacagaaaaaaaattgtggttaaaatttttatatatgtgttgctagtgatcttaaaagtaaaggctaaaaaataaacttcgatgagaaaatcttaaaatcaactcaaaatttaagattgaaaatttaaattttcactgataagcataggcgatgagatgagcagtatatctagctgcgcatcaaacagtaccctgctcggccccatcgagttaagcaatggcaggattgcaaaatggaaagttttttttttgccacgactataaatccatccgttttaaaatagaatcactttttagagttcttaatatgtgaaaatcagatgcaagcaagaacatgcacacacgcaacttcacattcacaaacacacgtgcacatcctaagggcctctttgaatcgtaggaatgaataaatggaggaataagaaaaacataggattctaataggaatataaatgtaaaacagaggattgcaaaacacatgaaaaacacaggaatgaccgtttgattgaaccacaggaaaaacataggaatcggatgagagagatagactcaaaggaaagtttgagctcttactaaatttcctccaaaatttctatagtattgtccattccataggaattttaaaggatatggtaggattcaatcctttgtttcaaatggcttcatagaaaattttactataggattcaaatcctccaaaattcctatgtttttcctttaaatcaaaggggccctaaacgtatacttatatactactccctccgtcccataatataagagattttgagtttttgtttgcactgtttgaccatttgtcttattaaaaaagtttagaattattatttattttctttgtgacttactttattatccaaaatactttaagcacaacttttcattttttatatttgcacaaattttttaaataagacgagtggtcaaacattgtaataaaaactcaaaatcccttatattatgggacggagggagtagtacttttgtggataaagattgatgtgtttagatccctgctaaaaaattttcaccctgtcacatcgaatgcttgacatatgcatggagtattaaatatcaacaaaaaataactaattacacagattgcctgtaaattgcgatacaaatcttttaagactaattgcaccatgatttgacaatgttgtgctacattaaacattttctaatgacggattaattaggcttaataaattcgtctcgcagtttacaggagaaatcagtaatttgtttggttattagtctatgtttaatactttaaatgtgtgttcgtatatccgatgtgacacgccaaaactttacacccatggatctaaacacccgtagaggccacaaaacctcagtgcaccctggtgaggcaatgcaacgtatgtcctgcaggatcgaacgcacaccagttaattctcatcgccgatgaacagggtttaccttttcgatttcgaagtagaaaccgctcctcactggtttatcgaaatccgaccaaaaaccggtaaaaacgatgaattcatgtcaacatcgtacgaaaaccggctaataccaatagcgatttcacaaaaactgaccggttttcatgaaattccagcgcagtcctcattcaggaacaaatcttgagtggtagtttttgctctttttgaaacagaggaagttttggctcagtgctctcattcaagacatagctaatgaaaaaaaactgaaagctctaaataaatattaaaatcaaatactaaattaggggtgaaaacggatcgaatattatccgctccgaatctgtcagaaacaaggatatattacgtgcttttagaaatccagcggatagtacaatggggattcatatgcggatatggtatctctaaaattcggcggatgcaaattatctaatatttttgccagattatcggatagaccgtttgtcggataatccaaaattatcaacccatataaccactctatctattttgtataacatgagctgacccatctaatggcctaattcatcaattaacctagatttctttgtcctcaacgtctatctcacacttgattagctgtatttttatattattgatatcatgcatttatgttttttaatacataaatacataattattacgatgggtcgttcattgattattgcattgtagatccttgtgttactaactcgatggtgtattggttgcatacacaataacatccgataaatttaatttattttcgaactaggtctgcactagatatgatataacccctgtccgtccgaatctgctccgtattcacccctaactaaaatcgagaattgtctccagttttaataacaagcgaaattacaagacgtatgacccggttatccctgtataggtgcaggacagtgtgacgtgtgcagcatacacgttcgatcgattaactggacgctcgtgcaggcagtactactaccaccgtccccaaataaatttatttatcacatatcacacacacatatcaatagaaaagaaaaaaaaaagctagaatatctctactttatcaaatcccaatacaactttaatcagtttatctactttcatccaattattctctacttttataaatttcgatgcaatgattactttaataatgaacttattttggaataaatggaggaagctaaaaatgaactttatcgacgagggatacccgtagaccggatatagagggtattggggtccgttggtacgagaatctacgtaatacaacatcaagcaaacaaaagacaaggattatactggctcaggccccttgataataatagccctaatccagttggtatgggattatatgaagaaaatcacagattataaagggaataacaaaactcgatgatactgacgagaccgtagtcgagttggtccgactagatctcccggcgacttggctcctgtaggctccgtaggctgtggtgggtatgttggcagtgatattcgatgctttaggtcctgcccagggggtcccttatataccgcaggtcagttgatctccaagtaggactcggagatatcggacccttcacgatatgtaaaaaacccagtcttgtccgagtagaactccttccatccgtaaataccatccctatcacgtgatagatatctttaatgtatacggggactacccgtatacgcgtgggtataccgtatcagtattgtcgaggagtgatcctctctagcgggacatcgtgagacccccctttcgtgagttcggctgggggaaaaagctcgcctctagaaatcacgcattcgttcccaaggctcctagctagctcgaacacaaccaaattatacaggttcggaccgctatagagcgtaataccctactcctgtgtatgggatttagactgagagttacaagagttcctagactcgggagaacactcttacttccctcctccacgagctcaggttttctgagagtcgtcctgttcctcggtgggcaaggtcctccttttatacctcaaggggataccacatgcaccgcatctacctactcttcttttgggtggggacccaccctatcttgaccaaaacttggcccgcgccttcgcctggaagctaaaccacagcttgtccttgagcgaggcccagcgccgtccctcgcctgacacgggggatagccctgtcattccctcattaatgggtgaatacttgcaatggccgccatccgaatgaccctccgatgggacgggtcatacctacctccactccgccggaagcagatgcaacgtgggagcacggttgtccgtccagtcagacgtgaccggcatcaggccagtcacagaccggtcattcttgaccatcacgcgtcagtttagcacgctgcacgtctgccctactgtattaaatgcgacagggggcagttggggcgctgcgcacattaaaggaggtttagccagggcccccctcctcgcttgctctccccgccaaatggtggctgggcgagggcctcggggcaaagcggcgcaagggcccgaggggcatgacgtggcaccccgaggctccgaccccccggccgctcctacggttcgcggaatgcgggggcaggaccaggctgtagtgacacatggcaggatgggaatgtagattcccctcacttcgcatacccccgggcccatatctctgacaagtatacaatttacatccaatgatagagggtataccttatccgtaaccctgacaaatttaatatgtaactaaggaagtaatattgtaacaagtacctgtaaataccgtcctataagtgaaaaaaaataagctagtacggagtaagagagttaatgagaggatagaaaaaaatacgaagaaatatttcacatgtaagaaaccacttttttatatatgtggtgtctatgtaacatagcgaatatgaataagtatttgggttgggatttccattagcatatacggtcctccatggattaatatagcttgctagcagttgtggtgcatgcgtgcatgacgtcatgctttgccacttgccagttagcacatgctaaaattccacgtgcggctaaacctgcgttgattctaacaacgttactactccatcaaacacaacagctgttttattttattttttttaacagacagctgtttttcttttgtttctttgaacgagatttttctttttcaattggggcgttgtcaatcgttatggtcggcaagccgtaacaataataacgctgacgataataagggaaaagtccgtgcaaatgtttgatttcaacacattcccggttactcgggtaggtgtgtgatatatgtcatatgtggatactactccctccattcaaaaatatttgacgctgttggcttttctaaacatatttgaccgttcatcttatttaaaaaatttaagtaattattaattctttttctatcatttgatttattgttaaatatacttttatattttatatatttcacaaaaggttttgaataagacgaatggtcaaacatgtttaaaaaagtcaatggcgtcaaacatttagggaaggagagagtattaaattatgaaagttgacacatatagtgtcacaactcagaaactaaccttcctaccacgaagttgtcactgatccaatctttgacctaattaatttgtcgacacaaaatagatactccctcctctgtatgacgcgttggctcatatataacgtatgacgagtacatttagctacttttccaaataaaaaaagaaaaataataaatccaaatttccccaaaaatttaaaaagttttcaaagttttattttctaatttttcaaactatacattatgcactccaaatctgccatcatcctaagaatattgctaccatacattatattctttgttcactccatgtgaagtaattttccgtattccttcgatcatccatttaatcccaaagcacctctcgtagtaataagttcttttatcggaattgttaaatgtcattcgacatattattggggttaaaatcttacagatttctaaccttaggatttgcatcgattcgtgctctgacgatcccagctcttctcctctagttcctgcgacaccttctcgttgccatcagaggaagacaatgcaagggcatctcattgctgccggcttgagggaaatgagagggtggaagggggtgaggggagggggaggaggccgcccgggggcatgggctcactggtgcgacaccttctcgttgccatcggaggaaaacaatgcaagggcctctcattgctgccggcttgaggaaaatgagagggtggaagggggtgaggggagggggaggaggccgcctgggggcatgggctcactgatgcgattgatgccttccagcagctaatgtggctaggcagcggcaatgacggggggagtcgagcgaacgagcgcttgatctactcagtcccatggcggctatgagtaaggagggaggagaggaagggaggagatatgattaagattgttgcatgaatcttgaagcagtcatactgtcgaagaaacaagaactagggtcccaattcccctagggcatcaggggacaacgatacatatcaagacgtacaagatctacatcttcaaggtatagtggcaggtgtgttcaagcaagggcctcatttccaagtcgtgcaaccatgaactccttcatcctcgacatcttcgagaagctcgtcctactccgaagaacagttcatgcctagtagtagggtggcctaagttcctagggtgccctagggatgtagggtgccccagatacgacggccgtccaaaaacgaagcccaatatctttgggtcccggagaggggcctaagtgcacttcatgccccgagcgagggccaaaatgcgttccatgcgctctcacttacgtttgtagtcacgtcaaggaaaagttatcgggctagggagttgctcaaccgctcccccatattaatagtgatatggtgcatgccttccatccatctcgtcgataacatggggagtgtgggggtacccatgcgagacgtcacctagatgggcctacggacaataaggacgggtgcatcttttttttactatcggcatgctcgctccatcaatcaacaagggaaacattgatccccgtctggatcaaaagacaatgattagaccaagcatgattcatttagtggtgtaggacccacttccacatcaatgtaatggcactgtggacttcccttaaactatataaagaggatccatgccaatggatagagggttttgattctagcaaactagcatacatccttaggctttcagttcccctcagttcctcaccatgtaaaccaatttcatcatccacacatagttcgtagataggagtagagtattacgcatcgatgcggtttgaacctgcataatcccatgtgttcatctttcgctcacggttagggcccgaactcaaaacttgcccctagtcgaatctcctaggggtagcacacacttacccgttagaggatttccacgctccgacatgtatggttcacaattcacatgattttatagggtatttttctgtcaaatactaatccatctgtttcatattataagtcgctttgattatttaaaagtcaaacttcttgaagtttgaccaagtttatagaaagtatagcaatatttatagaactaaattagttttattaaatctaacattgaatatactttgatagtttctttgttttacgtttaaaataggaaaaagtatgaattaccgccctgatctatcgtggtcgaccaaaattccctcatggaccacaaaaaccgaacattttaaaccctaaactatttataatagatgaataaccgcctagcggttttagtcctacattgccacacacgtggcacaagccccagatgtcaacctccacctcgttctccctctcttatgaagctagagggcccccacatgtaagctgctctctcctcttccattgtctacaggccacagctacagatgtctgcaccgcggtcctaggtcctgctgctgccctagggtcccgtcaactcctcgaggcacctgcgtcgccgccccatggtcccactgccgccactaggcactcacatcgtcgccctcatctcgaaccccgccttcttcagccggtcgtcactgccgttgcccccatccaaccgatgaagagagagggagaggggagagagagagagagagagagagaggaaaagagatgacaagcagcaccctccagggcaggtgggaaaagcggcgatggccgcggcagcctccaagactagcggggaaagcggcgacggctatggtggcggcatcggtgaaggtggcgccgtccagacaagttagaggaagaggaggatgtcaggagagtggaggtggtagcggcaagagagggaaaacgacaggcggctcctgcaaggcaggattcgacgaggcaagcgccatccgctgcggcccctcttccactcttcccccctgaagttatgtggacactggcgaggcgagccacgccaccgccatcccagtcgcgcccgttgctgctagccgccgactaaagcttcctctccgccgctcccatcgtcgcctggagcgcactcctagtcgtggcccctccccatcgctgcctagagccacccaaacatgcttgtcgccactcgccgccgatcaattcccactccccgctgcctgcagtgcactcctagccacgccccttcctcgctgctcccgctgctgaccagagctacccagtcacgccccgccgcccccactacaacaaaaggaatgtattaagacgcttggccgaagacgagattataatcgtcccaccctgaaaataaaggcgctccctgaccggttcccttcccattgtgcctaccgccagccggagccgcacccgcgcgtcgctcacctccaacaccaacagcacacaaagagagaaggggttaatatgacatgtgggccctatattttttattttattttttttttgctgattggatttccatatcggcgccacgtgtatgccatgtaggaccaaaacagctccagattaagtcggggggggggtaattcatccggtttcaatagtgtgtggtttaatatgtttgttggaggactgagaggcccctccttcttcagttcggccgggggcagcgggtgtagtttgaggaagcgagtatgctacaaagaaacgaggaggggggtcggggccgtgtccaagcggcgagacggcaaggattagacaggtttgggccgctgagaagcgtaacaccctactcctgtatatgatgatttttctgagctttggaagtctctgaatctctggtgtacaagctagggttgagtgtttttactccgactttggggaggatccctgtgattcttcatttaatggatgaagattggaggcttgcatgcactgggaacgtcatcccaggcattgcacctctcgtcaccttgatgggacagggcataccaaccgcgcgtggcttgccgctgtcccatctcgtccttgcaaggcacgctcgctccgcccacattgaatgcggttaggtgggcgcggaagggtgcctactaatcgcctttgcatggcggccacgtggtgaccaccccgaggggtcgaggcggcccgaccctctgggtcaggtatgggcggcctccactcgtccatggacgcgacccctcggggcgaacgccacgtggatgccgagggcggcacctcccctttaagcacggtacttctggtacccccaatccttatcatcgacaatattaattcgtactatcgcaatagttggagggtaattcatattttttctaaaagatattgctatattcttctataaacttagttaaagcttaaaaaaatttgactaaaaagttaaaacggtttataatatgaaataggggtagaataacattttttaacctaaaaccaccttaatagtttaactctttatattttttcacatggttagtatatatcgtagagcccactcataatttaccaatcccaaagaagatacctcgggcatgggtccctggaaatccccaacaaaagggccagtacgtgcgtgaatctggtagagtatggtaggagtactctatactcctactccgggtcatctacgccacctcccacatgcacacggattacataagcctcacgccccctcctctccattactccaaatcccctctgattagaaagagagagtgaaagcgagccatagatagatgctacgcgtagcgctagggagtagtagtagcagcagcagtcagcagtgcagtggagtacggtagtatagggagggctggtccaccgtcgcagtccgtcacacaccgggaggccttgccatcaatgcggaggggtcgggccgcattgattgcacatcttgtcctcatgccttgcctttccaacaccttaattaatggcgcccatgcgtgcctccaaaacctcccctgtttcccttccccctctccctctcccttgctctctcttctttaacctgtttatatttatctccccctctccgtctcgccgtctctcagctctctctgctactcctcctagctgcatgctaagctaaatcttctgttggattgcctagctttgctgctttgcttgcttgctgtggtgtggtgtggtgtgaattttgttgattggtcggagcttggggttgtgtatggtggtggtggtgtggtagctagtagctgctagtgctagatggtcgcaggggcgttggggtacatggcgagagcggcggacggcggcagggcggcggagctcgtcaccagggatttcctcggcggctgcgtcgccgccgacgacgccagggacgccgccgccgccgcagcagcaactgccaggcacgactccgtggtaaggccgtgttcttgacatatctctttcttcttcgctgttcaattgatgcttgattggctagtttggcttgtttagttgggtaattagagcgggagttaatgatcacaacctgctcagagtagtgatttatggccgtactgcgtgtttggtggaacagcaccgcagagtaacacaaaggggaggaattaattcgatccaagattttttctcttttcaaatttggtctctttttttaatggatagacaggtagataatcctaatctaagaaacttcgagcaagccattttaaatactagcaggagtatgttcattactaaattactttgctttgtcagaatatctactggccgattactcaatatgcgtaagagttggtacagtcaattcttttttttttctgtggccagtttatcttcctctgccgtgttatcttggcaacaagaattcttctcgtaattccaatggaaagaatgaaagcaaatattggtctcaattcattatttttatatgtaaccttgaaaaattcacagttttttttatccaaaattggtttatctttctcctctgatccgatttctaccttgatctgcttgtgtttgtgcagtccggcaagctgtccctgcagaagcagacgtgcccggcgacgccgacagacctcaacctcttccccgtccccggcgccgccgcgtccgccgccaagccgtgcccgtcgtctacggcggcggcggcctccggcgcaggcggcaccacgacgacgacgacgacgtaccacagcgtgtgcacgatcgagaaggtgaagacggcgctggagcggttcgagcgcggcaagcaccagcaccaccagcaccagcagcacagcgccggcgcgtccccgtcgtcgtcgtccgtcaccacctcctccgtgaagcgccgtggcggcggcggcgtcggcgacggcgcggtggagcagggcgacgggtgcgactcgccgtccgcggcgggcggcggcggcatggtggccgccgcgtgcccgaggtgcttcctgtacgtgctcatctcccggtcggacccgcggtgcccgcggtgcgagtcgcacgtgccgccgccgccgtcgccggcgccgaagaagaagccccggatcgacctcaacgtggggttcctcggcacctagctttcctaccctaccttcacctgcatcgccacggtggacacatgtgactagccatagctagctagccagccatgcccccaattctgttaggaaatcaatgaatcaatcaatcaaacacgtactccatagaacacgaggatgatcatgacgatgatgatgatgatactagtagtcctagctccactatgtaattgatcaaaaagcattttcgcccttaaatcaacttttccatttttgtcttcctcgaccaccatcctaatcatcatctcattagagcaattaatcaccagattagtagtagtgatctcatagtacagcagtagcagtactacatctgctcattaattgctcgacgtagtcgcagcagaaggtgcagttactacgattgctgcgcaaagtcgtgagttcgtgacgcgagttttaattagggatgtagcagtgcgtatcacgtttcgtctcgcgttcgtcgttgatgatgggggaggagttggtccagttggagttgacgtcgcagctgcagctttgatgaggtgcagtgcttggccgacatgaatggggggaagcaattaatggggcgcgatggagatggttgtccgtgccccgctgtcctcttgctcgctcggtcggggagggagggagggagggcagcctttgctaattgcgatggctgatgcccatcttgatgctgggcgcgagcgcgcggtggagtaggagtgagagtacacgtagtacggccatagcacagcgacgtttaaatggcgtgcagtgccgtgccgcgccgcgccgcaggctacatgccactccggaccgcgtcgtagttgcagtcgcgtcacgtacagtagtatcgtccctcgtatccgcctcgtcatttcgtgtctccggtctccccgatgattggacggacggactgctccccctgccgtacggagtactcccttcgtcaaaagaaaaaaaaaatcaacctgaaaataaatactccctctgtcaatataagaagtttcagttttggacatggttattaagaaagtagatataagtgagtggtggaggtttataattgaattagtagtagaggtaggtgggagaagtgaatggtgcaggtttgtgattggttgtgaagaaaatgtgggtggagaagttgttatattttagaacaaatcctaaagttgttatattttgggacggagggagtacttccttcgtctcattttaaatacaaccataagattccgcattcaactttgatcgtccgtattatttaaaacttttttataattagttttttattgttatgagatgataaaacatgaatattactttactcatgactcatgtttttaattttttttaaataagacggacgatcaaagttggacgcgaaaaaccatggctgcatttaaaatgggacggagagagtattcctataacaaatttagacaatctttccagatttgttagaatataaaatgtcattttcctatattgcttttttttttgacagagggagtactccctacatcctaaaacaagtataaccctgtaatttaaatttgaattacatgactacacttattttgaaatagatggagtagtttacactggagaatatccttagaataacttattttagaaatataaaatgaaccattttcatgatgtcaacgtttttaactaatgttggtgctgttgttcaacggttatttgacatcaatgttattgacatcggggaatctatttataaatatattttgttgcaaatttatagatccttttctttagcaaatatattctcgaggccaacataattgccgctgactcccttcttattattgagttagttttcgtggaaaggttaggggacatcgtcagacgctattatgttgaaccccaacatcaatgatgtcggcgccataaaaaagatctattccttaaataagtttttgaaaagatcaatttataaaataagtttttaaaaaagttttaaaatgtggaaaatccagcttgtttcacggcgcacactgagttacagtactaactactactacttcgtagtatacggttatatactgctcttgtgccgtggtacaacgtttcaaattcatcaaatccacggcgctgcacgcacgcacgtacgacgacggttacacattgtttccggtgactgcagcgacagtagttccgtgcgctgttgctacagggatgacacgatttaattaccctgcctcaacacccgctccggtctaccgtgtggacgagatggcgttcatttactgtagcagttttatctggagggttgattcacttgattgtactactcctagatcagatgatgagatcctgcgtaatggcaattactgtgtgcccctgtgctgtggaaactgttcatcatttactccttgagtggccgaccagcctagatgcaaacttataacaagggtaaactgcattagaatagaaagtcaagctattgaaaaacacaaaggctcaagtaattcatgctccactattctacagcgcggagaatttgacgataaattttctcaaaaaaaaattaacatatgtaaatataatgcaatcataatataattataatacaacttgaatgtagctttcaaaaatcttgcgataacatgctattttcgtgaagcggcagcaattcatgctccgctactctacagcggtgcggcattagagtaactccaatagaatggccaaatggctggccaagttaaattttagtaagtatggaaaaaaaaaaagccctccaacagcctctctatcctattagctaagctatccagatggccaaatcttatccctcactggccaaacttggagagtcaccctgcctggcaattcgtgggccccaccactccctctcccaccccatctctctctcccccggcaagaaggcagtgcagcagaaccgcacgacggcgacagtagggaggagagaggcgccggagccagccgccgtccgcactgtccccagccgcgcccaccgctgtccgcgctgtcctcggccgcacgcacctccgccgccgtcagcgtcgtccgcaccgtcgtcggaagtgctaacaggaagagatagagggtgagaaagagggggagaaagatgggaaagaatgggtatagatgctgacgcatggatcgcaatgtcatagactcaaaatagagaggacggatggagaggctgttggagtaaacaaccattttgacttgacaaatgaaatggagagacttttgaagatgctcttagcggagtactcctacagccatgaactgatctcagctgtagattttccatccgacgcagtatcgactacagaggatccgtccgtgtccctgaacttcaggttggggcggacttgtcttggactgtcaggcccatttcgaccggatatctgggccgaaaaatttactggtctggattttgacaattctatgcggaataagttcaccggaggcccctcaacttaacagcgagaatttttgagatcacacaaactagaaatgtgtacccctaaactcacacaaactgttcaaaggaggtcccatggcagtatctgtggatggtttcgctgacatggtatcctagtcagaaattttttttaaaaaagtatgtggggtacacatgtcagtagcacatattttttttcttttcttttattttcatcaccttctcttctctttctcttcttcttcttcagtggatgaggccggcggcgattggcgagcggcgggtgagcgttgcggcgggtccgcgggcagccgagcagcaccgggtggc

SEQ ID NO: 1833 - DNA, 7588 bp, Oryza sativa
gcggaccagccgcagcgctcacccgctgctcgcccattgccgctggcctcactcactgaagaagagagagaagagataaaagagaagagaaggagaagaaaagaaaagaaaaagattatgtaactgatatgtgggccctaagtacttttttaattttttttttctgactagtatgccaccactactgcacaagttatctttacctccggttcgtaactgcctgttctcccggttatacaaccgggagtccaaatccgggactaaagatatatctttagtcccggataaaataaccgggataaaagttgatctttagtcccggttgataacaccaatcgagactaaaggggaggaaagcggcagcctggttgccatttttttattgtttctttgctagatgcgtttttcattctattttcccccaaatcggatgggatcgatgcatatccccccataatcaaatcccaaatccccaaatcaaaatataacatctcaaatcatatatacattcacatcacagatccaaaaaaaataccacaaataaaatacatcttagatacatacaacaaatcacaaattctaaaaaaaattacacatctcaatggaatcacaaattgcaaaaaaaaaaacaaaaaaaacgaatcgaccaccagccaccagctcgccgccgggcgggcccgcctactaccgctggttgcggccccgccggcccctgccgccgccgccgccctccgcagccaatgccgctcggccacaccggtgcccgccgccagccgccaccgctcgacccgccgccgctgccgccgcttgggcacgccggcgcccgccgccgccgctcgatttgcatgcaacgagagaaggcaggaagggagaggatgaggctagaaggaaggagaggataaggcaaagaaaagaataagagagtaaaaatagaagaggagtttgagaggataagtcataggggttatatacggtacattgaaatttagtcccggtttgtgttaccaaccgggactaaaggtcccggggatatttagtcccggttggtaatataaaccgggactaaatataagatctttagtcccggttggagtctccaaccgggaataaagatccggggggggggggctgacagcacctgacaacacatgaaccgggactaaagatgatgtttagtcccggttggtgttaccatccgggactaaaaaacatatagtcccattctgcttataaaccgggactaaaaaccatctttagtcccggtttttattggaaccgggactattgtgatttttggctgaccaggcaaagatggtttctccagtagtgcacgtcagcgaaaccacccacatatactaccatgggatcttttttgaatgttttgtgtgaggttaggggtatacattttttgttttgtggttaagggacctcaaaaaatctcgttgttaagttgagggacctccggtgaacttattccattctatgctgggagatgcgaatcacattgggcccaatatgatgcattcagcactaaaacatttttatttagggcaaaacgtacttgctttaattggtagtgttatcatctctgctgtcggatgatgaagcaccaggtcgagcaatcaatcatcattgcgtcaggatcttgagttcttgtcgattttgggtgcacgctctagctcctgattaagtcaatcttgtggactgattttagattaattttaggggttctctttgtcagtttctgtgctaagctctccttttatgattgcttggaagataaataaaacaggatgactaaaccaaacttttaaattttggattgttttgggatatagtactaaaaaagaacgcctaccacttgagtgataattgaactgagtaattaaaagcacgtgagctgtgtgctacaccctggtatacttggcctcaaaaaatccacatttcacatttcagcagtccaaaatggaaagccaggaaagggacagaaaacagcggtaaaaatggcggccgccacttggctgccctcgctagcggcgagaacgctccgctcttctggcttttatacccagccctttctaatgaactagacgacgaacttcgttcggtgaaaagtcagtacaacatatgcaactagttatccgaagatgcaagaagccatgaactatatatggacggccgggatggtccagaatgtgcgtggtcagagcttgtgtttaaccatgaatggctgagaaagttactccctccatctcattttaaacgcagccataagtttccgtgtattgcatgtcttatttaaaatttttataagattggtatttttattgttattaaatgataaaacatgaatagtattttatgtatgacttttgttttttaattaatttttaaaaagttttcagatcagataaatgattaaagttggacacgaaaattcatggttgcgtttaaaatgggacggagggagtatgtctactgatgaaccgaatttacttttttttaagcaccacaccatttttattctttttaactttatacacctaaattttatacaaccaaaatttatacactaaaattttatatgcctcatttgatttcggattcaaatatagagtacttatattaaaaagtttatatacatgtataaggtctataatacgttcacatggaaagaaatatatacacggacatttttttagtaaagtggataatttttatttagtttgtatttcttttcctattttagaactttttgtgaaatcaatacgtgagaaatgcgcgggttgtttcagcaagggggaggggcgtgccgtgaccccacacgtggttggtcacccattagatgtacctaggaatggttgaggtattgacgtctactatcatcgaaattctgattaatttcaccattaatttattttatcaaaataagtttatcagataaggcaaaacatttttaggaccaatgtatgcatacattattttgttttcaaacgaagaattttaaattttattgatggtcaaagatgcgaaagtttgactaaaaaaataaatgatatactatatttgtagcccgaggagttataaatttggttgaaacccgaaagctgtggggtttccaatatatcataaatataacaaaggcgtagctagcgaaaacactatgattttaattaatctacaggaattttttgctatattgtactcttagggagtgtttgaggagaaggggattgaggagattgggaagatacgcaaaacgaggtgagccattagctcatgattaattgagtattaactattttaaattttaaaaatggattaatatgattttttaaagcaacttttatatagaaattttttgcaaaaaacgcaccgtttagtagtttgaaaagcgtgcgcgcgaaaaacgagagccaatctcccctatcacccctaaacgaacgatgccttagcccttcctaaccagctagatgggttacacgcgagattcaacacaaaaaaattcacacatgagactcaaattgattcgagtctatatctgatatctctatctctacttgaattcgtttggttttatttttcatactacgtaccaaattagttgttgactatctagctaagttgaaaatccaatcaaataggagtatatcacttctcgatctaatagatgatggttttggttgacatgcagtacgtgtgttaagtgttaactggtaagctcatgttgtagcaagtgcacgaggctcgcagaatttccaatacaaagacaaaaacacattatgatacatatgctccctgtttttttggtcaaagaatatgttgcatatggtagcatatctccacaagggttgcaaggtggtaagccggccatccgcattacctcaatatatcagatttatccggttaaagcaccgtagtatttactagcagtcattttcttttgtacatatatatcgtgcttaagtgaaatgcttgcaaagagaatatacaaaggactacctagcaaatattcgacagtaaatagcactgatttttttaataaaataatacaatcataatataattacattgcaactagcatgttttattataaattaaaaatgaatccagcatacagtactacaaacgtgatgggtaacatatgcatgcttccgatcgatcgagagcgtcgaaagaacatggttcgttagagtgaactcgctagtttttagagccgaacattttaaaattcgagcaagctgcaaacatagagctacagagattacatgagatcttacaatctttcaccccgagagacgaaccagacaaacgaagaaatgagaaaggctcaacgttaagtttaacaactaaacagatatatgatgctaattaagctacctcccggagctgtctctccactatgggatgctatctggaaatgcagagccccactgaaagtgaagttgtttgcgtggctcctggtcgaagacagtctgtccacaaagaaaaatttacagaagaagaacattgttcccactggcacctgtgacatctataacgaaggaaccgaaacgaccagccacttttgttttctatgcccgtttgcaaaaagtttccgggacaaaattggagtgcaaccgatgattcaagatgtgcatctgtttcattagctgaagctagtacatggagtgcctatacttcattttcagattttctacctcctatgtttctgggcaatgtggaatcacagatatgatgttgtttttagaggtcaagccccctcgattgcttcctggctgcaacgttgcatgcgtgaggctgctctgtggacagaaaacataaagactgaagatcgacatgtaatttctgtttggaaagaaatcttatcttccccctacaaactctcaattcaatataatgaaccttgcatccttatattcaatgaaatgataaattcgggtggggaagctctccccccgtgatttagtaaaacaagaaagaatcgagcgcaattcgccgtgtccgtaaaagaattaatcatcaaagatttaatcaatcttacaatagctagtctttataaaaaaatcaaagaataaacagacaccgtggcctgtggggtggataattgatggatcgacgccgcgccatcggcagggtctcatctcacgagtcatgccgtctggccgccggcggcgcccctccgcagcgcgcactcgacgactcgccggaaatgcccggcgtcgcagggcacacgcagcacgcccggctggccgaacccgtactgctgcgccgccatgtccagcagctccgcgatgctcgggtccccgagcagcctcaccggcaccatcacgcgctccccgccgccgtcgccgcagtcgccgccgccgccggcgaccatcgggacatgccctctcgggacctcatcctcgccgttctcgcggcacggcgaggcgccgccgctgccgccgccgctcttcctcctccacaccatgatgatatgtgatagatagtatatatgtcaggtttagcaccctggatcggagctggaggacggtgcgggggtgcagtcgtttgattcgccggcgtgcgctgcggaggagacgagagcgagtaggtgggaaatttatagaggagcaagctagcaagcagcgcaggatcaaggaagctagggttcatgaccatgcatgacgatgactgacgtctgaagattgacgaaacgaacttgtgtgtagacgatcaagccgcgattccttgacatggatggtcttccatggcgactggagagatggagactagcgtggagcaccggaacccgcgcgccgcccaccgcgcgcgcgggaagcatcggggacgttcgatctgcgcgcgctggacggacggacgtactgttcgctccataactagctcaacacgtactattgattgaccgattctgctaggaatatgctttattaatacggatttctcttttttaaaccaaagacaaatggagacgctcgcaacatatgcacactcactcatataaacatacatggtcgacagaacaaatgcaaccggtggacaggtctgagtgcaagcactccaaacgtaggttatggatggatgggagtagaacgtcgaagaatcatgtcactcaatccagctgcttcatgaggcctcttgtatagaaaatagactaaaatttcaacatcggaaaaagaattggttaagttgcataaaccaccccacctatcactctagttttgagattacaccacataaattattttgtcataaaaacccaccaatccaagactgtttacgaccagattgtgtcctctatgtgcacagaagtagttgattcggtccatttcttccaatataggatcgctgccgatcactgcctctgatcgcttcccacttcgaactagcatttgaggtcaggtgggtacagccagctctttgtgatgttcttaatctcgttcttgatgtggaattgtgaaactgtgtagctgcatgttcttgtttttagaaaactatgtcatcttgatgtggattatatgtgtaaacttcattcttgtgacttgttggatgtcaaggatatattcttgatatgtggttgatgagtcacgttggacttgatttttttatgaacatgttcatgatctgtgttgattaggggatctccagatatttgaggtcaggtgaccgctcgttgaatcggctcgatgaatcaatggattcatcctgtcgactaatttatttgtctcatggaaaccatcagtgtcgaaaagcttaatgttggttcaatttccagcactaataaggggttacgaattggcatagaaattgtgctctgttacaaatccagcactcataaccatgctggatgagtgatatggtccactgtaaatccacatcaaaacaaatgaacagaattagcaccggtggagaactggtttttactcccggtttgtaacccctatataatcccggttttccaaccgggactacgaatccgggactaaagatcgctatctttagtcccgggtgaaatatccgggagtaaaaatccatttttagtcccggtaaaacatttttagtcacggttaatgttaccaaccgggactaaagaggctagattcggttgcttctttattcttttcttttcttcattgtttttaatatattgatttcaccccatcccgtccctaaaatcccaaatcaatcattctcaaattgcctccaaatccacaaatcgatcatctcaaatacatcacaaaatcttaaaaaaaaattacatcacaacttctacaaaattcatcacatattcacatcacacacaaatcaaatacatcacacaccaatcccagatccgaatcacaagtttcccaaaaaaaacaagaaagaaagaaaccgccggcgcaggccgccaccaaccgccgccatgccggtcggccggcccaccgcgccccaccaccgctcggccgccagttgccgccgcgccggctggccggcccttcgcgccccgccgatgcagtagaaaggagaagaagaggaatagataaggctgaggagaggagtagatacctcgatccgatcgcgcacgcctctccgatctccgtgt

SEQ ID NO: 1834 - DNA, 8722 bp, Oryza sativa
cccggttggtaacaccaaccggtattaaagattgaaaagtactctggagcttttacaccgggactaaagatgtttttagtcccggtttttactacaaccgagactattatgaaatctggtcgaccgacaaaagatgatttcttcaccagtgtaggtactcacgcgtattgggtgagtgggcttttgccacaaaataataagtttatgggttaaaatctctaaattagagtgacagttcaggtggtttatgcaattttttccaccacttttagcgagtcaagaggttaggccacgttttaatttacaactcaaattgcacgtggactatatacatgtataatatatactatcacatcgatcagccggcacggttgaactaaataaattttccgaaaaccaccaggccggaaaggcagccgtggtggcccatgcgaatatatatgtaccgtgtctgttactaggagtaggcggagctggggatcgcgtcaactgtagtacaaactactgtaattccatcgtcagggacgaactagctagcgtctgcgcggtcaaccaggacatgagcacgagggtcgtcaaaaaatccaaatgcaacgcgagctcgatcgatcgagtgatcctggatcccccggacatatgcctggctagcttagcttgatcatctcgatcgatcgagtccaaagcgcgtacgtacgagttgatcaaacagtactgcatatatgcagccaactagcttggcctgttggccaattggccaacttgcatggcgatgatcagtgagctagctgcgatttcttccaaggaagcctgtaggtacgtacgtatttcgtcgctgttcaaagggatgtacgtggtcatcagtccttggcttgggcgtcacagccaagtcgatagggccgaccttctaggctgggaaagagacggctgcagatgtaaccggctagccattttctcttactactttcctttttcttgttttcttctttgcgattattatgtggatcgaagactatacaatatatctaaccacttggcattttcttgtttccgagagtgaccacgaaagctgcagggcctgcgactataggcaacggaacgtgatatgggaattgctccatcttgcattgcgcgagcgtaatttgatcgaagcaagagtttcaaggacaggaagcaaacttttgaaagaaaattcaaattgggtccactcgatccaaagcttgaacattcagaaataaaaaaaaatgtgttatgaactttttttacaaaaaattaacaggtcaaattaatatgtaatatagcacttcataaacatgcaagatcaaattcgacttttacaagctataacgaaaataacaaattaaactataacaagtatatatgcatccataatccaatttattgtcatttttacaacttgacaaattggattaatttaaacttgtatttcttgactagtatattacatattaatttatgttattatttttaaaatgttatatagccataacatgtaataaatgagtggacatccactcagatgaattaaagagttcccgtcaaagctcatcagaacacaaggtcctcctcaagggtagtgggaagtctggtgcatattagggttttagccccaagcttagctctacaaacccctaacgatttcatcaaaatatcataaaaatttctacaagagataaaacaacagttagatcagcccctaggcgtgtatatcctttcaagaggactgaataattaatggcggggtgaaacattaatttaatatggatatgtatatcatgtgttttattgattttaattggtgggactgattcgggaaagaagatgtctctgcatatttgtcacatctattctgtcgagggaggattggaaagggaatagatcagacgattcgcgacacaggtcaataaattacgcgcaaatattgactatggctgctctttgattagccgtgacgcgagcaagcaaagctcgttgtgagatgtctctctcctatacctgttcaggaatttagatcgttctgctaatcgcgaaccatcacagtagcaacaacaacgaggtaacgagatgaagcaaattaattacctttattatttgccaatctatacatgcacgaaaatataatttttattatgacaaggattgccggaagtagctggacatactgatagaacattaattgttgtgatacatataatatatccatgccgacaaaaaaaatctcaattatgtatagtttctgaattttcctctatatattttggacaaataaaaattgtaaactagaaactaagggtacattcaactttaagatcatccaattttaccaagaaaaaaacatatcattgtcttaaaaggctaaatagtttccccagttgtaacgcatggacattttttctagtataatcatatagttataaaatatttatttagcatccctacatactctctccgtcttaaaaaaatgaatctagaactggatgtgacatattctactacaacgaatctgaacagatgtatgtccagtttcataatactataatatgttacatctagtactaaattggtttttctatgggacgaagaaagaatattgttcgtgcggtggcaatgggtaaatttagtgccatggagggagtataatttcgttattgaagcacagtatgggtaatttttgacttttgagctaaattcaccatctccataaaaaaaatcagtatcaaattactgcaagaatcggcggccacctgatttctttgggaagtttagtcattgtcttggcggttgaaactcaagtcgctgacaagcatacacatattttcttgacggctatttagaaactccaaggttacaataatttgatcaatcaaagaatacacggacaacgtgtatgtacaccgcacgacacatcaggcgtcatgctgaccggccaccgtccttccgcagcgcgcgctcgacgactcgccggaaatgtccggcgtcgcagggcacacgcagcacgcccggctggccgtacccgtactgctgcgccgccatgtccagcagctccgcgatgcacgggtcgccgagcagcctcaccggcaccatcacgcgctccccgccgtcgccgtcgccgccgccgcagccggcgaccatcgggacgtgccctctcgggacctgatcatcctcgccgccgttggcgcggctcggtgaggcgccaccgccgccgctcttgctcctccagtacaccatggtgattaattgttagattgattcctggaggccggagcttggggatggcggtggtttgattgtctggccggcgctgaggagagacgaggacacgagtttgtggcggcaaatttatagggaggaaatggtgattagcgcacgtgttcttgggttcttgacatggatggtcttccatggcgactggaaaggggatcgactatggtttgaaacgagacctgcgatgagagtccatgcaattaatacatcatccacttgatttttctcttgagatgcccgatacttcgcggtaggatgggccgttgcatcgcgcggtcgtttttgacgtcatgttactccacgtctcaggcctgtttagtcggtaaatgggaaattttttctgtcacatcggacgtttaatcgaacattgaaagaggttttcggacacgaataaaaaactaatttcataacttacttggaaaccgcgagacgaatctttcgagcctaattaagccgtcattagcacacgtgggttactgtaacacttatgactaatcatgtactaattaggctcaatatattcggttcgcgatttacatgtaaactgtacaattagttttttttatctatatttaatgctttatacatgtatccaaatattcgacgtgatgttttttgaaaagtttttagggaactaaacaggtcctcgggaaaatatgttaaatgatgcgtatgtagagattagtacttcctttggtcaaaaatatttaatgccatgatatagaattgtaccacattttttaacataaaattgaagagtttcttagtgctagaggtacatagtactacctgtcaaggacaacaaaatttcctattagtattatagtactcttcaagacaaatttcgatacattttcttaattagctaagcatttgagaaattatcgatcatcaaaatttaaaactttgagaaaaacctgtactcaacgtcaaatatttatgaccagcgaattgagcttacataactcagcaggtaaggttctctgtagtggaatctacataacctattttttcatgcggtcaaattgatttttctgtgcggatattttccctgtctggaatcaggcgtttggaaaaataaatattttcatgtgcgggtgaccgaaccgcacaggatactcgagtatcccgtgcggtcaaattataccgcccgcacggaaccaacaaaaccaaaaaaaaacgcgaaaatcaccgccgcctgctagaccgcacgcactcggccatcgctgagcccgccatcgtcatcgccttcaagccggcccgccgccgccgcagtcgcgccggccgccatcgccgccggatccaggcgggggacggccgccactgccagatccgggcgggggccgccaccgctgctagatccgggcgggggatggctgccgccgctagatccggccgcctcgccgccgccccgctcacctcctctgccttgacaacgcacgcgacgacggcgtcatcgtcgagggagctgagcgacgacgtgcatgacgaggacgacgaccaggaggaggttccgcccgctcgccgtcgcccgcttgccaccgctgccttgacgcctccgcctcgccacgcgcacggaaggggccgccgccgacgcccgctgttgtcggaggaggggaggaggaggaggaggtagagaatagagataaggtagagagaggggggaagtggttgagggagaataaaaggggaaaaaggaatagagaggatgtcaaaaatttgaagtgggtgagaggaaaaggagggaggtattttcctgtgtggtccacttaaaaagcccgcacacgaaaatcgatttttccatgcggtcctcttaagttgaccgcacgggataatgataattatccagtgcgtcggattaagacgccctcatggaaaaacgcattttcctgtacgggcgacaacccgccgccggtccccctgttttcccgtgcggtttcacttatgaaccgcatggaaacaaaatggggcggcgtccagaaaaatatatcatgtagtatatctgttttgtttcgggaaaatattatccgtgaccaatgagagtataatataggaaaaaaattccaatacattttgaggaaggccttagtttttttttgttaccgatggagttggtatttggaacgcataaatttcgtgtcacaccaagcagcaaattaaaggttcaactagacttgtctgttgtttcttaaataaataaaaactggacttgtctgttttcacaccctgagtcccaaaacaggactgagccatgcatcctcacttgatattttattgcaatttgcccgtagtaagtagatgtcgatatcttgttaagtttggaagttgggtttggaccgctggtcccattaacggctagctaggccaccacgtaccaactgtcaagtcgatggggagtattagagagcacccaaatggccacatatggacgcctgggttggtgaaggcgggacgcgcgtacgtgcgatcacatcgccggcggacgacgccggaagcattctgcgcatcgatccacctgcagcaagtgcatgcatgagcacgcgagggtcaaataaacgcaacaatatcgatcgatatcgagctgcatgccgttgatcatcagttgatcgagtccaatggcgtcggagagtcagctgtggcggcacagtactacgtacagaggcacgtgccgaattgaatctacttttcttaaaatatataacccatgtatttatttattgattaaaattcaagcataatatgagtacatgtacgtacagtgcttagagcacagatcactggaaaactatagttttgcaaaggagcccctcaaaactggacaaattacactttggcataacatgcatcttgcataaaaaaagttacttaaaaagaaaacgaattaataaagcaatcgagtccttcgttctcctttgactgccttcaacgcccacggtgaaatcctagagctcgactccactggaggatgcatccaaataagctgcataggattaagccaccacacattccccgtagggggcctcatatatacacatagaggttcaggtgatgataagtgtcaggaaaatgaaaaccaagagttcccatcatcgaccactcaggacatccttgtcaccaatccctgagcatgacccttataggctgtgctcggagcacatcggcccgaacacgactgctcgaggcatatccgccctcgcccgtccaccgcgggcggtactcggggcacagccgacctccctccccccctccccccctccctgggtgaggagtgcttggggaacctctctcctcgagtgttcagcccacgagaaacacaaacgggatgtcacgccccgaactagccccgagcggaactagcccgtgacgctccaaattaacatgttaatcgatactagtcccaggaaacagtgctggtatcacaggaagacagtatatcacagcaacagaggtctatttattatagagtaggagtacagtcatgttgggctgcggacagatctcgagctcacatctgcattacaaaaggggaaaacggaagccaagacttgggccaaacatcacaggcgcgacttgggaactaggccgaaaccctaaaactcatcgtagccgacttactcctggaagaactcctcgtcagcgggatccacttcatcttcttcagcaactgggcgggattatttatatagagcaagggtgagtacaggagtactcagcaagccacgggaattaagtgtttaatgcaggcttcaaaggaaaggctattgtttttgcaattgattttatttaaactcctttttgaaacgactaagtgagtgtttctcaaacgacccggatgaggcagtgcgtctcgtccggtaggagtatgtgcaatgtatcagtctttgaattgatcaaggttggcacccggccaacagctttcaaacggccacccgggcctggctgatcccatcagccgccgattttccaaacatcgaatccattccacagcagcaatttcacaagtagtagtcaaacaaaactacgctaggaatcacctcacatccgcccatgaccatgggcacggctgttcgaacagtttaataccctctgcagaggggggtacactttacccacatgacgttactagccttggtcacccagcccgtgcagaacagccacgtctggtgaccttgggactttcatgacaaggcatttcgaaagccgacacaggttcaccatatgccaacgagaggggtcccagaccaacaccagattaggtcccagaccatactgtgccaggaagcccgggggttctccccgacaccaccccgttgaattcacatgtctcttggcatcaaggctcccccgattagcaatttactcagccaggggtgtcccatttcacccatgtggtcgcacttgtcttatgttcggatgaaattccaaggaaacggtccttaagtgcaagagcaggaaaccgtacacccggtacgttccccggttcacgattttggaaattcatttagttcgcaagcaccgacccaggtgtcgggttttccaagtcttttgtaaaacccaagttttacccatcgttggatattttatattttgagggggggtgttctgatgcgcgtacccgaaggcccgtgcatcaaagcacaacagttgacaaaggaagtctaagtgttcaataattcaaggggggtaattgcagcaattaggattgggagggggggccagcaggctatctcgcaagccgcggccgaattacttgtataaaacctattcatgcaatatttgcagaaaagaaatacttagatttaaattataggtgcaagatgatcaaaggtgacttgccttgctcgagatcttgagcttgatcctcgaaatcctcgcactgcgggtcttcgggctccgaaactacacgtgaaatgggacaactcaacaaacggcaaaaataaagccctattattgacctctaggcgtgccattagatagatctcgagatttaaggaattttggaagttgaacggagtcaaacgggcttacggttgggaagatattgaatttctaatattattagatttttggtccaaaggaaaaggatttatttaaatcctttttgaaaaaaaaaagaaagagggagggaaattagacttcgcgggcggctcggccgaacttaacgggctggccggcccgagaaagcggcccaaagcgcgcgcgcgggcagggaggagagagggagccggtgggccgggtccaccttgcgtggtcccgggtgggacccgctcgtcggcggcatggttcaccgtgcggagggagcacgcgacgcggcgctagggtttgggcgcggcgctgcgcacgcgcgcggcttgcggaggacgctggtgcggcgggcccacgcgcagcctcacggctcaccgtagaccacgcgcacggcgagggcagaggggagcggcat

SEQ ID NO: 1835 - DNA, 4577 bp, Oryza sativa
  unsure (1)..(4577): unsure at all n locations
cacactggcgccgtgcccgtgccaccgtggcactagggctgtcgtggaggtgctgactgggcagaaagggggcgccaaccacactggcgccgcccctcataccacggcgccagcatagctggcgcgcccctcctctgtgggccgacccttaaaccccgtgggccccaccacctttctcctccccactcccattttcgccattcccagcccgagcagcgagctgctgttcttctccctctctctccccctcacctctccacctcaaatccactcaatttgaagccgtttttcgcgggattttttgtggaaatcgaagagaaaggtagactccttcattctcccctcttttttttcgtttttattggttgaatttgtagatcggtgggtaaccctagaaccccttttttacccaaatttgtgatttttagcatttgttcttaggattggcttgttgtagtgctacatgtttgcattgtactcattggtgtcatgatttttttaaccatatatgtggtaatgttaatttttggatggtttggttggatggatggatgaaaaattatggttgaggcatgacggaggtttgggttgtatgatggagtatttgtaatatttcgatgtgtaatgcagtagtaaacttgttgatagttgtaggtggattaaatatttttttggagtagtagctttgggacaatttaagttatgcattggttataatatgtcggtttggactacgtttaggaatgaagatttaatttttgttgcaaagttacatttgattttttggtgtagatggatagacttgttagtgtttactacggtggtagagtggtgaaaccttatgttggtggacatgttgagtttgaggatatgtcattgaagaccattttgtttcccacccacccaactctagatgaactaaggtcacgagtgaaagaagttcttggatggaccgaggataatgtggagattcgtttttatgggagatacgatgttggtcaagggcataagtatatattaaatgtgataggtcagttggaatgggaagtttactttgatttggtaanagagtctcagtttagatctctagaggtgtttgcatcanagttagttcgtaccgtagaaaatttggatctaaacaattctcccttcttatcattacgttgagaagaattttgtgacatattattctcgtcgtggagggggtgcaagtaagagtgagttggtacgagaagacttggagggggaaggagagaagaagagacctttgcttggaaatgatttatgggaggcaggaccatcaaagagacattgcggtactgatgatgtggatgcagcgagggtgatgaaaagggagttagtacaagaggggcttgatctaagtgaacatttgtcggcgagtgttcattggtcgtcgtacggagtcaaccctgaatacccgacagaagtagcaggccaatatatgaatccagatgattactttgatgtcgaattgagtggtggtcacgattctgtctcagtagaagtcaatagagatgatgttgacgaggaggcaagtgttgagcaatatgatgttgaatttgctgaagactctgatgatgaccgtccattccctccacttactaataatgacaagttagcattagaggaatgtcgtgcgtttgagaaggtgtttgggaggaagccggacattcctgagtttagagacctaacacatgcccatggtgcactactagatggcggtatcaacctagatcagttgccagaaccattccaggtggatggtctcagaaagggtttagagttcccatccatggtcgcattgaagctatggctccaggagtacgccatcgtgcaccatcgtccataccgtgttgtcaattctgccgcaaataggaggtacactgttaaatgtgaaaacccacggtgcaaatggaaggtccatgcaactaagaggtctagtggcacgtggaggatatcacgggtaggtaaggaacatagttgtgctactgccgaaggttcagggagccaccggcagctgacatcaaagttcatagcaaataggttatgcaatgccataaaactgcaacctacactctctgcttctgcattagctttgtatatatttaaggttttccagtatagggtgaagtatggcaaggcttggagggcacgagaggaggctatgaagctcatttacggtgaatagggtgaagcgtatgtccgtttgcccaccttgctgcaagccattaagcagaggaatcccagtatggtctaccacgtcgatactcatcctgatagggttgtcaacgttgatggagtgaccaagaaaatttttatgcgtgcattctggtgctttggtccttccattgaggcttttaagcattgtaggccagtactagctatagatgcaaccttcctaactgggaaatacggtggtgccttgatgactgcattatcagctgatgcagaggaccaacttgtacctttagcttttgccttggtggagaaagagaattcacgagactggtgctggtttatcgatcttgtccgacgggttgttgttgggccgcatagggaggtttgtattatctcagatcgacatgctggtataatgaatgccatgatgactcctgttccaggattgccatcggtttaccaccggtggtgcatgaggcacttcagtgctaatttccacaaggccggtgcggacaagcatcagacaaaagagctcctaaggatatgtcagattgacgagaagtagatatttgagagggatgttgaggcactaaagcagcgtattcccgaaggtcctcgtaaatggcttgaagatgagttgttggataaagataagtggtctcgtgcatacgatagaaatggccgccggtggggttacatgacaaccaacatggccgaacagttcaatagcgtgctagttggtgttcgtaagcttccagtgacagccatcgtatcatttacgttcatgaatgcaatgactactctgtgaacagacatgatgaagctttgaagcgagtccagttagggcagcgttggtccaccaaggttgacagtaagatgaaggtgcaaaaaagtaaggcgaacaaagcttcaatgagccggttggaaggcctaagtggagacaaagcttcactccttggccctacaatgagccagacatggagaagacagtggcctacctttttgagagtactgccactgcacatgctcaccgggatgtggcatacaagcattatgtcaatgagatggactgcttgcagcctcaacatgtaagtacttccaatatcacttctagttagacatttacttctttaattgagatactaaccaacgacatctcttcaacttttgcagattgagtggttaccataccacacaaatgaggcttcaagcctgaccctgaactcgatgtgcaatcgagactctgactatttcatgtaccagtgcccattgatttgtttctgggcagttgagtaccaccttccgcaccgtgtcatgcgacagttcggaaagaaacaagattggccggttgaggacatctcaattggagttgaattacacaagtaaatatttcttatctttgtttgctttcattgtcaatgttcaattttgtaccatttaacccttgtcgatgctcactattgtttcatcaccttctacttgtctaggtatgacagggtgagaacaaagaaggtgaaagactgggggctagagcataatagatacattgatgaatggagaacagccggaaggaacgataggtacatcgagactatacaccaaaatcatcttttctcagagtaccttcgttggctgtataggacatatagactgttcctccgccctacttggacggaagccgacatagaggatgaccgcgactccgatgaggggcggaatccctatgatgtccggactagagttggatatcaaatggagcacgtcccacttagagacagagtcgtaagttttcttgcatttgtcaaagttacttccatttgcaccctagaccctaacatatatcttctcacgctttcagtcgagagagctcctcaggagtgtgaatgaaatggggcatgccctccaagctccgaggggtggtgaggacacggagaacacgctccgcaatgttttagaggtaaaatttatttagcactttgcattacttgagttatgcctaacaaacttcttttttttttgaaatgcagaaagttcgtcaaaggtgccggaaacttgcagcaagattaggttgcaggtcggttggattggacgacgtgtaccaaccggggagactaccaccaccactacctcaatccgcgcgtccaagtactgctcgacactccatcagaatagaagagcgtgaaggagttggtggctcgtcgtcgtcacgcattaagcaagggaggggaaaggggaaggcgccggctccacctagcgacgacgatgacgacgaggacgaggaggatgaggactacgtcgcaccagacgccgaggagatagacatgtcacagcttcccgacgcgccctcaggggacgcaacccacgcaatacaacttgcg

SEQ ID NO: 1836 - DNA, 2730 bp, Oryza sativa
aacagatacagtagtgaaacacattgtatggtgtatttcaacagagactatgcaataaacaagggcaaataagaaaatgacccaataaagtatacatgcaagccttatgtttcaaacaagatgaagaaaaccttgtgccatacatagtacacaaacggacagatcccatccgatggcgaagtatatattgaggcatctaaggaatatatatatccaagtcgttggacgtctcttaggcatctcagaaattaatccctggcggatgatgcatgcatatggacattcaacggggttcaaagtctagtctctccatcgtcgccatggaagaccaccataaatgtcaatatgcacgtgcgcagtgcgctaatccatgtcagacgcacgtgcgctaatcaccacggaagaaccgtccttgccgatccctataaatttgccgccacaatcctcgctcgtctctcctcaacgcgctccggccaggcaccgctgacagcccggctccaaactccggcacctccgatcgatcctgcaggcaatctaaccaattaacttggccaaaatcgagatcatcatgatgtggaggaggaagagcagcagcagtggcggcgtgtcacccgccggcgcctcgccgcgccacggcggcgacgacaacgacgaatgcaatgtctttccgagagggtacgtaccgatagtcgccggcagcggcgacggggagcgcgtgctggtgccggttagtctactcggggacccgtgcatcgcggagcttctggacatggcggtgcagcagtacgggtacggccagccgggcgtgctgcgggtgccctgcgacggcgagcgtctacggcgagtcgtggagggcgcgctgcggaagggcggtggccagtcagcatgagatcggacatgtctgtgtggtgtattccctccatcccataaaaaccaatctaagataggatatggcattttctagtataataaatttagacatagtcatatctaaatttatttgttgtactagaaaacgtcacagctccagggagtagctagctagggagatgtgcaagtacgtctggagtctgtttattctttgattttattttctagattcttagcacagattatacatatagcaattctttgattattcttttgtggaaacggcagatttcgctgaaatttgtctacgatgtttggttccaagaagaacatatatatagtccagtctaaccaatgacctagggtggcagcagcggccctagggtctgcgtcggcccggtatggcggcgactcccgtcggcgctggcggccctagtggtagcagcgggcgcaaggccctcggcgaggagcagacggaggtcgacaccggtggcggtggctgccgtagggcagcggcggcctgaaatgacggcgacctgagcatcggtgcaaggccctcggtaaggagcaattggaggtcgaccccttcagtggcggcagccctaggggcagtggcgagctgagagtctagaaggtggaagagcatccatgtcgacgcctgcaacattttaggtgtggaggcctaggattcggcaaagtggaagtcgatcccgtcggctagttccgacgattgacgatggatgaaagtgggctaactggcggcgcgtggcgtcagctcacctgaaatggatgaagatggcatcattggaagttcgcagcgacgacgtactaggggcggcggcgtctagacgaattccactcatcaaatctggccgtttcaggagagtatgtcaggatgcagagaagcagtggtgtgtcgaggtcgttttgtttttcttttcttttttggttgtgtgttatcctccttattgagatgtgagtctaagtgctcttgtatccctttggctatgtatatccttcatggatatagaggccggatttatgaaaatccattatccaaaaaaagtctaaccaatgaccatgttcttttatgctttggaagcatgtttgaattctgagtaccttttgccgtattaccgagtgtttttgacacgtggtagcttcgcgttcccttgtagtgaaagaatatggcttcacgttttccgagaagagcctgagacaaaaggcatgtttgggccttagcccgggcccggggcccccagatgcttgtgccttgttcctcggtggtcaccgtactcggggcagctgtgcgcccggagcacgccgcgtgccttggctgcccaacccaaggcacccatgatcgctcccattgctgatcataggtttacttattggtttggacaagcttcttgaagaagtcgatgacaaaggatttcctcgtgaacattgcttgaaggatatgctgtatcttcaacacactgaagatatagatcttgttggtctcaactctcctcttgaaaccttgaaaattaatgtagatatgaagatgtagattttgtatgtctcgtgtagcgcccgtttcgtcgtggcgcctagctggaaaatctaaattctaaaaaccctaattgcgaaaattgtttcttcgcttgcagtcagtctccgtgccattccggatctcaaatccccgatctatcgtcaaattcaaatcccgaatccaaatccttcccaattcatttcatctgcaaaagtctattttgcctccgtcaggttggatggagggaatgagtgtaggcccatctctctatccctcctcccctctctctctccctccctccctctctctctctctctccctctctc

SEQ ID NO: 1837 - DNA, 805 bp, Oryza sativa
gccgccgccgtcagcgccttccacgcctgcccgcgcctgccgcccgtgtcgccgctccgctccacaccgccccgccgtcatcgccgtcgtcacaacccggccccgccactctgcgcgctaacctccaagggacggagacagagctcctcctccctttgccgcgtcgccccctctccctcctccttttcccaaagtggcaaggggcaagccccctttccctcctcctttttcccttttctctcccgccagcgccatactccccccctgtcgccgttttggccgcgaccaccgagcgctagccctctcccttgacagccctaggtcggttcccaaaccgacatcgccatcctataaagcccaggcaccctccctcccttctcctctcgtttgtcccatcgtctccactccattgtcgccgcctcccgtgctctgttcgccgccgcctttcgttgccacggaggagccggcgcgttcgtggacgcggaaggagacttcgggagctcgtcttcttcctcttccccggcccgaggccagagagatcactcccgtgccgtcggcatctcgtcacagcgccccgcctcgtctcggtagtgcatccctccgttctccctcctcgctccatctcttccccttagctttgagtagccgatcgagtagtaccccagtagctagttggcgccgccccagcccgcgccgccgctcgcagtaggctcgccgctgtcgccgcccgagctcggaagcgcctctcgtcgccggcctccccctcgttgcgtttcctcctaatccggcgcaacggacggattcc

SEQ ID NO: 1838 - DNA, 604 bp, Oryza sativa
agggaagctcctacatgaagcatgccaagaagcttggtgagctcgacccactgatgaagccgaagcaagaccggtacgcgctccggacatccccacagtggctcggccctcaaattgaggttatccgcgccgccaccaagtccatcgagcgtgagatcaactccgtgaacgacaacccgctcatcgacgtctcccgcggcaaggcgctgcacggtggcaacttccagggcacgcccatcggcgtgtccatggacaacacccgcctcgccatcgctgccatcggcaagctcatgttcgcgcagttctcggagctcgtgaacgacttctacaacaacggcctgccatccaacctgtctggcggtcgcaacccgagcttggactacgggttcaagggcgccgagatcgccatggcctcctactgctccgagctgcagttcttgggcaacccagtgaccaaccacgtccagagcgccgagcagcacaaccaggacgtcaactctcttggactcatctcctccaggaagaccgacgaggcaatcgacatcctgaagctcctgtcctccacgttcttgatcgccctctgccaggccgtcggggctgcagg

SEQ ID NO: 1839 - DNA, 683 bp, Oryza sativa
gatttctttgggaagtttagtcattgtcttggcggttgaaactcaagtcgctgacaagcatacacatattttcttgacggctatttagaaactccaaggttacaataatttgatcaatcaaagaatacacggacaacgtgtatgtacaccgcacgacacatcaggcgtcatgctgaccggccaccgtccttccgcagcgcgcgctcgacgactcgccggaaatgtccggcgtcgcagggcacacgcagcacgcccggctggccgtacccgtactgctgcgccgccatgtccagcagctccgcgatgcacgggtcgccgagcagcctcaccggcaccatcacgcgctccccgccgtcgccgtcgccgccgccgcagccggcgaccatcgggacgtgccctctcgggacctgatcatcctcgccgccgttggcgcggctcggtgaggcgccaccgccgccgctcttgctcctccagtacaccatggtgattaattgttagattgattcctggaggccggagcttggggatggcggtggtttgattgtctggccggcgctgaggagagacgaggacacgagtttgtggcggcaaatttatagggaggaaatggtgattagcgcacgtgttcttgggttcttgacatggatggtcttccatggcgactggaaaggggatcgactatg

SEQ ID NO: 1840 - DNA, 640 bp, Oryza sativa
gaagaagtccatatcggcaaagccggagaagcggcggcgcaggccggagagccactcggtgtggccgaccaactcctcctccagcaccgcccagtccatccaggtgatggcgttgtcctgacaataggcattgttgttgccctgctggctgcgcccagcctcgtcgcctgcggtcagcatgatcgtgccgcgtgtggcaaacagggtcgaaagcatggcttcgatatcggcgcggcgctcgttcaggatagactgattgtctgtctttccctcaacgccattgttccaggagtaattctcattgtggccgtcgcgattgttctcgccattggcctcattgtgcttgttctcgtaggaaacgagatccatcagcgtgaagccgtcatgggccgcgaggaagttgacactgcggctctgtgtgcgtccgtcgcggccgaagatggaagaggagccggcaagaatcgttgcgagctcgccgatccctgcgtcgccacgccagaagcggcgcaagtcgtcgcgggcgcgatcgttccattcgaggaagggtgccgggaagctccccagctggtaaccgcccggaccgatatcccaaggctcggctatcaggatgcgatcccgaagcacctcgtccgccaacagg

SEQ ID NO: 1841 - DNA, 6183 bp, Oryza sativa
agactcaagtttcatgacccattctgtgatttggatgaaagcttttggatgttaatcgtgtgaggcactaatctgccatgccaaacacctggctggctaacatattcaataaaagatttttgtgtccggtactttacataaacatagaacagccaagtagtgtcgttgtctaagctttaatgcaactatccaagcagcaaccaggatagaacatccctttagcagaattgaattaaaaatcaaggaacatatcaataagtaaacacgaagtaaactctgtgaacaaagagagcagctagacagactgcaaatatgatgcgtaatttggatagaattaataatgcataaaacacagcaacacaaataaatgttggagagactaaaaatgtgcttgattggcggggatcaagatggattgggtgatacaattagcttgtttgtttggctggatagacgataaagtacttgcaataaatttttggtcaagtgaaatttttaattatgtataatatgtatcgtgtaatcaaattttgtataatttctatgaaaataaatttatagagtatttttgtctttggcagtaatatccgctaaattttgttgcctcttgtatgcatatactccctccatccacaagagttagacatattacttttgtcaccaaaaccaagaagaaattaactcatcttacatgtaacaaagaacttcttttacatgtaacaaacgtcaaggagcctatgcatgcatgcatgcaaccaatgagtattaaaatggctcattaggtttcgattaaacatttaatttatctcttcatttaagtcttagatacatgaaaactacaaatatgaccaacttatttggaaaaaaacaaaatatagaataagtctaacatttgtggaaggagggagtacatttttttctcataagtgaggtactgaggtacgattttcttttgcaggtagttgtgacatagtgagaagcaacattaacgagtaacctccttttcttcctaagcttcccaacttatcgacctatatgaccaacacgcaatgcaagaaaagattgtttttttcctgtataaaatgtaatctaaaggttatttctaagttctaacttaggaccaaaaacctgtgtgcaaatgcacagatgaacaatcaaaagaaatagatagcaacatatacagggcaatggcgggtggcacacaaggtgagaaggggaggtagctatggcacacaaggtggatacaaacacgcaaggggttaggagcaacagcatctatgcactgtgtcattgttttttttgggagggggggaggttgagacaattctgcatctagagagaatatcccctaaaattagaacttaagcaacaaaatgcatggaacatcattaaaaaactggatgtgaccatcctattcatgctaacacctccaactaagcaaacaaaaatgttatagctaggagcatgttgagattgaagtgttctaccttagcctcaggagcataatctttatgcgaccaatcatcaaaaggtttctttatgcaaatgagccaagcagaagttaaaatgatagcagaattcttcacttcatcgcactcgataattataccagttccctgattaatctctctaccatctacatatacacaaaagaagttagctaaaaagcaaccgacactaccatcaaataaaaaagattagtcgaagaatatataataccgtgataagctgaaaggctcacgatggatttggaagcatttatttgtgttttcttctgctcgggattatagtgttcaatagcagcagagattgacgaccttactgtcggtaatagttcctggcgtgctataacaaagacatgtgaaattcggtgagcttgaataatttttcaacaaattgcacgttgcgcttggtagtattatcactttgtattaaaatgtgtcacataacaccaggataaatcatcaaacctatagaaatttcataaattctgaacgaaacttcatgaaatatggtctaaatttaagaattccataagtttcaatcatattttacaatatcactccaattttgtgaagcaatctggtgcatagtagaacttatataccctggtgtaaagcgaaagcataaactaagcctggtgcacagttaaataaggtatgctttacccagtgcaagtgcaatttacacacaattttttgcaggtaattccaattttgttttgctagtttatcctactactaaaggacagcatacaacttatacctttcaacttggataccataaggcaaaccttggaaagttttttaatactagagcagactgtggattgatgcagttcagccttacattaaaatagtacttggtgtaattattgtgcttatcacaattttggtaaaaacagacggacaaaaagcgtacctctcttgttcttgtactcgtgaaaagcccaatgataggcttctgcagctgtgggatcatcggtgatgccatacaccacctctccagaaggactcgtccacataggcacaagtggagcttgcggttcacgcagcggagagctgtatgaggacgacaccgagcccagatgctcttgtgctacctcttgcttctcttggctcttgtcctcggagccgccttgacctctcttattccttttgccccgcttcttcttctttttcttcttcttcttcatgctcttcaagacgtgcagattatactctggtttgccctcggttgcctcaggatatgatgcttcccctggacgtgatacttgcacggaattggcttcccgagagcgagcaaaccaatacattttcttctttggcagagatggtatcctctccgggcatgtcctctcttcccaggggagctgctgcaatgacgatgatgccctcccactcatcggcgacgatcgtaccctctccgggcatgccccctcttcccaggggagttgctgcgacggcgatgatgccctcccactcatgggcggtgattgtatcctctccctctccctctgttcccaggggagcagctgcgacggcgatgatgccctcccactcgggggcggcgatggtgtccttgcctggcacggcggcgaagggaggtgctccgggcttgactccatcccagtgccaccagtcgactgtagttggcatggcacagacgacggcggcggcatacctgcaagggcccagaaggggttctcccggtcttcgtagttcgccgttcttctggtccgttccctggaaatccacagcgccctgcgcgatttcatccttgccggttcgaagcgctcccgcaggccgacggcagcggaggcgattccggtggaggcggcggatcggagctcgcacaggccgcaggccgacagaagtgggattagggtggaggcggcgcttctgatgagttcgcgcagcctgcacgccgacagaagcggaggggattagggtggaggcggcgattcggagatcccgacggccgaagctttacggcggcggaggggaggcctttcggggttttttttccccctaggcaaagacgagaaaattacatacctaatatcatagcattatataaggttggattagctagaataacgttatttaaataggtttcgccgaaataacctccacaacccgagcgccttcgccaaaatactatattagacagaaatacacttggatcttcttccttctccctccaatgttccaatgtcggaagagctcgccggtggctctccccgtcaagcgtctaccctttttttaagcactacgaggcattgaggcttattaggtatgggcgtatggcggccttgtacaaaacggcgtccacgtgggttgcagccactgagttcttctccatgctgagtttgccaatgatgttatcgatgtcctcggttacgccatcatcgacgacaaggaaagggtaagcgttgaagccgtcctcgtcttcgaagtcaaactccccaaggtcgtcaacggtggcgtcagcctcgggtgttcggtcgccctgcctttgtctccacccatgctcgccgccatcctcgtccctcttcgccccgccgccgtcctcgcctccctctccgccgatgcttccacttttgtccccgctctcacccgtcgtcgtccttgttttcccctccaccactgcctacctgccaacgcccccactgctgccctcagctctccttcggcgctgcctccgctcccgcccgccaccctgcctttgtctccgcccatgcccgccaccgtcctcagctcccctctgtcgctgcctccgccccgtcgccgtactcggctaccctccccattgcttaagtgatatagagagagagagaggaggtgagggagagataagatagataggattggggaaagagatagaaaggatgagagattgacaagtagggtcacggatttaaaaaagaattgctaactggactaccgcataggatcaaaaccactttgaattgagttgagttgggaggtaatttatcatgtattaatagttgagagtgaaagatactcccttcgtcctaaaataagtgctgttcaagtccaatgtctgaccgttcgtcttatttgaaaaaaaatatgattagtattttattgttattagatgataaaatatgaatagtactccatgtgtgactattttttttatttttttcataaatttttcaaataagacggacgatcaaaacactggacactgatatctatggatgcacctattttgggacggatgtagtatatgattttcgggtctgagaagttaattcgtactcactcaatagtttagggacgtaatccagacttttccctttttttggctgatgtagtatgcattactatatgggcgaccactggcaacatggtcccacgtgcgcgcaacgaagtagacaatagatggccatatgacccgaggcccgatagccccgcccaaagcacggccatttggccccggcccaagcatggcatagcccaactagtgtcaagcctgtgccggcacggcccgacagttaggtcatgcctaacccgaggcatggcacgataaaaaaatactagagggatccaaaatatacttaataaaccatataaggcaaagcaaaaaaaaagaggaataaaaaatagacttatttctagccatataagacacattccaaagagttgagggacaaacaatagacttattttaggaagaagcacgatgtgcggtcgtgtctttaggctggccgggcacgacccgaatcttattgtactgtgtctgggccatatatgcagcccgtgggttagcacgacatggcccgactgacatcggcccaggcatggcctgggcggcccgtttggccatatatagggagaccatgagatgggaggccccgtagaactttccatgctccgatggccggttcgaaacggcgaccattggcaacatggcccacatatcagcgagtgcaacagagattaatccgccactgctctaactaccctctaaagtctgggagtcttgtcggttcgtcctcctctgcaagtcctctccggcgtccgcttcttttctcgcttctgctccccgccgccaccgcctcctgctctctccgctcgggtttctccgcggcggttgttagcgaggggaacgaggtatcgccggcgccgtggttcctgcgggtgagctctcttctctaaccctgcatgcttagccgacgtgccctacgagtgcttgcttgcggttgcggggttgtgggggtgtacccgtgacggggattcagttcacacattgcgtgggggcgcgggtcgattttgctgtcgcgggatcggttctgcgctgatgcgaccgcgccctgaatctagggctcgtgctaattagtttgtttggttcggattgttgaaagagagatacatctgtgtggttcgcctcttaaatggagtccttgttagaatctggttgcttctagcgccctgaatctagggctcgtgctaattagtttgtttggttcggattgttgaaagagggatacatctgtgtgtggttcgcctcttaaatggagtccttgttagaatctggttgcttctagttagattaccactttgatcgcaggaacacgcagttacttctggaatgtggaatagtttagtgcttgcctcttgatgtgtaggcagagtggactttaatttatactct

SEQ ID NO: 1842 - DNA, 3065 bp, Oryza sativa
ttcctgcagcccgtatgtttgtttacaaggatcattgaatggtggtatattattaaagcatgcatctgtcagtggtacaaacttgtatcaatcttaagcatatttggttatttgtcttaacatatttattcctcataagaatttggtggtcatgcgtagccaaggttaatggttttaagaattaccttcaatattgtggtatcagggccttcttaggcatatgcttgattccatcattccggagtcttagttgttttttctaagtctacctaagtgtaatcctcttttcttttcctctcctttggcgcctgctgccagtaggatgccgggtgtaaactcatttgctctcttgctaatataatgacacgtaagccttttgcttgttcgcagagaaacattttgattcctaaaattgtatatattgcttacacacaacttgtaatcttgagaatatcttcttaatatattccgtacttgtttgttatgtactttgttttttttttctcaagaattacatatgttttgtgttatatgatgtataacatgcatgaactaccacatttaggatggcagctccagacatgcccaaccggttctcccatattgcccatcaactggtgcatgcagagaagagggaatcaatattctttgtgaaaatggttagagtgcctcactgccatgctaagatagtggagcacctgcagaataaattccatatgaaaccatctgaagcagaaggcacaattaaggagcccttctttgctactggatctatgatttatcaggatgagaattttggatacattttgacctgtgctcatatcctcgaggatttctattcagccaatattgtactgagtaaggagcaggccaacaggtggttcaagtttctcatcctctgcaagcacaatgaagatcacatgaagactatccatcctgacttgtatgaatctgagcgtgataagcggaattacactgtagcaactgttttgaaaattgatcagcgtaaggatcttatgttgcttcagttcaatttgtccacactctatgccacccagtatgctcaaagatgtcgcttacctcatcagtcattaaagctcgcagaaaatccatcctcagcaccaaatgatgtggtcatgatctcctggccacctaataggcctgatactgttgtcattgggcaagtttcaaatcaatgccgcttattcaaccaactgacaacagaaagagataaaggctataatatgcaatttatagagctaaagatcaatgttgaaaagggagcatctggctcacctatactcaatcatgctggtgatatccttgcagtttatcatggccggattgaaggaaagggatatgctataagccatgacgacatttacgaattcctatacacgcgcaaaattctatcacagaatttgcgttaatgagagtgttcataagtgagttgcatcgacaacaaaacagctctctgattcttctaatgcagtcaaagtactgatttacagctttggttctgaagctattgattttcaaggacaagaaagtgtctacctggaggtacctgtgattactgttaggccggtcagctggtgcatacctatttgcctggatcaacgggagcgttgtctgccttggcatatgcctcctttttgtccctatgaatgtgatacagctgcagttcagaatgtttttttatcgaatgctgatgctgcagaaacttcatgttagttgtattccttatactaggtctctttttcctgctgatacatcccaaaaaaccacagtatagtagatggtacatccttattcaactctggatattttcctcttttgtaatcagatgctcagttttcactatctttgttaattctgatgggtacaatgataccccagagagagatggtacaatggtacccacattttcctcttgatatatctctcttatgcattggatctccacttttcactgtgttgcaactctagagttgtactcttatttcgacatgaatatttgaacaattcacttggcattgaattctcttcacaacacaactgtatgtccaactgcgatatattctgagttctgaacttattgtatgtaaatccagaacaaattgtcctgtgcgcagtgtgcactttgttcttctgcagcttattgaaatttgtcgatgctgaacattatgcccctaaatgctgcgaagtaggtaaaagttatctggcaaactgtcagatttgatttggttaagcacaactatatatcgtgggggcagctgcctcttttatacagtaactagaaaaaaaaacccgcgcagatgcgcgggaaatttatttattgtttataaaaagaatactaaaataagtcatatctcaccatattttataagaaaattgattaataataattaaagaaatatttatatcccggttacatatgaactcgcctatcatcattctttgcaaaaatatgagttaatatgtgtttgttttttctttcattatacatccgattcatctatgcatattcaggggtaatatacgatggaataatctatattatcaaaattatttgtgctaattatcaacactatttagatgagaatgtcataattaaaagtgatataatgtggttccatgtgatattttttatcgtaagtatgtatgttttttctagcgaatagtagtctcatgtacgaatgtactttttccttttttgataaatatttttctctgatatgttaggtgtgtaattgtatttataatttggatgtgcatacatttatatgagtgctcacaattccattttataccattattaaaataaatactttgaagagatttggtgggatggtgtgaagcagcactgcagcggcgtggcttcttcgataacctcaccagaagtagatgcctcataacacacgtgcttattggttatcagctaattattagttgcacaatgcatggatgcctcataaccattatgacttggcgattaatggatagtggtttctatatataacttatatacatgggattagtggaaacataaaattgatatattt

SEQ ID NO: 1843 - DNA, 9983 bp, Oryza sativa
cagcctcaaacacacaaaatatgcttgcaaagtacatgcatgtacggttatttgttttgttgaacggaggtgggtgggccataggatgtgtcatgggaaagttgtaggtgtgtgatcaaggaagaacaccagccatattaagattatttaattttttttgaaccttttaaatttttaattttaaaaataaatctatccaaaacttattttcaagatcttagccttttgacaagccaaccaaactagcgtgacaaaacaatactatcatgcccgctgcaggggtcttgccagtgttgttttgttacgtcaagcggactggtgtggccaaaaggttcattttgaaaataagttttgaaatggtttagttttaaaataaaaaatttagaaggttaaaaaatataaacaaaattccatattacttcctcatccatttgtaatgctaatgtaaaaatcaatagagtgatatatgctctaaaattgttgcgtctacaaccaattaatgaagatagaatgcaatatatattataatggtttttcttgtattttttatattaattttttcttaacaaacgaggcctaaaaggtaaacctagctctgtgcccaactctccatgactctccatgcatgccactagcttagctagcactacgtacttgctgtggagtcaaccctgggtatcaccagtcgaaccaccagcccacactgtgtattgaatcatgctgtgtattgggtgggtggtgtggattcacttaatacacaggtaggactattcacacatgtataatatacacggacaaccaaacgaggcctaatgaagatagaatgcaatatatattataatgctttgtaggaagcagaacatttcaccatttaggcctacaaataaatacgtgggttgttatcgggggcggccctaggattgggacaacataggcttgacctggggcttggctccaaaactccatgtaaatccttcggaaattgtcctagtttggattgtttatttcataaaaaaatgatttaaagacttaccaacctgaattaaattaaaaccgttggaagatcttgtcctagttaatttggacggtttatttcataaaaaatgatttagtgacttgccaacctgaattaaattaaaactgttggaagagcttgtcctagtttggatggtggttcaaagcagtacggcaggcaacttgaagttacataaataaaaaatctagtacatatcggggagcataacttgggtatctaggtcataataaatatttaaccaaacaattatgtatgtcaattattagcgggaattttgatacacattatatatagaaaaaaaatgaagaattcaggtcttgacgtttagaaattatcctccaataatgatcacagctacttttagtaagttcgacctggagaaacaaattaacttgtaagagaccatggccatgaaaaagactttcaatgcttatatccggaagaactttggaacaatgcagttgttgagtctacagtgcatcttctttacaaatggagaagagaaccatggattaatgaattgaaatggtgaacatgttttatttttctcaccaaaaattgccactttatttcaacttccctttttttttccacccctagttgtgcatgctgaatgacaaacattttggttaaagaagtgaagacgacggctgcattcatggcaagcaaatagtatacggttctatgctgaggtggagaatggagatattaccttggaagttcagtactatacattcatcaaatgtttcgctgatgattcataattattggcacaactaaatggagctcaatgatgtttctgaaaatctgaagaaaaaagatctagtttgtcgatgctttcacacgtaagttgctagaacaataagaagcaactaatgaaacaaattagcaacgtgtaggcaacattttactaaatatatggtcagcttgttaaaagtcttccattcagtaattttatcaacagaagaaagagaggaatgataggaggggatccacgatcaaataataatatattgtgactaagggcctgtttagtttgcgaaatgaaaatttttgggtgtcacatcaaacgtttgaccggatgtcggaaggggttttcagacacgaatgaaaaactaatttcataactcgcctggaaaccgcgagacaaatcttttgagcctaattaatttaccattagcacatgtaggtttatgtagcacttataactaatcatgaactaattagactcaaaagattcgtctcgcgatttcccctctaattgtgcaattagtttttgttttaatctacatttaatgttctatgcatgtgtaaaagatttaatgtgatgtttttgggaactaaacggggcctaacaagaaagacggcaaaagactgccaaaaggggtagctgaaattgttgttgcagctttaatgaagagtagtagacgccagttcaacaattctaacaccacgaattggctgctgaagtttttatagatgattagtgtgagaacgtatagattggatcatctgagtaagcatttgaccaataacctaccatgcaatgtgcaaatgagaacatacaacagaaataggcaacggtggatgggtagggagaatggtgcagcaagtggttgctccgtccacggcaagcgtgagcactgagcagacacagacaggtgacggcgggcagatatatatgcgtgacgtcgaggccgtgtgccatggtcgatggtcgctggcggctgtgacggagcagtgagcgcccgacgatgggtgttcgaccggagctgaagtgttacccagttcagagctagccgccggaggcatgagaggatgggtggcgcccgtcgcaaccaagccttcctgcggtgccagcggaagagaggaaagagaggacggcgacgctcactccgatgccacttgctccacagtgctgtttccatcctcacacgccctactttttctcccaagaaccggtggccttctttggacacaagaacctcatttcggtgggcccagatgcaaaggtggcatgtgcccttaagctttgcctatgtgggatggcaagagagaatgccacctcaccgcactgtgaaggccctaagtcgcaacgggtgttatggcggggcggaggtcacggcggcggggaaagcgtgaccaggtaacgtcacgggatcagcagtagaaatttcatatgtttgattgaaagggtgaactctttctttttatatattactttgtacgatttaatacaagttatagtgtacaatatagttataatataattacatttcaatatactactagaaaaatgctcatgcgttacaacgggtgaagtctattttaatcttattattgttataatatgatttttttaagatgaaatttactgtaagagttcgcttggacatatatgtttttagaaaatcataagctgtagttaggagtccgatcgtctcaggttagcatgcgagttttttttaaaacagatttcttatatgattccttctgtattactgacggagcttggggctcctcaccgggagaccgcgcaggcccccctttgccggttcggccgggggccctgggtgaggttctaagctcttggtctgtggaaagttcgcgagagtggaaacacacaagacacgggcgatgtatacaggttcgggccgctgagaagcgtaataccctactcctgtgttttggtggatctgtgtatgaagaagctacaaagtgcgagccagcccccgattgttctgggatcgtttttttccctctctctaagtgggcaaggtcctccttttatatctcaaggggataccacatgcaccatctctccctctctttcttttgtgtggggactcatcctctcttccctccaacttcacttctcttcattaatggacggagatttgtatggctgccgtccgaatgaccttctgataggacggcccatacctacctccacttccgccggaagcaggcgcgacgttggaacatggctgtctgctgacgacatgaccattgtcagaccggtcacaaatcggtcattcttgtccaccacgtgtcagtttaacaatctgcatgttcgcccttcttcatacaatatcttgcctataatggttaggatgaagcctggcatatatctgaccggaaccaacgtgccatccccaggagctaacacgccggctccggctagggacgagtgcttggaggctctcgtcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgaggcgggagcggtccgaccccctcggggagacaaagaggagggcgaacacatcaccctcgggcccgacgccccccgagggtgccaggccacgtgggcgattgtgtctgcctcaagcctctagtcatgatactcccggtcccatgtcaccgacaattaccaaaagtgaatgatcttaaaaaccgactcaaatacgaatatgtatttccaaaagcaaatgaacttaaaaactgattcatatacggatgacgtaccaaaatactggcaaaaacatcttcaatttttataatagtagagatagagatagagaagagatatagattaaaatcaaaatataaaatcaaaaccgactcaaacatggatgacgaaccgcgggaacatctttaatttttataaccgactcaaacacagatgacggaccacggaaacatcttcaatttttataatagtagagattccttctgtattaaaaaaaagaaccgatcttaaaaaccgacttaaatatggatatatatttcaaaaaacaaacgaacttaaaaaccgactcatacacagatgacgtaccaaaatactgacgaaaacattttcaatttttataatagtagagatcagaagatgtttttgccggtattttggtacgttatccgtgtttgagtgggtttttaagtttgtttgcatttggaaatactgatacatgtttgagatggattttaagtttgttcgcttttaaaaatacaatccgtgtttgagtcggattttaaatttgtttgcttttgaaaatatataaaaggaatcgtataagaaatctctttaaaaaaccacgcatgctaacttgagatgaatgtcggactaattgtagctcatgattttcttaaaaaaaatatccaagcaaattccaacaatgtgtttcaccttaactaaaccgtaatactgtataacaataataagattaaaatagcattcacctgttgcaacgcacggacttttttttcttaagtataaataaaaatgttacttgtattcgggaatacctattccaatcgaagtccaaggtttgacgctacaaataaaaagcgccccttttgctttggcttttcagcactcccttccgcttagccgccgggttgcgggcgctccgaaccgccgcctccgtctaatctctcctcctcggccgtcggccctcgactgcgatctgcgggagatccgaaccggcgaagatgagatcgggaccaggatccaaggtgccggattccaggactagaagagcggcgagcgacgaggaccaggagaggccttcgttgcccccttcgctggagccaggtatgtctaccatgccaccgtcgtcgtctgcgccatgcgggtcgccggcttgtggaggcactagcatggaggagccaagccgggaggaactccctgctccatcatcgcgggcgtcgccgtcgcaaagcctccccgctgttacggaggctcctccgacatactggttcgctcgccctcgtagagccgattccatgacaatgtcatatgatccacaggcaactgagtccaaacaatcagaattggatctaccactttcaacacctcaatcgcaattcaacgactcctccatagcttcagaggagaagcagtgggaggtagcacaagatcagcaagactcggattcctctgcagatagctctccacttcgtgaaccgcaggccccactcgtgcctatcttgagaactccttccggtgaggtggtgtatggcattactgatgatccagtagctgcacaagcttatcactgggcctatcgcaagtacgaggagaaactaggtttgtttactttctttcatccgttttattacatctatgaaatcaactaggaagtgaaaccaatttagtttttcacaatttatttattggaaacttatgaaatcaactatgaatctaaccaattcaatttaatataacccacaacatgcttgtagaaccaactaaagaattaaagttaattcaatttaacgcaatttaagctcacctatttcttatacaccatatcattgttgtagctcgtcaggaacaattaccgacactaaggtcatcatcttgtgcttcctcttgtactacggaatgttatagccccaagcagaagaaaatattcctaaatgcttccaaatctgttgtgagcctttcagcttatcacggtagtgtatattcttcatctcgtgtataattccatctctaatggcaatgttggttgcttctgctaactttttgtgtatgcccagatggtacggagattaaccaatgtactggtattgttgttgagtgggatgatgtaaaaaaaactgctataattctcacttctgcttggattatttgcacaaagaaacccttcgatgattggtcatacaaggattatgctcctgaggctaaggtaaaacacttcagaagcttagcatgcttgtgattgttagcatgttaagggcgtgttctttactccctattcccaacttctattagcttgttttccatgcgcatactttccaaactgctataaacggtgcattttttacaagaattttctatagaaaagttgcttcaaaaaatcatattaattaatctatttttcaaattttttagctaatacttaattaatcattgataatctatcgctcagttttgagtgctagaggggaagggttttcaacccccccaaaagcatgtctagtattcggttcgtaaagatacaaaccaatgacaatttaaaaaaaaaacaaggaaaaaaaacgtaagccgaacaagcatttggttcgttgtctagtggtcggctaatttttgcccacccttactccttgtagcaccttggaatcaaggatctagtttctggtcaccgtgcttgcaatgctaagtacatttgtaccttgtcccccctcatctctctctttagttcaaactgtacttagtaaaatcaaaaggtctaacatagtgttcaaaatagtataaccggtttgtctttcacatgaagtgtttcatatactcttttatgtacttattattgtaggttattgttcgcataccggatgacacagcctcagattgtcgcttgctgtacttcagcaagcatttcgatattgccttctttgaaactatgggagagttgactctaccaattgtaccgttgaaacctgatttggagtatggccagaatttgtgtgtgctagctagagataataaaacagatttgatttgcactacagtcagagtgaaatacgtggatccttatgagtatcagcacaatcactatttgttcatagatggttccattcctaaggtaatgatatatttatattctgaatatttaggtgtacttatatataatctcaatccaattttgtttgcagtgtggtactggaggtgcattggcagattttagtggaaacattgtggggatgttattctgcacgttacctattgttgctttcataccaagctctctaatccttacgtgtatgagattgtggagaaattttgggtgagcgccattttgttaatcttaattggttacatacccttgcctgtttcctttttcttttgaggtgtgtgtgggtggtaattattttctcacgctaccagaccatactcgctccattttattagttaaagtgatatttagacccacacaatgccatattttgcctaataacgaatgagtacaaacttaatttgcgtatgcataacatttaagagggtaagatgtttgtttaaatttctgaagaaccttgcttatatataaattaatactccatggttgatcgttgctgaaaatgtagcgattgtacgcttatgttttctataattgatccattttggatattcctagaataaatgcaacaatctaacgataatcttatgtaggcaacttgttcgacctcagcttggcttgaagttaagaacagtggattttctagaaatggcgcatattgagctattgtcccgtaaatacaacattgcctctggtcttattgtaagagaggtaaacttcttgtttatggtgtctaactatttctgcaggtatattatattataactcttctgggttcatactaggttttttctcagtgtgctgctgagaaacatggcattcgagttggtgatgttattctctcatgccaaggagagaacatttcaaatgtaactcaggtatcaaacaattgtcatccttaaggctttttatttggatgtttcaaaatctaagttagtcttcgaaacaagacctaaaatgcacaaagtatagcgtgtgcatgtgtggagtactttagtttatacagtaattcgactaccattttatttattttagttggaagatatactgttgggtgttggtgagagacaccttgagaagggtaatgactcgggctctaaagttgatgttgaggtaaatttcttctcctacttgggtatcttaaaacgatgtatttgtacttatcttacataccataaacaacaaacattccttttgatttaacaggttggtgtatttcatgtacgtaaatgttctagaagacttgtcactttgacagtagagttgtccgatggtattgaagtctttcactaaggtaataatagttataatattatgtcattatatattgttttcctttattttcagttcatttatcctattaatcaagagcaaatggtctctttttttttcagctttttgacgttattaatttcttctgaatactcattatgaagttttttttttctgttgttttctgtatcctcactaccaggctctcaccactccactctcagctagatggcagagcagtcactttaattctgagctctcagctatttgcctatttctaactgcggaaacacataacagggatacatagcaggcatggttaatgttttgtgcatgtgcatcccttaccagaggcactcagctagtaatttggtactctagatggtagatgatgcaaactagttctgagctattgtcgattactcagctagtaatttggtactcgatgatgcaaactagttctgagctattgtcgatagtaatctactatgtactaacacgcacgctgtgaactatgtacctcttgtgcgtgttgttagaaaaaaaacacgtacgctgtgaactaccttaaacatatatatgtatttgtacattaagttttccttttaatatgggtgacttttacttgaacttattaggccaatcgatgtgactttgttattccacaagtacaatataatacacaaagactgtgcttaccatacataaccaaaggcatctaggtcccttgtggcccacttgtcagactaaaaaacggaggactccatccctccagtaaaggctccaatagaatctatccttctaaagctggcatggaagttgcaagatgattgggtcacttggcatgactaaaatttaaaataaatgagagaacatatgataaaaaattccaagaaaaaaaacaagctttaaacattctatct

SEQ ID NO: 1844 - DNA, 12351 bp, Oryza sativa
cccacctgtctcatcagaaaaaagggcgccgacaactccagctcctaggaaaacacctaaagcgaccgaaccctagctacccgcagggaatcagatgccgacaaggaaagtttcctacacatacagcaccttatgcttcatccataagacgtctaatcactcttttatgaactgcaaggtggtgctacaagtgaaggctgaactcgatgcatgtagagatcgagagatccagcgcacttccccgtttaagagttggtgtccaattcataaatcaaaaggacactctctttcaggctgcaaggtttttcttgatgctaccaaatctatgacccgacctccatgctgctagatccatcaacacgaaaaccaatctcaatgtgtgtcaaaggacgattgcacggaagaaccccttgatcgcttcgtgggggtcatcgacatcgacccccacgattcaacgaacccgccaccatagaagcaatccggaggacttgaagccaattcaccgatatatctcgtcgagactctctcgacaaggatctcgtcggtaatccggagttccgttgttctctattatactatgtgattttctctataatcccatataaactaattagggctattaccttacgaggggtctgaacctataatccttgtctttttgtgggcatgatgtcgtatcgtgtagatccttgtaccaatgtaccccaataccctcaaactacggttcgtgggtatcccccgtcgataatcatgtctcatgcataccaaattaataacatggacacatattggggaacatgttggatagacccaatatgagacactacaagagctatatgtgatatgtcatcagcgatctcatttagtgttggtgtagaatccttacacctgagattatcatggttcccaacatatgtagtagcttatttagggctgccaaacgctactatgtgagtgggtaattataaaagtaatctttggtatgctataaaacatgtagtgggatataaataatcaagatgggatttacccctcctatggagagatatctctggacccctcgatgttatagattatggaagtgcatggccatgcaaaaagtaattgaggagttaattacaagttaaataatctatcactagatcaagtaaatgattgagctattaaagaatggcacatatctagccttgagcttaatcgataacgtgagacaggaggattcatacaagtgtatactagagatgcaaccgatataaccttatgtatgtccggtgggtcaatttgttttgttaggagccgctcttttcgggttacaatcgagtgtacatgaacctacggggtcacacacttaataggccggaataaggggattggatggagatccaataggtgctcaattaggatgggatccgagtaggactcttatgggcctcggaggcccaattattgatcctatgtattcttcaggtgatgtgactggtgtcccgtgagaaaccctagccgccactcctctccaagccaaaccctagtcgcacgcgggtgctagcacgtccgcgtggcatttcgtctctggacgtgtgcataccggtagaggcaccgctggtttgcagtgctgatcggcctaggagcatggcgaggcaaatgcacgaggaggagaaagtcgggctgctgcgattgactactcctctacatcgacgcgcgctacatcgctaacattccttcggcttcttaacacctacctccgttccacaacacgtcgagtggtaatgattcatgatctcatacttgcattggttcctggtttatgcggtagaaaaattttgatttatgcaatcatagcttttacgcgtatcccaacactgcgagccgtcgtgccgcctcctaatagtgacagaggggataagaaagaagatgtttcacttacacctggatttcacgtgggttttttttcttcctatgccacatcagcgtcatgttattcaaaccaccttaaatactgccatacgactacatttgtaccggttttgaaaattgaaggatggttatatccagttttacgatttagggattttattcaagctcggtgataaattgaggaacatcatgtgaacttattcctacttaaaaaaaggaaagccgggctaaaaagctagggccgaaaatggaagctaggcttgatcgctcgcacaccctcacgcgtgactattcactgattagtgatttcggagtcttctgagtggagaagtgcttcgtaaacgcccaaccagatggtccgtaatgtgaaatcattgtcatgattaatatttgtgatgaacaattggctatgcaaatgatttaatcagtgaattggtttggaaagatgtgtggatgttggtgtgagtgcgtgtgactaatgtgggtcaggttgtgatatctgtgcccaggaatggttgttttgtctgattgtgtgcaggtgacttgaggtcaaccttggtcaatggtgaggatcgggactatgttcagagaggaacataggtccagtgcggtcgggataccatgtgagaaggtgactagagtcaggattcttggaggtcaacttcggtcaacggtggggaccgggactaaactcagggaggagttgaggtccagacggtcaaggataccgggtgacaaagttgaatacgagatggcacacagtggatggacaccgtgtgggagatatcttcgcaacgggcttcacgaggtgtgcgtgcaagcgtcagtgttcgcgaaggagatcggaagaaattggagaggagtatatatggtgctacagtgattcgggttacagtagcatgcatatatgtatgtttactggtgtgcagtaggcatgtgatcgatacatgcatgatgttgcatgcatgtgtgttggcgtcggtatggttggcttgctgctgccaggtaggtcaggagcagcagcaggacgtgcaggccggcaagagcaggcggctcggctcggccaggaagttggtccacaggagcgagaccgagtttgatttggtgaatttgctgtgtccggttgtggggctgcaggtttaggagattgtaatctggatagagtcctagtgtgtttaggagtggtactcctattttgagtagagggttttttgtgatataaatagagagggagcgtgaggctttccggtatcgcttttgagagcaattgagttgatagtttagttagggtttcgagtttagtcgagatttttgtaaggagtgctgttgttgcactttgtaaacacagagagaagcaataaagttgtcatctactttgagagttcttcaattcgtgtttcttcgggttccggcggcatgtgagcaatccgaccggcggcgacaggactacgtcgagatttccatcgatttgagggtaacttttatttccgctaaaagtttttgggtttttggttttccctaccattcaccccttctctggtaggcttggtttcttgtgttcaatcctaaacgtaatatatgggttacaacgtattcgattcggacatatatttttctggtccgtaatttgtttcgttttaccaaatggaccgtataatctgattagggaggggttagttgcgtcctagctagccagttccaagcccatacggccaacatgcatagctgtaaggaataagtgaccctcaaagcttatcgaaatctaatccgtgaccctaaaccataaaatcggatatcttgactctcaaactcttaaaaccggtgcaatttgacttccttgacggttttggagagcggttttgctgacgtggcgcttaagtggtggtattgacctggtctcctttacacgtgtcgttgatatggcgtttaggtggtatttagaattaaaaatatatataggacccatttatcattgacacagaaaagaaattatgggaccaggtatcccttctctctcccctccctccaattacttctccctcctctttctctctcccgcggcgggcagcgagggccagagcggcggcgggcggccgcccgtccatcggctccgtcttcaccaccgccgcgtgttcgtcttcgccgccggcgccgccttcgtgccgcgttcgcttccggccgatggagacgccgaagagcttctcgcgctcatcatttcctcttcgttgtttgatacgggcggcaccgccggggcaggaaggcatgaggtcgaggacggcagggagcgagagcggcgtggccgcctcggcggattcgccgaagcagttgttgttcccggcggtggaggaggagttggcggcgttgagcttctgcgtggaggtgtacttggacatgaggaggaggatgttgttgccatcatctggctgtgctcccgcgcgagctgcgcgttctctcgccgcagccgctcgttctcatcccccgctggacgcgacgccgccggagccggagccggagccggatggcgtctgcgacagcatgagcaggggctcgggggacgagctggacgatatgatctgctcctcaccggacagaacctgggaaccatcccgcgtcgtcactggcaacgccatcgggatcgtggccgcgaccgtgaccgcccccgtcgtcgtcgttgctggcgtcggtggcgtcaccttccatcggtgtatctcgcagagcagccgccgttcccctcgccggaagcgtcgttggcgaactcccacctgtccgggacaatattcccaaatccctgtataatccaatccattccggcgaggccgagacaaaaattagtggaggtgttcgaaatcgaacgggacaaagagaaaacaaaaacacggcggcgaggcgtacgtaggtgttgagctggcggacgaagctggagaagttattgcgcttgaagtacttgggggaggaggtcgcgggcgaactcggcggggcgccagacgacgaaggtggagccgtcgtcgttccatgagatgatgtcgtcgccggagaagaccccggcgttcgacgacaccagctcctcaccgccgccttcagaagaggaggagagcagaacaactcctcgcaaaggggacccggcccgcgcccgccctcccgccaccgtcgccagcccccgtcccacgctcgcggctcaccgaagggaatagaaagagagggggaggatgatttttgtgggccccacctgtcagcgggtcccacccatatttttggtgaataacaaatgggtcccacatatattttttatttccaatgccacgtggtaagaagatcgagtcaatactgctatgtaggcgtcacgttagcgaaaccgacatccaaaaccgccgagggagtcaaattgcaccgattttaagagttggggggtcgagatatccggttttgtggtttagggtcatagattagatttcgatcacttttgagggtcactaagtgaacttattcctagctgtaatgactaatgaataagtctatttttcttcccttatctcttgcccttatcgaatcacatcccttaaccacaaaattaggtataacatcttcctcaaccttcaaaaactggtgtaaatctactcctaaggcagtattgaacctggttttagcctacgtggcgtatggattaggattttatcctacttggcatctgtatggcgctcacggtaaaaaaagaggtgggatccatgtgggcccacctatcttccatcttcttcccccagccgccgccttctccatctctccctctcttcctcgtgctctccacatctctaggccagcagccgcgtgggagaggagctgtggctgcagcggtggctcctctttacagagtagcgcgagcggcgatgcctcgttgtgcggtggtagacgcatctggagtcactcccggccactcctaccctcgctcccctgcaagcttgccgaggtctgtctccccgcgactcgagctcgagatccttagctaacgttttcggccgtcactcctaccttcaccccagctcgctcaccaaggtctcccgacatctgcctccctgcaactcgagctcaagatccatagctcacatctgtggctaacgctcgggaaagaggagaagttgcagctgaagagatcgtggagggcgacgcgttcagtggtggccggggtttgaggaggtggatggtggggtcgggtaggagacggcgagctggaaggtggcgttgggggacctgcggcggtggaaggcatctgcggagtgtgcttcggtgtcagtggacgagctggagcggcggtccagtgtcgtggtgaggcaagtgtaggaggagctcgtcaggtggcttcgcgtaggaggaggagtttgtcggccgaccgcgatgcgtgcagtgcggagatcagcagttgatggcaacagcgtggtgaggcgccactcctcactcctccatggtggcagctatgttgggtgccgcacatgcctgacatcgcaggtcatggacagccagtggcggcgcacgacatagacaaccggcggtggcgcagaaagttatcatcaccgccggcggtatttgtgcaattggccttgggggaaagatggttgtggccatcgtcgtcatagcattgtgtgtctcaccgtcggcccgttcgagattgagaggggagggatgataagtgggcactacctttttcacttacatgtgggactcacttttatttttaattcctttgatgaccgggctgccacatcagcgtacttggaccaagtcaacgtgctacgtcagcaatgccacttcccaaaaccaccaaaggagttgatttgcaccggttttagaaattgggggaggtgttatacgtggttttgtcattgagagatgcgattcaatcgaggacaagagataaggaacacataatagacttatccctagctataaagaaaggtcatgagctcgcacgcgctggcaccggtgataacatatccttcttttgggcgtaatgtttttccttttaccactgtctgtttctttttttctttttgagaattatacaacgctcacagcacacgcacactcacccctatgaatgcatgtaaacaaaccctaccccctatgagcatcttcaaagaatgggccggcaaatcttgcagattgacgaagtcatcatagacacctcactgtcgacgggtacgtcacctaccactgaaagcaaaataacgctaaattctgcaaaagggtttgaacgagaatggttagacgtttatatatccgcgatgctataaccgcctgaagaaccagtaagccataattaattcttcagtgttactcattcatttgatatttctgtaccaacccgtaatcgaggtggaaaagacgtatagtttactagtcgcggtgtgcgcgcgcaccagctgctatgtcagccaatttttgttcatctcgtttcgcttatatacttataagctaaattttattttttaaaattgattttagttttctatagtttattttataatatttacttttgaatcgctaaatacatatctagatttacccataaattatttttagttgatattaaaccattcgaatatgtactatcgaaaaaaaaaccattcgaatatgtatgtgcataagccaaaagatggatctccgtttgtattgtctggcctagctgctgtgttggccccgcgcgcgccacatcgctatctgcctttgatttccataggcatggagctatgtaaaccgtatcccatgctccggtgcgataccaactgttgccaaaccctctaaagctctactttgtccagaccgatcagttctccgtttccctttggtgctttccaagcacatgccaatgtaaccaatgacccaatgaccagtgatgacagatcataagtgacaagatttatccatttattttcattatcccaaacaagtgattcactcagtgcgaggttttatttaccaccatatacaagtacaggaactaagatagttattactgtccctgtacgagaccaagctcatcatgggcagaagacgatctggtagtcggtgccggcggggcaggtgaaggtggtgccttggccgtcccgggcgtaggtgaccgtctccgggcacagcttcttgaagaactccgtgtccttggtcggcccgcacgtgctgttccccctgcacgggttgctgcacccggccttggcgcgcagctcgccggggcactgcagcgtgatctccgccgcgcaccgaggcccgccgcgggggcaccgtcgcccgcccgccgccgccggcacgatggccattggcgcgttgaacccatccacgagcgagatgtcgaagtagtcgtccttgctcgcctggcccagcgagaactcggccaccgtgacgggcggcgcgccgacggccgcgcaccgcagcgtgccgccgcagtcgcccgtctggcactgccctaggctgccgccggagatgaagccgcagcccgtgcgcccccacacgcgcgcgcccttggtgcccgccggcacgtacacggcccagctctgccccgggtcgagctgattgccgtcgcccgacggcagcgccgccggccacacggtgtacccgcacttgttgacgatggtgaacgtcaccgcatcggcggcggcggcgagcaccacgacgaggaggaggaggtggacagaagagttggcgagggacgccattattggtgacgtgttagtgtttctgttgctcaaattgagctgagcaagaatgcaagctaggggtgtggatttttatagcggtccggctaatggataatgtggaataatggaattcaacttttgcagctttgcgtgtgcgaatttcgttacgaaatcccaagagagtttggtggggaaaccagctgatggtttgataggagtccagctggttgtattaatttggcagaatcgtctagaaatggatgtgaatgatttggtcaaatatcgtgccaagattttgcgtgataatataaagttgtactatcttaatttatatctgaattgtcaattgatcttgacttggatgatacaaaatccaaaaatatggtagggacaaattttactctatatattatccatcgctattatcctgaagatataaaatacagagctctgccaagaacaaagaccgttcaacccaggataagaaaggagctaggtcgatgaatcgtcgatcacattctgggttcaaaaatcctcgatcacagttcacaagcacggttcataaggtttggaacgaatagagaacgtgtcatccacgcatacaaaaaacgttgttcagttctcacttgtacatcgtagtgatgctaaagtgctaaactacccgtcaaacccccctggaaaaaataatagaatttgaacggattcgttcatgcctgtgtaattaaccaaactacaagtgaaaaaccacttcagttttgaatggtttactttattacagagtaacttttctcttcatgattctgatacaaactcgcataaaaagtatgcatgcttgtttattgtgtatacatctaaccaagatcacatcgatcagatgccagctaacaagtcatcgtccctcatgggcagaagacgacctggtagttggtgccggccgggcaagtgaaggtgctcgtctggtcgtccttggggtagctgtaggcgtccgggcagagccccttgaagaactgcgagtagttggtcgggccgcagttgttcgccgccgagccggtgcagcagtactggtcctgcttgaacaccgtgcacgcgttgttgcacccgccgggcgccctcagctcgctcgggcactgccccgccacgtccgcctcgcaccgcggcccgcccttggcgcacccggcgccgtcgccggcggggaggaagtccatgggcacgttgaatccgtcgatgagggagatgtcgaagaagtcgaggttgctgaactggttcagcgcgaactccgccagcgtgttgggcggctgcccgtacgccgcgcaccgcagcacgccgccgcagtcgcccgtctggcaccgcccgttgccgctgccgtcgaagctgcagcccgtgcgcgcccacacgcgcccgcccgtcgtgccggccggcacgtcgatcacccactgctgccccgggtccagctgctgcccgccgccggacggcacggctgccgcccacacggtgatctggcacttgttggtgatggtgaacgtggcggcgttcgcggcggcggcgaggaggagaagagggaggaggcggaggatggcgggagctgccattgtgttagcctgtagtggagtgcgtggttgtggtgactgatcgatcgatgcagatatttatagtctggataacgtggaattccggtgcttccatgcgcaaatttctcacagaaattccacaagtttggcgcggaaactagggatgttctggcggtcggtctcggcttaatggtctgattactgagaaaatagaaacgtacaaatggcacatataatggggccgacgggtttatgccctctataaaacgggggaaacttttacggaattgctagaaaacttatgtaagtttttttagtccaaaaactttcaaatttgtgattattggatcaccttaagatttgtgcatgaaaaaaaattgctagaaaaaacttttacacatgtcacacgtaaagattccagtgctaaccaaccaaaccataattgaatataagttttatataagttatatcataggtacagtatagttacaattagaagcatctattatatactaaaagtccattaaactttctataaacgctctcaaaccgtcaagtggcaccctaataaataagagaaatttaaccatttatttttatttaaattggtggacctattgttttggatggttagatctattcggtaaaagcaaaaatcacatccgaaaccaacgacgtacaaaccaaaaaaataaaatcaatagaggcgtcatatatactaacgaataaaagtacgtactatatgaacgtaggtactgtacgtacttcccttcttttccttcctatgttactttctatttcatgagaaattaaaattaaaattatttttacatgcaaaaaaatcacaaatagatcaattgctatgtctagcagctctccctccgtcacagatttaaacatcctacgaactatcctaagtcgctacgtggtgcaaataaattagagaaagtactaaaaattcttaaaaatacataacaaccaaccatcgatttctacttaaattgatgattacatttaggtggttaatttttaataaaaaaatcccaaatctctctccctccctccctacccccgtgtggtgttaaagtccattaaatattttttaaacgcctctatgacagtcttaaattaaagaaaatcttaaaaaatttagaaaaataactattatatattaaaagtccattaaacatcgtacagatactccgatcctaagtcgctaagtgacaccttacaaatgcttctatgtcgccaagtcatactctaatccgatcatcgattttcatttaaatcggtgtatcttttattttattttagaaggttagctttttataaaaaaacacgcacacatccagaacttccccatcacgtacgtatgaacaagctatcttcatgagaaattaaaatcaaaattatttttacattaaaaataccacaaaatagatcttcctctgctaggtctaaccgctctcgctctgtcacactaaagatcctatgatcgcttctaaaatgctacgaggtgctattaaattagagaaaatacgagaaaatctttaaaaagaaacaaagcatctagctatcgatttgtcaggtttttgtaataagaaaaacccaaacttctctatgtccctccccacacccgtgcaacgttaaaatccattaaatatcttataaacgcttctaagctgctatatgaaaatcttaaattagagaaaaatcttagaaatttcgggggaaaaaaatccaaccatcgaatttgacataaatcgatggacacataattttcaatcgattaacatattattttaggtcattagatctataacttttttaaagaacaccccaaacctctttctctccctccttctttgcggcatacggtattaaaagtccattacacatcttataaatactccaaagatattatatcgttctcttaaatcgaagaaaatacactcttgagatattacgttgttatcttaaatcagagaaaatcctaaaaattttgacaagaaaacaaaacattcaactaagttgttagattaatcatttagaaaaaaagtcccaaacctccctccctcctgcccatttaccgcgtgccccattcttttctctctattttttttatctcctaatcaacggaagttaaaattatctatatgggcaaaaaaaaaaaaggaccgggggatcca

SEQ ID NO: 1845 - DNA, 3370 bp, Oryza sativa
tataagaaaggagagatgtgggcctatatttattttctcactcacatgttgatcccccatattttttttctcactcacatgttgatccccttttttttctaattatgatgctacgccaatgaaattagagatctacgctgctatgggatctaaattacacggttttgtatggtttaagggtcaagatttctagtattggggattagggatgtcatacaaactcaatgtaaagttgagggatgaacggagaacttattcctcgtacaaacacagtaccagtacgggcaaagggccgaccgagcgcacattctcctcgtactacatggccgatttagatgcaacatccgtggaccggaaaacagaaggcgcctttgcccgtgctggctggcccgtttgcccgcgtgcccaaagccccaaagccccaaagcctggcctgccgggcgctcgtacgttatcagacatccgcgcgcgtgatagaccaaaatccaaccaaacgggccggccacacgcatgacgcatatgcctaggcacacaccacgcaccagtgtatcatgacgccccatcataacaacagccgatcctgcagctcgatcggctacaccatccatcatccatgcagcctgcctgcagttagctgcaggaattccctcgatcacctcccacccggtcgatcgatcgatccggtccctggacggagggggggacacgccatcatacgcctcttacgtaggtacacgcatggcatgtcccatcaatcgatccccacacacccctcctcctcggcctcctttccccgatccatgatgcgcaccgtttctcacgctctctctcccttcgcgcgcgcgttcgatcgatcgatcgatcgatcggcatgcatacgcccatgcgtggtgcacggccggtgcactcgctccgtgcctccgcgcgcggcacgcgcattgcgaaactactcgtaacacacgagatctcgatcgccatcataagtgcacctttttacgtggaactacgcgctcgctgctgcctgtgcatatgctgctgcctgtgaatgcctgatcgatcgactagagctcgtcaatcatgccccgcccggtctccccacgaatcaaccgtttgatgtgatcaccccgtccatccggcacagccgcagcacaagtgggaaaaggagggagctcttccgcgtgcagcttatcgatcgctagcggtaacttttatgcgtgatacagtacgcctttggagtaactgagtagtgacactagtactactgcctttgcgggtctctctccggtcgccgtcatctctggtccagccattgccacctgcgagacctgccctgatgccctgatgggcgcgcatagctgacctgacctccgttctctagcaccctagggccagggctgcgacatgcgtatatatgcatatggcggactcgaactcggttggcacgatgcgtaagtataagctggtatggtagtactgtgctgtactgcccgatggtgccgtgcatggaaaactatactacctagaaaacgacccgagagaccgtgagcgtacggtgccctgccatgcatggtttgaccttgggacaaagcagcagtgaacaatcaaacaaacagagaggtcactgcttgcgcatgcatatcagcagataaatattctcatcacctgcatgcctactgacggccgccggcgccagcgatgtgttctgaccatatcacccgtcaaaacatacgtactaccttaaccataggagtatctctcttacatgtgggggagtgaattttaaactcgagagagacatcccctcattatttacatatcatttaaatagttaaaaaatcaataatacagattaatatatgataaatcacttcacaaagatataagttaaaatttaacttttacaagttgcaacaaaaaataaattgaactatggttagttaatgtatatccgcagttaaatttgcttttttcgttgcggcacgtagaaattgaatttaagttgcatatttgtagagtaatttatcacatattaatctatcttgttgattttttttaaaaaatatataattatttagatgacacgtaaataataaggtatgtaccctctagagtttaaaatagctttttcttacatgtgtcttgtagtgtagtgtagagtgtagtggttgtactatgtcgatctgctcggtgtttgctatccaggtcggtccatccaattgaggccggagaggggccggtggggttaaacctggctggctgcctctgctgggtcttctcttctgtgaaaattttgaacggtagctgttgggttttaccttctgcagctgtctagacacagtgaaaaaaccacgcgaactgcttatggctgctggctgggtggcccagaccttggtgagaaccgagggaatatgtggaatggaatggaaacaacccgttagggagggaacaaaagttacacagctagcaggagtagtactacgactactacaggcccgttagtgggcgattatagatgtcatctcaggttgccacaaggacacaaggtaaaaaaaaattactaatgagtagtgaaagtgtcttgctttctctagactagatagtatataggaaactcaaatcatcccttaaaaggatatctccttatcgttgcatgtgacttgaaaagtcataaaaaaaattaaaaattttcgtaggatagattaatatgtgatatgttattttacaaacgtgcaaattcaaattcaacttatacaactagaaacaaaaataataaatttgactatgaataaaacgtgtaattcacagtcaaatttgttatttttgtttcgaattgtataagtcaaattttaactcgcatgtttgcgaaaaatatatcatatattgatctatctcgacaaatttttttataactttttaaatgctatgtataaaacgaggggatgtctcctctatggacaaaaatccacttccgtagtatatatatgtagtagccatatgcatcatcacattacgttatcagatagtagattaattacgagtagagtggtagtgttacaagcatgcgtgataattaactcccggccgtcccaaagattgtaccggggactttcccaacattaacatgtttcttgttaatttagcattgctggtatagctacggtgcagtactggtgcatagacgataaatcgagatgcttggtttgtaaatatgcttggttttcactattcgaagattgctcctttctccatctagctcacctatatatattcctggttttattgagaaaagtaaatttcacaaaactacatgttttatagtttaagttgcataaaaccacacacactttgatacttggcacttaagtacata

SEQ ID NO: 1846 - DNA, 11095 bp, Oryza sativa
aatatatgtacttaagtgccaagtgtcaaaatgtatgtagttttctgcaacttgaatcataaaacatgtagttttgtgaaatttactctattgagaaataataatgagaatattccgtggccttaatttgtgataagaatacatgatcacccagctagatagcacaagatatatatgatgcgcaccacacagtcatgcatgtacggaatatatgcatggttcccatcatccagcaaactagcatgcaactagtttgctagcagtctactgcattcagcatgcatgtatggtccttgttaacccttacattgttttctgctagatcagaaataaaggcagatttaaagggtatatatacatccactgcgctgtgcatggatatgttcaagatgcatacctacacaatctatggctatatatatacttactccgtttcaaaatatttgacgccattgatttttttaaatatatttgaccgttagtcttattcaaaaaatttaagtaattattaattcttttcatatcatttgattcattgttaaatatatttttatgtagacatataattttacatatttcacaaaatttttttaataagacgaacggttaaacatgtgctaaaaagtcaacggtgtcaaatatttcgaaacgaagggggtatatcgacactggtcatatataggttttctacttgcaaaagcgttcgtgatatacaagttacttggtagtggatatttgcttatgtgacagtaacacagatattatccatacatctcctatgacttattctatggcccctaacgaatcccgtacagaactttaactcttgtgttgattcgattcgattcgatcgatcacaaagtcatcgaggaaaaaaaaagtgacttactccctccgttccctccgtcccataatataagtgattttgagtttttgattgcaatgtttgatcactcgtcttattcaaattcttttttcaaatataaaaaacgaaaagttgtgcttaaaatactatagataataaagtaaatcacaaataaaataaataataattttaaaaaaaatttaataagacgagtgatcaaacgttgtaaggaaaaactcaaaatatcttatattataggacggagggagtatattagctagctagagacatcgcaagtggacaagaactaacgtgtactcctgtcttggtcagcttggccagatattcttccgtttttcacagtggtgatatgatcatctggccatataatccacactgcaactctgcaaggcctttcaccaagttagtgatggtgatcactgatcagtgatccactttactcgcgctaatcagctcaacagtttggtaacctaaaacatccacatctcttgaatcatccaccacgcgcgcgcatcatatcatacagtagtacgtacagtctccatgacacgcacacgccgagctccaagaccaaaatccagaccgattggcgctgtcgatcgacgaacggacggcccagatcccagtcgagatcatgtcccggcacacacctctcactggacccggtctcagcgacaagacacctccaaaatcattgccgccctgtggccatggagtgcttagagagggtggaatcatcatgtgcttattgaaaaaaaaactatagaattaagctgaggttgacaccggagtcaagatcgagtgtggtacgtgcgtgcgggccggcagaacagcggatcagctgggcgatcaacacacagctgactgatgaggcgacaatcacatggtgtggaattaatgggattaatgaatggtgatgactgatgagatgatctatctatctcgttcgagttgggatacagcgttgtgcgcagatcgatcggccgatggaccggccggttccctgtccaacaatcatgtggaggtgtggtaagcagagcatgcatgcagggtggaatgtctgtgtgatgcctgagctgtttagactatgtaaattattacaatgaattatcgatttgattatcaagatactttaaagatttaaataaatatacttaacttatagctttaaacaagtgggttaaagtagaagaatcttttttaaaaaaaggtatttccaaacgtggagtaaataatgtgttctaataattggatggataatctgagaaagaaaatgaccttagactatttatctggcaggggcaagatcatctacgtatggagatagcacatatcaatcaccttaactgcaagatactgatctttactggatcatacaaaattcacattagtcccggttcaaaaacccgacggcacttttaaaccgggacaaaagatatttttgagtcccagttaaaaaaatagcaggtggtgtcagacccctccactatctttagtctcggttgtttaacaaccgggaccaaaataaaaaaaacaatctggactaaaattaaaatttttttgcaaagttgtgccgagccgccttgtcctccccacaagttacagtccttatctccatctcctcctcccttcctctccctcattcctctcccccgatctcctcctcccctctcctcctccggccccctcccctctcctccccctcccctctgcgaagccgacgacggtgacggcgggcggcggcgccctctcctctgccggatccggcaggaggggagacagcgggggcggcaatgacatcccctttcctccccctcctcccggccccttcccctatgcgaaactggcaacggcgaccgcaggcgacagcgatgattcttagattttttgtttaagtcgatttgttgtggatgaatttgttgttgatgatttttttaatgaatttatgatgattttgttgtggatgatttgagtatgatatgtgaatttgtggatgaatttgctaacagtagtatattggatgatttgtgaatttgtggagcaacttgacgtggggaatgcaaacatcaaaaaacaatgaaaaaaaagaaaaccatgactaaagatgtagcagcgtcatgtggcgccatctttaatcctagattcgaggtttcggtttgcaacccgaaactaaagggattgtaaatcaggactaaaagatgctttctccagcactgtttgttggcggactgagaggtgaaaaaggagatgtttcaaatgttcctctgtctgtggcggtcgtacatcgcctgcggggtgagggtcatcaggtcaggctcatctcgttgtcgagttaatcttgtagttttctctcttttcccttttccttgtgcaactcgaagtggtggtcagtgtacatcatcttcgtcttggtggcgaccggccatcaccggagcagctagaggtttctctggcttccatcgagcggctgaagctaagcttagtgattctaagtggttattcatcgtaaaatttagtgattctaagtggttatttacgtgtaaactactaaactgtcaagcatagaaatatgtatatgataagcttccttcagacatgataaatggattatgttggattaatccaagaaaagcatgtactgcattactacatcatacctgctttaggatttctcctttttaacgaattaaagtgccgaggtcttcaagtacgtaatcactattttgtgcccgtattgctattggaatactggatcaccatatatatgcaagccacgtatgagacgtcaattctgatcagagctttcactttaccaagttcgtcaatgcatattattttgtattagtactagctttcagagtatatcaagtggagtctacaaaagcatgcgaccgattaaatgtggagctaaggcaaataggatgccgacctggctccttttacgcttttaatcattagattacgagaagtttatgtaaagcgttaagcgattttgcgccgctctgcttcccaacttcccctgctttacccagcaaattaatatactccccctgctttagccagcaaaatatgagtacacgacggcttttgcaagcaagattacgtgctaattgcatgtagtgtaagctcagatcaatgtggtggttaatccttaatccatttccaagttgaggtcagccgacacatgactgtgtgtttagttcacgtcaaaattaaaggtttggttaaaatttaaacgatgtgatggaaaagttgaaaatttatgtatataagaaagttttgatgcgatagaaaagttgaaagtttgaagaaattttaaaactaaacacggcctgatgtggatgtctcgttcagacaatctaatcttgtttttgatagcactctggcagcacagagctttcatttacttgccctggccctacagttgcttatattgttcgcaacatgccacatcgacttgcacacgctttgacacttgtcaccattggtaactcaataactattttactctacaacctcagggtctgttcactttgatgctattttcaaccatactattttttaataaagttgtaaaaagaatctacatttagtttgttaccaaatttggttaatgcataaaaaaaattctgccaaaattttagcaatattgctatgttgctaaaattttagtattgccaaaacttgataaggtttattttggctataatctgattagacccgaatgtctcagcagccatgactacagctctcatggaattgcaaggaccagatagtagcagcagcatgtacatgttctgaaacagtttgcttgtgaacaaaatgaaacagttctgaaacttcccctgcgccagaaacagaaagcaagtggtagacataacgagtcactcaggcacagtttgaccatagagggacgacacatctgaccattttccatccatgacacacacctgaaccacttactgtcaccagcgagtagtggcacgaacacaaaaagacctatcccaacagtgcatctccacaatattgctcgaccgatcgatcattccgtggacttcaacggaatggaggaccggatcgagtcagttgatgcgcggatcaaatcaaagcgcaacgcaaggaggcgcaccgaggattaattgaatcgatcacaattcacatgtacgtgcgttcttttgatggtccaagatgttccttaaccgtgtaacactggtatgcccccaaaaagcgctcgagccattaaggtacagccagcccagctcctgggggccccctctctcatagttagtggaagcttcactaagtacgcgacacatttatatatgtagatggagcatataagtgcgtacatatgtgtgccttgatcgatctgttgttatatactattaggagtattggcgttgttgtagcccccagctgttagctcgaggtgaccagtctatctgtcgttgtttatcgatccagcccggggtgcccgggctccattatggattgttcattgttgttgcggttgcatatacagatgcagtgcagggccctggcacgcggtccccttgcccggtgttgagctgctgctttagccgcgcgctagctcatctcgatcatatctaggagtatcatgcaaaggccttcgcgtcgcgcggttgattgggtcgggtcgcgtcccccacgcaacgcatctaagctaagccaagctcgctggccggccaccaaaaggagggcatcatttgtttggctcgtgccaaagctgcccgcccctggcccggccggccgcgcccgggtcatgatgagaaaattgcaatagtaggactgtaaatatgagggtttcactgttttgacattctgagtggatgacaaataggtccatctgtgtagaaatatggatccagtgttattataacaaatgttaatgtttgcagtgttataattgcaaatccccacatgcggccagcgcgatcgatcgattcgcccgtttattctagtagccgcgcgcgccgacgccgacacgctcgtttcgcgaggacgacgaggagggcagcatgtaccagtgccacggcgcgccgccggccgcacgccgccattgaccagcacgtacgcccgcgacggacgacgtgggcgcgttcgcgattcgcggagaggtgcccggccgcccgttttcgcgggagaaaagggggggctagcatgcgccactacttgtgccggtgtttgtaccgcgttttaattagcgaaggaccatgcttttaatttgccgtgcaacggattaatttagtcgaccaaccgaacgcccatatgcacaccaggaccgttcgatcgcgtgcgtgtatactggatgcgatcctgagcactgttccattggcacggtatagtgcacggtccagtccgatccgatccaggccagggcagagggatcgggctgtactccagcagctaaacacgggcactgtggcagtagggtttggcaggggcagagctgactcgtaaggctggggcagcgatgttacggctctcgacccccaccttttcatcctgtcgccgaaaccctcggcacggcggccagctgcgcggtggccggccggccggccctccggccagcgcgttgtgtttatgtgtgcgctctcgagcgtagcttcgcctacggctttagcccacagctttgtattctaggatgtcgatgcatctcgaacatgttgtctgaatctctgatgaacagatgcagcactaacatcgcctacctgatcgatttcagtagcctagctagtattgccgaaagatcgattcttgcgattcccaaaaacgcatacacctctatctttctgctactactagtagctctaatctccaggaaagcacggattttttttttacaggtttatattacttcctatgcatccaacgaacttcgatgggattggatttggaaggctaatgtttgggaaagtaaatcattcaggcgccacaaagtgaggatctttcgattcttttcaataacatttggatacatttatttatatatgggtgtggcgaggcctatgacaacgaaagcaacaactggagtcggcactatggtggtacttgtgcagttgtgcgcccatgcatatgattcactactactccattcatcatttctcgaaaaaagctaaactgcgtattgattttttttcccaaaagggagagggagacccaccagagaaaaaagattcagattatattactcaaagccaaaaaaaaactacctccatttaatttttttaatgttggttagcttaaaattaagagcaaagtgtacggacggtgcttaaacttgtaggggtgtgtcatctaggtccttaaactcttaagatgcatatccaagtcccagaacttgtcatagtgtgttatttaggtcccaaatcgccacaacctcttcaagatcctacatggtattgatgtggcatgccacgtggacatgacgtggcattaatttgactgacaaatggaacccatttattttttttcctttttctttttttcttctctttctccccgtgattcttctttctctgtgacccaagcagaagaaaggaaaaaaacaagaatgagaagaaaacgaaaaagaaaaggaaaaataaaagaagaaaaaaaaaagaaaaggacacgtcacgtccatgtggcatgccacatcatcgccacgtaggatcctaaagtggatgtgtcgatttgggacctagatgatacacttcgataagttctgggacccggatatgcaatttgagagtttagggacctatatgacacaaccttacaggattaaggaccgccaatgcactttactctaaaattaaagggtaatttggaaccatgccattataattttgtaaagtttgagatatgtcattggtaaccaatgtcaaatacttggaaaataaggtatttgactggattgaattatatgtccatgttttgagacggcatttcttgcttttatcgagccatggatgcttggattctgaatttgttgagatccagctgaggctgtgtttagttccacgtaaaaattaaaagtttaaagaaattggaacgatatgacggaaaagttaaaagtttgtgtgtgttgaaaagtttgatgtgatagaaaagttaaaagtttgaaaaaaaatgttggaatctaaacaggacctgacagtggtaacagagaagaaatgccccaaaaggaaaggttcaaaaattactgatgaaaacgaatgcgcaacagaaagcttagcacacatgctcgacgatattgcgcaggcgctactattactgggagcataatcaacaaaataattggcattgattagacataaatacgcatgcataattatttcatatatatgctcgtggtagtcgttccatccactcgtgcaattgcgatgtggacgtaaggtggatatattatcaatcaagattttaatttgctatcgctgtatgataccagatggcatgcagatggggctacataaacacacggccggatttgcagacgtggtgaacatgccaccatctgtatgtatacattacaccatgaagaaaaggtcatattatacatggaccatctaagaataatgagtttcaaaaaacaatatagaaaatcaagaaaacaaaatgtctattcctcatgtgccagggaatctggtattaattaggccacaattatgaatgatctctaggggcttgatgaagtggccgtgtgatgcaccacaaatttcgtgaagggaagggaacagagtgagctgcacagatggtaagtaaacaacgtgatgtggcgtacatgtacgcaggggacagctgcgatggcatgggtctccgagctacctacacgagtagtaacacggtacagatacaaacacgcacgcacgcacagctgcacaggcacactgcacagtatggttgatactacgcgcggtgtgcggtgtatattgccttgcctggtcgatctcttgggttggttgtcgcagcagaggagatgtcgatgaagaagaggaagatatgctatgattcggcagcatgcagcgtgcgtacgtataggtacaggacgtactgggtgtgtcaacggcagcggggcagcggggcaggagggattgggcagcagattggtgactgatgataaataacgcggcggcagggtggagtggcgagccctgcgcgctgccgcacggcgcgggcacagggacaaaagcgcgtacagtggcgcgcgctgctctcggattgtctcggagatggcaagggccaagggagggaaggatcggagtgtgccggtgtggtgtgtgcgggtgtacttcggaggtcattgccgcgtgggcccaaagacgccggtcacgggaccacgcgtgtcatgtgcgtccgaccgaaggagtactggatttcttggagtacgcgtacatgctcggaccgagatgtgcaacgtgctactccttcggttaataatacttgtcgttttagataaggacacgatctgaaaaaacaaatttaaccattattttttattataatatatataaaagtgttaacaaatactctctccgtacttgtataagaaatcgttttgaacaacgatatggtttccaaaacacaactttaacttattgtttctataatatttaaatgatatatgtatacttttatgaaagtattttttaatacaaatctatttatataatttttatattttcaaacttaataacttaagagttatttatgatttatattctcaaggtttgacttaaacattatcataattgactttctttacgagtacggagggagtatatgattttattgaaatacgttttaagactattctatacatgtagtaaccatatttgaaagataaatattttaaaaatgcttcataatcaaagattttaaagtttaactttactcttgtctaaaacgacaagtattatcagcctggaggggtattatcagcccgaagggagtagtagagtgcgtagctagtcacgccccgtgctgctgctcttcttttagcgtgtgagaggagtatgtttgtagggtgatttcacggttattcaaaacgtattaggatgtatcacattttttatataaaatttggtacttgtcaatatcttcaatgttagcaggtacggaaatttatttattgaaatatctcaagaataataaaatttctcatgtgtgtaaacggaatgcacgctgaggtctttgtgattttctttatttcgatttgcaacgaagatgtagggtgcatgatcgaacataaaatgcaataacgagctttgacacaaaacactcaggccccatgtagttcccacgcaaaaacttttcaccatatcatatcaaatatttggacacatgtatagagtattaaatatagaaaaaaactaattacacaaattacgtgtaaattacgagacgaatattttaagcctaattgcatcatcatttgataatgtggtgctaccataaacatttgctaatgacggattaattatgcttaaaaaaataatctcgcagttttcaggtgaaatctataatttgtttcgttattagactacgtttaatacttcaaatgtgtgtccgtatatccgatgtgatacgctaaaacttttcaccgctgaaataaacagaacctcaattagatcgagtttgagggaaattcatgaatctctgatagatattgtctcgaagtgatcgaattagtggttccctgcttttcaataccactggacttaaaataaaaaaccaatcttcaggtacgttattcagatgcatggaaaaaaatatatgctatgttcgttcctcagggttcccaactccacacactcattttccacgcgtacgcttttcaaactactaaacaatgtgtttttttaaaaagtttctatacgaaagttgcttaaaaaaatcatattaatctttttttaaaaaaatagctaatatttaattaatcacgcgttaatgcgaacatcgttttacgtgccgagaggaggggttgggagagcttaatacatatcaaaatggaggtagtatttatattggaacagacaacataaataggttctcatcgataggatatcaactagccgtgtagtagtaatctgatgagtgatgacctagccatatataggctgtgttttgtgtttagtttccttcaaatttccaaaaatttcgtcatatcaaatatttgacatatgcattgagcattaaatgtggaca

SEQ ID NO: 1847 - DNA, 4712 bp, Oryza sativa
atatgtttgaccacttatactattgcacaaatgttttgcttttaaaacacttgtatttgccagcttactctgattagatacaatttttttagctatgataagttacaccaatgcattaactcgaatattggtttaccaggtcggcaagtgtcagcaggtgaaagaaaaaatttattttgttggtgttaagttcactggaaatatttttaactgaacttttatttgcttatcaaatcctattcactgagcaacgagactgatagaaggcattcagtgggtacgaaatgtcgatctagctctaaagtttcagaaatcacatcttactatatggagggattgcttaatgtgtttttggtcactcactattcattaagttcttatcgtgttacagaagattggatgtacatatggcagaaatataatgttgtcatgtcttcctacttatccttggatgataattcacaaatctgcatcaaattcttaagcatgcagttcaagcgatgatggtggccacaactggagattccggtggtagttaataatgtaagaatcatagttgtttactgacaattcctataatgcaatacatcatcaaattatttagatagaaaagcatttttttgtctaaacaatgattattgccgtttatctctctaggttcaggccttgaggatcatgttcaggactctgctgccttcaatttgttccatcgataattgagcgctttaatttgtgcactgttgaactatatacgagagaattttcaaccgtccaattctaacattgcagagaagtctaaaatgtcagtagtatgcttgtaattttgttgttatacttggtttgctttattgacatttcaagtttaaatattattctctgtaattttgtagattctataaattgtaaattttatttcatgtatttttagtatgtttaaatatgttgttcaaccttttagaaaagaaaagacaatgaggattattggattgcaatcaaatggaatgtgcaaagtaaatatattattggaaggattagatgttttaatacgattatatatgaaaaacgtgcattgtacgtgcgtgagtactagcaatggaataggtaagggtagtaatatatacatgctgacactacggtattatttcgatgcaaatcaaattaccataagataatatatgttttattaaacgagattgatttaaaacatcaaaaaaaacagtaacagtgagaaaagttattttgttgttagtatctccggttataaatatttgacttttgctctcatataaaagaaaaccatacttacttgacctgcttgataacatgaaccatttgattgttttttcaagttccaatgaattcaagcaatattataatttttggatttctatccactgggatcccgtcgggagtcgggacgggacgggatccccgcattcccacatggtcagcaaatgacttttcacacggaagcacgaagaaggcgtcgtacgccttgttggcctcacgcgctcccagtccattgctgccaggagctagaccatcgtggtcgcgagcccgcaacccccatctaccgccagcagccgaatcgagaggagtgtctccattggtgcccagcgaactcctccatgacctccaccttccgacggttgcccctattcctccttgtgcttgctgctccttgtccttgttatctgcaattgcagggagggacaatgtaggggagcatcctgctgctccccctcttgtctaggattgcggtaagagaagatgggagattgtggagagggaagatggggagcgccgccatcgccctgggggaggacaaggagcagcgtcgtcttcgccacagcaatgctggtaaccatctccatcccttcttctcttccccctctcggctcagatttgatactcgattggtgccatgtctaatagcggtaggtataggcctaataccgatatgtatcaactggcaccgactggggtattagctagtaccgatgaggtattagttaatacctgacgagtatcgagtgatacatatgaggtataaaatctaataccaacatgtacaggaatctgatacctgcttggtatcatcctgtctggacgggatcacgctgtatagcagtctcctattatttttgataaaatttgaccattttctaccgtaagtcaatggtttcaaaatggttttagcgaaaaccagaaaaaactggtttttggatcgttaaggatttcccccaaatagtccgatttttcctccacgccgataaggagcgattcctgcttcattcaggcgagttgcagcctgcaatccgaactgaggacgggtttttggagttagctcaccctcgcgagatcgcgacagcagagtgctttcgccgttggtgttctttccgatctcaatgcatttcaccggtccaaaaattcttatctttagaccattctgagccatttacgaacattacggcaaatatgatcaagacatttatagctcccacataaataagaagttgtgccacagctataaagtaggaattcaataaaatatagaataaggatattattagaatttttttgttagaatccaaaagttctttactaactagaaagaaaaacgaatacctagtgcactaccaacccaaaaatcccaactctgccttacgtaaagttgccagagtacgattaacctctggatcgtaccattcgagccttttttttcatgcttttcccggcggtgacctcctccagaccagagaggagagcaatcaaaaaagaaatattactcaatcaaagatccaactgatccccatgtctgtattgcaaatacgcatggtttcgatgtgcaaaagcaaaccatttctattggaaacattcctataatgatcgtcgagaggaaaacagcccggatcaccagctaaggcccctaaatgaccgcttagtgataaaggaggtgggggaacaattttttctcagttgcaatatagaactaatttttttgttaatttaggataagataggtagaagttgtaagtcttattgcaggaatactgtacttttcataatagaatcccctttttttatttattatacggatatacgttccttttagtttcgactttagggataatatttttcgctatcttcttccgagaaccacctaaggttctgactaaaaaagtgaaataatttaattgaagtaagaagtctccccatctgagagacttcttacttcaattagtccccgtctgctttgcattttaaagaaaaagtacaaaaacatatttattccatttagctattgctattcttttcctgatcgcaggtcatatgtataggacccgccagcgttcatcctgagccaggattgaactccccaaaccaaagaaaaagagaatggaagaattcttcccttcaattcatagttttcgaaatctttttaaaagtggattaattggacgaggataaagagagagtcccattctacatgtcaatactgacaacaatgaaatttctagcaaaaggaaaataggaaatcgatcaaacgatcccaataccgtgaaagagaaactgcacgctctaccactgagctaatagcccgtcgtgcgggcctcccaaagggaggcctgctacgccaaaagcgagaaaaaccccacccctttccttttgacatcctcatgccgccggaaggttaaggaagttggtgaactgatgacagggaagccggtgaccgaagccctggtggggaggtcataagcgcctataccgtaaaatcgattttcgacggaatcaaaaagacatatctggtagaatcataaccatagaatccaaatagcctccgggttttttcagatttggcaagcatccggaataactattcactcatgggatccgggcggtccgggggggcaaaggaaccggacatgagaatttttcatcatccggctcgagcaagaatgaaagaaataaagttttgtaaaagcaacatgaagaattgctcagatgcccgtgagcgaggcttacttgggtcgtgtcggctccgaaaacttgcagttctccccgtcaatcctcgccatgagtggaactccgaccataacataattgacagatccaagatgtgctccggtggcgtatttttttaaaacgaggtcctcgataacgggacatgaagacgatctattacattctaattaattccaattatacaaaaggttcagatagactaagcaaaaaagggcttcatttcgttggaaaatcacatattcatttccttcgtatgaacagaaaaatatgatgacttaaagaagttcactaccacgaaccaatttgttcttaattttgtagcttgtgactagaaatccactgctatatccgattataagtatttcacatcatcctgcaatgcagcagattgaaaaaatatttaacttggaaacgttcgaggtggagtatttgtttacagttaggacaacattacgaagacatgtagcagtgataattaaaaaaacaggattgctatatggcattcgaataaaatttggggatgaaatcttacaaattttggaccattggatccatgccaagattcgtgcatcggcatctctcctccaactccggcgggctccccttcttctccggtaccggtgacaccccaactccggcgggttagggtttggggttggggtgagggtaggaggggggttggggga

SEQ ID NO: 1848 - DNA, 4712 bp, Oryza sativa
cccccatgagaaagtgaaggggaaggggggagggggcttgccggcgccgttgaccttttccggccagccgcgaggcgagcggcggcacggtggggcggtggcggtggtagcggcgacggatcgtgcgtgggacaggaggaggagggtggcggcgtgatctggaaccgaggggaggaggagttagggttaaggggctgcacgaatcttaaagtacatccaatggtccaaaattcgaatgataggagttgggattttctgtcacataatatatagacagcctcttaaaaaaaaggacagaacagaaaataaagtatgattgtggcaaggaatgcaacacaatgcagttgttaacagatctagacatctcaaacaatatgtccttgctaaattgtgagggagaggtaactggaacctgaaaagatgtgaacttgagttacatgctatatagtgagggagtctactacgttgtgaacctcgtctattgctgttccctagattctgtccaagttattctctagtagactttcagcaataaagactgattagtacaagttaagtggttcatcttccctgcttgctccaaatcctcaatggtcaatcttcttccctactgtagcctgcctgttcatctgagaaataaaactgcagaaaagtcacgtaagaaatgaaactgcagaaaaggctatctgtgacttataaacaatacagatgatgaccaagcagtgatggccgtccaacatattgtcaggtaataagagaacaaaataaaaaaatgctactccatggaaatatgcaatccatcctactaactgctggctcattgcttttattttccgtctagtcaaaaactaattgcctgttagccttttgaactgcggttcaaccgccgggttcaaggttcaaccggtaaaccaaggagtcaaccaggtcatccactgatctggtttttcatactatggctgacgatgatgggggacgggtggggccaccttctactcgttgtgggacttcttcggggaggatacgacaacaatgggcattgcgtcccaggacaacatgcggtgcctgctaaagcagtcgaactaaccaacggtcataggaggtagtatttttattactagccccgtttcagtttataagacgttataattttagttaaacttagtcaaatttaaaatatattgactttaacttaaccaaagtcaaaacgtcttataaccttaaacggacggagtacaagttatagaatttaaatttaaattatatgtttgtgaaatgatatattaatttgaatctatcttgtttttttatttttttataactatttagttgatgtcaccagtggaagagatcagaccagccgctttgagctaccattttcagacggcaagaaatcgataatctgacttaaaatcccaaagagaattccaaacaaaggggatcagatattcagatgttcaagtatactagcctagttgcgtatagctaagcagaccagataagcttcgggaatccttgcgtcgggcacacatgcatgcccaatttaaaagaaaaaatagtttaaagtggtttgcacgcatgcgtcacgtcagcgcccgatttttccactcctccatcaggcgcccgatcctgagttgcgtccgataagcttcatctcactgaaaatttcaggtggcgcgtaaaaaggggttgatgaagggatgaagtttctttttctttactatgatatccttgccttgactacgccagcttgttacgatatgcatgtgcctgatggcttcctatcttctttcatatagagatatgaacagattactgaacatcaagcagtacagggcaacaaagctacagccagcaaacactcaagcaataagaataacataaataataaaaccaacacataaggagtaaacaattattaaagtttatttgtgaatctttattcgtagtagacaaaaatctgccagacattcatatataggaaagaaaggacaggtggccaagaccacatcatgctcagatctgcacgagccatggaatgttacctcatcactgcttctcagccatgaccttgaccagctcttcagcatcatcaatcgccttcgaacacctgtgtgctaacagggaggacttcccaacctggtaggccactcctgatgccttcacctgttcttctatcttgccaaaggaggccacctcttggtgtgcatacaccacactgggtacagttcataatctaagtgaccttttcctgcgatgaattcaacacaggcaatggatcttcttcagctttatgtgcaagcatgggtccgggtatagcatccccagttgtgtggacacgcttaacatttgtcatcaacaacgtccagaatactctgctctccaccagctgcaggctccacagttaacttgacacaactaccagaggcgtcaaccccaactaccattgtcttaagcatgaatttcattttctgcttctccagcatatgcttgaatggcttcctaatttgtccatccattgatgggacaatgtcagaggcaaattcgacaacactaacctcagacctggcccgttccagaaagaaccgtctctaaacctatgtatccagctccaacaatcaccaatttctttggtatttctgaaagaaaagagcaccagtaggcagtaggtgacaatctttttctcatctattgtaacttcagggagagattttacatctgaacaagtggcaatcattatattcttccctttgaagattgtgctacgttaccgtgcaagtccacaggtacttctgaagggtacaggaacttccaaaaacctctggcatactcaaccttgttcttttttagcaggcacattgtccttttgtgccatcatggcagccaaatctatttgataatttaatcccatggtgtgcaaaataagactttgcctcactatgaatgcagtaaagcctgaaatcatgaagaagaatcccaagtcaggtgcaatgcaatagcaagccaaacaatgcatttacaattagcaggtctcgaaatatacccatcttccaacagagaaatcaagtaataatttggtaactcagctgggtttccatcagcattttagcaagaacctcgtgatgtatttatctggctttaccaaggtttacagggaaattttgttacacctgggtaaaaatactataaatacaagaacaataccgaataaggtgacctcaaatctttatatgtttcaatcagcaggttgccagaaaaactaaacaattaaaatgaccttcaaaatggtaaccatggcacaatctaatggatgtgcacagtattatctacacttgaacactatttaaagaaaacacttaacataaagatactatttgagaaaagatcacacatcatttagaagaaagagcaagaaagtgtcaactctaaatgagagaaactgaaaccatgtaactattgtgtaattttgtgatgtgccttcttttcaaggataatacaattgatgttttttattccaatccatcccccacttagtgcaattaaggtattttcctgccttcacgctttgccacgtcaccccttcatttccatccattggattactttgattgacggcatcggattgcatgcccgagcatctatttcattcattactgtctcatacccagcaaattaaacccagcccaactttcctacttggcccagcccatctcactggctatcgtttcacttgcactatcagcgcaaaaggtgtcccccctgacctgaaacgatttgctgcgcccgcgctatcaaattctgtaacagctaggagttgaagcgacagcaatataatataggccatggccattcatttccctcaatatatatgccttttccttttcctatcaaatatgaggccatgaccaccaacgtgctctcaggcactcccagaccaatcaatcttcatcacagggagaaagaagagacaagatgatgagcttccacagctcaactagcctctcaggatacgccaccacaggttcaaatcaatatgttttagtcttattagttcaatcaggtttcttcatatatactggcccttccagttatgtgtatatcctatggtgctttcattgtcagatcctttttcttcttctcaagcaattgaagaatgcaggaaacaagatcatctgttggttcactcataggcgaagcataatggctatatgaggtggtaaaactcttaaatttgatggaaatttttagtttgtcaaacttctttgatatctgaattttaatagcgatctttatatgaatatgaattatcatctttatcagcttttttttctatctgtatttgaatgaccattttatctggtgaaagtgtctatcttacctttactgaacacctaaacactttatattcatgtgccactgatagagatgtattccatcatgcccatatttcagcttggtaatctttgaattttgaaagtagcctgctttgcctcctgagagagatgaagactgaacaagtaactgaaatattgcattcatgaggcacagatgtggggtaaatccttttttttccttttcagttccgatgacttacttgaacaggaccttctgctaacattcttataaagtagttagtgtttaagttatgaatcccctgctatgattggttttgctaactctgttattcgacttggggagcaatgtactccctc

SEQ ID NO: 1849 - DNA, 1025 bp, Oryza sativa
cgcccattaggattacccggtttaacgtgccacggcaacgaaagtcatatcggttttaatatagttagagcgattgatcgatatatacttcccgtttaggttgatggttacgaaatacgaaattcggctaatagttgagggggttacattggactttgtttcattccagcctaacaagaactgtagaatgaaaaccttggcccaacccaaacacaaatagtcttgcgcaagactgtgattattattagtttgttatctatctatctatctatctatctatctatctatctatctatctatctatctatctatctatctatctatctatctatctatctattattattattattattattattattattattattattattattattattattattattattattattattattattattattattattattattattattattatatactaaaagtccatgaaacttactacaaacgctctcaagccgccacatgatgctcctaaaaacactcgtaagtcgtaaaaacactcctaagtcgccacatggtactttaaaaatcatagaaaatctaagaaaaaaacaaaatatctagccattgattttcatttaatctggtgggaccattatttttaaccattagatctatcttctaaattaacaatctaatttatattatatctccaaagatctacatcgttccatatttgtacgtgagtacgtgcatttgtatcccgaaacccacacccgaccaaaaaaaattgtacgtgtacttctctttcctttttttttatttctcacttagtcgaaaaaccaatctaataatcagcacatcttaactataatttaagttgtaaaaataaaaatatatgttatttcaagttatgttcaaataaaaaatatatctcatgaaaacatccatgaaaaatataaataaattaaaattataaatatattacttaacaacatgtataattattatatactacaagtccattaatcttcctacaaacgctctcaagccat

SEQ ID NO: 1850 - DNA, 1099 bp, Oryza sativa
acgataaacagggggaactagatttatagaagtaattagtaacaggaaattgctaggatagttaaaaatatttgcatagattaaaaaggtagtccaaaggtttttccgtgcaattttaatgcaaaatgatggatagaaatcggtattctaggatacagttattttaggacatatagtttccacttttctgttattcacatgcggaaatatctatggtattattcatcatctttccccaaatttcccctgtatttctttagtcttctctgtgctccatttatctctaatcggttgattcgatgtgtgtcctcttccagaaggtacagcgtcgtcctctcaggaagatgtagcagcttgtggctgccgatggcagcaggctactgccagcagagtgaaagaccggatgctcctcctgagaggcgaccttgaagaagtcgcagcgtacctcgccgatctgtcggagctggagaacccccccttgacagcgaaacactggatgagagagtttcccaagcgatatccggcgcagcgctgggtggaggaggataaggctgacgacctcgactggggcctctttggcgacgccaatgaccgctgcggcgagctctgcgttttggtggtatcacataatatgtttacatatttataatacgttgttttttgaaataaataattcattattggttaatgaatatgtgtttcattcatgaaactctttatgttgtatgttgttatttctaaaggatccctgatgaaatatcatatgtggagcaaatatggtttagtgatcaacatatgtattgattgatgatcattgtcagggttacggataaggcataccctctattctaggagtcatgagatatatggttggacactgtatatcttcaagtatacgggaccttttggataagaaaattaatgtgttcttaaggaaataatctttgtgaatagaaggtgttagagttgaattcggaggagataacgataccgtacggggtccgttgtctccgagttctacttggagactaaggggatctgcggtatacagagatcccttcagggggtatagggcatcaaatcttagtgcataacaccg

SEQ ID NO: 1851 - DNA, 423 bp, Oryza sativa
acaggcccttggggttgcgcagcagcaccggacgcgccgggatcggggtcggcacgaaggccggctcggccgcccggggcgccggcacgaaggggaccggcgcgaagggggcgacgggcacgaacggcatcgccggcggctgggcgagggagagggcaggggagggggccgaagacggcaccgaggagggggcagaggagggaaccggaaccggagcggcggcctcggcggccatcggggcggcgacgggcagaaccgccggacggccggcgcggatcgccgcgcgggcggccatggcgtggagcggggccgggcgggcgggcgccgcgcccggaagcgcgttgtcctggccctcgaccggacgcggcgggccgaagggctcgaagcgcacgaggtgctccaggcgataggcggcgcgggccg

SEQ ID NO: 1852 - DNA, 238 bp, Oryza sativa
tgcgaactgtgaattggtacatttgtgcaatatggatcttcaatttgcagggaggcagagggcggcgccaaccaccctggcgccgcggttgggaagggtggcgccagccagtgccgcgaggcagaagggtttcgggctgggggatggcggcgccagctaccctggcgccgtggtccatgagggcggcgccagccgaggcccggaggcagaagagcttcgatggggggaggaggggggc

SEQ ID NO: 1853 - DNA, 438 bp, Oryza sativa
agcgactccggcaagaagggcggcaaccctttggaagccatgggcgccttcttctcgtcgcaggtgaaccgccggaagctggtcaccagcgagaagcaggcgctggccacgcggctgtccgccggcggcgaggcgttccccggcagcgagcaccggccggccgaccggaagacgtggatggcggagctcgggccggagcggctgcgcgtgcaccagctggtgtggccggggacgcacgactcggcgacgaacaagatcggcatcccgttcgtgacgcgccccttcgcgcagtgccagtcgctgtcggtgtacgagcagctcgccgcgggcgcccgcgtcatcgacgtgcgcgtccaggaggagcggcgcgtctgccacggcgtgctcgcaacctactccgtcgacgtcgtgctcgacgacgtgaggaggttcctcggc

SEQ ID NO: 1854 - DNA, 327 bp, Oryza sativa
ttgaaaggaaaaatcgtgttttggttgagatggctagaacaatgttggatgaatacaaaactcctagaaaattttgggctgaggctattaacattgcttgttatatttcaaatcgagttttcttgcgatctaaacttggaaaaacttcttatgaacttcgatttggtcatcaacccaaagtttcacatttgcgtgttttcggttgcaagtgctttgtcttgaaatctggaaatttggataagtttgaaggacgccctaccgatggattgtttcttggttaccccgcacacactcctggctatcgggtacttattttaaggactaaca

SEQ ID NO: 1855 - DNA, 5241 bp, Oryza sativa
  unsure (1)..(5241): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggactctaccaacaggacgaagattgctgagctcctgaggtaccactccaccaagagtggtgatgagttgaccagcctcaaggactatgtagcccggatgaaagagggccagcgtgatatctattaaatcactggtgagagcaagaaggctgttgagaactcccccttccttgagaagctgaaggactatgaggtcctgtacatggttgatgccattgatgagtacgctgtcggtcagttcatggagtttgagggcaagaagctcatctctgccaccaaaggactgaagcttgatgagaagtttgacaatttgagcatagtgatgaaggaggtgctcgttgacacagtggagagggatgttttttctgaccgtgtggtggactcttcctgctgtccagtcactggcgagtacagctgggttgctaacatggagaggatcatgaaggagaatgccatcatggacgagctacctaacaaatcccaagtgaacaaatgtgccccaaagcaaaaggttgatatccttcctgtgaaggagaatgctatcaggctccaaagcagtgaagagagagaagttaatactaaattttctgttaccggtgagaggattttttttaataaaaaaattacaatatgaagcatgcatcgtctgatcattcgtgttttgctgacataataacctacaggaatctgtggagatggaagatgcctattccgatctatagtacatggtgcttatattaaactaatgatgattccacctgatgataatcttgagaaagatatggctgatgacttaagaaaaaaggtatgcttgtaatgttcagatttacttgcaatgtgaatctatactgtttcttaaatactggaagcaacacagccatttctctgtcaatttatcatttaaaagatctgtttaaatggtgccattgttaggtttgtgatgcgttggagaaggaatgtgctgacaaaccctggttagttctacctgtccttggtttctctgcttctaaatattgaaatattgttgagttatgcattcttatgcttctttatgagacatcaatttgcaggcttgttgaggtgactgccattcctatatcaaagagatgaggaaacctcatgtgtggggaggtgagatagaaatctctatggcgtcacatgttttaaagtgagtactaaccatgatttttgatactttttaaattatccatatttcagatgcagtacatattagttcagtatcctatcctattggaatgcttatgcatgtacattgggcttgatggattcacttttactatgctaggatgcccatcaccgtgttcgtggtggaaaaaactggaggtttgagggtattcaccaaatacggaaaggagtatggacggaatgcaatacaggttctttttgatggtaatggacattatgatgttctgagtttgcggtagtccaggactgcaggacagacatttgttcccccttttttttttcttccccaaatacacttgctgtaaaaatgtaaccggagtttaccaacaattaaaaatgttgttctttccaagcgccaaccttattcgattctcctgtagcattacatatcatgattttgcatgtattatgtatgtttctgtcattacatctgcaaggctgcatgaaagcagcttcaggttgcttaccctgcaaaacttctctgccgcgtgagtcggctagtgcctggtggacacaagtcgacaccgtctctggacaaggctgtggagagagctcacctctttgccggccgccggcctacccacctgagccgccggttgtgctgagtttggttggtgggcagctggttctacgacttccatctggggtggtgtaagagttgtagaaggatacaaaacttccagcttcacccattttttatgtactcattcagttatgttctagtgttcgaccttctgtatctcttaccaagaccgagaccggagccttttttttacttgatattttgaggtataactattaatgacagaagtgcactagagtcttcttaaacataggtccttgaattactgtttatagttgcgaatgtgctgatactttggttcaatttagcttctgggtacatggtggtcgtgattttacaatgggaagttggcgcgtgaactgatgatggtgtcttttgattatgttcgtgtttgcaatgtgatattccagtcctggtaaaatgagccttggtcttcaggccccattttgaaatacaacaattttgtagtaggaatcatatcatatcatatcatatcatatcatattaaatccttagtttttacaacccactactagcagtgatttgatcaacctcagcccaggaaaagatgctacagtactacagtcatcacccagcatgcaccgtccgatgtccacgcgttgatttgatccaaccgtccacgcctcacatgcacatcgctgcgcccggcatagcttccccaatcccctcgatcctcgacatcctctgcgcctcccttcccaaaatactcaaatcttcatcttccccttgcgagtcgcgaagcccgccgccgccaccttcttgcggagctagcggccggggtcgtcgccttcttgcgagccacctgcaagcgccgccaccgttccgcctgattcgcttgctcgaccggccaatttctcaaggtggacgaagggtgcacgcccgctgccatagttgccttcgtccacctcttcgcacggtgttgacaacatgtgcagtctggtaagccaagccctagcctgatctgcttcttatcttcagcaaccttgcttttatcctttgcagcgatcaatttggatgacttattttgtgatgaatctatctgtagttagggtatgggtatggagtagagcagagcaagccaagccctaactcaatctgcttctccatcttcagcatccttgcttctatcctttgcagcgtcaatttggatgacctatcttgtgagtcagttagggtttgggtacaagctatggagtggagcaagtgttcttctagccattgtgctgccgtcaccttccttgggatagtgaggtatgatctccccattattttctatctggattaggccctaatcttgattcaggtttgggctaggcccatccagccagaagtcatacgatttttcaataaaaagaagtcctccgattgttgccgtttggccacttctcactgccaaaacaatattaatgtctggcatcaatatctaatgaatattttatttattttccttgcatatcttcattttaatccaggacagtggttcgtcagctccctgatccccttttatcattatgttgtccaattaatttatttcaccatcctttactctacaattgataatttacatggccattgttctatgcccaagaaatgcatggatgatttcaatgtaaagttgatgaagagtactgtcctatctctaccaaagtttgtcaaatccacttgcttcctgttgtagtgtagtattgcttaaaagctatttttcatatcatcctgccatacacttaaatgcatattctattttccttgcctcaggtatttaactttattttgttttggtacatgtgatcccaatactatatgatgagtagctcagttactactaaaacagatatatgcaacacagtttccctctccttttgtttaaatacctagctacatatttatgtgccatcatcctatctcaaatatatctatacgatttttcaatcatccacaacaacacatgggcatatttcgtttcatttatctttttttattttctaatagtgtacttgcttctttgagtggcttcgtttgctaattcctatgtttttcatatttcaggttcaaggcttccagctacttggcaattgctctttagggtttctctacctgttattgcctggtattatttcagttttttgggtagttccttgggaagtcttatttgttgtccaattgttatatccctatgcatgatcattatttaattagttgttttgataaacgaccttccctactctattttttatcatataaaccagtattcggctaaactgtagcatatatttttgcatgggtcaatatttatatttggcagcatctcactgaccactttcatccattttcgttttcaggcatgggcgcatggcagagaccacaatatgaggcaaacattggaccttagctaacacgataactgaatattgtgatggcattttagtggtttgttgcgtattttatatagctcatgggtttatggcttcctacaggctttcactgatgcttttgtgaccgccagtccgggtaatttcaactttctcatgctattatatactgatgctatattacttagcatgctttagtgtcacaccccgaagttctttcccaagcctaaattgaagttataaatggtctcaagaaaatacctgtgtcaagcaagagtaaaccttaataaattaatgcaaataataatcggaattggcatgtggaatttttcttgagttttacatgccgaaatacgctaacaagatttttagtggaattttcagagctctcgaaataattttaaccaattaaaattgagcacatgcaattttaatcccaggaaaaatcctttttccttctttttcctttttctttcttttcttttctctctttcctttgaatgggccgtcggcccattcctcctttttctccccctcctcccgctgggccggccgaaggctgaggcccagctaagccgcgcgggccggccgcccgcctccctctctccccgggacgccgacaggtgggccccacctgtcggggtcgtcccctttctccggccgcctgaccccacgtcgccaccaccgccgaaaccgccgccgcgcccacgtcccgccccctccgggccacgttggccgccccggtcgtgcgccgcgtctaccgcacccgcttccccctctctcccgctcgcgcccgcgtctga

SEQ ID NO: 1856 - DNA, 16942 bp, Oryza sativa
atccaccccgtccgcccttcctccgtcgagattcgtcgccggaacccgcatcccctcgcgctccggtgagctcatccccttcggccatggatgccggtcgccgtggttcgtctccctccctctaacctctcttttcctcccttagggcattccggacctcgtccgcccgtcgtcgccgtttgcccgtggtcgccgtcgccgttcgccgtcgccgttcgccgtcgtcttcctccgcgccggccacccttggtgaggcgtcctctcccctctattcccctccctctccttcctagccgccgcttagcgccgccgccttcgcgtcgcctttgcgccgccgcctccgccgccggttgccgtcgccagcaacgcgtgcgcgcgcgcgggccgtcgccatcgccgtggccggttggccggccttgagccgaactgagccgggtcgccgccgcccgtccgatcggccccgggcgtggaccaccctcgtggtctcggtccacggtggaccggcagccttgggccgctgacccggggaccccacttgccggcgcccctctcttcccttgagccgctgacatgcgggccccgccgcccccttgatgacgtcagccctgggaattaactgcgcaataaattatttaaggactttttgttatagtaataaacacagtgaatcttctaaaattcataactaattcatccgtgctccgtttaagcccattcaagtctcagtaaatcaaggaaaatgtgtagaatccattaaaaatggttttgttctctgtttcagtagtcttatagcctgtttgcattgtttgctttgtatgtcgcttagattccggttcttccgacgctccggtgtacttcgaaatagtcgccgaggttccttcagcagcagagcaaggcaagtcatgcctgttacttgaacatgttgatcctatattgcaaatgctctattgtttttcttcaaatactgcattgttttataatgttagtatgggatgtttacctattgttacagccatgctattttgataccatgctcctttgttagcttgggttataacatgaatagactttggactaggaattgcttagccatgcttagttcaactaatacacaatggggaaaatcctattaatgtttagactgtaggttctaatggtaatgttggagtagtgacaccgcttcggtgttggttaattaaaataaatcacatggtgggctgtgggtgcatggttttgttggtcgcacccatggcagttaaggaccggttcgcgggatgccctggaagaacttatcgtacttaccacaagccagcgtgggcaacggctgggcttgtagtgtagcttttctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctaatgaaattggatagtttaggtggatggttgggcttgttgcaacgtgggatagcgttggacagcagatgattaatattgattaattattgcgactgtttttttctttaaacttctgtttataaatgctcgctttatgcaaatgaaccactctagctctcctatgataattccctgcatcatacccctattccggtatgacttgctgagtacagtgggtagtactcagtcttgctccattttccccaaccccagagtacgagtatgtgtcagatggtggtttctccgaggagtaggcttcgtccgtgccgtcgaggatgcctgtggagtggtgttcccgctgcagatcaagtcaaggcttagctcctgttatctttcgtttttccgctgcatttatgtaagacttttatgatgtttgtaagacgtggatctgaatgtcaacattgtcgtttgtgtaccccggctggtcctggacggggattttaatacacattctgcttggaattctattcgggaatttctgggcgtgacatttaggaaattagaaactgttttattctgttgaaattatgctttgttgtttgtacagtgtgggatatgcatgctcttcatcaaggttaaaatgtggatgtattttccttttcttattggtggctaaaatagatcgatgctaattaatgacaagctggcgagaatactgaactctcatatctccagaattggctataaaatcactggttctgggtcatggagcagtaaaccttaatttctatttgttattgctaatggccaatttgtatagattgtaaaacatatacaatatgagttgccactgccatatatatgatgtgatgtccgttgtccttccaaattaatcatcgcccaaggattcgtttttcctaggatctgctggtatcgaattaagaatgttgtctactatgtaccgagatccatgtttgttagtgtaagattgctcttaaaaaaacttttggtttgattacatcacttcaaaactgagaacattgttagattatatgccctttttgatattgcgctattactgtggaacagtgttgcatgttatcttgtgatatgcccaattctgatcttgagttattataggttgcctcatatgcccgcgcaatgcgcaggggacacaactgtgatgtgctgtggacatagttttgtttgactatccttccaaattaatcatcgcccactgattggtcttcctgggaactgctactctgctaggtattgaaatactaatgttgtttattttacttttgttgatgtaattgtattatgcaccgagatacccgttgttcgtgtaacattgattatataaaaaatattatggtccaattaaatcactcaaaattgagaacatcgtgatattctctttctgatcgagttattattattattattgttgtgtagctctgttatgtgctatgttgttttcaatcatgcttattttttactattatgatttttttttatgattaagattatcttggatgatgtcggcgcatcgcgcggggggcacggctagttatattgtttaccgggcaaagctacggagagattcttgtggtacgaatttctgtttgcagagaagtgtcataaagatcgcctagtcgtgttacattgaatcgtcaaagccgccccgtgctagtccactcaacatattgtacgcactggtttactgactggttatgtgcatactctacattatctggttgaatttagggaggttatcagttgcctcatgcctagtagcttgcatctcgcatcagtttggtgtgcaaatccttttgtttgttgccatttcattttgaaaagctgactgggattaaggttcatcaaacacgcttgcatgatttggtccccatcagcaggaacgctctgtagcggtattctacagacaacttaacaaaagaggagttatctatcctacgatcctctcaactgagtgttgttatcaaaatctcagctgagtgttgttctatatatcaaaagtcccaaactttaagatatcagccttaacacccatcaacccttatcagaagtgtgagtactttttcataagaaaatcttgccatactactctatttacataacctaaataaccgttttctccttgttctataattccagattctgaatgtcgaggccgccgcactactttggtttatccacagtcctacatccatgcgtaccaccaatccaccatacgtccccttccccttacatctagacatctagtgatgccaatcggtgttttacctcttgcattttcgtactaattaacgaggcttccatggctaaatattattgggtcaaacaggccaagaccagtgcatcctcgaatgcatgttggactcaagacgagcaatcatggaggaagtctaatggcgatacgtaagagaggtaaaaaagaggtaagggtttgttaggttcaaagctaaattttggcctaacaaaattttggtagtactaaaaccttgcaattgttggcgctaccaagtaaaagcaacaagttttcctacacaagaatacggcacatcatcaaaaacgtattgaccgtcggataaaaagtttgaataaacaatggccattagataaaaaagtatatgcatttaaagaaaaacacaaatgagctaaatatatgaaaatttctggaggtttatagtgccacctcttaaactcatgaacaaagaaagagaggggcaattacgatgaaaaaacaggagccttctagtgattcatcatgcctagattcattttcctaagtggtatcaaattctcacatactatgttgtttttctttacggagggagtgtactctagtataatttagctaaatctataattggttagacaatttatacttactagataaatgaacttacgtcaaaaccttcttaaaagctaactaaactaataaattatatatagaagttttttcgtgggatcaaaagtcgagcaaagtgtgactatgtgactagttttaattattataggcaaaaactagtagcatactaaacatttattgatataaaaattagcttcaatccaaacaagctcgtatatagtttcttttttcttttacatgaaaagacatcatcatcaatacaatagtaagctagaccagtacagattaaataggtggaagcagaaagtgctcgaggacagttcgcgttcgcaccatgagcatcttggccctccgtcgacggcgctcataagccacggttactataggagtgatcactacgcagggcacggccccaaccacggcgaacggtccactcatgtagtcgttttcgaggaagaaaaggccagccacgcataagaccagcacgccgacgacgaaccagaacgccacacaagcgacggacagctgggtcgacccgtcgagctgcaggttccaatggatctcggcgatggacgccgcgatcctgtcgacgtcgcgctcgcccagccgcggcgacgccagcagcctcggccgccactccggcggcattgctcccgccgcgaacgcagcgtcgatctcatccttgatgctgctgctcatggtgatcgatgccgctgaactgaattgcagagatgatgaatggatgatgatatctggtgactgcttgtatcgatcagttgtcttctttccttcccttccaggcaaattaaaaactaagtgctgccatatccaattcggaatagttacaactaaaaagaaacgaagtacagttctacgtaccttgaatccgagtccatctctctcttgacggttcgtcgtcggtcgtttgactgacatggatgcatttcgtcggagagtaccacccactggagacaatctttcattcaaagaagtacgtagccgccgtcaactgcatatgctgtggattcactggaatcaggaggtgttgggtgagagtaagcaagcaggagccttactgagctcactgggactatcggcctccggccatggcaagatcgacaaagtccgtccgatgtgcaagcgacggtcgacggagatcgtgagttgaacgacgtcccactgacgtagaatcatctatgtcctttggagtgactattctttttagttctctttgtttacactttaatttactgggagcacactgcacattacgaaatcgttcatacattcatccttgctgatttctgctattacatttagggtcactagtgtagatatgtaatttgatagtgaactttatcagcttcaccatttttatatactctgaataagaattcctttcggcgtctcgacggagctctttttacttgatattttgaggtataactattaatgacaaaaatgcactagagtcttcttaaacatagaccaggtcgttgatgtgactgtttatagttgcgaatgtgctgatactttgtttcaatttagtttctgagtatatggtggtcgtgattttacaatggaaagttggcggtgaactgatgatgctgtcttttgattatgtttgcggttgcgatgtgatattccagtcatgataaaatgtgcctatatcttcaggcctcattatgaaatactccctccattcctaaatatacttttatgtgtatatatatatatatagttttacatatttcacaaaagtttttgaataaaacgaatggtcaaatatgtttaaaaaaatctacggtgtcaaacatttagggaagaagtgagtacaacaattttgcaggaattacattatttatttttgttgcagggaagtgtcatgaagatcggctagtcgtgttctcgtaacattgggcatttgggggtcgtcaaatgccaggtgctagtccatttaacatactgttcgcgctggtttactgactggttatgcgcataatctacattatctggttgaattgtagggaggttagcggttgtctcatgccatgtagcttgcatctcacatcagtctcgtgtgcaaatgtttgggtttgttgaccaaccagaataaagcccggcccagggaactagcgaaaggaaaagttgacgatgactccctgcttgcgttgtcagttggtttggaaaagctgactgagattaaaattcatcaaacacgcttgcattgtttggtccccattgttttttcgaacggccaccctcttacttgaacaggtttggtccccattgttaaactttgccttctttgctgcagcaagaatgctctgttgaggtaacgaggatctattttagaagcttgtggagttacactactgttataaacaacttttataatatctgatccccaaataatctaaattctcatctaatttatgagaataaatagcggtttcttagaatctcttgctaaagcagaaatcacaaccttcttcatctcatctcacagtaagttcatttttagcttcttctatttgtcctaaaataaatccatttttaagtaatcattatatcaaaatttataaaagtactagtataaaataattacattgagaattgataaagtgaaaaacaattacattaagatttatgaaataggggtatttcggtaatactaatcgtttaactcgacacgtccatctcctgcagaacaacatgaatacgtcgaccatatcaccactgcaaacaccgtatcgagatcacctacgacaacgaagcgagacgcgacagggagagcctacccgcacgtttcttcagccatccaaaccgtagctgaaaaaaccagacgcggtaggcgacccggaccagtcagcccagtcggacggaccccctctcgccttgccgcgacgcgaccgagccgacccgaaccgaaaccgaaaaaaaaaaagggcaaacccaacccaacataaaatcgcccacctccacctctcgcattccccttccttccttctcttcctcctcctcctccacccccaaatcgcctcgacgagcggcgcggcggcgagggcaggagagaggcggcggcggcggcggcggcgggggcgagatgagcgactcgttctgcccggactgcaagaagcacacggaggtggcgttcgaccactcggcgggggacacagtgtgcacggagtgcggcctcgtcctggaggcgcactccgtcgacgagacctccgagtggcggacgttcgccaacgagtccagcgacaacgaccccgtccgtgtcggcggcccgaccaacccgctcctcaccgacggcggcctctccaccgtcatcgccaagcccaacggcgcccagggggagttcctctcctcctccctcggcaggtggcagaaccgcggctccaaccccgaccgctccctcatcctcgccttccgcaccatcgccaacatggccgacaggtccctcctctttctccaatcttctccccttccgccaccatcacggcttagttttttacgggctcgattcgatcgagacatgaggatgtgcctgcggcttgcccttgatttatctcgtatgttgaaatgaatcacttgatcgtgcggagcccctgccctgatttgggtttgcgggggagcggatttaggagttgaggagtgtgatggggcttttggagtaatggggatctttcttttgcagctatgcctgccatgtttgtaggtttggaacgtgtgattctcgtgtgaagttctagagcggttcatatatccagtagatttactgatgcatctctggttacgcttgggatctatgtgtggggaaggactcttcgttgatagatttctgaatttgggataatgcgataaatatcatcagattgtaaaaagtgtaaaaggaatttcggggcgtataattaactttgtgcaccaccaaatgctcatctcatgtagttgtattagtattatgtaccttgggagcaatgataaatctactacaaaaggtgtgtagcaccagttgcttgaggcatgtgaggtagccatttagcttcctagcaagctagaactagtgaaatgttactttttggcatgaggcatgtgcaattgcaatagcctcttctactagtggatctataggaagggaaacttcgatgaagaaaaacgatgttaggtttatttggtttgattgaaggagatgcagaaacacgatgatttactgctatggcagtttagatatttttcttatcacaggatttctgcaatactctgacatgatatctctaatctcatctccaggttaggtcttgtggctacaatcaaggtaaacattctgactgttactttccatgatatattgggtgaactacccctattttttcaaagttgcgcttgcttggcagtgtacatacttgatagtataatgcctgcatgcacacaacagacttgaaagtttatataaaattcatcaggctgcttccatgctgcacgattccatgttatgtggcatgacttgtttactctatagtcagcttttggaaatattaaccgctgcttctttggacatatttcatttgctacgaacagtaacacgatgctggttgcttgtagctgtataatgactgtgttgtcttttctttctgaaggaccgagccaatgaaatatataagaaggtggaagatctcaagtctatcaggggaagaaatcaagatgccatattagctgcctgtttgtatattgcttgtagacaagaggatcggcctagaactgtaaaaggtacagtttgttctttgctgaatgcatttatctgaatgcgttctgaatgcatttatctgatgcgttcttgtttgatgtgatggcttattgcagaaatatgttcggtcgctaatggagcaacaaagaaagagataggccgagcaaaggaatttatcgtgaagcaactggaagttgaaatgggtcaatctatggagatgggaaccatccatgctggagatttcctggtctgtagtttgccatgtattctaatgagtccttgtctgaattgattgagtgaactcttgaataaactgataaaacctgcagaggcgtttctgttcaactcttgggatgaacaatcaagctgttaaagcagcccaggaagcagttcagcgttcagaggaacttgatataaggtttgacattttggattcattatgaaccattctgatgatcaatagatcctttgtcatggaagttattttatccgttttagcttcagtgtttatcacctctaaatcactgatgcttagatcaatgcattgactagaggaactaatcagataaacgagttgcaaatacagctatcagcaaatctatattcttaaagcaagtagcatacatatcctgtacagtccatacatacaacctcattatccccatttatgtattgggaaggggcagggctgcaggagagctagtttttgactattagacacaaactttccttattagtcaaattccaagtgtgcatcatgacttattatattcacacctccgtgcaaacctatgctgtgcaggaggagtcctatttccattgcggctgctgtcatttacatgataacccaactctcagatgataagaagcctctgaaaggtttggaacacagacccgttctatgtttaacttgcaactgtttaactcgttaataacaccgtgaaaatgttgcagacatatccttggctactggtgtggcagaaggtaccatcagaaattcatacaaggatctgtatccctatgcttcaaggctcatcccaaacacctatgccaaggaggaagacctgaagaatctgtgcacaccataggaaatttttttcttttcttttttgtcacataacatggaaattagatttgccagagaggagtaatgttgtccttggatgtgagttttactggcccatgtatcactgcacctaattttatgtgcatggacctgttagaacaaagttatctcgaatcgaagctaagttatatgcaaagcttatttaggaatggcaaaatttcatgcattaccttgtgagcaactttttaaattgttgattgataacgaccaaaacctacggaggagcgataagtttcacaaactaaaatgatctgcacgccacatatataaaattttgcaagtggtatcatgttcatgaattgccaggtagtggtgtattcgtatatatttttttatcggaactgcagatcttgtagggaaaaacaaaagggaagtgaatcttgaaagagctttgcagttcatgccatactgccaaggctcgttgcatactgccgaggatcgtgccgcatgatcgatgcatacaagggaaaaaaggagatcccttccctctgcgttggcacttggtagctcctgtgctgaagcagcggagcctttttcttgtcttgtcagccaccaattctccaaatgcagaaatgctgcgaggtgcggaggacgcgctcgttgtgccagccgcccagcggcgcgcgcgcgcggcgatcgaccagctgcgacgcacagagtgcagtggcgcaccacggccgccgtcgagcgcgggcggtgggatttggcaatgccgcccatggcgcgggcgtccacccgtttgacgccgacgcggtcgccgtatctttccttccctcccaacttgctgacttgcaccttgtttagattttgatacatggtgtcgagttgtcgaccggagagggtggagtattgacaaatgttgatgtacagtgatggttcgtttgaaaatatcattcgagactcaaatgaatgaataaaatattgaatggttgataagttctttttagataaaaaaagctttctaagaaataccgataatttttttaccgtgataatatatataatctgtagaaaaagaagggccctaagagcggtcaacagttaacacctctaaaaaaacagttgatacacaccaaacacgcaattgcccccaattcaaacgggtgtcttgtgcctacgcttagaaatcaatcatctaaaacttagctgactggatctggtttttccaccataagtagtttagttactgggttgtttttattgtgtaaatattgaaaactggtattttgttgtgtgaacactgttcaggctttcttgcagggccagtaaggtgtggaggatcaacgatcctacggcaacatcgattattatgctcaacaccacaacattccttgccttccacagatgtcgggtaacaccacatatagcagcaatttttcacgtgttattggtcactcactcactaacaaataataggctctcgtaacgccagccaggtctatgagaaaaaacaacacagtggcatcttgcattattccctcgtgtgccaaaacaagcacggtgattgaacacgaagtatctctatcaagcaatatggtgtggtagccgtctcgctgcctctgggtcatttatttctacagaagggttacatcaggctgcaactttcttggaagtcaccgagttgataatagtggcaaaatccggaccctgcaaaacggaatgttgcgtaatgaaatacaatacacaattacacaatagcgggttcattggtttaagaacacggcaatcaacaggctgtatttcaggatatgatgttaatttatcataccttcaaagaggcaccaccaacaaggaagccgtcaatatcttctttctttgctagctcggcacaattggctgcatttacagaacctgtaccagaacgaatcataaaatcagtgaggcatattgccacatcctagctggcatcaaattaataatggtgcaaatattctctgaagtcacaagccttagcaggtactgataccactagatcgggcttctagatatttaccacaaacaacatatttcaaggaataaccaggctttcaattgcttatataagagaaaaatagaaaaatccattttgttagatgctgttgttaaggacattcataacagagtgtttcataatatatcaatgttcctaaattctgccttccaataatcaatttcatggggtgaagagaggagaaacacagtgaaactcatccaagtgataagaaaccgacctccatatataattcgaatgccggaagcaacctcaggtgacacgttggttttcaaccaatcacgaacagcagcatgaacttcctgagcttgctcaggagtagcaactttcccggttccaatagcccaaacaggctcatatgcaattactacatccgcccagtttgtaatactgtctgaaagcaacatgttgatacatgaatcttgtcttcagatgatgtaggctcatcaaccattattaatttaactcaagatgaagaattgtcacctgcaaaagccttcatctgcttaaaacagacgtcaaaagttttccctgcttctctctcttccaacagctcccctatgcaggcaataacctttacattttgactcaaggcatatgcagccttcttcccaataaactgcatttataaacatggtatgtcacaatcccaatcagaactactgcatgtcaacagcaatcatgcatctcaaaggtgccttcagaatgttacaggctaacagcatggacaagtggacaagtgagagaactaccaatccagtagcatctgtgtatatagcgcttacctgatcatcttcaccaatgacatgtctacgctctgaatgcccaagaataacccattggcagccaatgtccaccaattgctccgcactatagacattttaggtgaaacatataaaaactccagtgtgaaaacaagaaacaaaaaattatctttttgcgcttgcttaaaattcaaagctaccataatcccgtaaaaaacatcgaacagaccgccaccatttatcatcaatttacacatggttctgacgccatgtaatgcattatactaaagaaaagaaaattgcaacatgtttttagctttacctgatctctccagtgtatgctcctccttttccaatccaaacattctgagcagatacctcaatacgatcagttagtgagttcttaacctgatcaatataaatgaatggtggtgcaaccacaacatctgcagtattgccacagcaagttaattgaaggtagaaaaagatagacagtggaagctaaaaagaattccggaggatggatttggatgaaaaagaaggcatgaaagaaccaatcaaatacacacatctaacacagtgtgtatagagaggaagagaatcatgcatagatgaataaaacgtgcttaccaacatcaggttcaagtgtagcagcattcaattcagtcacaagcttgctgacagagtccttcgttccattctaaattgagggacaagaaattatatcatcagaaccaatcatactgatagtaacatatctgaccaaaaagtcgggaaacatgtcttgatatagttagcataagctctcgataaaaagtgaagcaacatataataccgagatgattctccaaaaggaaaaatgagcaactgaatcagctcgtcctaaggatggcctaaagaagatgctactatctttatttttggacaagatactgatgcacactttcttaccctcggaccactagaactaatttattttggacaagatactgatgcacacactttcttatccttggagcactagaaccaatccctgtctacgtaacagtagttgctcgactccatgaaatttgggcaaatgagaaagccagggactgagaagatgaagtctgaaaaaaattatacatttttgcatataagatgcatattccccaagagaactgcttaagccaaaaacgactacatcttgtggcaccaaaagcgactccatatctagcaaacacgaccaggtgtggtgtagatcacgatgtattgatgacgacaaaaaatcccattcattccgctcatctttggaatgtcctaggcggcaaccacaaggcgccaacgactcaagatcacgaaggtgcagcagcagcagaatctccatccatcatcgctctgctcataggtaccccgtgcgtctgcaaaagttgattgatgaggaggagcggatacttacgcacttccagttgcctccaacgaagaactgcaaggacagcagcagcagcagaaagaaagaagcagcaagtcgtcagccacgagcacaaaagggcaacgaagggaagtgtaattaaacgatagcaggaaggaggatggatggcaaccttgccggatccggccatggcgacgacgcgctgggcgcggcggcgggagcacccgaggcggagctgctgcggatgcgccggggcggcggcggcgacgcctgcgcggcggaggtcggcgaggcgggagaggtgggaggacgcgagggacgacggcgccgccattctctctctccaatccaacccaacccaatccaatccccttcgtcgcgcgctgcggttggtgagagcggagctcgcgagctgaggtgaggtgaggtggtgatgatgcgggcagcggcgcagccaccaccaaccgcggaggaagggggaagagaggggagagcgacccgtgcggaggtggagggccacgcggctttgtatggccgcgcgcccacgcgcgccttatcggcccacggatagggcgcccagggccgtggcctccgccacgtcgcctggtatttcctgggccggcccgaccgcgacagcccaagcaacactccacaaggaatgttccagaatctctcttatgctttgtttagttcctggtccaaaatattttttaaagtatacggacacatattaaatcgaacgtagattaataataaaataaattatagattttgtctgtaaactgcaaaacaaatttattaaatctaattaattcattattagcaaatatttactgtagcaccacattgtcaaatcatgatgtaattaggctcaaaagattcttctcgtgatttacatgtaaactgtataattggtttttttccgatcacatttaatgcttatgtatgtgtctaaatatttgatacgacgaaaaaattaaaagttttttaaaaaaatgaatctaaacgcggccttagcttccctcctccgctccactgactgtaaattggaaggttttttaaaaaaatgaatctaaacacgggcttagcttccctcctccgctccactgactgtaggcccatgtaactggggcccacacttcgtgacgtgacgtaacgtgaccactcactctccgtggggaccagcgaggccctcgcagagttgcacacgtacgggtagaggagaaaatgcgcgtatcacatgacactgacaagtggagtctagtgtaatacttcctctatattttaatatatgacgctgttgatattttatccaacgtttgaccattcgtcttatataaaatatttatgtaattatcatttattttattgtgacttgattcgtcattaaatatttttaaaatatgatataaatattttcatatttacaaaaaaatttaaataaaacgaatggttaaacgttggttgaaaaatcaataatgttatatattaaaatatggagagagtacttaccccgacgtgtcagccaaaaatacctttcatcccgtttataaaaaatccgtagttataaaatccaaaaagcaaattaatatcactatctccacttcagtcgttttaatctttttagttctaatcaaatttataaaaaagtaatatttttacaaaaaatataaaaatattaatatccaatttaataaaataaattgatactataaatattacaataattttctataaatttagttaatattttaaaaaatagctttaataaggtcaaaactacttcagaacggagggggtattattgagaagctagaaaaaaaatacagtgttctaaaaaaaaaagaaaaacaaattcagcctttattttcatcggcttctcagactcggtctcgacttcagactagtctgtctgaacgaggtcgagtcggaggagttgcatcgctagcttaacccgaccgctttttaaatcgaaatcccgcagttaaatcagagatttatgcagacaaaagaaaaacacacacacagcaattactattctccaacccaacacgccccccgcaccgccttccgtcctcataaacgcgagtgggtttaaactcgagttgtttttttgttcgttaatcctcgccccctctttctctctaatctccgccaaggcgatggcggattcgaaggggagcggcggcgccgccggcgacaagcccggcgccgacgcgagccccgccacgaatccggccccgccagctgccgccgtggccgtcgccgctgcggccgcggacgccggaggggacgacgacgtggccgcggccgcggaggcg

SEQ ID NO: 1857 - DNA, 1700 bp, Oryza sativa
tccaggagcaggtatatgtgggggagatctcgcggtcgggtgttggtgctagggttccgggacctctcgattgacaatttgacatggttgttgtttggatcggctgcaggagcgggcgtacatgatgcttcgcatgggcggaggcgtcggcgagggcagcgattacgggagctcggatgccgggagctacgagtacgacgacgaggccgaggaggactacgaggaggagctggagcaccacctccgcgtccaccaccacgagcacgccgttggggagggtcgtggcgagggagagcgagatggggagggggctgagggaagcgagttcgaggaggaggggttcgacgaggagtatgatgaggaggaagtcgagccagagctagaccccgcggagtacgaggacgatgaggcttatgcacgagctctgcaggatgccgaggagcgcgaagtagccgcgcgacttatggctctcgcggggatcagcgattgtgagtagaaaaggagtgctgtttcttcagttcatttcacatgtttcagttattgctgtcgataatttcaatttgatattgctttgtagggagacctgtggagcctgtagaggagcatgcgaatgatccacaggtaatggtctatttttcttgttagttggacaaattgtgtttgttctgatatgtgggaatcctagagttggatgaaatgatcttggagtaataacataaatgatgatatagtctccttaattcgttgttgttgcaataaaatttacacctacattatgtatgacaaccgaaatcatatggaatttacacttgaagtgatgaatgtgccttgcaactttccttgtttccacgcactgttgataaacgataagactgcccccaaattcattttttgggtaccttccagcatccaaaatccatcttattttcagttgaacctggaattctttttcttgctcaccttcagtttcatatttgagtgataaactcatgagcatccaaggtttttatgtactttttatcacatttacagatcatgacttctataagaagtgttggttgtttacatcaggtggatttttaatcgtttatactttagtagagcttgtactgtccattagttgagcaatagtaagaccagaggtggtatgtggttcatgctgtggcttgtcaaatttgcatgctgtcctgtttactccatggattttggcatgctatattatctccaatggaagctgcatacttgaacttgggaaaatgtcttttcattttttccttactccattactcattgataatcagcttttatgaactggaaaaacgtcatttaacacgttgatatatttttaccaaaacccaggatgcgtggcaagaggttgacccagatgagtattcttatgaggcaagtttcattgttatatgttagccttctggcacctggcactgcatcagaagctttaagatgcaatattaatggttctctctatatgacttcaggaattagttgcattgggagaagcggttggtacaggacacagaggcctctctgctgctacacttgcttctctaccttcagtaacttacaaggcagaaggtgtccaagatggcaacacagagcagtatgtgtgaataatttgtctcataagtcataaccttactatcttacattaatcacatattaagtcctaatgtatctattgt

SEQ ID NO: 1858 - DNA, 1434 bp, Oryza sativa
attaatgtctatgaagctatcttgttgcgcatacttgtgcttggacagagggctttatttgactgccaggctgcatatgttgctaagttttgtgtcaaagtgtggcaacccaagattgtctccaaatttattcgccacattagtgggaagtcttttttataggaaatgagtctgtcatgtgggtttaagggctaagaaaatgtgatattagttatttttatagtgggccctaaatttactagcaggccatatgttaggttcatggtttatgtctggatagaatttttgttattcttgctgtataggtatagttgttgccttgtacctttgtttcaccttcaggaagaataaaggatcactttggtagacctactaagtactagtgacattcatttttggtacaaaaattaggccattatatttgaaaggtttagcaaatcaccaaacatggaaaactcacgtgcatcagtgcataactagggaaatagttttgttgcatttgaaagttcattcctcttgggtgataatgcagtcttacaaaataaatccaatctgccaaagcattcacgcccttttattagttttggctaaaagatgtttgggtaacactaatagcactgcggatattttggtcatttgtgttatgcaatttaaattctgataagtttaagccaacgatttgatcatgtgaacttgcctctcgtttttggttgctttactgcctgcgcacattgattagctaggtatagctgtatatactgtgatttcattcatatttctctacccactacccaggtgcatcatgttagttattgtcttacgaagtacagtatatggattattcacatgtagctttctctagtttcgagttgtttacaatgtttaacattagtattgaacgtttaaattttataaacacgataccggtgtgtagttatcagttggtgacgaaatatccttgatgtgcaggtttgcccgatgtgcagcgcggaagtttccacatcggacagcaaccaggcatgaccaatctttgctgccattatggggcttgatgggagcaaatagcgggcatcatatggtcgcatcttgtaatgttggggagaaggcagataaaactttcggacacatgcgagggaccagcactatgatcttttgcgttcttcagtcctctcctggcttagctccactgtactctgtttgcccgtgccgctatgctctgcattccctgtgggggcctcatggctgttgtatgatccataaatgtacaatggttatattattatattatatattgctagccattcttttactacctcatatagcactatcgttgtaatcttgctttttgaatgacgtttttttcctctctttacctagtcacgtacttaaaaagtttttgatcaaatggcctctcaatcatttaaaaagttactt

SEQ ID NO: 1859 - DNA, 3503 bp, Oryza sativa
gtagaagcatcagcaaagacaattgattcagtcttggatgcctttttgagggaggagaaccaatctttatcaccggtcatgtgccacgaacaaccggaatccacaatccacacgttctccttccttgccaccaaagcctacacacaagtagacgtcgaagcctcagtactggggttagatgataataaaaatttaggaatccagtactgagacacacgaccagaagatccaataggcatatatccacgtgcaaaatcaattttagaattttcaaaaaaattcctccgaggccggtctgaccgaggtacagtggccggtctgaccgggggccggtctgaccgcctctgtaccgccggtctgaccggtgcccggtctgatcgaggctgttcagccggtctgaccggtcgccagtctgaccgcgggacccactgcggtctgaccggtttcttcgagggaaaaccagatttttgccactttgattttgcaaaagcaatctctctctcctttttctgtttatgagctaatctgaaacaaaaatcaacaatatgtccatcttttccacaaaaagaacaagtatatttttcacgttgtttagacacattgttagagctagaagatttagcaacacaagcagaaacaggaggttttgcatgcacaacattggattttgaagaagatgcactcatagtagacatgataccagcagatttaaacacagttttatttgtatcaggtttaatcaaaatctcaccacttctagcaccaacacctaacacaacaggaggatgtctagagttatgagcataaggatcaaaacctaaaccacagttatttgtgctaacctttgattgatcctaaatcatgttgaggttctttttaccatcagaaaatcttagcaaagaatttttcaaataagaaacctctttttccaaattaacacaattttcacaatctaccattacacctttgcttttccgacatttggggcaagaaagcacttcattgtttttcacaacatcttccatgtactcaacatgacctaaagcatcttttagtttcatgttattcaaattacatgttgagcaatccaaaacatcatgatgttgttttaactttttagcagaaatcatgttaaacatcaaactagcataaaaagcaatttgatatttttgcaacaactttttagttaaaaacaactcatccaaagtgcgtgtgtgcagagcaaaactacaagcaagagaaggtctatttttcaaatcatgtgcagcattaacatctctaatttttgaaatctcattcattaaaacctcacaattttcacaatcatcatcattaggaataagagattttaatctatcaatttcagatttaagagatttaatgataaactcctgttttttatacatcttctcacactttttattttttgcactcaaaatattaatagcttcctcaaaagcactcacctcattgtcttcatactctgtgtcagattcaccacgcgccatgaagcaaacatcggagacgttctttcccttgtcatcatctccactttcaccatctacatcacttagtggctcgaaagcggcgcaaacttgttgaaaagccttcctaagattctccatcttcctcccttggttagaacccttcgacttgtagttgttgggcttgttgttgttggtcttctcaccatctttgccttctcttttgcctctcccaagcttaggacaatgcgaacgaagatgatcaattgaaccacattcaaagcaacgatttggaccacctcttttcctgttcctggcattattcatagctcaagcaattcggttagcaaccaaagccaaatcctcctcctcgatttgttcgagttgatcatcggatgtggcattaaaagcagcaagaaaagaaggcatagatgaagaagcatcaacaaccaaagaggaagaagaagaaaccaaagcactcgatttagaatcaactttgcgagaaagaatattcatctcatgtgttttcaatttagtataaagtgaatccaaagtcaaagtagacatgttaacagactcctgaatagatgtaactttcatctcccaaatagacatgtcgagaccattcaaaaagtgacaagaaatctcagattgtggataattaacatcataagaagaatcaacagatctaagatcactcaaaattttattaaacctagaaagatagtcatctaaagcttctccatgtttcatctcaaacttaatgtactcctttttaaaaagatctcgacgaagctctttaatgttatttgttccttgatgaaaattcttcaaagcattccaaatctcatgagcagtttcaagatgtgcaacacgatcataatgagaacgagaaatcccactcaaaaaaatgttgcgagctttgcaattttgttcaaaagcagttttttcagcagcagtattaataacttcaggaatcacataagcatgagaaacttttctccaaatatcataatctttagccataatgtaagactgcatcctactacaccaatgagtaaaatccgttccatcgaaaacatgaggcttagttgaaaacctagcgggagtagccatgacaaaaactttagatcgataaaaatccaaagaagaaaacaaggctctgataccaattgtaggatcgtaaagggcctttcccaccccaaaagctagccattgaggtgaggggctcccccacttatatcttaggtcctttacccttccacaaccaatgttggactattcaacaatctcccccttcacacattggtgtccctcagcccttcaccgccccttcaccgtatccgggccccaccggcccatggtccatcaggtatacgggccccgcagacacccacggtccatcaagccttcacacgtgtccatcgggccagagatgttaacctagccaggctctgataccaattgtaggatcgaatcacaagaactaagccaaccagagggggggtgaatggttggtatacccaaaaaccgaaaacttttagcggaaataaaagttaccctcgaaatcgatggatcgcagtctgaccgaagtagttgagccggtctgactgcctgatgaacgtcggtctgaccgatgtagatcgatcggtcgaaccaccgaaaacacctaccgccgactcctgtcgccgccggtctgaccgccgtgtgcccgccggtcggaccgccgcgatgccgccggtctgaccgccggtgtgccgccggttagaccaccgaaacccggtaaacacaaatcgaagaactcttaaagtggatgacgactttattgattctctctgtgtttacaaagtgcaccaacagcactccttacaaaaattttgactaaactcgaaaccctaactcaaaactcaactctattgctttttaaagtgatacaaggaagcctcacgctccccctttaattaaacattaagtaagcaagcctaaagccacgaaccaaactcatacgggctgcaggaa

SEQ ID NO: 1860 - DNA, 8487 bp, Oryza sativa
gtgaaaaccaattatctccaaaaccacttcgtgattaattccaaatacaaaaccaataatgtccaatgcccaattgttcatcacagaataataatcaaaaacacctttgattttacagcacgcttaattcaacacttcccggcttcctgtaatgtttgtatagccaccaaagcaagggctgtgtttagatccaaactttagtccttttctatcacatcaacctgtcatacacacacaatttttcagtcagatcatttccaatttcaaccaaaatctaaactttgcgctgaactaaacacatccaagaattctccaacggggaaaatttctgggattaatcaagttcagaaacggggcagccaggtatggagattgtcaagaaacaagcacggatggacgatcgctgcctgtttttggtttcttttcactattcatgtcctcagtcctcgagcaggtgcaccattgtccccagggccatggcaatgtgccaaattgccaatgcttgtcatgaatatgacaacgctagctagctcagcggaccacggctagaagcacagtggcaacatcgccaccagtgtcgtggtcgttcgccgcccacagttggcaataccactgcattttagtagcctttcatgcatgttctgcctaattcgtgatcgaagaatcatgtactatataataacgtatagattatatatttatatgtaggggtagggaaaataaacagtttaatccaagaaaactataatagcacgtactagtagaaattatgttatcttcctattgtttgacataaaatgtactatctctgttttacaattacttcttgttctaattttattctaagtcaaatatttttattttcaatcatcatttttttatatattatgaaaatatttctcattatacgttaataacataaatcttacaatattaaactataaattaatgtttgacttaggatgaaagacacagtactctaaaatggaccagtagcgtgaatgtctcggtcagaataaatatgtgaaccctgtaaaattttcacgtaaaagtaatataccatgtatgcatatgtagtagtaatatatactgaaattttttttaacatttttgatagataaagttatgcaccataatgtctttgattttttttttcaaattgtttgagtacgattgaattatagaaaaatatagcaacacctaaaacactaaattaatttatgaatttgacattggatatattttgataatatattagttttgtgctagaaatgatgctatatttttctataaacttgatgaaacttaaaatttctaactagaaaaaataatcaaaacgatgtatagtatgaaacgaaggtagcagtatattttcatacccgtacatgagtacaacagctatttaaatgggagaaaatcttcccttttcaatcaatcataaaaaagatcaccaaaatccctcccccaaagaaaacacacacagtacaatccaaatcacaatcgacgtcctaatcgcacgcgcttttaatctcgattaaactactgaacgtaaatagcacaactatccattccctcccccagccaaagctatagcatagagcgacctttcgatcgttccctataaatcaccacccctcctcgtcgcctccctttcgctgcttacatgcaaaaaaactcccataaacccctcctcttcgagaaaatccctttttgttcaaccacgacgcgaattcccaagcaacccccccacacccagctgagtagctgacgcagcaccagcagtcgcggggaaagggacacgtctcgccgccccagcttcccgcctccctcccatcccgccgccgcggacgcgtccaagccacagcaacagcaaccactccgacgaacacctcgcctgcgcgatggtggcggcggcgctggacgcgatggcggggacgaggtgggggaggtggctggggctcgtgacggcggtgtgggtgcagtgcatctccggcaacaactacaccttctccaactactcccactccatcaagacgctcatgggcctcacccagctgcagctcaacggcctctccgtcgccaaggacgtcggcaaggcgttcggcctcctcgccggcctcgcctccgaccgcgtccccacctggcttctcctcgccgtcggctccctcgagggcctcctcggctacggcgcgcagtggctcgtcgtgtcccgggccgtcgcgccgctgccctactggcagatgtgcgtcttcctctgcctcggcgggaacagcacgacgtggatgaacaccgccgtgctcgtcacctgcatccgcaacttccgccggagcagggggccggtgtccgggttgctcaagggctatgtggggctcagcacggcgatcttcaccgacgtctgctccgcgctcttcgccgacgacccggcctcgttcctcgtcatgctcgccgtcgtgccggccgcggtgtgcgcggtcgccatggtgttcctccgcgagggggaggttggcggcggcggcgcggacgggcgggaggaggaggaggaggatgggtggtgcttcgccgcaatcaacacgctcgccgtcgccatcgcgctgtacctcctcgccgccgacctcaccggcgtcgggggaggcggcggggtcgtgtcggccgtcttcgtggccgtcctccttgtgctcctcgcgtcccccgccgcggtgccggcgcacgtggcgtggaagtcctggatgaagacgcggaagctcgcgaacgccgacgtcgaggaggcggaggagtgcgcgtccgccccgctcctcgtggcgaaggcgacggcggcggcggcggcggaggcgcgcggccccggcgagaagccggtgctcggggaggagcacacgatcgcgcaggcgctcatgtcgctggacttctggctcatgttcgcgtcgttcctgatgggcgtcggcacggggctcgccgtgatgaacaacctggggcagatgggcgtcgccatgggctactccgacgtctccctcttcgtctccatgaccagcatctggggattcttcggccgcatcgcctccgggaccatctccgagcacttcatcaagttcgtctccttctcccatccctttccccttccatctccgtacacaaaattgaaccgcaaaatccccagcgcttattattccaaaaaaaaaaatccccagcgcttactgtcgccatagatccgtagctccgtagcacggattaggtgtggcattttctttcgctagagttggaatcttggagcccactagcccgccattggtgatggatgggtgctgcaaccatgtcggcatccgtagtggtggtgcccaggttggagcaaggcgagcatttccaagacagagtcaagatggtcaatagaatttcagatattgcaacttgcccactttaattgtagtactatagtatgatcattatactaagctgtaggattcccagattccctcggatacatctgcctaggaataggatggatcaagttgacagactgagagaacgagagagcttagttgggattggggaaaatggaggttttggttctagttgggaatgggggaactgaagggtttggttcttgattcctttggaaggatggcttacactaatctgcaatataattagcaattgtagagacaaataatcatctttaggtatctgcacctgctggttagaatggtgataagatagcagtagcacaagttgtgtttaagctgtaccccgtagtacttatctgcaggtactatccatggagaattggtagtcctatgctttcagtggtcactacctaagtacctaactgcagtccatactatatggttactcaattcacatgtatagagtacatgttacctttctgtgttagtggtcatgtgtgcatagcacatcatgtacagctggtgtttccattaagaactgttatcggattatcaacattggcttccttttcttttttggatcaacctattctggaagagcaattcgacatattattagtctgaccaaatttatgtaaaactagggagtcaatgtctacaacttaatgtgtccacttcgtagtcttaatccaatgttcatttcatttctgtatgcgtttccctttcctcaaatattttgctgagcttctgaacgtgacaaaatttcaggacaagagcaattccacgccccttgtggaatgcagcttcgcaaatcctgatggccgtgggctatgttgtgatggcagttggtatgccaggctccctcttcgtcggctccgttgtggttggcatctgctacggtgtccgcctggcggtcaccgtgccaacagcatctgaactgttcggtctcaagtactacggcctcatctacaacatcctcattctcaacttaccactcggctccttcctcttctctggccttcttgctggcctcctctacgacgcgcaggccaccaaggtacccggtggtggcaacacctgtgttggtgcgcactgctaccgcctcgtgttcgtggtcatggcgattgcctgcgtcgtcgggttcggtttggatgtcttgctgtgcttcaggaccaagagggtgtatgccaagatccatgagagcaagaggcagagcaggtcggcagttgtgcagagggtaagctagccaaaacctacagctatgagaaaaatggtacagattcgcgcaattgcatcaagattcaatgattcaacgagtgcaggttctgtaaattttgtgcaaataagaggatcccatgtcttgattctttggaattagatggatggatccattcaatcggtatagtttaactgccacggaggtttctaggggctgattcgagcaatgtttgccctgtgtgtgtaattcagtactagtactgactactactgactgagaggctgcagattgtggagttgtctgatccctcggtgtaatcagtttagtcagtgtatccttgaggaaatgtattctcggttttagcctgtacgatgaattgttgtgcaattagcctgttggcatataaattcagatcaattcaagccattctttttggaacattgttaagtactctatttattttgagcatgaatggatgtactcagttactcagagtctgaaactagaaaccaatcaaccatcgaggaattggaatattggatgaaagaaaactaatctactgggttatatctccaaagttagaaatggcgaacctgccggccgccgtcgccgtcgccgactccacccaagcgagatcgtcgctgtgccgccgctggcgaggaaccaatcggtgctggtgcgggtgacggcgacgcacccaatctcggatgcttgcgcagaggaggatctggagcacttggctggggatcgccgccagcaaagggaaggggaaaaactgcctggagcctgctggaccgtaggcttcaatctgggccgtccaatgcagcggatgtggggagcacgaatcttggaatacttatggaaagagccccatgtacttgggaacaaaatgtgttgaaagttgaaactataattatctgtagttcgtaaaagaatcattctttggtctatggatttgcttttttgtgattcacttgagttaggatacaccaagcttcaagaagataattaattttattcttttgattaccacctttatggactgatccgtgtttgcttgtttgtttcgtgtgttgttgttcagtaactaaattcttgcagctcgcgtgcccatttctaaggaaaggaaaatccttcaacctgggcctaagaattgctaattctgctcctagccaataatcacctggttatgcaagaaacagctcgatattgtagtaatttatcagacggttcttaatgaaaccatagtacttcaagcgattcaggtgtacttgatgcttgagaacctgttccccatcttgatgttatgaggctttgagctgcatttgcatacagaagtaggaaacagaaaagctcatttccaagtcagtaccccatagtagcaaaactcatctggttgtcagattactaaattccaccattttactggatttatctagccattgttcttcagttcaacaagcaatcaagcatgtctgaatttcattgcaaaagcaaaaatatcttgtttctccatctggatattaacttgatcggtcttttgtcaacatttgtgtagagctgattttctaatatgattagtaccagtggatgctgacagatgaagggcacagttctgaaggtagtcaccataccttaatggcttaatatcacgtccccgtcgaaatctttcagatctgtttgggcctgtttggttgctcgcctcaaatcctgacaatgtatacacatgttctaaatatctatccagcctcactttttctttccttcattccaagattttacatctggcatttgtggccgtaaatgcacatgttgaaacggagcacaccgttgaaatttccttccagatgctttcagcagatttattgacctggcggcaaggatatgtcagttgttgaacagtctatagaatatttcagagaatccgattattaacagacgaaggaagtataattctgattatattcgaacggcatttttggggaaaagaaaaagaaaagtaagatttgcagaaagggttttattgtcactgctagggaagacttgttttcatttcatcaaagcagatatttttgtcacattcttgactaatacacgtatagctatatttcaagccaaaagccatctacggtaacactagcttaaactatcatattcctactgacttacctgaattattttggtagcatcagtttacacaagagatcaataggtccacgaaagccagcaggtgcagaggataagtaaaatcctgctgcctaaaaagaaagaaaaatgcacagcttccaccatttagcatatgcagattcagcgaaagcattttgaacctacaggtcctgtaaattcagaactaatgtatgattcatgtcttgattctctgaagaagatgatggatttactcaaacggaatagttcagaacgacatcgcgtcaattcagttcatgaagtaaaggtgcatagttttcaaggaggccctcgtactattcgtattatcatttacattcacaaggagtagttctgggcttctgggccgtcggtccgttatgagcgtccgaaatttatcttacctggtgaacgaacaagttacgtgtattttacaataggacccctatagttcatcctatttgtattttgaaatagaggactcaaaagagaaagtttcttccaagtcccgtgccgaaatcgcatcggaaacaatccaccccatgcctacgggagggaggcaggctagcgtcgcgtgtttgattggtgggattgcatagtcgcggattgggcgggaccgcgggagtttccgatcaaggctgaggagataggcggtagaaacctcgaaggtgaatctctctgtctatatgtgttatccaatccacatttgttttgatcagatctagatgttgagaaacagtagcgaggctcctgttctttttttgccgggtcagccaaaggttggccgaccaatttcattaagaaaggaggaaataaagttaaaacaacttagttacaacgacaacaaattgtcgcgctagaacgagcgaagcacgcccagcagaaacagcaaaacaaaggaaaggagcaaacgctcaaaacttccggctgattactcactaatgagggaaaagatcccggctgctttccaaacttcaatttcctccctgatgtcctgcacaagctgctgtgctgttctggacacattttggaaaatccttgcgttcctctccttccacacaatccaacaaatcagcatgaacaagcaatcaaaatcgctcctgtagctcaaccgacagcgtgatctgaccgtcagccaccaatctgacagtggcgtcgccatctccgctggcagggggaaatccacaccaagccaccccctgattcgccgccatacctccgtcgtgaaagcacaatccaccagtaaatgatggccgtcctcgctgttttgtcgacataactgacaaagatcctcgtgaggccagtttcgcttggcgagattatccgctgtcaagcatttacctttgagtgccaaccacatgaagaaacggactctcgacggagtcctagattgccacagcagttcaccaaaaggacagtcctccttggctaaaaagaaaagattgtatgctgaagaggctgaataaagaccatcagcagccatcttccatcgaatggagtcagcactgttgtccagagttacctcccgcatttcatcccaaagctgaaagaactccccaagggcttcagtcgacaaggagcctagaagatccctcgtccatctatggtcgaccaatgcttgacataagtgaaaagggtcggccatctccaagcaaagcaacctttcccagaccaatctacagtccaaaaccgtgtatcttgaccactccc

SEQ ID NO: 1861 - DNA, 11820 bp, Oryza sativa
agcttgtcgaggataggctgcagtccagccttcgtgggtttcctggtacccaggggtagaccgagataggtaatcgggaagttctccactcgacatgagagcgtctcttcaatcaagctcagctgatcggcagagcagtggatcggtgtgttcgcactcttggagaaattggtcttgaggcctgttgcatcaccgaataggcccaagattgccttgatcactagagcctctctggccgtaggccgaaaaaacaacacggcatcgtcagcatagactgagatagaaggtaaattctgtcttgctgagagggggaaagaagatgcatggttcttgcttgatccaccaaagcttgaagggaatccattaccagtacaaatagcaacggcgataatggatcgccttgcctcagcccccgagccggtttgaaggggttcgatgctactccgttgatcaggatgctcgtcttctctgtaacgaagatcatagaaagccaccgcctccagctcggcccaaaaccccgaaatttcaacatggacagtaggaagcaccaagataccgtgtcgaaggccttggaaatgtcgagcttcaagagaatcatctcctccttccgtttgtgaaactgttgcactaaacccttgacaaagacataattctcatgtatacttctacccttaatgaatgcagtttgcgagaagggaaccaattcatccagtcttggggccagcctcctagccatgacttttgttgctagcttgctgaagctgtgcacaaggcttatcggccgatagtcctttaggagagttggggcttctttctttggcaaaagagtaatcacagccgaattgagcaaatctaagttttggctactacctgagcagaatttgtcaagtgcttgcatcagctctggtttgatcacgtcccagcaagtctggtagaaaagccccgtaaaaccatccggcccaggagatttctcattcggcatactccggatagctgcccaaacctcatcttcagtgaaaggattgtctagctcaatcatatctcctctcctcaactgagtatgctgaaaaagaatctcccttttgtcactctcccctgagctcatcaccatctcgaagtattctcgggccaaagcttgcatatcttgttgagatgtggcgcatctcccatcgtgttccaagattgggatcaacaacttccttcttctagctttaatcttcatgtggaagaaggcagtgcctgcatccccttccctcaagtttcttacccgagccctttgtctcagccgaattctttccaatgatgccaactccaaacatctccccttgcagccagcccctaaggcggcgctccaagtccgatagcaagcgagattcctgcgccacatccagacgcaaaatcacttcgttcgcaatttggatttgaagcctgaacttactgattcttctttgcccccacttggtgagtttcttgcacagccgcgccaacttgacatgcaaaatcgagtaagggtcatcagactgaacttcctgctgccagctctccatgaccgcttctaagaaaccatccaacttcgtccagtaggattcaaacctgaatcgtctggttctttcccctgcaacaccgcaactaagtagcaatgggcaatgatctgagttggaggaactcaaagcctgaagatgcgcttccggaaagcactcttcccactgggttagacgagcaatctgtccaatttaaccagcgtcggctgctgctgctcattactccatgtgtatcgcctcccgaaaagatacatgtccctcaattcgagctcgttcagcttgttcctgaaggcattcatcaaccttctgttaattctgctattgctcttgtccatcgcagccgcaatgaggttaaaatcaccagtgatcatccattctccctgacaactgttcctcaccatcgacaattcctccagaaacagcagcttgtctgcatccccttgtggtccatagactgacgttaggaaccaggaacgctcgcccaggatccaacgaagttgcaccgtgattgaccactgtcctatatgcactacattcccctggaaagccgcccccttccatgctataattacccccccgcgagtctgctccgccggcaacgcagcgaagccatcaaatctaagccacaggagtcaaacaccaccgccgaatccaccacctcaagcttagattcttggaaacatacaaccgacaccccactcgacatcacagactcccgcacaagggctctcttgtcagcattattgaggccccttacattccacccaagtaaactaaaagaaagagaggaggttgacatggaaacagatagaacaccagcccacaccgcctacttcgaccccgacgtcagacgtattccctcaagccggagacgccgccgccatgaaccagacggaggacagaaccaggctcctgttctgtcctccatgctggaaaaattttgcctgaatcagtcgtaagcatgtggattggtacatggtttatgcttttggttaccatcttaattatgcattgcattcctgtatgcagcatgaatatatacataagccaatctaatacctggtccaattttaccggtctagctaggctggtgctgatttgacaaaatagtcctagatgaaagtactttctgaagagattcaggtatatttgatgcctcaattcaacacctcatcccctcatattctaatgtgagtctttgagctgtttatatatataggccttttaggataacagatcaacagtgtaactcaccaaattcagttgtcttgcctttgaccctcagtttagttggtcactcggatttgcaagaaaaaaaatatcttgcatctctagctggatattaacatgacctcttgattcttgttggtgctgtgtagatctgattttgagagacagtcggtataagtggatgctgatatggtgaagctcatactttttaatgtggcccatgttgcttaatatcatgtccctgtcaaaaccttccatgatttttaacggctcacatttgataaacctgtaattctaaaataaaagttggtctagtgtttttttgttgtttttcagtggcacttcgccccataaagcacatgctgaaacatagcaaattgctgaagctgccttccaggtcatttcagcggatttaacttcaaggttaagataagctgattgtgttgtagacaatgacacatttcgaatatgcttgacttcttctgaacttagtagttttgtttgatttcccctgaaatggctgcaaactcttgtcggcatgaggattctgaagaatattttatacccaaatacgggatgaatactgatttcaggattctgaagaatattttatacccaaatacgggatgaatactgatttccctcaacctaatgcatatttacagtatatcaggtttcgaacctttgcactctatgcaatgaagactaagcttccacttcattaatacaagtacttttgttatattcctcattgatccataattaattctttttcgggaatatgcaaatgcaaggagcgcatctttatattaagagaaatatcaatgatccataattcctatacaactatatctcttccagaaaaggaagaaaaccagatgccactaccccctcctatacacctaactggcttattcccaccaactttacgtacaatactctggaaaatttaattaattgctaaatgtaaggaagtgaacagaatcatacagttgggtttttgcctgactgacagatcacctgcagttgctgttaggactgcacaatagcatacgcacgcaatcatagctttttattccccaataggacaataggatgaccccagagcaactactacagtgacatatgacaatggtttttctacagtgtatggtacagtttccactgtatcttccccttccatttttcttttttttttttggaatacgcaaggagcgcatcattgtattaagaagaaataaagtttacgtactccatttttcttttttgggaatacccataaggattgtgtatctttgtattatgcccttccattttgaatccagcgatgctactattactgcctagttttgcagtctggtaggggctgaacggaatctacttccttttgccttgaaaaaaactagaaaagcaagaaagataaaaaagatgctcccaagaacattgtagctgaagcagagatatatttaagcagcagatctgatccaggcatcaatgtgccaagttgagctgaggttccatgaaaagaattagagaagtttttttatatacaaaaaagaggtagaaaaggaaggctcaaatttctgtaggggcctatagtgtccatctatcagtggttcattttttgctcagagcattaatattgcccctctatcaatggcttccaaggctttttatggttgtcaattctgaatttctgattagtcacttaaagaaaggtgcaggaaacagcctggattgctatgttgtcacattctcattaaaaacaaaaacaacaactactcgtttatcaggtatctactttttcttattctaaaaaaaaactttttcatttcttacatgtaccagttgtcgtggtgaaaagtatgagatagcatgattctaaagaggagatatttcataatgcatgtctttgatcttttctttattgaagatatgttgcaatactagttcaactatgtcagactttgcaaacaaaaaaattattcgcctaccagtgaatagggatcttacatgttggaattatgtaactgtttttttcatatttttcaggattgttaattcgagcattactacaaatctagaatgaagtctgttagatgttggctctaatgcactaccatcaaatatatcaaaaagaactcgtaataatctgaggttggtgaaattctactgaagtcggcaatggttagtacttattttttcttgtaaaaaaaggtgcttggtacctttttcttttcctgaagacctcttttaagactttgctaccaatatgaaattcgtgcatttctgaactataacttggttttgtcttctctccttgcatttgttcttttcatgccatattcattctacatgtgcagtaataactttctaatttacttgtgaggtctgactgttttcactaaatctaccgtactattctgtcggtatttacttgggtggtgcttactttactgagctatctgaaaggtaactttatggtttatcaataagtaattattctcctttttcttctgatgagcatatcttcgagggccatcccaaaccttttcaagatctgtcccccgttttattttgctctgaatcaccatatcttcactttttttccccagagaactttcctctcatcatcagaaggaatctgtggttatcactcaattaacatcatcaattacgtcctagtctttttcagaaaggtgatttttctgttcattaacgcgtacaagtcaaaacccttcagccttattctgagtttctgatcacagtaactggttgcaagtgtccacggagtaatgaggaagacaggacaattgtgatgactggtagcttatgtgggaaaaatgctttctgaggacagcatgggttaagagtggactatagtcactaaagtaaaacatgattcatagcttatgtgatcacatgatttggcaccaccaggagccttaaactaagccttgttttaccagcactgtctttttgtaatggtactatccatttttgtaagcctctcttttatcaaaaaaaagaaagaagtaaaacatgatcatgaaaatgcttaaggattgtcaaaacaacaatcatcatctaactttcagaaaggtaaaagagattcattagactgataacaggtgatgaaattttactatatactttctttacttggaatacagcgtgtgacatgaatatatgtgggggcaaaaaaaataataataaaaagacaaaaatctatacacaagaagtaactaaagtagcaagtttcctgaaaggcagaaaactattgcagtcttgcagagagttcttgttgactgacacggtgacaccttaacaagtcataataccactagaagtccacagagcttcaatccttctatccacaagcaaaaggctaaagaatatcgcttcacgtcctcatcctactgctccaatcttgtttttttaaaaaaatcggaaagcaacaccggccacttcctaccgatcaagaatctccatcctcttgccacatcagggtcatctcctatccggccttttttttttgactgaaatatccggccaatttaatctttagctagctagtgtagcacaagcaaagccattactgccactgctaatgtggcttgcagcaacaacgacgtcgacgccggcgccgcgccgtcgacctcgccggtggccaagctcgccagccatgagtcgtcctccagctgcggatccttcggcctcggcgacgggtcattgctcgatttctgactgcagagatagaatgacacatgatatatatgttgatgaacaaaaagattattaaaaatgtcatcaatcaggaattcaagatgcaacctacagaagaagaatcaaggatgtttagttaatgtatgagagattagaccgtcataagacaagttaattttaccctgataaccgtgtcgcgatagtatgtgagagattccaggcttgtttttttttcccttgattttttggtgattttttgtccagttaggcatgggaagctttaagctggacagccactagcaatggcgggtgactgatgaccatacaaggtggggaaggaacaaaggcgaaggcggcaaaagaagagaggagaacaatttaaagctagctagcagagctctctctcttttctctctcacagcttatccttgtctctctctcaaccccctcactcctttctccatctcagtttgatgctccttttgtcgaaaatgcattttctaagtaatctggaagatgcccatattctccagccattatgtccgtccatgtttcagctctgggccaccgccacagctaccctcacttgatagagggaagagccctaaacttgacatttttttctccatattatgatgtatcttgcgactgttcaaccaccacaggacaaataacctatgaaaataagcctactaaagtgtatgctaggcttaacttgcctaattaaggaggtaccaaatttttacgctacaaaaatctcctatgtgagtccatacctttgaccaattgagcttgataagctgctgaagccaaggctgccatcggttggtttaatgttgatataaaccgtacgatttatgagtaatatacaaaagtaaacattttatatgtatccttaaataatttaaaacttaatatttaaaaataaactccgatgaaaaaacaacaaaaccaactctaaaactaaattttaaaatttaaattttagctgtggtctataacaaaacataggagcccaaaattcaacagtgttaatagatatttcttccgtcccagaaaaacttaacctgacacatcctaatacgataaatctagatatactctatgtccagattcatagagtatatcgtaggttgagtttttttttgggacataggcagagcacgacaatgcacacgcaaagtaaagcgaagaggtaaaaattgtaaaaaaaaaaaaagagttggccaacctgttgggattgccgggtcgaggacagaaggtgatggagtagtcggtgccggtgcaggtgaaggtcgacgtggcgtcgtcgtaggcgtagctgtacgacctagggcacgccctcttgaacatctgcgagtacaccgacgggtgacacgtgtccggattgccgtggtcgccgctgcagcagtactccggcgtgccgaacgcctcgcacgcgctccggcaagcctggccatggccggccttcagctcggcggggcaccgctggttgaggtccacgacgcacccggtcgccgggcaccccgccgccgccgcctccaccaccatgggcaggttgtacccgtccaccaggctcacgtcgtagtagtccttcccgccgccgccgccgctgcccagcgtgaactccaccagcgtcgccggcggcgtcgcccccgcgccgcggcactccacctcgccggagccgcagtcccccgtcgcgcaagtgcccttgccgtcgtcgtcgaacgtgcaccccgtccgcgcccagaacctccccgaccaccccgccggcgccgccagcgaccgcgtctcgccggcgcccagcgcgaaccccgtcgtccccagcgccgagctccccgagttcgacagcacccccggccacaccgtgccgccgcacctgttcgtgaacgtgaacgtcacgccgcccaccattaccaaccctgcacacacaccaaatccaccatgatcaacttacaaacagaacaaacccaagaaccaagaattcaattcaccattgccaatctcaataccttgaaagaatgataggatgacgaagaacacactcatgatccaagtagatcgagtgatgatccaagaagccatttgagcagcaataaattgtaaactgaaacccaattcaaatgtgcgttactgttatatgtatatatatgctggatatgcaggaaagtgatcagttatggcaagagtgaccggtatgttcttgaaattggcagtcagctaaccctaaatggcaagacggtggttagaagcttggaggaagttagatgcaagtaaactagtaatagtggccactacagcttgagtgtgcagagtggaagcaagccgagtgtaggcttgtttgcttacacacctagcctatttatacagctagcagtgacgtcagcaatgatatgcaaaatgatgataccaagaattactacttcccctctcgtttcacttattccattgccttttgttttctttgccttttcccttttatttttctctctcgaaagaaaaacaaaaaggaagaaacagagtacttgggataaaaatgccccaaatgctttcttggaaaggaatggaagaggcagcagagcatatggaggtagaagacgaccgctgccattcacgaatgatgtcttgctggtgtgtgtgggggggccttcgttggttggtccttggcccatccgatgatctgatcgatcgatccttcgttttctcggcgcattagccgctgcgaaaactttggtgatcactcgccatcatcgatcgattctttggctcgttgctgcacaatgcctctgctgcgttttgggcgtggcggtcgctcgcctttgtcgtgttttttttgcctctggtttgggccagtgttggtgtgttggaattgtcggtttgcacccgatgtccaggtaggtccatggccaatgtggccaggcaagatcgttggaagaacgaaccgaccgatgtccagcctccgtttttgctgctgctgctgctgctgctgctgctgacgatgatgatgaaaacgaagggaaacgacaggtaatgcatggtggtcaactgaaagcaagggtcaagatcacggtaccggatcgaaaaccggtaggaacgggatttccatttttcacagaaactgttggttaaccaacaaaaaaaatcagaccaattttgtttaaaaaaggtaaattttagttgaatatttttattttgagccggcttggaagtccggttttcacgaaaactagaatgttgaacgttaagattgcttcttgctgctgtatgctggactttgtggattaccagaaacactatggtgtttagagataaattgatctactcccccctaatgcttcctttccaaactactttcttattatagtggaggcctcgatctgatccaaggtgtggagattggtgagctggagttgctgataggaaagataatggagttcagtgctgggcttcgccagagtagaacaggtgtagggtagctctagattgatgtgtagtttcttttgagggactgtggaaacgtgaagagttgtgtctttctatgtctccagccgtggctattttgatgctttcgtttctgaatgtctagtagttggtttgctgatggtgctgtgtcattttggtctgtactctgctggtaagctggaatccaagcataactctgatgattagcgttcaatataagctgggtccttgtgactttttctctaaaaaacaaaactagactgttttttgttcttttagtttggatatttcagagtttttttttaaaaaaaatctgagattacacgtttcatttttaaaaattaagggtggattgttatggctgccagctgatccaatctaattcaactaaataaataataagcctagatcaatccacacatgtccctatctaaaatcggtttatcttcgtgtcagcaccgaagaatcagtttattaccaccaacaaaaaagaacgcaaaagaaaaggaatcattttctgcagaactagctattcagagatggggaaaaaaattacaggtgatcatattactgtcacaaaggccaagcacagcggtacgtatcattttcaggacgagtcggcgttgcactaatcacatcgatggtgcagtgcagtgctggatcaatcgttagattagatagatttgctgctttctgtttgtactggaggtagcagcagctgctagatactttgaacgcctctgcaattaatccaggttggccagcagcgttaacgacgacgcagcagagattgctccagcgatcgaaagctacctgcagctttccaccgtgtaatgctagctaagtaacattaaagctcatgctaagatattcagcagtgacactgcacttacctttcatgtgaaaatgatatgttcccaacctgtaattagtcgagtagttacatgaaagcaccagttcggctctgtcggttacaaccagcttcagttaactgagatctaacagttaccttatgcagggagaaaaatctcttacatatagtgatatggatgataatgtggggattgtctgatccgaaggtcctctgccggagtagtggtgttatcggcaccgaagaagagaggagctcagttagggatcttggcacggatctgacagtggagaaatctttctcaatttttcagtcaaatgccacttagcaaatctggataatgtttcagttttgagctaaaataagatgttctgtgaaacattgttagattgatgaaatatttattggttacagtgggattttcttttccattattttgactcctacatgcaacaagaataatgttttcagatagacatgtgccagctaaataagtttagttgaatcatacgtaggtagctggtaggatcagggcataaccataatgctggtgactctacacaccactttgatcaaatccagaagaccagattaaactatatgtgcaatgctcgatctttgcataacctacgaatggacattttctttttaacaaaggtaacaatcaatcttgcagagtttcaggtatccattccatccaactaacttgacgcccattagttccagtcgtttacttactttctctgatcaatcactgcacagcaaatggcaaacggggaggagtgttcgatcgatcagaacgatttgattttcttcaggcagaagcaaaaggaagaaacagaacgacgaagaacaatcggcgcacaacctcggcagtacacaatgctgctgctgctgctgctgctgccgtgtaaagcgtacaagatgatctacacttatatcggataagagatcaggctagttctttcttcttcttcttttttcaaaacc

SEQ ID NO: 1862 - DNA, 7151 bp, Oryza sativa
  unsure (1)..(7151): unsure at all n locations
acgacctccaaacagtcaaacagtcatctgctgttgctttgacggatgatacgaatcaatccctgtgttcttggatgcatatgcatggcatatggcacaggagagaagggattaaaggctagcccttacactgtttcgctgcttttgtgtgcttgctttttctgaatgtttttttcttgccagccttgccactgtttcgcttgaccttgcacagttgcacgtagctgaagtcaatgggcaatgttggccaagtgccgttgaggtggagtccatgcggcgccaagtcatctcgactccgacgtgactgccgttcatcggttcatgtgcaaatttctctcttttgtactctttcttaaaaaaaaaaccaactctatagattttttttacataaaggattatcaaacctggcctctacagcttcgtgaggtgtacacagccaaataatcaaattcagagaatgtatgttcaaatttatttttagaattagatttttttaacaaaaggaatactttaagagtcaattttttctaatagccgaatgattttatgataactgttaaatgtacaaaagaatggatgaactatgacaattaaaaaatggatttgaaatagttgtttaagaatcgtatatgaaagtattttttatatataagaattgtatcgcttaagggcctgttcagattgccaaaaatttggcaagatagcgatattgttaaaattttggcaggatttcttatgtatttactaaatttggtaacaaagtaaacgtagatatttttttggcaactttaccaaaaaagtgatatgattgaaaatggtatcaaagtgaataagccctaaaagctgagaaagcttgctgctgaatggaattccattcctcagaaagaacacgcccgagaagggcaccaaacgactcaaatgttaagcaactgagaaaacggcggtatacgtgcccccgtacgtacacgtacgtatatacatacaaccctgtgtcattgcactaggtatattgatggtgatctcatccggcgacggctgcgtcatgtcaatgccatgtcaagcaaagggaaacgatgaaattaaagaagtcaagttgcaatattgctaaagaaaaggaagagtacactgtacacaggtgcattgcattgcatggaccggctgctggaaaaagatggggaagatttggggcactcttttcgccgagatataaagcgaccgatcgattcacgtctgccatgtcggcattgcacattgcctgccgctttgcacgtacgcatatataagccaatttcatttctagctgctgctgccgccgtcgtggtggggcctacgggctcgtcaccatgttaattttagttatctgcactatatctccttttactatttcctgcactttgacatggatttgtgacggccggagataatcttagttattagtagattctaggagtaatcggcaaaggctacgactactcgccagctgagtgcgttgcgttctctgcccctctctctctctctctctctctctctctcgcactatcactgattcatattataagtcgttttgacttttttcttagctatatttttttaagtttaatcattttttttaaatataacaatattttgaacacaaaacagatgtattatcaaaatatattaaatattagttttaataaaagtactattgtgttctttacattgctaacttttcataaacttgattaaaatttaaaaaattgaaaaaaaataaaagcaacttataatataaaacggagggagtgcaacttactcttcctaccttttaatcatctgtcatcaacggtgtttccagtatttggtaaaagtagctttggtagtgatagaagtgttctgttatctcggcaaggaggcggatcaggcgaaggtagatcccgtcggcggcagaggcntagaagtctaagaggcagaggaggattccgacgtcggtggcggccctatgggcgacggagacctaggaatccggtggagcggaagcggatccttttaactcgcgtctggtcggttagttttgattggacgatgacggatgaaggtgggcttaccggcggagcgtggcatcaactcacttgaagcaagtggatgaagatgacactagcggagttttgtagcaacaacgcactagggacggcgtcagctagacgacctccactcgtcgaatatggccgtttcagtagaggatgttaagaagtaaggatgtattgagatagtaggtttttcttttttttttctttttttttgtgtgttctcctcttcaatgtggtgtgagcctaagtgctcttgtatcatttggctgtgtatatcccttgtggatatagagaccgggttaataaaaatccattatcagaaaagaaaaaaagaagttatctgtttcctgttataccatgttcaaaatggatagactttgaactgttttattcattgtaggtccataaaactggctctaaaacagtaagcacattggaacccatttacacatgggcctttacagggacaccagctcaaattgtcatggaataagtctgttatttctccctcatatcttgctcctgattgaatcgtaccctcaaccgcaaaaccggatataatgtctcctctatcttaaaaaccggtgcaaatcgactccttcgatgatttggaaagcggtttctaccgacgtgacaggttgactgtgattgactcattgagttagcaagtggaacccacgtgtcaacgacttccacctcatctcatcttctgccatgccgtcgcagccgtggatggccaccacgggatgggggaggcaaaatagacttaagcctattgtcatacatttgagccaagtatcttgatatcctgtactcctgttgtactaccagactactgcaccagagggaaaggatcaaaggaatcagcatctgcagtctgcactgcaatgaagtaatgcagcgatgcatgctgaagttgatcagttcatcagatggaccatgccatgcaccagagtggtccaaactctgcctgcccaaccttttcagttttcaccatgcattcagattattcagagtcagccatgcgactatagtactacagtagtacgtgcccacaactgctgccgctataaaatcacaacgagaccggaaagaccctgacgttgcaactgtaccaacaactggcactgctcgagacaagcagtaaccaacaagatccatcgtgaaaggattcagagtttcagacatcgagcccagataatcagaacagatgatagtttgattcagaattcgtgaagaccatggatttgattcagcagcattcaggatttagatttctgaagagtgaagtgaagaccatgcctgacgtgtacgtacaaaataaggaaacgctcatgtgatcgactcaccgacccatctgcatacactcgttgtcccatgccctaacccacctgcttctgttctgcaattctctaatctcaaaaaaaaaaatgtttggttgccgccctgctttttttaatgaacttgatagtgcagtaataaggggtgtgtggttttaaccccaaggtttcgtatttaatcctcaacaccctcataatttcttttaaaaaaaatgttcgcaggacgtctcttccttcaaatttagggaaaaaatgtcacaggtttggttgctgcaatgtggatactacgggtgtgtttagttcgcgaaaataaattttttgggtgtcacatcatatgtttgaccggatattggaaggggttttagacaccaatgaaaaaactaatttcataactcgcctggaaaccgcaagatgaatttattaaagcctaattaatccgtcattagcacatgtgagttactgtagcactttatggctaatcatggactaattaaacttaaaagattcgtctcgcgattttcaaacaaattgtgcaattaatttttttatctatatttaatgctccatgcatgtgtcaaattaagattcgatgtgaactttttggaaaaaaaaagttaggaacttgacctaggctgtgttggaagtttggttgaaattggaacgatgtgacgaaaaagtttgaagtttgtgtgtgtaggaaagttttgatgtgatagaaaagttagaagttgaaaaaaaaattggaaattaacttttttttgtgacaggagaccaattaattacttcatcttcccaattaatcaaccaagtttttgtactagatgcggctgccattcaccgatccatggtgattgataatctatacaattcgcgaatcgcaatacggcccgaggtcaaaatgtcgggccggccggcacatggcgccatggcggatcagcacggctggccggcacgaggtgtgctccggcggatgacggcggcggcggcgatctctaccacggcagccagtggcggccgcgggcggtgcagagccacgcgagcacggcggcggccgcttggccggcgacggggaggggactgggcgccgtcagcgaggcgctgctcgacgcgtcgtagtagccgccgttgccgccgccgccgcggttgaggaaggagaccgtgtcgttgatgagaggcagccccgtccccgacgccgacggattcgtggcgccgccgcccaccgacgacttgaggctggatatcataccagagttagctttctaacgcagggttggttgatcactcattaggtttttatcacgaacacggaaaaatattacacaccaatatattagaagaaagtaataaacacaaagtaatcgacaatcggccagaagaccgttgctgagggcaagaacaaaaaggaggctaattgcacggctatggcttatacgtgtatgactttctatggcgagcatattcaacgaggcaaattatctactctctccgttttataatacaagtcgtttcatttatcaagtttataaaataaatatagtaacatttaacgaaactaattagatattgtagattttactagcttttttaaaaattttgatcaaacctaaagttttttattattttctaattaaatcaacttattataatatataaaaaaggagaaagtagttgcttgtaacttaatcagtcggcacaagacgttaataaagcctgcaattaatcatcttcaacgtagtcacgtacattggatcatgcatgatcattgaccaaccatccaacccacgttcttgtcaaatgatttgatggttggcagtggcacatgatactgcatttgatcaggctcactgaaatctgaatcgacgattcatctgttcggcttaattacctggagatgatagggcagaagacgacgaggtaactggcggtgccggaggcgcaggtgaatgtggacgtggcgtcgtcgtaggcgtagctgtaggcgcgcgggcacgcgttcttgaagaactgcgagtacgccgacggccggcacgtcgccggcgtgccgaacgcgccgttgcagcagtactccggcgtgccgaacgcctcgcacgcgctcctgcaggcgatgccggcgccgtcggcgccggcgaccttcaggtcggcggggcacggcccgttcaggtcgacgaggcaccccgtcgcgccgcacgccgcgccgccgccctggggaaccaccaccatcggcaggttggagccgtccacgaggctgacgtcgtagaagtcgttcccgccggcgccgtcgagggtgaactccgccagcgtcgcgggcggcgccgcgccgccgccgccgcactccagggcgcccgacccgcagtcgcccgtggcgcacgcgaacctgctggacccgcccgggtcggcgccgcagagcgtccgcccccagacgcggcccgaccacgccgccggcgcgtccacggcgagcgactcccccggcgccagcgcgaaccccgtcgtggccagcggcggcgacccggcgctcgacaggagccccggccacaccgtgtacgcgcacgagtttgtcagcgtgaacgtcgtgcacaatgcccctgcaacaacagcaacaacagcagcagcaacaatctcatcagaacacagctactaccacattgcacagctgatcaccaatgcaagtacgtacttgagagtgagatgagtaggagagtgacggggaggagacggcgagccgtcgccattgccggttgcagcaagctagcagcaagatggatcaaaaaaaggaaaaaacgaaacgagtgtatgtttcttgatggattcttgtggagttttcgtggtagcgatgcgattgcgcgtaatcaagcaccggggtttataagttataagagactgagagcgcttgcttggagcctcgtgatggccggtgctgtgcgcctgtccgcaggtcaacatgttatgctggctcaacgttcgagtttgcaaagaggagcggccaatcagaggctgacacgtggtgaaaccgcgagatttaaccctggtatgaagcgacagctgaaaagacttttcgtgtacgagaatgctacctagcgatcgatcgctagggatcgctaggagcgatcagatttctgattccctcccttcacctgattttcttttttggcaccacattatttttctattttagtaaatttatacacctaaagtttgtacacctcaagtttacacatctccacaaattttttttaaaaaaacaaaaagttagaaaaatttatgtatagaaatactatatataaaaaaattgaattcaaattcaaattcaaatttgaatcgggtatgtaaacttttaacttataaactttgggtctttagatgtatagaaatactatatatagaaaatatttgaattcaaattcaaatttgaatcggatataattcaaattcaaatttaaaacgggtctataaactttagatgtataaactttagatgcataaaaatactatatatataaaatatttgaattcaaattcaaatttgaaacgggtatgtaaacttttgacttataaactttgggtctataaacaactttaggtgtataaactttagatgtatagaaatactatatataaaaaatatttgaattcaaattcaaatttgaatcggatatataaacttttgactaataaacttttagtctctaaatttaattgtgtaaacatgaggtgtataaactttaggtgtataaatttactaaaatag

SEQ ID NO: 1863 - DNA, 2103 bp, Oryza sativa
acagaatacagacgtacaagtcataggaatatggtccgccgcctcatagtatattagtatatacagaaaacaatgatgtactgctacagatatgctgcaaacaagaatgatattctgatggcaaagactataagatcgaaacaagtacctggaacacctttgccagtataaggttaacctctggtgaagttgactaatgaaaagactggaacctgtaattgcatctgaagcatgaacaaaaaattggtgaagtgtacagtcatcattgagcagtgaaaacagtctaactgtgaggttgcacatgtgcgcgcacacacaagagcaagaaccttgaagtaaagaaaatttctcttatagatgagcgaaatgtaatatacacgatacataggccaaagagagtacaagatgctaatctcccaaaactatacctccaacaagagcaacttaagttctgaccatcaaagcctacaaacccccaggacacctgaagcaaaattacctctcagcatgaaaaacccaacaaaaggtgtaactttaacaacttttttcctatgtcggggataaaaaaaggttttaccagagtataaatagaagccacccgatgtatgtacagtacttggtcattgtaaagaagaacagctttatattcttctttcatgccttccaacaacacaaagtgatttaatggtatccttttgcacctctggattggtacagttccaatctgatcttggcctctggcaacaagctctcaattagcggatcttgcatcatgaacgactgtttggaggcccattcaagaaccgtaaggatctctgcttgcgccaactcctcgctatctgggacgttgtgtgcaatgtaacatacaagggcgagtgctgcaagctgaaccacctgctcactaaaatacacgagctgaacaaggtgcttcgcaccacccgcactgatgatcgctttcgagtgatcaacacgcaggtagttctctgtgcatgcaaacttggtcagggaaagtgctgcctcccgagagacatcagcttccctctcatcaagaagcttcaccaatggcccaatgatccgagtctcagttgcacggaaggttctggacagacagcctaatgagataatgcagggaataaggagatcatcatactcagccttgtcgacaacacgtaagagttggtcaacaacagcacgggcagcaggagaggttggcttaaatgctgaccgtcgcaggtcagaattctgctcagcaacactgcagatttccatgagagccatggcagaattgtattgcacatcaccttcgcctttctcaagtagcaccgcgaagcagagcagagcccttgactcagtgatgctcttgcagatagctgcattgcccttggcaagatgccacagcgccttcgcggcatttgccttcatagatgcctttgtctcagggtcctcaaactccctgcccctcgtagtcgctcctgacaacgatacgttgtgctgcttcgatgcgacgacaccgccattactgaccttaccactgctcccattaggctttgcagccatggtggaatgcaccaaactgtacatctcgttcttgctctgcgaaacgtgtccacctgggtgcctcgtaccgccatgctcccccgcgtccatcaagtccgggatcaacgccccgcgggtgctgttcttcttgtccatcaccacggaatgtatggacatcttggacgacgtcacggcgtacttggagtgctcctgcaccgtctcgaacgcgaggtggccgacgagcagccggatcacgttgtgcgacgcgaaggcgtcctggcacttggggtggttggcggccagctccgagacagcccaggccaccgtggcctgcaccttcatgggtccctccttgagcaccttggcgaaggcggtgcacgccccggcgtggaccatctgctcgacgcactccgggtcgcggccgaggaggccgatggcgagcgcggcgttctcctggccctcgagcttgccctccttgaccagcctgaggagcggggggacgccatcctcctcgatgatgagcttggagtacctgtcattgtcgcgggcgagcgagacgaggctggc

SEQ ID NO: 1864 - DNA, 21996 bp, Oryza sativa
atttggaataggtccctgcttttttttggagcggcgggtactactactacttggggttggggtgcgcgtcgcgtgagctggtggggagagccagcagagccgaggacggcagcagcagcagcagcagcaggcaagcaaaccgcccgcctcgtctcggtgcgtgcgggcgtttcggtcgcttccgcgcgcgatatctgcggtgttttttgggctgggtgcggggggagtcaatggacggtgtggggggtggttggcacggacggaggctgtgcaggctggattggatagttgtagcggcgacttggcgaggggaggggggagcaactgctacgctggttaggtgcggcaccacgtggatgaactcgttttgtatggagccgtgatgtccgtgccggtgatgtgcggttgctggcactctctcctgttttatggggacgtgtaggggccttttggggggggggggggtccaggcacgttccctaccaccatttttgaaaatggaaatgttaattatagagaaaagaaatgatcaaatgaggttgagactacggtagtgttgaaatgattcttatattgtgtgtgaaatatagtcgcatctattaaaacggaagcaaaagttaaatatgtttccttaaaacatcacgcataatataatgcgacatttcatatgtagagcgacatttcatatgtagagcaataaaaaaaaatatgacaatagtataatcctaggaagccatagccaggtagaaaactatagccacacgacacgtctatcaccaaaaaccgcgcgctactaataagatatgaacacgacatcataaaggaaaaagaatcttctaaacagcaccttctacaatatcaagagtgctgccgcgcctatcgtggtttttacctagagcattccatcaaatagtaggaaagatcactcgaattatctatcagagggcaatatctagaaaatgaggctgcagccaagtggacacaacgaggagagtgcagttgtaacggagtaacagacttgttggtcatcccagcactccaattggcttctgatacctccttgtttgctcccaagcacccatcaaggaatggtgacatagtggcgtttgatactgttccttaatcacacacaaaaaaagactcatttcttggacgtatggtcatggacaccacctaaactgccaccatcccggatagcaaggaataccaacaagctgcacaacttcaggggtagcagagcaacatcgttgtcatcgcgcccaattgcaagcttttcttcacggcaaaagaatgcaagtgtcgctttgccagtgtcgtcgtctcgtgcaccaaccgaacagaacgaacacgatatgggaaaaagaaaggcctcaacatggtggtacagcttgtagaaaatgatttttaggctattgttctacaccaaaaatgctcgcaatttttccctcacgaaacaaaagtgctcgcaattttcctagtgttagatcctactggtgttagatcatgtgctcacgcagctgttggtttataacttttttgacttcttgagaagaagaagaaaaaacagctgtttgatttgttcgtgtggtccactttggtgttacaaacttgcaattagtgcgagaatcaggcgacttaacagcaaacggattctgcgtttccaactaaattaaactactgaagtaacccgttatttgctgtctggaagcgagcttgaaatggtcttcatgccaagttgccaacctggtcaatgcagctaaagaaaaatggttactcacatactagtacattgctcccgttcttttctgtaagaagattaagattaagattttcgtaatatattttttaaactgctaaacggtgtgtttcgtgtgaaaactttctatatgaaagttgctctaacatagtaacatatcatattaatctgtttttcaactttgtaataattaaaactcaatcaatcatactttgataccatctcgttttacgtaaaaaacttaacctccatctctcattttcaggagaaaagaacaccaccattgttcgacaggtagtagaatcgcagaatggacttggtcagttgaagatctcctcgctcacatgccactcaccggctgaccaagtagtggtagcctgtcagccacgcacgcgcgcagctgatcgattcctcttgacactgaaccggcggcgccggtgaagatgatggcagcagtagcaaatgtagcagggacagaaatgctaccagggaatcatccaatgttcaggtactgtgggtgtttgatccctgtgaaccgaagaacagctgggagaagaaagttcaggaaatggagaagacgacgagcgatcatatcaatctgtggtcttgcttggttgtttgctgcggcggtggagaagacgacattgccatagcagatgactgaactgtgtgtctgcatagctgaactgctgaaaaaaaataaaagaaattatcggctacagtttctagatgctctcctcatcttgttggttatcggtcgcaaccaaaatttttacttaacttaagagttaattttagtttttttttaatatcgtagtatattttcactcttgaaatttaaaccatcaaggaaatgtaaaagtttcagttttgcttataaattattttttcttccttcatttctctatggcttctactacctttgtcccaatttaagtgcaattataagttttcgtgtttaacgtttggccgcctgttttatttgaaaaaatcatgaaaaaaaataaaaaaaagccacacatgaagtattattcatgttttatcatctaatataaataaaaattaactaatcatggaaaaaatttcaaataagatgcaatacaaaactacacactttttgggatggaggtagtactacctaaaaagggaaatgtaaatatcatagtttaaagggttaattggatccatgccattataattttcacggttttgaaatatgccattactattcacctatttgtaaccataccattataatttcccaagtattggagatatgcctctacataccctttcaatgcattttctaattatttaggaccaaaatacccttgtcttcttccttcctcatccctcctcatcttctcaacgagtctctccttttttttcgccgggctggcaaaacttgccggccaaagtatattaagaaagaaagcgagaatgtatattatttcctaacgccccaagaacagaactccgggagcaaaaaagcagagaaaaagctactaaaaatccctccttaaacagggccgccccaactacagatcactctattggaatcaaccccgcagctgtccaggtctcccattcatccatgatggtcacacatagattgacaggggagcttgctttcccttcaaacacacgcgcattgcgctctttccaaatcaaccaagtcaccaaaatgacacccgcatcaaatacctttctctctttcttagcaacaatcttacgagcatcacaccactaggaggagagatcagcagacggcgttgtttgaaggagaccaaggcgacctctgacaaggccccaaacctcctgagtaaaggaacagctactaaagatgtggtggcatgactcgccgctgattgagcagaggtggcaaattggggcaagatgccagcccctgcgttgaaggttgtcggcagtaaggcaagcgctcttcatcgcacaaaacataaagaatttgcatcgttccgacgcccgggatttccagatgatcttgccaagagcgcagcgagaccgtcccgtggacaaaagtgaataagccgatttgacggagaaagttcccttagagtctggacaccacctcaactcatcgcgcaccccatgatccagctgcactagtgctagaagatcccaaagcgcgaagaactccaggagggcctggacagacaggccgccccgaacgtctcctacccaagaattctcgtgcagcccttccgccaccgattttgtcttgttgcgaacataggagaagagcataagggaacgatttgcgattgagccccctcccgagagccagctatcagtctagaaggatgtttgttcaccattgcccagttgcaccatgcagccagccgcaaagcagtgcgccacttttttgtctattggctacacaaaattaacccagggcctcttaggctagacacggcagagccatggccagcgagttctcaaggcgacgcccatgagacgcaggtccttaatgccgagacccccgttctcgattggtagacagagtttatcccaggccaccaggctgcagctgcccgctgcgttttcatcccctttccataggaagccgcgacatttcttctcaatttccttgattgcccaaactggtagctccagcacagacatgaagtataacggcaacaccatcaacacatgcttgatgattgcgagccgagcgtctagagcgaggagcttcggcttccaactagccagactcttagcaagacgatccatcattggctgcaggtccgcttttcccagcttgcgcactgaaagaggaagtccaagatagacgatggggagcaaccgcaccgggcaccccagcacttcagtcacagccgcaagttgttcgtccgagcaatgtatgggcgtgatggaactttcgcgaagttcgagaccaaaccagttgcatccctcataaacctgagcaaagtgagaatggtcgaagcatcctgagtcgaaggatggaagaaaacgatggcatcatctgcgtatagcaaagcacgcagaggaaacacgccaccagcaagaggcgacagcgcgcccctattggcagcggtagcacacaaagcggcaaaggtctccatgaccagcacaaagagcagcggcgataaagggtcgccctgccttaaacctctcgccaacctgatcctttgtgtgtcacgcccattgatacatacagtagtcgacgaggagacgagaagcacggcaatacagtcgtgccatttaactccaaaaccgagatggcgaaggagctcaagcaggaattcccaggacaccgtgtcgaacgcctttgcaatgtcgagcttgagtaggatagcagggcatttcgcacggtgaagcctctgcactaccccctggacataaaggaaattctcctagatcctcctcatcttgataaaggccgactgagccgggccaacgagatcgcctatgcgagcagcaagcctagtggccaagactttagtgaacagcttgatgaaactgtggattagactaattggcctatagtcggccagctgcattgggtcttccttcttggggagcaagataatggacgccgtgttgagaaggtgaaggtgttgcgagttcgcgttcaacaccaggttcagcgccgccaccacatcctccttcacaatttcccaacatctcttgtagaaggctgcgccgaacccatccggccccggtgcgcggtcactcagcatttctagcatgactttcttggcttcatcctccaaaatctcaatttccagctcagagagatcaagggtagggagaccaaggcgtcctaggtcgagcgccaccattggtggcgagggcgagcccataatttcgaggaagtagtcatgagccatagccaatttgtcctcctctgtcaccccccaaactccgccttgctgcagcacaggaattgtcttctttcttcttctcgcgttgatcttcaagtagaagaattgggaggctgtcccactgtgcttgagatatcgcaggcgtgcccgctgccgcagccgaatgcgctccagcgccgcgagcgccaaacaccggcctttgagtgccgcacgcaaagaacgctcctcgtgggacagcagacgcaagtccatagcaccgtctagtcttagaattatctcatgcgccatcgcaagttgcaaacgcaactcgctaatacgacgctcaccccatgacttcagcgccatcgccgtcgctcgtagcttgaagtggagggaacttagggcgtttgaaccagctggcaccacatcccacgccgaccggaccacctcctcgaagccttccagatgaagccagaaagcttcaaacttgaagcgtcgcgatctgtgcaccatcgcctcacaagccagcagaagggggcaatggtcagaggccgacgagctgagcgcctgcagatgtgcgtcacggaagaagtcctcccaatcagcattcatcaagactttattgatcttggtaatggttggtcgttcttgctcactactccatgtgtagcgtcggccgaacaagtagagctcacggagctccaaagtgttcaacagacccctgaaccgattaatcaagcctctattgacattgccattgttcttgtccgactctgctgccaggaggttgaaatcacccacaatgcaccaggccccctgcacgcactgttgccccacccaggttagctcctccaggaactgaattttctgctcggtctcctggggtccatagacatttgtcaacgtccatgacgcacccccttccagattggtcacacacagcgagagcgaccatacccctttatgaagacaactcatattgaaacgatcactgcgccaggcagtgaacaacccccctctagttccctcagcagggatgaactcaaaaccatctaaaaaagagccacaagattgaacaacaagctgtcgatcaagcacggccagctttgactcttgacaacaaaagatagaagcgcgggaggatctaaccatctccgctacaagaggccttttaccagcattattcaggcctctgactttccacaccaaaagagaacacgacattgaaacaggggcttcaaagcgcaagcggagaaacagggcttcagcaaacctcgacgctctgaggagacgacagcctgacgttgcacagtgccgccaaggcttgcacatgggccggcacaagaggggacttgaagagctccaagtatttgaggatgtcagtgtcttccaccttgctctcgtcttcaaccaccctgagcttcttcatgagcacacgctgggctttggacaccgagtgctggtgtcgcccgccattaatggcggccagcctttcgctgcgtcttggagtgtgggagtatggctcaatccgccgtttggatcgagctggtgtcgcctgcggacgcgtgccgatgatcgccgctggctggggtgccacaaggtcacccagcgatggaactgcctcacccggagagagagacgcggcggccgctgggaacgcagcgctgggaagcgccagggagccatcaatgacctgcgaggtccgctccgagtgggccagggaaagcggcacccctggcgagccgtcctgagtaaggcccaaagcggcccgatgggtaggccacttgcggcctgaggttgggaggaggtggcgtttgcggtagactatttgtgggctggcgacgtgcacctcgggccacggcccaagaaccatctccagcgcccctgtagaaaggggaaccgattcccgctcaccgggcggattgaacgtgaggttcgcgccctccacaactgccagcggcgccacagccggaagaggtggcgacgatgtaaatgccactgaactcagcaaatctctggcgggttcttcgaaggatatttgcctggcaagccccacacccagggactcccttacatgtgggtccaccactagttttgctggcgctgatgctgggcgagttaatgagcccggccccatcacgaccgtctcgatggagatcagcacctcgtttggtgacgcgtgctcgaccggtgctcccaagatggtgaccgtttcaggcccttccggtgcgagcatcggtgacgagaccacgtcggagatgacatccacctccaaaccgccgagggccgtgcccggcggggatcccagagatgccaaggacgccatcgcttccggtgtgtgctcgggcggagagcccaaggcggaggccggctccatctcgactggcgttggctccggcggggaaagaaccacctgaacggaatcgcaaggacgatccagaactgctcccgagatatccgtcgacggtgccgacggtgtgacggctagcaaatgcggccccctagacgtggctcaaggggccgctgtcgttggagacccccagccgttcccgacctcggccccgcgaaacaatgaccaccgcccagaggctaaccgggccggtgccatcgatcctgccgaggaaggtgccgtaggcgcacctgcgcagagcctcgcgatcgtcgttgtaggggtcatcgggggggctgtccagcagctgctgaactgggtcaaccacttccaggacatggatcagcaggtcaaacgagaggcacctcttctctatcgggggcgccggcggtgtctgcgagactagcggctcgtgtatgtcagggtcctccatcaccggcggcatccaccattcttgcatcggctccggaatgtcgagggtgaattccttgggaattttggacgggtccaccgaccaggccagcacctccgtcatgcatgcgtcgactggcaagaacagttcgatgaactggcagtcaatcttgttgaggaactgcttgatggcttcaaactccaatgcatgcgctgggagcccctccacggccagcttgacgacaaacaggagcttggacctccgagcatgaactgagcggtgccaatgacggaaggagatcgacgccccctccacgctgaacctgccggaccaccccaggacggatgcgcagtcctcctcacgccgaaaggagatgaggaagtccgagggcctggtgacctcgatgcgaacatcttccgagggaaccctgcagcgacgccccaaagctgcgaccaccatcgccggcgagacctcccttctcccggacagcaccgacgtgaccagcgcacgcttcctcatctgctgctcaatcgcggccatcccaggggtccaggacaggactccacggcccccctgcggccgcaagaggggggtctccagctccaatgtcttcctccatcggcttggtactgacggacttaaccggggcgggcgggggcaacgcagtagggggtagcgccgtcttgctatgcaccggctgaggatgctccttgtcacctgggacagaagcgctggtgctggcggccaaatgctggggacgcttgggcgccgcagccgccggcactttccgaggaagggtggcgtcgatgtcgaccttgcagttgcgctcgatatgacctggataccagcaacgatagcaagttgggggttgactgcaggaagccttaaggtgccccagacctaggcagcgaaagcatctgccgtggagccaacgcggaatcggacggggctccggcggagtaaatgcggtggttggccgaccggcagcagaagagcctttactcctgcgcctcaccacacgccaccccgcgtcgacttcctcctgcgacagggacggacgaggagcaggcggggaccagacgacatccgcccaagatgcagcagaaagcgcaggggccttatctgggcaacggccatcggagcgagcggccgccggacgaggagttggtaggtggttggtcgccgaggctctcgcactctctcttatctctctgtcaccaccgagtctctccttttcaccgatctgtacaccggtgggctttgcctgctggtctcatctagctctaccagcgatggtgtcatgcagtgattctttcagcatgttcctgttcaagagggccaacagtgttgttgatgaatctgcaaaggtgatgcagaggaccattttttgtcctcatggcgtctgatctggtggaaattggaatggggaaggtgagggagcgatgatgccaacatgtatggcccggcgaggtggcccaagcggcgcgatgcaagcttgctgcaggtagctcgttggctggaagatgacaaacggggaaaggaagaagaagggggatgaatgaagaagacatgggtattttagtcctaaaatattagaaaatgcattgaaagggtatgtagtggcatatttttaacacttgataaattacaatggtatggttaaaaataggtgaatactaatggcatatttcaaaaccgtaaaaattattagggttaattggatccatgccactacagcgttgccaaattgaaaaaataccactactattcgtcatatcggctgggtgccactgtaattttgagaaattggatccataccactcagttgcgtttttcatccactcctgttgacgccgtctctccgcgtccgaggaccaaggacacctgctgaaaaaaatcagagaggaaaacaaaggaaaaggaaaaaaaatgaaatagctgctacggccgtgtttaagccccgtttagttcccaaaaagtttttcccaaaaacatcacatcgaatttttggacacatgcatagagcattaaatatagattaaaagaaaaactaattgcacagttagggaggaaatcgcaagacgaatctttttaggctaattagtccatgattagccacaagtgctacagtaatccacatttgctaatggcggagtaattaggctcaaaagattcgtctcgcggtttccaggcgagttatgaaattagttttttcatttgtgtctaaaaaccccttccgacattcggttaaacgtccgatgtgacattcaaaaattttcatttcgcgaactaaacatgccctgtttcccccctatttccaactttccgtcacatcatatcacatcaaaaactttcctacacatatagggtgtgtttggttgggcttttcaacctgcttttgcttttgcaaaagccaaaagccaaccaaagggctcaaaagccacagctgcttttacccaaagccagcttttggtgtagtacaaatcaaaagcagccctcccccatgctttcagctgcttttgggggaaaaaaattacccaccactgccattacacaaaaacaaattgcgtgttccttttcttttctcccatcggcatcgctcctccttctcactttgccgtcgccgccgctcctccgcgccccaccgccgccgctcctcctcgccgagacgctgccgtcgtcgctcctcctcgccgagacgccgccaccgcagctcctcctcgccgacacgccgccgccgccgccacccctctcgtcgcctccgctcctccttgccccgtcgccgccgcacctcctcgctgagatgccaccgctgccgctcctcctcaacgagccgccgtcgccgccgccgccgctgccgccgcccctctcgtcccgcgccggcccagatccgccgacgaggaggtgagggaggagaaagaggagtacgaaggggaggaggaggagatggacggcgaggtgccggtgtccccgccgcccgccgtcgaggccgactccaccgccgcccgcgtctacctcccctccggcgccaccaccgctgccaccgaggccgatgacgccgtgcgcactgccgctccccgccgccgctcgaggccgacgacgccaccgaggcctactccgccgcccaacccgacgccggcgccactcttgcccttccccgaccggcgccgcccgacgccgtccccgcccatccctaaccgacgccggccaacccgacgccagcgccgctcccgtcctttcccgaccggcgcctcctcctcccggcgccgccgccccttcgttcgccggccgtggaggaggcgcgtcctccttgccgagccgccgccgccgccgaggccgatgacgccgccgccgctgccatctccatctctccccttattttctttcgacgagtgtatggcatgtggggcccgcttgtcagcgggactagttatttcaaaagccacagctgttgaaccaaacgagctttttcaaaagccacagtccatatttcacagctacttttcaaaaagccacagcccacagctactttttcaaaagccacagctcaaccaaacacaccctcaactttttttccaaactctcaaatttctttaaccttccaactttttttaggaactaaacacacctacgatgagcagccagcatgtagtggcgttgccatccatgagcaccgcccgagcagactacccatcaacgactgctggccatcccatccgtccctgatcgcacagagctcgctggtcatcaccatcacgtcttatagaaccgcttctgcttcttggacggtgaacgccgggttggggaacatcaccatcttcttggcccatggccagttcctggggaaaaaccagattcgcagataccgatggccgctcgagcgacgaggagggcttgaacaggatgcgggactgttgttgcttgctccgtcgcttgggcgtccacgacggcattgcgcgccgccgctacttgccattgcggacctcgcgcgcgcggacgcctccgcgccggtgacaaggaggagcaggagaaggcgccggtgccgcccgtcgccgtcgccaagctatccagccgcggaagcgcccgccacctccagccaaggcgccggaagccccaccggaaaccaagcccaagatttctccggcgccgagctccctcgccgtcgccgccaccaagctccttcgtcgccgccgccaagctcccggatgaggatgaaaatggagacgctgtgagagatgagatggaaaaagtgacgggagtgccatggttctgatttttgaaattttcaagggttaattagatccatgccattaaaattttgcctgttttgaaatataccattaatatttgcgtatttgtaatgatgctattgctacttgtttctaatcttagtggtgccactgagatacgtattttgcatgtattggacaaaaatgccctcatcttctacctctctccctcttccccatcttctaccctctctatcttctcactgcgccgccatcccgccgccgcgtgctgcagcagcggggcgcgcgctgcagcttgctccaccgctgtgtcgctgctgctgccaccgcagctgctgcgccgccgcgcgccgccgctgcagctgctgccgtcgagccacatcgcgccgccgccgctgccgccaccgagccgcgtcgctccgccaccgctgcaactactgccgccgagccacgtcgcgccgccgccgctgctgtgccgccgcgccgccgtcgccgcgtcgcgtcgctccagccgccgccgtcgagccgtgtcgcccctgagaaggaagagaggagggaagagaaaggggaagaaggaagaagggggaaaggggtagtttggtccaattttatctgaaaatacatccaaggggtaagtggtatcttttggatatgtgtgaaattataatgacatatttccaaatacatgaataccttttaataacatgtatctaattaacccaatttccaacggcacccagctgatatgacgaatagtagtggtatttttttaatttgtcgaagttgcagtagtatgatccaattaaaccaaattataatggcatagatctgtgcacaaatgaaggagtgacagatcttagccttggtttttccatcggacggtgggcgtgaggcgtgagtggtggtgcgcctgtccgccccgggcagtcgcctctcgccggcggcgggcttggacggccggagataggccgcaaactcgcgaaggcgcctccgtcgcggcggcagaagcgggtggcgtcctgtcggtggtcggcgtccgggtggggggttgggggaaccctcgcggtcgcggcggcggggatggtgaagatagtgacgtacaacgtgaacgggctgcggccgcgggtggcgcagcatggctcgctccgccgcctcctcgacgccctcgacgccgacatcatctgcttccaggtccgctcaatcgctcaccccctgcctccccaccgcactccgcagcactggccgatgcctcgcaatctcatcatgtatataaaccctagctgtttgatggggtactacttcagtgattcactcactgtaggtcaccacaaatgatgtaatcgatcgcactgttatgttcagcaatacgcaaatgtgctaaattagcattgtgttgccatagccgcttgatttcatagagattcagaacgcgtaccgtttgtttatttatctctgaactgataaatgagcattgttctgtggtggaagctgcacatttgctgttaaatgtttagtcacgccaacacgtgcagtttctgtatgaactatgaagtaagttaagcccgcgattcagcagagctgactaaattaatgtgatgtatttcaggagacaaaattgtcgaggcaggacttgtcgggggatgtcatcatggctgagggatacgaggcttttatttcatgcaatcgttcatcgaaagggcgtggagcttactctggtgagtttttctggagattaaccaggaaatacccatcgactgatttggggtgggggtcttttagcaacgcactattagttgaagttgcttttcaatcattcaatctattggttaatttactttgaatgttgtgtcacgaagtgtaagtttctgtacttaactctattgtaggtgttgccacgttttgccgggtaacatcagccttttccagtcaagaggttgctttaccagtagcagctgaggaaggctttactggattgcaagagactgcaaagaacagtgaaactattggggattttgttcttgtaactcctgtggaagaggaaggtcttggtgaagtaacaaaagaagagctgctcaaggtggacaatgaaggacgttgtgtaattacagatcatggacattttggttggtctcttgttctgtccccttgaaatatagacagcataagtagcattcagcatgttgatgtttattcgttgcacatttgatttcttctctttatttgatgatatttactgcaccatttctgcagttctttttaatatatatggcccagctgttgaagaagatgatatagaacgagttcgctttaagctactattttacaagatactacaggtacttcatgtgcatctcagtcagtcagtaaattttggaggaatagtttcacgattgattgatttctgccaatgataatagcttgtttacttactctgattttatttctttttagtgcaaaatgtgcacccctcctgtgtcttccttaaataactgttaatagcttagttaaaggactgttatttatactgtcttcatctcatatcttctagagaagatgggaacatttgttggctcttgggaaaagagttttcgttgttggtgatttgaatattgcaccttcttcaatagataggtgtgatgcccaacctggattcgagaagcaaacgtaagctcatttccttttcctttttagtaagatttacttggaccgttttggaatctcaagtcaaagttttgctgaacttgcatgattttaagacatgaaaataaactgaataacctcagcactattactaaatatatcaattcgtttcataggaaaattccatttaacatgatctggtgatacttttctctgtaagaacaatctgctgttgagggctgtcaaggtcagtgaggcaacatcatatgagaagcaaaactttagcatttcaagtgaagttccatgcacaggccacgtgaacttagagctgcttctgctttcacctataatgacgtaatgcatcttgcagcactaaggctgaaagttcagtagaaattgttgataagtgaagcttgaaattttttgaacttgaccttccacttgtgatgagttcgctagtctgatgatgtgcttgataatacatcaatcatttattttatcctctctttagagtactctaacatgaagccacttgggaatgacaaattacttcattaccctttccctaattcaaggtttcggaaatggttgagatccatgctgagagaacatggaggtccattttttgatgctttccgatcaaaacaccctgaaaggtattgaaagctctctttctttgttccatgcttgtgtgcttatccaacctattttagtttttgttataattccagttactccatgcctacagggtaggtgtgtatttccctgttaatgttaatcaattttttctgaaacttaagacctactctgtatgcggcccattattgaggcttagaaagcatgccttgaatttgttaaatggaacaaatatttatcttttctctttataagattaacaactatagcagacacagaattacttgctaaccatgtaccttgatattctaaccttgctgctttttcttatgcagagtgggagcttatacctgttttaatcaaaaagttggagctgaagtatacaattatggttctagaattgatcacattctcatttctggtgcctgcttccatcactgcggttctgtggatgaccacagcatctttccctgccatgtggaagaatgtgaaattatggatcatttcagaagagggaatagcgaaaatatgtcaatgtatagaatggtcgaaagttttctttgcaggatttgcagtgacacattagaattatttactatattacattgtccacaggtggaaaggagggagaagtagtaagctagaaggatcagatcatattccagtttatattgtgctgaatgagatacctgaacttccagttcataacactccttcatcagctgctagatatcttcctgaaatccgtggacggcaacagagcataggtgagcaaccttttgtgttcctacttaagtaatataggcttttaatgtttattatagcattatagcatataacttgtgaaggcagccgctcctggccttatttgatagtttagttatgagtacatacttgcgtgcatattgaagtaatactgtttgtgtgcgcattatgctgaccaattgtattttccaacatgcagtatcattcctaaggaaaggcatgatttatgaacataaagatgccatgtccatggatagagcagatgaaagctgctgtggtggtggcttggaaaggaaagctatatataaggaagaaccaccaactgatatagccaaattttccaaaggtaacgaccttcatagtgtcatcaagcggaaaattcgtgatcaattgttaaatgaaggttcaagtggcaactcccataatagcactgcagcattactggcaacacaaagtagaaaagcttccttttcttgcagcaaggctgtgtccaacaagaaaaacaaacataacttgtcttcccaacctacgatcaagtcattttttcaacaaccaaagtcaaagccaggagatagcagtaccaatagcatagttactccaccagatactttgcatggtatggatgaattacatgatccaaagaatgactgtctgccagaaagcatccagtgtacaactccagcaaccgaagatcagggtaactcagatgtaccctgctcgctttcaacagataaatgcaatgaagcaacactggagtggcaaagaatacagcagagaatgaagatgaccctaccactttgcaaaggacaccatgaaccttgcattccaaggtctgtgaagaaaggctctaatattggtcgcctattctatgtctgtgcccgtgctcaggtatttaacttcagaatcaactgctcaattcacatccgaggaacaatcataaaggtagttcatattgacagaggatgaaaagcattggcattgtgctgtaaccaccatgtattgtctatgacagggacctgcatcaaaccaagaagcaaattgtggtcactttcagtgggccactgttaagtctaaagagaaacgccggtgactaatttctcttttatcgcataggtgtaacactcactgtaagtatttacttccatactgtacgtggtggtgctattattgggcaattttatttgtttaagtgctaacttctgtttttttccccaagtagcctggacatgtgtgtgtcacttgtttctatacacatgaaatgctgatgttcttctcgggagcaagctggtatttgagtcagcaactcggcattaatctctagttatgcattacgcaggtacataatttaattttgtgtttaatttagatggctaccatggcctcctttgttgtttacatatgttatattgtttggtcaaatgccaccttgtagctttctcgtagttttgttttctcgggtttggctagcttatgtttgcaactacccttggatgtattaattgaaaaactagctgagaagcatgaaaagaaatcaagtgaagtaaattgtgtactagcagtatattgttctgttcccactatgagaattaggcacttgaatcgtgtttctgttttctaaaaaaatgtggcctcactgagcataatttgtggcattttgttgctggtcaatttttgcccttgcacgtttgcacctatgttgttctgagctctttgggtaacacgggtctatatttgagacttgagaggatctttgggcctcttgccgatttggcccttgaggatatggctcgaaatcgaatattgtagggcattatgctagtccatgccctcatggaaagcatgatatacttgctcttacttgaataacataacaccaagcaaccaactatcgttgcatgattcatagggtttttttattatgtacgcccaacgagcatctcgtttggagcaactgaaatggatattgaattgcttctgaaacgaagcaccggctttcagttgaacttctgcaagcttcagttaacttgaaatccagttctgttctaggttaaaaataaaacacgcttaattgcagaacatgttgaaaggcttgaagctcatgtggctcaccgtgcattgtccttcgttttcgtccttttaagagcaatcgatggatggagaaaacgtacaaatccacgtgttacatggtgaataccggatagggatcgttcctattcagctagtactatattattggagagtttactataggcagctgaccgagggaaccttgacagcaaagctcccatttgtctgtagtgtgattcccgtggtaatttatcttgcaacctgaacctaaaatagaaaagtatcatgtgtaaaagatgctaattgagatgcccttggacttagagactcatcacatcctgattctattgtacagcctgccagtagaccacaataccacatggctattgcaagtttgtaacactttcacctttctctgctagtaggtgcttctgctgctgcatctctgcaatcaatcaatctatggcttgtaaatctgaatcaattaaaagctccaaccttttcccccgacatgccattccatgagcgcctggaaccttcatcttcaattcaccatgacatgttgacattataatacggcatccaaccatacaacgcaacaccatatatgacccacctcactcacctatcattgtcctcgtggcccctttcccctcactatcccgccataaaaaccatcactccctatgagtaaagaactccaaaaacgttcttgtccttagaaaaaaaaatcttgtttggccagccacacctaacgccagttcaaccaagaactcggctttgcctctgttcctccttccgagtcccaatcggaatagatcgatatcatctcctctcatctcatcttaattatctctcccatgtgtccctagacatatagtccatgcactaatcgatcgatatatctatatagttttcgagagatattttgctggttgcaattagtctcgagcttacagcgaccttccaggtcagaggtagccggattaaatccttggtttatttatagtgcttgatcgatcatgtcgtcttcctccaatagcgactccggcaagaagggcggcaaccctctggaagccatgggcgccttcttctcgtcgcaggtgaaccgccggaagctggtcaccagcgagaagcaggcgctggccacgcggctgtccgccggcggcgaggcgttccccggcagcgagcaccggccggccgaccggaagacgtggatggcggagctcgggccggagcggctgcgcgtgcaccagctggtgtggccggggacgcacgactcggcgacgaacaagatcggcatcccgttcgtgacgcgccccttcgcgcagtgccagtcgctgtcggtgtacgagcagctcgccgcgggcgcccgcgtcatcgacgtgcgcgtccaggaggagcggcgcgtctgccacggcgtgctcgcaacctactcagtcgacgtcgtgctcgacgacgtgaggaggttcctcggcgaaacggcgtcggaggtggtgatcctcgaggtgcgcaccgagttcggccacgacgacccgccggagttcggcaggtacctggtggagcagctcggcgagcacctgatcccgcaggacgaggcggtgttccacaagaccatcgccgagctcctcccgcggcggctcatctgcgtgtggaagccgcgcaagtcgccggcgcccaagcccggcgagccgctgtggagcgccggctacctcagggacaactggatcgacaccgacctgccggagaccaagttcgagagcaacgtcaagttcctcggcgagcagccgccggtggccgaccggaggttcttctaccgggtggagaacacggtgacgccgcaggccgacaacccggtgctctgcgtccggccggtcacgcggcggatccacggctacgcccgcctcttcatcgccgaggtcttcgccaagggcctcggcgacaagctgcaggtgttctccaccgacttcatcgacggcgacttcgtcgacgcctgcgccggcgtcaccaaggcccgcgtcgacggcgccgcgtgagattgcatggccgggccctgtagtaattagaggggtcgccgcgtttagaggatttgcttcgtttcgccggtgtcgcagcgtacgtacagattagtttgtgttgttcgtgttagacacgtgatttatgaatgatttattatcatgcatgtgttgggcgttcgtgtgtgatttaattgttgaaatgtatatagtggtgaaattgctcgtgtacaaaggaataatcgcaaagtgctcgttttgttgtgatcgttcgtaacgagggtaatggagaggatcaaattggtatttgattgtgttccctctatttctttttgtgcgttagatgaatgaattaattcgttaatgttacttcgagttggagacggttttgaattatttatgtttaccagtaacttatatgaacctgcgttataatagagcttcatgtgaaccatgaaaatggatagttttcctttttaccgctaagatcatgtgacttaacagaaaatcttaataactcattgtaccgcgtttcgaaaaaagaatatcaatcagcaatgaattgataaaacgggagggttttatctcgcttattggactataagccccaattgtcctaatcaacaaatcaattgaaactgtttttaaagtagaaatcaaagagtacacatgctctctttatccatggtgaccgcgacatgtcaactaacacgactgaatccaaaataaaataaaaaaaatacaggtcagcactatctgaatttgctgggattccagaaggtccagttacatagcctacaatagcccacttatttctgaaggcttcagttctgtttacttgggccgacactatgtacaggccttgcttgtgtctattcacatgggcctcagactaactaatcatgcaataagttcatctaagatcccttaacttgtcaacaaatctgattttcgtccctcaaccagaaaaccatacacaacgggtccctcaactattaaaaccggtgcagatgaggtccctcagcggttttggatgacgtggagcctacgtggttaatttaactcggtcttcatctgacgtggcgctgatgtggcgcttacgttgcaattcaatccggaaaaataataaaactcgtgggacccacatgtcagtttcacacataaattaataaaaatggtggggcccacgtgggccccacatgtcattctcacccctcttct

SEQ ID NO: 1865 - DNA, 14659 bp, Oryza sativa
tgggcgtaagaggaaggggcggtgggagttggccctagctgcggcagacggcaggacaggagctgcacaaccgaggccccgccggcgccgactccttcttgatgtcgccggcgccgccaaggctgaggaggtggacgcggtggtggtggaggaggaggaggaccgcggcgcggcgcggttccatgagcggaggctggtggtggtgtttgtgctgccatcccagccgatgtgcgccacgtgctggcggtggtggtccgccgcgccgccaccctcgccgccgccgcctagacacgcacacagcatcactaataccaaactcctaaatcaccccacaaaaaacaatcgacaagatcgagcagaagtgaagaataagcatccaagactccaaacaacgaaccttggggcttcttgccgctcttgccgcctccatcgacgacgtccacgctggatccattgcggcaggtggaggagaagaggatcacgatgaaccggtccatccgccgctgctccttgccactattgctcatggctagctagccactgctagctaagctgatactatcttggaatcaaatcgcttgccgctttggctgaacctgtactggtatgggggtcttgacccttgctcaaaaaaaaaatcttggaatcaaatcaatgtctgctcctcgccggcgtgcgctgcgatagcggccagatgctgagggacgggagcagcacctccgcggccttggcgactggtgccgcgggagcggcggcggagcctctctccgcggccgatgcatgctggctcccctcggcagcggcggcggctctgggggcgtcctccgccatggctgcgggtaagtgggagagggagggatctatggcgtggagagaggagagaccgagagagagaaaagaagctccgccgccccttcctcttccgcccacagccgccggagccatgcctccgctgccgcgccgctccctcctctcccgccggccgccatgccccactgcctctccgttgcgcctggagagaggatatgggagagagatggagggaaatggggagagagagaggaggaagaagagggatgagaatgacaagtgggcccactttttttttattattttgtgtgtggaattgacatgtgggtcccatgggttttattattttttccggatcaaattgctcgacgtaggtgccacgtcagccaaaaccgcctccaaaaccgccgagtgacgttatctgcaccggttttgatagctgagagacccgttgtgtctggttttttggttgagggacgaaaatcggattcgttgataagttaagggacctcagatgaacttattccactaatcatcgactgcatggacatgggcttggaagaaaagttgggcttacagaacataggcccggttggtttcttctcacgtgcagtgctgagtgctctagccagctcggaaggtttggcgtactgctggattgcatggtgcgaaacgatatgaatttttgttggccttggcaacccaaattcagcgggcgcgttgctgtagagtgtagagttgtattgcacggttcaaatccatcgaacgtctgtattccggagataatgcctatcgacagctttgtgcagatggagaccagttggcaacagaaagacaaatttgcactggagtagtaaccagtacacaccgaactgcatgcacgccaaattgtccaggcttcttcgttcacacgattcttcgttcacgaacgcaataataaccatggagtacaagctcggatgtgttggtaatgctacgtgtttcaaatcaaaggcctgctgtagttttcaattttttttttctaaaaacatcacatcaaatctttaaacacatgcatcgagcattaaatatagataaaaacataaactaattatacagtttgcataaaaatcacgagatgaatcttttaagcctaattagttcatgattagccataaatgctacagtaatccacatttgctaattacggtttaattaggctcaaaagattcgtctcgcggttttcagatgaattgtaaaattaaattttttattcgtatccgaaaaccccatccaaaaattttcttttcgcgggtagtgttcgatcgccccatgcgatttccctgagatttccagagtcaccacatttaggaaccgagatacactgacagtgatgcgatcgaaaaaaaaaattcaacgcagaattgcaatgcacagcgctgggctggctgctacctctccccaacctacctagagatgcacgcaccgtattactccccccagcccagcacgcagattggttacctcctcgacgcctcgcgtcggctgacgcctgacagctagccaccatccagccagccaacgcgacttcgcgggcgattgcgcattcgcggcgcggcctcgcgcacggaagaaacagcccaaacaaacagctagtatctcgcccatctccccgcgtccgcgtgcacgctgcggcgtacgtcgcgtgcgcacacgggaatttcccttccgctacacaggcgcgacgacgaattgaagcatccgcgcggtccacttccccgtttgttgcttcccccacctggccatgcacgcgtgccgcgtacggtgcgcgcgcgcgctacagcctcgttaaaacccgcgtcgttctcacacacacttccaccatctccatcagtgtgcaccaccacgagagcggtggctatgcagccatgcgggcgccgtctcctcggcgccggcaccgcctcgccgccgccgctgccgggcttgggttcggcttcggcccactcgatggaccgcgcgcagcgggcgcacatggtgcgggcgctgggggtgaccaccacggtgctcttcgtcgccagcgtctcctacatcgcgctcaccgcgctctacgcctgcttctgcgacggcggcgggcggcgacggcgagaagacggcgggtcgtcgtcggtgcgccccgagccgtccgaggagaccaagcgcgcgctcgacgggatcccggtgcacgtggtccagatgccgccccgcgacggcggcggcggcggcgccgacgaggagggcggcagcggcgactgcgcggtgtgcctggcggagtacgccgccggggacgaggtgcgcgtgctgccggcgtgcgggcatgggttccacagggagtgcgtcgaccggtggctgctcacgcgcgcgcccacctgccccgtctgccgcgcacccgtcgtcgcgcgcgtcgagggcccggacgacgacgccaaggaggattactgcggcgacggcgagagcgtcgagaggcacggcggcggcggcggcgacattggcttcctgtccgtcgccggcgagtcccgcgtgcttcctgcgatttgattttgctacgagtactcatcagctgtaatagggtacttagtaggtgtttagctcaattttgctagctgtggacaaacgtagcttagtaggatgattcgagtttgtttattggcgagagcaataacgatcatacgagtagtttcactttcagggttacaagttcatgtgcgatcaatctggttatttagttattataccttcttaaaatttctgacctgaatttgtaggaagtactgtagtatgcttgttttgcttcatactcctagctagtaaccactgattgttatggttttcagcaatctgcaatcatcgtcagagtctcagacattcagacatcagtcacctgcacaagaaatctttcgtacatacaccgtcgtcagcctacaacaaagtagaaaaatttgcagagagaaatcagtggcagagaatgttaacaatgtttaggtctgtgatttgcagacaaacaacgtgcggtcgagaaccaagcggatggagtccagcacatcatcggtcgacattcctcacaactgaattagcttagctagctactgtaggacaccgttcgttacttcagcatcaaattcagcaacagtgcaacaccttgtagaattcagaaaatatgacctgtctgttgtttttttttttaaaaggaacatctgttggtttgataaaacttgaggattttcatttcattaacagggatatacatagtacatttgcaagaacacaaaacattattataatccctacttacactctggcaacaacaacaatgtcacacaaattgtctttctacgaacatgacatgctttcttgctacaaatttgacaaatcactgacaaggaaagaaacaccataaaaatcttcaagaaagggggtaaaatttagaagccaaatccaagtgcaatcagtagagaaaccaagccggaggtgacgacgacggcggcgtgcgctcctcttggccgctcgccggagctgtcctccaatggctgccccgcgccgttcagcacctggtgctgtccaaacgcgccctgctgctgcccctgccccccgatcgggagcccccccgccgccgcgccatggccagcgctcggcgccagcgcgtccggcaccgcggcggcctccggcggcggcgacgctcccagtggcaggtggtgcggcgaaccgtgctgctgcggcatgccgccgccggcgggcgcagcaggcgggagtgctatgccacctggtgcgccggaaggtgtcttgccgtgcggcaatggcggggagagagcaggcacgtcgacgggtggcaatggcgtgtgaggaacaaatgccgtcggagccggcggtggcgacgagtacagcggctggtcaggagagacagggtacgtgtcggccggcggtggtggtggcagcggcaagtccggcgtggcgggtgtcgcgtcagctggcggcggcggcagcaatggctggtcaggcatagtgtcaaccggtggctggtcgggcgaggcgggcagcgacgtgtcaaccggtggcgcgagctggtctccgaaagacaggtccgagctcccggcgccggcgagggtcgacgccggcggcgtcagaagcttcgctgtggttgtggtcgacggcggcgggagcacgtccatcgtcggcgacggcgagaccggcgcggccgcgccgcactgctgccccgtccacggctcgccgctcgcctgccacaccgacacgccgtccttgctcacgatcctcatgtcgccgccgtcgtcaaggctcagcgttcccggctcggcgtcgatcccggtgtcccagagagagtgcccgccggcgaagagctcgagccccaccggcgagaacgccaggtcgcacgcgtcggcgccgccgacaagggtgcactccgactcccacacgctgccaccaccgccggcgccgccgccagcctgctggatttggacgtagcacgcgtcggcgcccgggccaccggcggagctgtccacggcgcggcggaggtacgcggcgtacgacccagacggcgaggtgaggaaaggctgcgcgctctggccgacgtccacggcgggcgcgacggtggcgatcacctgctgctcggtggttcttgatatgtagcttttgggagaggcggccatggcggcggcgagccgcatcacgagcaggaggacagcaagtgaagaagacatggtgaaaatggtggtgaggtgtgaggagcttggcaatggagggggtagggttttaatggaggcaagaggaggatttggtgcagcttttttgtggagcaactctcaggtgtagtggtagtaggagaaaggtgtgcattgcatggagatggatggagtagagggaatctgaagttttaatccaagattaattagcccaagtttcagttagagattgtagtgtagttggggtcatttggtcatgttcatttgttcaacagatccaacaggttgcattaggtggaatgcagccaaactttttcagtctgtactctgtctaacactctaattcaggataactttgttaataggtattgataccttcccaaaaaataaatggaaaactactggttatatcagttcaaaagggacgtactactactactcaagttatgtattgtgattttcttcgcatttcagaagagtagaatgtccatgaacagttaaatgagaaaaaaaagacagcgtgcactaaatcacatatcatcgaaatgtgaatacactataactaaacacatgcgtaagctatttgaaaccatacacatctcaagagaagataatctgaaatgcaatctcccatactcccacgcaaacggatatccaaaacgagtatgaaaacattcacagctagttgatttgaacattagttcagttacatggaattggcgttccacaaaatggtaaaaagcatacagttagagtgtgaattctttccaaacactaatgatctttggcacaaccgtacaattactgtaataactgttgcagaaatccaaagtagaaacatgcgcaggttcaaggctctcaatttctgctgtatattattatgatttttaatctccatggatcgtgtaacgctcccacttcttggtaggatcatagatctgcaagacaggctagttgttactccaaagaatatctatgccttgtacaagaatgaaaggataaaaaggtgaatgtccaacctcccatcttgatgcaggaaatatatgtttgtttttctcataccagtgtctctctacgacttttcccgcatgagactacagtcataaagcatgaggtagaaacttagaatgcaacattgggaactacaaatacaagatatcggtagacatgttacctcgtccttttcttttgttgcatcagcaatggtccgcacatcctcatgaacatcaaagtggaaaagctgagaaagaaaggacagaaaaacaagtgtcagcaaatgattaactcaggtcatcaatattcgtctggacaaacagaaaaatatcctgtccgcagaagaaccgaagttctatgttgtgacatccatgtcttaaaataaagtgattatacatatgaatgaattatatataagctatcaacatattttatcaaaacaaataccacaggagtactaacaaatcatgcattaccggtccactcttgccccttgctttgttgataatcaactcatagaagctatgttgctgttaccaaaacaacaaacatgggattaaaataagagtaaaaaaatacataaacaacaatgcaattgacaaggtaacaaacataagctttgcatacatgagggataataagatcttccttcacataaagaagattctcaactgatgttgtccgcacttcacggaactcaggggcaagctgctgctgaacagcccttaggaattctccaatggagtcacctttacggacctgccaggtatataggtgttgtttcaatcatatggtccacatgttcagaacaatcaaaagaggaacacctttttcaatggttagaaattacctggataactctcctatgcccagtgccatcccagtaactgtaagtaattgtcagaggttcatctgacacacgaggcattttgctaatcagttaggatgcaaaaattactcacaagggaaaaatagagtgaaatgattaaacactaatggtaattaatgctataagcttgtggcaatacttttaatcagttcctgctcacgcgaccattgtttcttcaaacgctctcgctctgcttgttcctctgcttctctctccctgatggatcattcttagcaaccagcttgcaggttaaacaacacatggaaacaaataatcgatcatcacagaaagataatcataaactaaaagaatacctgtcaggaagaaaacttgtctcaacagtagggtccttcccaagtttgacaggaccatgtttcttttgaggttcttctgtaaaacaatttaaagcataatgtccatacttgctttacaggtaaggtaacttcacaaacttaaacaaatcaagattcaggacacacacacaaaaaaaggacagtacaaacacaaaccccatggcactaaactgccaattcataacgtaaacaatagagagagaatgttcattctgaatgaaaccctgcccaggacccaatctttgcttagatgctttgactaaattagtttgtcgagttgattcatttaagggacgtcacatgagatgttcaaacattaacaaaaaagttagaacatggtaatacaaaataggatatcacaagaccctagaaaggttaagaggaccatacgattctcaaattcatcctcatcacttccattctcaatctcatcacagaaagataaccgtggatctcccctcactctcctctttttccgcttttgcatttgcaattcttcttccctgaaaacaaaaaataaataaactattttgatatacacatataaggtaatggcacaaattatgatagactaggactccaatctcactcttgttgcaacttttgaagcttctccttctcttcttcctcaattttggtccgtatattaaccctctgttcagccacatggatgaaacattagatggtgaaaattcactttttgacagaatggtaagaaatatatctggatattaccttctcgacatactgctcccttgtaactaaaccgactgtttccttcttaaacgcagtctcaagaatctgaaagtcatagtccatactgttaggtgttagcttctaaaacacagataaaaaatatataaatttctgttgtgcctttagaaaatgagataattcagaaccatgccaattgtgaagcatatatggggggaaatgttttttcttttaagtttaaaagacaaaatataacagaagtggttcaatacaaaagctattctgcagcaaatcacatagctgtagcaatccaacatagaactacagaagtatagataacatccacatcctaatcaaattaaacaagagagataagacaagtatcgaccaagagtattacaaatgacaatttcacatcacaccaccagagaacaagcgcttaaaaacctaggatgacaagtacaacaaaatatgtgaaggcatggtaagaaaaatgtaaggacaaccagttctagtgagagacaaactagtttcgcgagtgcacgcgcacacaaatacggagatcagtagtaggtcactgagcctcacgggcaagcgaattttcctacctacgcgtgtgccctagaaggtagaagcctagtccgattcatatgatggcggatggccatacctcggaggtgctggagccgaactggagcaggccgggctggccatcggaggacttgttcttgagctcctcgatcttgcggcgctccgcctcccgctgcttctccagccgccggatcttcacggcgtcctgagccgtgccgacgtacccgtccccgaaccccgacatctcgtcacccccgccgctcttcctcggtcagacgagggattccagagattccagagaaactcgcagccgacgcgcggccgccgcggaaggtggagacggcaaccggcggtgggattgctcgccgccgccgagagcggaaggaatagggatttggggagggggaaactgctcgctgccctcgcgcttacttgggctgggccttaccgacttacaatttgagggagtattagcttagttgggaagttgggccacgtttcatagaggcccactagacaagtgcggcccgatggatagtctgccctcgagctgccgttttcctattaattatttttttttaaaaaaaaggaaaatgatacatagaaagttcttacagacttttcataaacatgatatgtcattgatgttgcatgttactacatccgtcccaaaatatagtaacttttggttataaatctggacacacaattgtctagattcataggtaaaaatgcttacattttggagtatttatatcttgatactctattttataactactgactaaatgaaacgaacttttttttggctgaatcaattcttagtaagattttgagaaaacaaagttttagtacaactcagcaagtcagaaacaatgttactgaaagtcttagacacttgagatttttgttgcaagagttttgtaaaaaaaaagaagaagaagaaggtacagtacgtagtaatgctggaagaaaaacacttttttttataatggaagaaagacgaagaaattaaacaaacaaggtttttatatgaccaaaccaaacaagttttaaattgctataaattgttgaaaaccaaacaaatcatgatgttacacaagcatgattcgaccgagaataaatgaaacccaacataagtttgggactttaacacaaacaactccagaaacatagttcgacgacccatgcaagaattgcatgcacaacaacatcaatggagcaaagctccctaaggctcacagagccacacgccgagtcaggaaacgacatggctaaattattcgttgaaacggaaatgatgcagacgaaatcttcggcaccaaatggattgacgacgaacaatccagcttcttgatgattaagcttgcttcttcttcatcccacctccacgcttcttgctaccgccacctgagctccccggagcatctgcaacacgcacgatcgagacggcaaaaactgcgttaggattgcacatttgtacacggtgatcacgagcaaaaccaagcacgatcgattaattacctgccggcggcggtggctgctgggcgcgagaggcggcggcggtcttactcttgtccatcctgttcttgcgacgctccctggcctccagctccaccctgtcgcggccaccacctgccaccgcaaacatgggtccaccagttctcctgctgctgccgatcatctcccatggcatatcgtcgaccgtagcctcgatcgcgcggcgctgcacgaggtactcctcgaacgcccccgccggcgcggcgggcaccagtcgcgcccgcgctggcccagtcggtggacgaaccagcaccggccaggaaggcagcccggacggcagcgccggaggcgcggctggggcggcggcagcagcagcaggaggagtaggcgcgcgcggcgtagcagcagcaggtggagaagtgggcgctcgccgcgcacgaagatgaggagcaggcaagcgcagtgaaagaggagcggtgggcgcgcacggcatagcatacgacaagctcacgccaccatagctgaagctgtagcggccgatggtcgttggcatggtccacccacgaggtgcagcaggaggaggagtagccacgggcggcgcacgaagatgaggagcaggtgcgtggagtgcaagaggagcagtggacgcgcgcggcgcagcggacgacgagctcgcgccgctgtcgctgaagctgtagcgggcggtggtcggtgacacggtccacccgcgcggtgcagcaacaggaggagctggtgcggatgacgcacgaggatggggaacagatacacgcagtgcacgaagatgaggcgcaagcgcgcgcagtgcaagaggagcactgggcatgcgcggcacagtagatggcgagcttgcgctgtcgggcggcgtagcaacaggaggagcaatcatgggcggcgcagtagcaggaggagcagtcacgggcggcgtatgaactgaaggggcaggcgagggcagcgtagaaactggaggagcaggcgcgggtggcgtaggaacaggaggagcaggcatgtgccgcacacgaagatgaggtgctggtgagcgcagtgcaagagaagtagtgggcacatgtggcgtactagatgacgagctcactccatcatagtcgaaactgtaccgggcggtggtcagtgacacaataaacccaggcggcacatcagcaggaggagcaggcgcatgtggcgtaggaacaggaggggcgggcacgaacggtgtaggaacagtaggagcggacgcgcgtgacacatgaagatgaggtgcaagcgcgcgcagtgcaagagaagtagtgtgcatgcgtggcgtagcagacaacaagcttgctccatcgtagccgaagctggggcgggtggtggtcggtgagacagtaaacctgggtggcacatcagcaggaggaccaggtgcgggcggcgtaggaacaagacgggtaggcgtgggcggcataggaacaggagttgcaggcgcgggtggtgtaggagcaggaggagcaagcgtgcgcggcgcacgaagatgaggtgcaggcgcgcgtagtgcaagagaaatagtgcgcatgcgtggcgtagcaaacgacgagctcgctccatcatagccgaggctgtggcaggtggtggtcggtgacacagtaaacccgggcggcacatcagcaggaggagcaggagtggcaggcgtgggcggcgtaggaacatgaaaggtaggcgcgggtggcgtaggagcaggaggagcaagcgtgcacgatggcgcacgaagatgaggtgcaggcgcgcgtagtgaaagagaagtagagcgcacgcgtggcatagtagacgacgagctcgctccatcatagccgaagttgtggcagatggtggtcgatgacacagtaaacctgggtggcacatcggcaggaggagtaggcgcgggcggtgtaggaacaggaggagcaggcgcgggcggcataggaacatgagttgcaagcgcgggtggcgtaggaacagggggagcaagcccgcacggcgcacgaagatgaggtggcgcgcgcagtgcaagagaagcagtgggcgcacgcggcatagcagacgacgagctcgctccaccgtagctgaagctatagcgggcagtggtcggtgacactgtcaacccgaccagcgcaacagtagaaggagtaggcacgggcagtgcaggaacataaggagtagtctcgggcggtgcagaatgagcaatgggtgtgagcggcgcagcagtcgacgagctcgcaccaccatcgccgaagcggtcgttgtcggtggtcggtgatacggtccacccaccgtgtggcacaacaagatgaggagcaggcgcgggcggtgcaggaacaagaggagcaggtacagacggcacgacaagaagaagaagaggagtaggcccccgcgtgatagtaggagcagcgggcgcagtagaggatgagctcgcaccgccgtaaccatagccaaagcggtagcggccggtgcccgacgacacggtccacctgcacgggggcacaggccacacgaatgtggtggcgatgggcgtcatcgacggccccgcgggccggcgcgcggtgaaactaaggacgggcggtggcggtgcaggcacttgtgattcttcggaagtgaagctggtgtcaatgatgtggtagctctcgccgtcagggaggagtgacgggacgatgcggctccagggattgcggctgggcaggcgcctctaggccgggatggcgtgttgggtcggaggctgctgggctgccgccccgccaccaccgccgagaagccggtcctggctggcaaggcgaatgggccggatcgccatggcagcggcgatggcgtaggggatgatgaggtggcgaggtggaaggccttgacgggccgggctctcgttggcatctccttgctgggccgggttctcgttggcgtctcccatggtaggcaggtcaggtcggcggatttcaccaccttcctccgttcgaatcttgcagacaaaacctgtgtggggaaaaaaattgaaaaaatggcattggcgatggcaccacacaaaacatacatgaacctgcaaaaacctgtaataaatcgctagaatttcacagagatctgataatcacaagcttacaagaacgtctaaacctcctgtaaaccaccaagtcccatgtagatctgattagaaaaagcttacaacaaagtctagatctttagatggtggatttcaggatttcaaaagcaagaaacaagtttttttctctctctactctacggtattcaaagctatgtacttctaagaacagaaactagattagaatttgtgacaagcgagagggaacttacctctctccaatctacggtattcaaagctatgtacttttaagaacagaaaacatattagaatttgtgacaagcgagaaggaacttacctctctacaaatctacggtatgcaaagctatgtacttctaagaacagaaaccagattagaatttgtgagaaaaacaagagggaacttaccaggttgcaggaagcttatttcttcatgtatctgatttccttcaatctgtgtgtagtttttacagaatgggggcttagttttatagtcaaatttcagtgcttcaccctgtctttgtgaacgcgttctatacactgtctcttgtttctttctaaacataaccaattctttatctgtgtgaaatatgttgcaccggtacaaaaaactactccaagcaaaaggaaatgttttatagtatatcacaattgtatcctctaaaataggtgagatatattgagatatgaacacagatgtttcaactttagccgaatctcagtggtactgatatattgagacatgaacacagatgttttttgaaacccaaaaaaaaaggtatgaacacggaaagtgactgccaaccagtacagctgcatccaaccgcccactgctactactgatttggccataataacattactaccaaatatacaaatcttcctggacttatttggtggagcatttatttcagaacatatctggcatcagcaactaattcatatctaagtatggaggttctcatttatttttacagatatatgaggaggtatatatctgtaaaaatat

SEQ ID NO: 1866 - DNA, 1308 bp, Oryza sativa
tccaccaattaagtccaggaagatttgtatatttcagaagtctaggaatatatatatatatatatatatatatatatagtaaatttgtttggtgctccatggtgcccgggcactattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatatatataattagttaggtatgtaatcatggattgtgaaataaagttaaatttgagttgttttgttgataagtataggtatgaatcaaattattataactaggtatatactcacaatttgaaaattttgaaaaatttgagtaattttgtgcattagataccatggtgcccgggcaccatggtgccccatataagtgtcctatatatatatatatatatatatatatatatatatatatatatatatatatatatatatatatatatatatatatatatatatatacccttatatttcagaagtctttgatagagtaaactaaatgtgtgaaattcagctatcgacaatgtcaactctatcttagacttctaaaatataagggtatagatatctcctagtataaatcaagagatataaacctacgccactcaaagacttgagaaaaactcaaaaaaatataaattaatttctaatcatgtactacccatgtagtattagttttggcacttcgagctcccttcatagagggatctctctcaaggaatgaggtgtatatgtctttctaaaaatgggagaaaacctcataagtatatccaagtataagggtggcaattgagtttatatgtttaaatctcagcatgaagatctacgagattcggccgaaatggaaatttatacaactagcttccatgcgaggacatgacctgacatgtttgacagaataattatgatttactagaaagaaatttccttgcttggagtagttctcgctatcgttgcaacttatttacacggataaaatagtgtttgtgttcaaaaagaaagaagaaacaatgcataggactcgtttacctagatacatgggcttagggttatcattgagaaccgacgggagaagctttgcaaaagcacagtcccgggagtggccttggggccaagtatgccatcctctcaatgcgtggtcatttccttagtagcccaaagtgcgagagtggattctaagctctagaggacatcccctcatcattcacatgtc

SEQ ID NO: 1867 - DNA, 1648 bp, Oryza sativa
agtggacagacctgagaaccaacttataatatagataagcggataacccagcgcacttataacctagatctagtggtcggtgcgtgcggaagacaaggccatcatccatgtacaagaaggaaaatacagccccacataggatcgtatggatgtcaaatcaaccatgtaagaacatatcatgccacacatggggaagaatgataccttggttgccatcctaacatcatcaactgagatctagtgggtgatgcatggggaagacgggctcatcatccatgtgcgagaaggaaaagctagccccgcccaagatcatgtggattccaaataagcaaagtaagaacacatcatgccgagataaggaagaatgataccttggccgccaacatagatcgactagctgatgagtggggaagatgagccgccatccttgcacggggaaggaaaactggatcctgtacgaggaaggggagcgacatcagcaaccacctaaacgttgtccgcgcaaaggccccagtcccaaatcctagatctaggcaaccaacaactagggaaggcactgtagaatgtagcgttaggtagcgacgatggcaacgattggcttgatggtgttggaaggacggcgattcgctctcttgatgtcatattggtgctagaagaacgaatgtgagcaccagatctaggggaatgaaagttaggtagagtgcggcggaggggtggtggtggatggaggggaagaagtggcatcttctacccattttagggtttagcaatggatttatataggcagggatggtacattagctttggcccaattaggcccaatagacggggatggtaaaatggttggttgttggctttcatttgttaaacgtccccgtccccagtggcaaataaaaattgtcaaacccaaacccaatagtgacatttggatggacagtggaaagaggaagggatattatggcatataaagtggtggtttaagataggataggatatactttaccattccaatgttcaaatacatatggtttggtatagagataaaatatttattggacgaaaatacccttcctgactatctggttgtggcaatcacacgacatttttgtcatcgccacccattccgacctaaactcaccttccccaatattggttggaaatgaaccgtccatatcctgttcttatatccacttcttttcccaatcacctaaaaaacatggaaatgatttcttttcaagaaacatcaatgtatcaaaattttcctctggttccaattatcaccttttttttttcattgatttcctttctcatcgagactcacttttctcaatatactttaagggtctttgaagcacaatattcaggaaatggatgaatagaaaacaaattacaagaattggaggatggcataacatatgaaaaatatagaaacaaccatttaaatagactataggaaaggaatcggataagaaaggtagactcgggaaaaaaaatgaagttaaagcttttgctaacttttcttcaaaatctacatgcatttactcgtcattgcttaaaaatttcattgaatttggaaatgcccaatcctctgtttcaatgagccgaataggaaaagttcctacatgatttaaatcttatataactcatg

SEQ ID NO: 1868 - DNA, 1494 bp, Oryza sativa
gaggaagtttatgtcaaacaaccaccaggttttgaaaatcctgattttcccaaccatgtttttaaattgtctaaagctttgtatggtttaaaacaagctcctagggcatggtatgatagacttaagaactttttgcttgcgaaaggttttacaatgggtaatgttgataaaatgctttttgttcttaagcatggtgataatcaacttttcgttcagatatatgtggatgatatcatctttggttgttcgactcacgctttggttgtagattttgctgagactatgcgcagggaatttgagatgagcatgatgggtgagttatcgtactttttgggattgcaaattaagcaaacacctcaaggtacttttgtgcatcaaacgaagtatacgaaggatcttttgagacggttcaagatggagaattgcaagtcaatttcaataccaattggttctacagctgtgctggatcctgatgaagatggtgaagctgttgatcaaaaggaatatagaagtatgattggatctttattgtatctaactgcttctaggccagacatacaatttgttgtgtgtttgtgtgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgattttggaggttgtagaattgataggaaaagtactagtggaacatgtcattttcttggtacatcattgattgcatggtcttctaggaaacaatctagtgttgctcaatcaactgctgaatctgaatatgttgctgctgctagttgttgttcacagattctttggcttttatcaactttgaaagattatggtcttacttttgagaaagtacctctattttgtgataatactagtgctatcaatattgctaagaatcctgttcaacactcacgcacaaaacacattgatattcgttttcactttttgaggaatcatgttgagaaaggagatattgagttgcagtttttggacacaaagttgtaaattgctgatattttcactaaacctttggattctaatcgctttgcttttcttcgtggtgaattgggcgtaattcatccttttggcatggtttgagggggagtttgtacctcatggttttatcaagcaataatatgacaatgaaaaaattgataaaagagagctttgtttatgcatatggtattttcttgtgcatgctagcaatactttgaaggtttatttgtctctagcatagcttgtatatattctagtcttttcatgagatttagattttgcttttaagagagatgaggcatgacacttaaattctatacttgaattaagaaaatatgcaatgttgatgctagcatatggtttgatttataaatgctatatatatatatatatatatatatatatatatatatatatatatat

SEQ ID NO: 1869 - DNA, 14546 bp, Oryza sativa
  unsure (1)..(14546): unsure at all n locations
aaaaaggctcaagaaaagaaaaggttaaaaaacttctcttggttattttgtgttaaaggttatttgagaaagagtgataaatgcaataggtctatgtgtttagtgtttattcttcaacctatgtgcttgttaagatgttgcattataaatcatatgaaatcatgaattttgattgttgattcaagcttaattgtaaaatctttggttcatggttatactttaatacatgcttgttttgttatagatgggtttatcttctttttattgcaacacatgacttgatatgctatatgtatgctaagctcttgaacattaataaacataattcctatgcttgatgaaatcattgtcaaaagggggagaagtaatgtgaaatttttggattttttggagtagcaaagtgaatttttgagaagagcatgttgttggttcaattgggaatttctttcttttaaaaagggggagaagttttcttttcgatttttgagcacgatgtgtacatttgtacgaagtgtgctttttaccaccaaatatcaaaacatttttatgagtttgccaatgtgttcatcaagggggagattgtaaaatcaaaggtgtttttgattattattctgtgatgaacaattgggcattggacattattggttttgtatttggaattaatcacgaagtggttttggagatgattggttttcacaggtgaaatctgcggcattaacattttatgtggaccggtcagaccgggctctggtagccggtcagaccggcgtgtatcgcgcggtcagaccggcgcgacccgcggtctgaccggccgacactgtgttggtttcggtttcgggttgtttatttggatatccgagtttattccatgattatgacttctagatggatactatacgtatgtaatactattgtttgctgctaatgagtcaagttggagatagcttggtctcggaatatggtttctttgtttgttccatgtgtaggtgactcgatgtctcgagaaagtatttgcggtgatggacagggagtcggcttggggataagacgacgtccttggtggtcagagatcatgcgggatacttaggctagagttgatgcacgtggttgatggagtttccatatggcatacgatggagttattgtgtgagtatgggatgcggagtcgaatttggaaggagtccaaatttggtacgattggttatgtaaagtttctttcttgtactagtgggtttcctaaggtgtttaggactcctagtatgagtttggttcgtggctttaggctgcctacctcatgtataaatagagggggagcgtgaggcttccctgtatcgctttagagagtaatagagttgagttttgagttagggtttcgagtttagtcgaaatttttgtaaggagtgctgttggtgcactttgtaaatacagagagaatcaataaagtcgtcatccactttaagagttcttcgatttgtgtttaccgggttttggcggtctaaccggcggcacaccggcggtcagaccggtggcatcacggcggtccgaccggcgggcacacggcggtcagaccggcggcgacaggagtcggcggtaggtgttttcggcggttcgaccgatcgatctacatcggtcagaccgacgttcatcaggcagtcagactggctcaactacttcagtcagactgcgatccatcgatttcgagggtaacttttatttccgctaaaagttttcggtttttgggtataccaaccattcacccccctctggttggcttagttcttgtgattcgatcctacacgtgcaagtctgaataagtaagttagatctgtataattttctgcctaattaatcttctcattggtcattacttaatgctttgaatctttggggggaaagtttgcctgcgcaagaaacgttgcatatctatatgtacaggcaacctaccctgcatcctcctgttgaagtcctgattcctgaatgataggtactgcacaacagtatgatgccattaagtacgacaaattggcgagcaatttgtgattaaaccattggttttatggaaagttgcaaaagaaaactggttgctgcttctccggttccggtaacagcctaacagggtcgcttcattaggtttgaagcgtcaaatgataagctttattattcttcgctttcactttctacatcgcaaacattgctggatagaatattgtgcacaattccaatcgaagtacagaaaatcacattaaatcgctcgtttgccataagaaaaacaaaacaaaaaggacggtaatcttacttcaccatttttttctcttttggtgacgtaaacacgcgccgtactcatgcgtgtgccgtaacatactcccttcgtcccagaaaaagcaaaccctgggtttgcgtgtccaactttgactgtccgtcttatatgaaatatttttataatttatatttttattgttgttagatgataaaacatgattaatattttatgcgtgacttgtctttttaattttttttaaaaaaaattcaaataagacgaacggtcaaacgttggacacggaaaccagggtttgtctttttttaggacggagggagtatgttggaagacacccactaacgttcagtcgtatacaatactactatgttggagtacgtaatcagtatttgaactcttgtagattataaatcgctcaactttaacaggttaaaagtaaccgagcaaatgttaggcatcaccactgctgtcgacggacctggtcatgcttgtgcctaggtgcaaaaggtgaaaatttagcttgcgggtgtttagatccaggagcgtaaagtttttgcttgtcatgtcgggtattatatagaatatcgtatagggtgtttgggcactaataaaaaactaattacagaatctgtcaataaaccacgaaacgaatttattaagtctaattaacccgtcattagcacatgtttactgtagcaccacattgtcaaatcatttaccaattggcttaaaaagattcgtctcataaattagtcgcaaactatgcaattagttttttttagcctatatttaatactccatgcaagtgttaaacgtttaatgtgataggatgtaaaattttagagtatgctcttattctttaatcttttatgaactgtggacattttgacatttttggttgcttacgccgacatttttctctgtgttttcccttttccgcacctgacccggtgtgagctgcacgttacgtttgctacgctgtaccccccccgggtctgtacgtacacggggcacgcgctcccgaagaaaacgccaactttgccaactctccgggccgtcaaaccggtcagacccaggagacgcgaaatcctgcgttgggcggccatgggtttttccgggcaaaaacaccggtcgatcggtctcgccgccgcgccgccgcccccgccccgcgtgcgcgtgaatgattagacgagtggcccgggaagcgagccatggtttcgcagggggaaaaaaacggtcagtttcgccgcgcggcgtgcatgattagccgcgaaccagccgactatcggccatgggtttttccgggtttcgctgtgcgcgtgcatgattagccgcgcgaaccaggcggcgggcgcgcggaggcggggaggaaacggccggcgcgggttgttctcatgcctggggtgccgacgtgcggcgtgaattcgaccgcgtttttgtacgcttcctcgcggagatttctgtgtcggatcgtgccgttttggcgacgtacactccactcgtgtcacacccctggcacagttggcacgggtcgtacaacactgccacgaacatttttcacagtgtgcgcgaaacagaaacagaggggaaaacctgcaagttaacgtgtttttatactacttggaaaattagaggatttttaggcgtcctcgaagtaaatcggacatggagtaattcggattcagatcagattgaggaccggccaaaagctaccgatccagcgttgtctgtctcgtaggactgttcaggcttcaacagagtttcttataaatatctaatctttgaaaatatacgagcagcaaagtttcataaagagagaaagcgagtgaacaccgtcttgagaaaacgaacaaaagcgagtgaacagcgagtgacagggacggggaggcaaggcaagtacggcaggacagaacaggaatacaggatattgcagagattacagccggggtaggcaccatcatttttctgaagaacgaaaccggcctttcggtgtctgaacagcccggatgaaaggatcatcaacgatgatgcaggctccagcagtcataaatcataggagtaccggagtaaacatggtccggatgaggtccagatagtaaggctgtgtttagatttaaagtttggatccaaacttcagtccttttccatcatattaacctatcatacacacacaatttttcagtcacatcatctctaattttaatcaaaatacaaactttgcgctgaaataaacacagcctaaaagtacttcaagtacttcactctacatggtgatggacaggcccacttgtaaattgcagtacgtaaatcagtgtacgaacttttggcaacttgagacgcttttcatgcacaccaaatcagtagcagtgtcacaccaaaaccaatactcaaatgtgaaaaatgcttcgaaattcactgcagtagtttttttttctcttttaaaaaaccggagtagtttttctagtgttccccaaatcagtaggagtactacctagtgaaaaacaaaacttactgttcctaactttaacctttaagactgtgtttagatctaaaatttggatccaaacttcagtacttttctatcacattaacctgtcatacacacataacttttcagtcacatcatctctaatttcaactaaaatctaaactttggatccaactaaacacagcttaagattcgccttgtattttaaataaacattttggtggctgcagtctgcaagagccgacgctcctggactcggaatcgcatcaaaccagagaatcctgcacatcggttgccgaccaccgcgacaaaacacatgcaaatcgcagtggaaaaaggataagaaaaccacatcaaaatgacaggcagaccattagaacccaatcagcgagagaattcgtcgtcgaaagctgctgattactgcaaaacccgcagcttagcgcttgacgcctactggatggatcgacgacgactactccaacttgtctccaaccattcagaagatgccgattgcgatacgtacggaagcacatggtggtcgcgttctccgtactcctatcctactactccctctgtcaaaaaaaaaaaaggcaaaccctgagtttccgtatctaactttgacggtccgttttatatgaattttttttataattcgtatttttattgttgttagatgataaaacatgattaatattttatacgtgacttgtctttttaattttttttataatatttttaaataagacggacggttaaacattggacacagagtcttttcgacggagggagaattcgcgttcggctatcagcatcaccagcgcgccagcagcttgcaggccttatcatatcagatcgcgacgcgtcatgataagccgcctgaaacttcctcccgttttgttcttgtccttaatttttactgtagcatggaggaaacaacggtgtttttttcttcttctgacagtacatgtgaactgtttgtgacagctgcaattttgttgtactgatgacaagatgctgccgtggaattcacgtgttagggccagagcaaggagtatgcattaatagtactgtttattagcgatcttttcttttctgattttacattttgaatttcgttggcacttttccctagctatggcttctaaacgatcgtttgctagtagtacaaaagttttcttggagcatataatttttttctatggtaaattttcagctttgtactgattcatttatttattataaagaccagattatacatcagtcaaataatttcagttctctcaaacaggctttgtagaaaatgtgtttgacattctgcatttcatactatacattccctagaacttcgcggcgcagcaacaatatttgaaacgctagattacttgtaccgtgctactcttcgagccaaatgtcgacgtatttgctggaccatggttggcgagacaaagtcctcgacaactaggaggttgtctcgttgatggagcatctttcgctcatcagcagggttatcttctctttaattattcatactagagatcaatacacttgaatagtgtaccttgtgggagatagatttttttgtccctcaagacaatatcccctcttttgtgtatgatgtgaaacttaacaacgaattatacgatctattccaagttaaacttgttatttttgtttttacttgtgtaaattgaatttaaatttacatgtttgtgaaataacatattacataatgatctatcttactaaattctttcaattttttataacattttaaacgacaaaaaaaaagtgagagaatatcctctccctgatgtactacaatccaaacaacacttcgctctcaatacatcttgagtcatgatgggaaaagcgaatgatcgcatcactttttggagttttggtgcacttttcgtatatctcagaatgtgttgcttcactccaaatcagtttgacgtgtttttttgggggtaaattaatatggttatagaagggataatcgtgatagcgttttcgatcaattcgtaggatttttgacatttgatttggcaagcaggcaaatcaaaatcgccattcaagataaggtgcatagtacaagtggtgaccaagaagaacaggtgggcttgtcatgcctatgcgtcgttcttatcctctaaaactcgagcttaaatttggtcaggcatggtttgaaacgaagctcgttatgtactccacgctctcttcgtgttaaaaaaaaaacttttatctatgaagctagagagactcttgtccaagtctatggcagattttggcagtttgtgaaatcttgtcatataccatgagcatttagtcgttgtttgagtaataacatcatctctagtttaaattgtgtagattcgtttacagcacgtgagtaaactcacgatcgaggtaatcgattcgagtttgttaagagaagctgagaacgctggtcaaatttgagcttgttaagagcacctgagaatcgactgcgtgtgaattttgagtttgtctacgggcaaatatatttgcgccttcgccgttagtttgcttatttaccttatcctcgctggccgctgcgacacggtttgacgacgtcacatcagcaccgtgctccacgtcggcctcgcgatttactgggtcccactttcagtgtctcgtctggccaccttcctcctctccgagactccgatcacacgtgaagcgagagggatgccgcggcgacggcggcgatggacgcagcggccaccggtgggaacgagagcccttgccgctgcttaattattcgggggatcatgtggtcggcgagcccttctgcattaacttggatctatagtagaacatattgtccatcgatcgtcatagctaattttagtttttttcccgaggagataaaaattaaggaattgctatatatcattcgtcagaaatttgggaatgaaatcttatatattttggaccattggatctgtgcctagattcgtgcatcgacttcttgtccaactttgacgaactccccttctcatgtgtcggtgacaccccaatcgagaaagagataaatcgataaagctgacggttggtttgaggtgggtggctcaccaaggaacacagtcagttatatttcacaattagatgatcggcatcctatttatacctgcaatatgtttttttatttattattattaagtaatttttagaaagccctatattttattatgattaaagttgtacaaaatcacaagtattatgacttgtgacacataaaccatgtattatggatttaaaagtttcacaaacttcacatttgtgcatgtttagtacaaatttacctgaattctaaaacatagagtgtatgcaatatttttaattaatcaagattttattaaaggtggtgttttagaaacatactagtaatcgtgcacgtgcaatgcacgtttccaacatataaaaacactcaaaatatgtcattttcctgcaatatatgtcatttataatctttgtccttcaacagacaccagaaagttatggcacctcacaaaagggaaaatgaaccttctgctgcagcctacataacacatttaagtggcaaacatgtaagcatatcagttaatgctaatgacctctgaagcaaaggacatacttatgggcacatatccttttacaattgaagtaaaatgaagcactgcaagattcaaagagctgctcactccacctagagagaatttgatctttatgcatacatagatggaaaaagaaataattgactaaacctggtgttctgaatgaatttcagactacaaacttgtatgtataacttgatgaatagaagctagcaacttccagaatttagcacagagaagaaaagactgtaatcaaatggattctggaattgaaatgctgccagagttaagtgaataatcagttggaactaacccaatattcagaccataggaggaaaatatcagatattcagagttattaatctagcaagaaagtgcagtggcagtgtgctgaagatcactatagaataaataatggttttaggctgtaccttactcagctcttctgaagatcacctttccctgaaatgattacagtatgcagttaaaacttaaaaccagtaattaattcttcacagggtacacaattttcggccatcaaatccattccatatgcgccaactaccattctgaattcctgatacttctattacacatgtttaattcttaaccttgctttagctttatccacttgaaaacttatactatcttgttctgctaccaaccacccggaggaagctctaccatgtattatatccaaaagactacaaaaaccaaaagaattgagtttattttatcgtcccacgcagaacgaaaaacttaatcacaacagagtttcatcgagcaccatgtacaggaatgaatgaacgaatatgaatgaagttgtcggctgaggaaaaaggtagtgttagaccttaattagaagcatcaatctcctgagatggcatggcggatggagaggaggcaaagccatgataaaggaagaggaacatccctgctttcatatggctggagcagcagatggtgagggtctgaggccgatgccatcccgccggagcttaccaccctcttcgtcagacctggtgcctgcaacaacagtgagctgcttctggctcccggcatcgacgtctcccacagctcgttcttcaaccgcgccgacgccccaggcgcccacggtgcccctgccggcttcctcgacactttcgacgtcgccatcaacggcgcgctccgcgccgctcctgccgcggcttcaccggctttcctcctgccgaacctcaacgatgacgcgactgcgactctccacgcccaagccgtcgccgttctgaaccacgaccgcagattcgggtggcgctgccatggaaggtggagaagaaccgggggtggagccgtcggcatcggcgactacagaggaaccgacagcgaggtggagcagaagtcagcgaggacggagggagtgggtggttaagccgtggtgcacttccgacgggggcgccgaggcaacgggtggttggtgcatgtgtcccagcctccggtggcagcagcggcctcaaccctcagatctggggcggcacagaggaagttacatgccagaagccggcggcgacaagaagcagcatggcggagatggaggctggtgataaaaagaacagcgaatggtggaggccgtggcaatgtgaaacaatgtggacagcaaaatctggagatggaatcaacaaatggaccattacctcgctagctcccttgaggcttcttccattgtcaagatccaaatcaacaacagcccccccaaccttccaattgagccattgaggagtgaaacgacggccgacatgcaacgaaacggagcggccaagatacactacgaactccaccacggccggctagcttctgatctggccactgccacgacgccacaccagcacacgctctcgtgaaaccctaggcccctctcccgcaggtgtggccttccccgacaccgagccttcacgcgacggcggaagagatgaccggcggcctgcggccactacttattaggggaggatgtgcgcactggtattcaatgcgcgaggaggcgcatcatccggtgtcattgctctgtgcgcgggaataacgcggcaagcggtggcggggatagcgctcgaggcggtgttactgcgaaaggggttctcgcgctcgcccggtgggatgaggaatcggtgatttcaccgctacacagagggtggggacatggggattgatttcacctgtaggattgctagtcacaacttctcctttttatattagtatagatagaccataaaacctgtgattatttgccacgcttcataatacatgtggttttgtgcaaatttaaccataaaatatggagtggagttttctgaaacttttttaaaaaaataaagaaaagaaaaagctactaatccaaaccgtaaagaagacggggaatacgagaaatatctccaaacatatacgctgaaaaacaagaaaccgacgcagacttggatcgatgcgatttcagcagccgtcgtcgttgattcggattcggggagtaaccgcgcaagagcagcgacgatgaggttcggtttccgtctccgatttcccttggggttccatccccttcaaatttaacgcgacccttcactccccgtcgcatcgcatcttggctgactcgtcccgaaaatcttgagcgaccgagttaccggcggcggagatggtggtggctgacaatggcaagtgggcgctggagaaggctcgggcgctgcaagatttggaggaggaattcaaccaacagattgcaaggattctcagctgctaccagctacctgaccacatcaggctggatctccatgagcagcaccgcaatgactacaaggtgcctgacgatctccggctcaagttcgtgaatgccgttttcgaggggaaatccgggatgcttgatcaagacgaggaactcagggttcaggctcggaaggaatccgagaagttttgggtggaggcggcgggggcggcgaagaaggcgcaagcactacaagacatggaagagagaaacaggcaattgttctttaagcattatcctggcgtgcaagacatgcctgaccacattagggagtactgcttcaggaaattcatggaagatgccagggatgaggtagaggtcagattcgggatacgtaatcacgaaatgcgactcaggatccgagcttgggaggaatcgcagcagtttctgatcaagacaatggccgatgggcgggcagccaagaaagtgcagaccttgcaagatgaggagaagagatatgttcagggtgttaagaaaacttttgacagcgaaaacatatctgagtacttccaacaggctttcttccagcaaggcctacttgataatatccggctgcttttcatagatgatatagaggaganattcaatatgccagtgacgaagagaaacctaagggttacatttcggaggattacacaaggtgaaaggcgcaggccttacaagatttggaggacaaattcaacccacagactgcaaggattctcaagcgttatgacctacccgagcacatcaggctggatctccaggagcaacactacaacaactacaaggtgcctgacaatctccggatcaagttcataaatgctgttttcaatggaaatccccggatacttgatcacaagagggagctcaaggtccaggctcgcaaagaagcagaaaagttttggatcgaggcggcggcgacagcgaagaaggcacaagcactacaagatttggaagagagatacaagcaacaatttattaagcctagttatgacagggaagacatatctgagcacatgcaggagtatttcctcagggaaagaaagataactgacaaggcctatctcgagtacaagaataatgtagaggataaattcgcgatacgtaaccacgaaatgcaattgaagtttctagcctgggagaaaacacagcagtttcggattaagatgatggctgatgagcgggcggcgaagaaggtgaaggccctgcaagatatggaggagagatatgttcaagattatatcaacaaggttgaaagactagatgtacctgactacatcaagcagggcgttatccaggaatacaaggtacctgacggtacccgactacgttacataaattatatcgaggagaaattcaggatgcttgatgaccaagaggaacgtaaggttcacatttgggagaatttcaaaaagttgaagatccctctcacaataaagtctcccatcactgtcgctatcatgttctcgattggcatcatgatcttgttctccggcttccttgtccccaagatgcccaaatcgttgaagatcatgtgttgggcgacttcaattgtcatctgctttgcggccgtgctcagctacgataatgaaagctcgaagaccactgccccaactgaaatgcatgatctggaaaatcctccaagtatttaatactgaataatgccatttaactggcatacagttccatccctgtgtaatctattgttagataggaaatagtgctatttaacagatcggttagtaataagaacttgttagtaataagaagtcatctgagaactcgttccatccctatgtggaaaaacaagttcttttttatttggaaggtaaacaagttctttgttctagtgctttaagtctagctgtttacagtcttgtgcttgaaattttagacttcagtgtatttctatatgctatgagcctgttaatgacatactatcagactgatgaaagatgttttgatagagcagaaaatttatctgaatatccaatcaccggatcatgaattctgatagtacatctttcttgttttctgtaattatctaagcacacccactattatacaatgctgcgaggttggatagtcagattagttttcttcactatcaaaacatagtttgatcagagaagggaagtttttcagaaaaccacaagtcaaacttgatgaggcacagtaagtccagacttatgagacttgtttacagtcaattgattatttgttatcttgattgatatacttcaatagtaactttggtaaagtataaagaaatggtacatttcctgggctactttatcaaccaactccgaatcttttctttagatcagttgtagtaaagaagagttaatgtattcatttcacaatctgcatcctttgttttgcagccacatagaagacatagcatgtggtgctggaagctttttgatgttttcaattgtttttgacaaatttaaatgctgggtttaaaaaattcagtttaccttccatcttcatggttcaaagaaattactaccccctccatttcatattataagtcgctttgatttttttttttaagtttgaccaagtttatagaataatatagtagcatttccaacacaaacaaacataatatcaaaatatattcaaggttagatttaatgaaactaattttgtgttctagatgtcgctaaatttttctttaaacttggtcgagcttaaaaaaaattaactaggaaaaaagtcaaagcgacatactccctccgtcccataaaaaacccaatccttatgtccagattcaaaccaagaattggattttttatgggacggagggggtataatatgaaacagagggagtacatgtttgcaatgaatcattatgataaaataataaacatttctgttacattcaattggttataactttttgttttttgtaatcctcagttggactggtgaagagactaaggaactccagtatgctggcactattgcaagagtgtgcaacaaagtgcttcctatttcaagtattacaacacattaactcttaatgctgctgtcaaacattttctctgtaacactcaaaattttcagcaaccatcttgatatcatcttcttgttttaggcagttaaagctgcttcagatgctgaatcaggaggagtgcacttaagtggtggttcagctatgacactagaaaataagcagcaattattttgtttcttcatccttcaggcatttaaaacctaatgttattgtgcattatgcatgtttattctcctgatcgagccactcttttgctgagaatggctgccattgaaatgattacccaacttgcattacagcgtttttctaaacgtgaaggtactaatatgatgtcttatcatctgtgagaaagcgtgtttaaattcgtgaaaatattttcaaataatgtg

SEQ ID NO: 1870 - DNA, 247 bp, Oryza sativa
aaggcctacttgataatatccggctgcttttcatagatgatatagaggagaaattcaatatgcctgatgacgaagaggaatcttaagggttacatttcggaggattacaacaggttgaaggcgcaggccttacaagatttggagtacaaattcaaccaacagactgcaaggattatcaagcgttatgacctacccgagcacatcaggctggatctccaggagcaacactacaacaactacaaggtgc

SEQ ID NO: 1871 - DNA, 7368 bp, Oryza sativa
  unsure (1)..(7368): unsure at all n locations
nnnnnnnnnnnnnnnnnnnnnnnnnnnnnnnnnnnnnnnnnacagcagccatggcggcgaggaggtgggctgagggcgtcggctgcggcctgtggcagcgacgggaaggcaagacgaggcgacgccaactaggggtgtcgaggaggtagtggtgacgatgcagcactagttgtgggggcggcgacgaggcaccaagcaatgctctagccgatgatgtggtagccatatctggcaaaggccaccaggttaaccctccccaccggtagcatgtaaggccgcagttgctccgcctcaacacctcgtttcacgcgcttcaaccagccttcacccttcatgcaggacggatccaagaggtaggcttcatcaggctcgagcctaccatctgatttttgcaaaaaaaaaattaattatatagcatctatcccatgggagtagctggagaaggcttggagaagagaagaggtgaagaactgtctctgttggcgcgaggaagaagatcaggagcgatggaggtagctgaaccggtacgcagtatgcataaaatggcccatttatcactttagcaaaagcccacttggcccatttgtctattttatccattgacttagggttttggagtctggaggctgcgtgggcgtggctgctggccttggctttgccctgtggggatttttttttgtggaaaaagtacaccgaaggtccctcaacttgtcatcgagttacaaaatcgtccctaaccataaaaccatatatatgacatctctcaacttacaaaaccgttcacttaatgtccttaaatggttttgaccccggttttatccgacgtggcagctgagtcagcgtgggacccacgtgagccccacatgttaggattcagcaccctctcttttccccctccccttccttcctcctctctctctctctaactttttctcttctccgggcaatccggctggcgggtggggagaaggtcactggaccgaggtgggaggaggtccggcggccggtggctacacggacgcggttacatagcatttccctccggaataacgcggcggcggcaccacggactcatgcgatccacagtaggagctcatgcgggaaagcttcctgctcaattcctaggcttggggcgccgtggcgaattcgtttgatgagatggagggtgagttcttggagtacctgaacgtggtgcttcggccatggccgcgtgtggccgcctattggcggtcggcccccggcgacggcgtcggagatcgacaatcgcttcgttcagagatgttataacaatcgatgcgcagcggagacacatattttacgtggaaaacccttacgggaaaaaaccacggccgccgactggcaatcatcattatagaggagttgattacaaacgtacgggactaacaatgggaacgtcaccccttcctgtacggcttacaagagtatatataggggataaaagaaagacacctattaggatagacatagagtgctactatgaaactaatccgaatatattgtgggcccaaaattcggatcacatatttaacaagaaatcaaaagaacatcgacaccgtactgcgcccatcgattccgtcaagggcgccgttaccaagttcggatgaactgttgattggagagaagtaaattacatcgatctccattgctactgatcttgtcttgtggttaagcttagacagtgattagcattttgattttcttgtgatttgcccgtttctagtgtcgactgctgcgtgcagaggcacaaacaagtgcagggtgagcttgacctggtgcaggatgaggccaccgagtgccacaagagatcagaagaagcggaggccggcaaggcacatgcggtgaaggacctaggcggcaccaatgcgccttcttgatgagctaagacgaagcttggagaaggcgcaagccgagaaggcacgagcacggcaagacatggagctcgccgagctgcgtctccgagagacgcagcgagcgtcagcgagagccctgcggcgaagtcggaattcgtcgtcgccagggacctccatgccaccgccgaaatgagcatgcggccgctaccactgaggtggacgtccccgcttccaccgcccacctgtgcgctgcccctctcccaccgcccgcccacagctcctcccctcaccaccgctgcatcgcccgtggccggccgccgatgccctcgtcctctcaccggctgagtcaaagaagggagagagagatgaggaagggagagaagaggggaagagagagagagaggaggctgaggtggtagccagacatatgggtcccatgttggtcccacgctgactcagccgccacatagaataaaaccagggtcaaaaccgccgaaagacctattgtgaccggttttgattagttaaggggcaccggatatctggttttgcagttgaggaatgattttgtaactcgatgataagttgagggaccttcggtgtactttttccgttttttttggcgtcgagccgtcgacggcgtgcgattgccaataagatatcagacgattggcttaatgatttgatggtatgctatactgagcgagagatattcaaaagtattgatgataatgcaatcatgaagcgattccaagccttgaaaacccccaaaatatcctttcctcgtgaataaattgtaacagcttagtggtatgtggtatgttgcttcttttagttagcatttgtttacttctaccatttatgcaatactaattttgctcatttatatattcaggtggctgctcactttactctttgctaaggcccaagaaaattagcatcttaagtcaaggactcaaggtattcttttataagtatatttttctattaaatcatgtaagtgttacatttgaattgataatggcatgtgccttattttagcattatcaacttaaatttagacttctagtccagcctatcctcaatttttattctggattcgccacttgggctaccttacactagtacagatccttccatctgtgacggcccataacaagactggaatttgcgggccgtcacaaggaagtaatttcaatcgggccgaagtttcgcccgattgagatatggtcgcacagccatggtatatcggcataaaactaaagcccatcacggatgacacttatctgtgacgggctatagttgaggcccgattgagatgagggtaccatatctcaatcgggccctaaaagaagcccgtcacagatgagggtcatctgtgacgggctccaactagaggcccgattgagataagtttattgcccgtcacagatgacactcttttttgacggccttttattaaggcccgatagagattacttgtatgcccgtcatggttgattgttttagggccgttacagatatttgttgcacagtataaataccccccaccacctagtgtaactgtatcccactgttcactattttggtgggaggctgtagggggcgattttttgtcctttttccaaggaaaacagaaattaaattcccaaaagtgatcaaaatggatcaatcaagtgagtaatataaatcattaattgagcaatttcatcacatcttacttttgcaatactgatcttataatatgtgcctctaatttgttttttttagcaattgatcgaagttggatgtatgccaaaaaattgaaacgtcattgtacggagtaccgaaagggcgtaataaattttatgaacgccgcggaggaggatcggataagaagaaacagtgattacatttgttgtccatgtgcagattgcaagaatgagaatatgtttgatagcggagaggacgtacacggtcatctgatacaacgaggattcatggagggctatacatgttgggtgaagcatggagagcaagaatcaggaagtggagcagcagcagacagaagtgtgtgcataatcaggaagatgaaaatgagcatgacatgtttataccttctccattgggcggtgaaatggttgatgtggatcacgatctgctgcaagacatgttacgtgatgttgaggacctagcccagaatgagagagatggaatgaaattcagcaggttggtaagtgattccgagacgcctttgtacgctggatgcaaagcaaaacacactaagttgtcagttaccttgaacctaatgaaggtaaaggcaagtagtggatggacagacaagagtttcacagatcttttaggaattttgaaggctatgcatcctgttgagaacacattgcccgagacgacatacgaagcaaagcaggttctgtgtccactggggttagaggtccgtagaattcacgcttgtcccaacgactgcatattgtaccacaagcaatatgcggacttggatgcttgtcctgtctgcaaggtttcacgatacaagcgaaagaaaagtgctgacgaaggaaataagtcaaagaggggtggtccggcaaaggttgtgtggtatctacctatcattgatcgtttcaaaagaatctttgccaacccgaacgaagcgaagttagtacgttggcacgccacggaaagaaggaatgatggtatgcttagacacccagcggattcgattgaatggaggaatatagatcgaaaacacaaagactttgctgccgaccctagaaacatgaggatatgtctttgtacggatggcatgaatcctttcggtgacatgagtagtactcacagcatttggccagttcttattgcgaactataacctcccgctatggttatgctttaaacagaaatatattatgttgtgcttgttaatctaaggtccaaggcaacccggcaatgatatcgatgtattcctggagcctgttatcgacgatctggagattctttggaaagaaagtgtggaaacttgggatgcatatggtcaggagaacttcaagctaagagttctattgttctgcaccattaatgactaccctgcactcggtaatctttccggacaaactataaaaggaaagaaggcatgctccgattgcaaggaacatccacgaaaccggtggctgaagaaatcacgaaagatggtatacatgggtcaccggaggttgctcccggtacgtcacacatttagaagaaagaagaaaatttttaatggtaagagagaacttcagcctgctcccaaagatttgtccggagatgaggtccacaatatggtcaaggacataagcaatgagtttgggaagaaaagaaaacgtagcaagacaaaggagaagggtatgtggaagaaaaaaatccatattttggcggctaccttactggaaagatcttgatgtccgtcattgcattgatctcatgcatgtagaaaagaatgtgtgtgagagtttggttggcctgatgttgaatattcccgggaagacaaaggacgggttgaacgcgcgccttgatctacaggacatgaatattcgcagcgaactccagcccaaacgagatgcagagataggtaaagtgtacctccctccagcctgccacacactgtcggaggatgagaagatcgcaatgttatcatgcttgaaggatattaaagttccatcgggctattcagcgaggataagtaagtatgttaaattggacgatctaaaacttgttggaatgaagtctcacgattgccacgtgctaatcacacaaatcttgccagttgctatcagaggcattctaccaccgaaagtgcgtcacacgatccaacgtctgtgcgccttcttcaatgcaattggacagaaggttatagatcctgaagatctagatgggctgcagaccgatattgtgaataccctctgtcacctggagatgtttttcccactgtctttctttgatataatggttcatctctctgttcatctggtgaagcaaacaaaactatgtggtccggcttttctaagggaaatgtggccgtttgaaaggtacatgggagttctaaagtcgtacattcgtagcagagctaaacccgaggggagcatcattaaaggttacacgaccgaggaggctattgagttctgtgtcaattacatgtccgatgccgatcctatcggagttccagcgtctcgtcacgagggaaggttgtcaggtgttggcacaattggaaggaaaagaattaggcccgatcaagcgtcgtacgtgcaggctcattatgctgtgctccaacatatggcagaagttgtcccatactttgaggagcacttagcgaaaatccgagatgagaacttggggcgatctgatgcatggattaacagagaacataattctcggttcaacgaatggttcaagaatcgtgtgacaatgtccacggatgtcccaaatgagacagtacaattgttggggatgggaccgtcttggaccatagacacatggcaaggatacgatataaatggatacacattttacaccgtcaaacaagatgacaaaagcacagtgcaaaacagcggcgtccgtatagatgcattccaggatcaagttgggtcaaacacatactacggccgcattgaggagatctgggagctaaactacgtcaagttcaaggttcctttgttccactgccgttgggtgaatctacgcactagtgtcaaagccgacaaggaaggtttcactttagtagatctatctaaggtgggatacgccgatgaaccatttgtacttgcgaaacaggtcgagcagatattctacacaaaagacccttcaaacaagaagatgcacatcgtgagggatggaaagcgccaaattgtaggagttgacaacgtcgtcgatgaagaagaatacaaccataatcttcatgtaagacctcacattgaccttgacgatgatccccaagagtctgtggcatatgctcgttcagatcataccgaaggcataaccttatgactgatgcatttatacttatctattgtaatgaatggagtattttgttttattgcaaagacttgatatatgtagtcattaatatggctaattttgttttattacaaatgaccaaaataaaagttgtagatcttgatgagatgatcaactttgttgttgaccatatttcaatttgaaatcatttagtatttacaaatgctgttaattagatttgtcatattgtcgaaatcaatttcaagctattgggaaaaaaattatatagaataatgaccaaaataaaaatagtagatcttgaaaggctctacaactttgttgttgaccatatttccatttgaaatcttttactatccgaaaatgtattatgactaataaaatgaattattacacagctgctatatattttgcacccacaacaaatgaaagatggaaaatgagtcattggtgacgggccttagtttacggccgatagagattaatctatctcaatcggg

SEQ ID NO: 1872 - DNA, 11481 bp, Oryza sativa
atgacaaatctaaacagcatttgtaaatattacatgactttaaatgggaaagccataaatagctaacttgtacagctaatcaagatctacaacttttattttagtcacttcttcatccgacaaagtgatagtaccaatgtttacaaaattgacatatctgtgttaatatttataaaccagatgagagaaatgtgatttttgtgaataatataactatcactttgtcggatgaagaagtaaccaaaataaaaattgtagatcttgatgagaggatcaactttgttgttgaccatatttccatttgaaatcatttagtatttacaaatgttgattatatttgtcatattgtgaaaatcaatttcaagctgttagaaacaaagttatatagataaatgaccaaaataaaagttgtagttcttgatgagaggatcaactttgttgttgaccatatttccatttcaaatcatttagtatttacaaatgctgtttagatttgtcatattatcaaaatcaatttcaagctgttggaaacaaagttatatagacaaatgaccaaaataaaagttgtagatcttgataacctctacaattttgttgttgaccatatttcgatttgaaataatttactatccgaaaatatgttatgactaataaaatgaattattatacaacagctatatattttgtactcacaaatataaagacttatctgggaaatggaaaaatagtcatcagtgacgggccttagttcaagcccgatagagattaatctatctctatcgggcattatcttagggcccgtcacagatgagtcatccgtgacgggcctgactgtcatctcaatcgggcattagtatggagcccgtcaccgatgagtcatctgtgacaggccctacggcaaagcccgattgagatgactcatcactctaatataactagggtttctcagatcggatcgaaaatttttctaagtcccgctacagtttcccgcctccttagaaccctagcgccgccgtcatcctccctcgccaagcccgccgccgtcgccaccgagcccgccgccgtcgccaccgagcccgccgccaccgcagtcgtcctccctcgccaagcctgccgtcgtcaccaccgagcctcctcggccctccattcagacctccgccgccgagcctcctcaccgacgaccctccccccgagcaggaagccgccgccgccaccgagcctttacaccgatcggaccagtgttggccttcctcgtcgtcgccgcccgcgtcctcaccgacccacgtcgccgacccccatagagcacgacgccgcccgcccggtgccgacctgcccgatcggcgtctccaccgaccggcgccgccctccaccgagcccgggcgccgccgagccccaccggccatcctcaggtgagtcctccatcgcgtcgccctctactaactgtgaatgacatgtcattgaaatgtggatgtggatgatatgtgattgaactgtgagtgagacatgtcgatgttgggatgaaatgtggtgcatttatgaattttgtgatagatgattgtagtaattgatgaaatgtggttcatttaactttatttatatgcaatgtggttcatgttgggatgaaatgtggtttattcatgttgggatgaaatgtggtttattcatgttgggatgaaatgtggtttatttaagttgggatgaaatgtggtttatttatgttgggatgaaatgagatttatttatgttgggatgaaatgagatttatttatgttgggatgaaatgtggtttattcatgttgggatgaaatgtagtttatttatgttgggatgaaatgtggtttatttatgttgggatgaaatgtggtgcattaatgaaattattgtgaaatgtggttaatagattgtaataaattgtagcactaaattatgtttttttttgtttttttggaaaaaagtagataatgtctcagcaaggcgaaccaatgtcgacgacaactagtgggtcctcaagggcacgtactcctaggacagggaacaaaattcctaaggaacggttccgcataacagcggtggacgccgtagggttgccgacatctccaaggaaaatattgagccgatttaggtctatctgcggggtcatagggaggcagaaattcagtattctgtaagacgacttcaagctcatgccggccgcagagaaggacattgcttggctaatgttcaaggagagctttgattatcctgcggagcatgaggaccgtctcaggcgggctgctttcaaggttatgggcactgcttggaagaacttcaaaactaagctagtcggcgagttcgtctacaacccggcaaatccagatccaagagagaaatttccttggatcacagaacaggtctgggaggaattccatgcgaagaagtcgacccccgagtccagagctagaagcgaggcatatcgcttgctccagaccaggaaccagcatccgcaccggcttggtaccactggatatgccggtaaggaagaggaatggcagcgtgaggatgaagaagcggaggaatcgtgcacaccgctcgtgtttggcgatatcccacaccctcgggctaggaactgggccagggctaggtaccagaaacatgatgatggcacaatcttcatgccaaatgcagaagatcaacgagtatacgaagctatagtaagtgtctagtcaaactagatgttcgcattgtttcccatcgtgcagtttatttgaccccactaaattgtaatgcagaaggagttggttgccgagcaacaagcctcgcaagaggcctgctctcaaagacgcgaggacgacctcctcacgaaagcgttgggcaacaaggaacaccgtggacggacacggggcattgggtcttctgttccttggaagtatggatttccagactacgcgtggcagtacaagaagcggacttccaacaaggcggagaaagatgcacaccttgaagccaagatccaggagtcgatacgagctgagctgacatctgaattcgacgaaaagctcgagtcgatgagggccaagattaggcaagagatccgagaagagcaatagatcccccaggccgtcgttgctgctgcgcacaaagagttaggaagtcccaccgaaaaacgcagcagttgcgcatcaactgagttggcggaaaatccaacatcggtcgacagcgccgtcgaccacataacggtaaccgtgaacttactcaatacatgaaagacgtaacaaatccatatgatatataatattctaaaaaaattgattaatctatcacaggaaccaacgagctgcaccctcacagttagggtgatgccgaccttcactgttccagcagccgagggacttgcgtacaagccgaccccagagacaagagtgcatggagcgcaactcagggccgactgtgcaaaagttcaagtcgactcggcgaagcccgaatacgagctgttccctctgaagtatctaccaaacgacgaggtcctctcactaggaaatgcccgtggtaccttcatccaatggcccaaggacctcattgagatcaggttacagcgaggccaaccactgcaccaggcggtcgtccaccaaagagacccgcttctactccttcagcccctcctgctcaagatcgtcatgcacaatcttacaatgtgtagttgcagtacgatacggattttggggaggaccgaacggaggccgacagcaaggcgattaatgaacccccaccgatgaagaagagcaggaaggcacactcttccccttagagaattactctcgataaacccgaagcaaaggggtgaggaaggggaggaaaggtgcaggcctcgcttctagctccaagaaagctagatctgggcaagagccaggaagagactaagggcaaagaggtcaagaagaaatacgtcgctccacaggagttccaactaggcatgccattggttggagatgacgtgcttcccgcaatgggcaccgcttgcaaggaccttcacttatactacatggagaaatctaacgccaggaagccaaataaagctaccgatatccttggacagcacgatggaaagccattccttggtccaacaaattatatcgtggtcgacttcaaggatcttttcgacctctacaggctccgagcggtggacacaagcctccttaagtgctactccttgtaagtattgtcgcccaactcattctggtaataacaatcggtttaacttgcttacaagatcgttgatcctgtgtgtaggttaagttggcaatggtgtcagaagcatgcaccagaagttgccttccttgatccacaagtggtcactgtcacaaatctccataatgaccgtcaatgaatggtcaactacatctacgacaccttgtggtcccgccgagacaaggagtacattatgtgtgcctataatcaatagtaagtgtgttaactaaatatacacaacagcatgacacattccttgagtacttaattaactttcactatattaatgccgcagtgcccattggatccttctggtcataacacctaaatggagtacatgtcattacctgaactccagaattgataagaacgcatatgattggaccccaattcaactagcgatagatgaagcgtgggcccaatacgtgcaaagaggaggcctcaggaagacaggacatgacaccctcatccacaaaaaagacttcccggtgaagcaacaaataggtaaccagtgcggattccatgtgtgccacaacatgcgacttctgtatagagaaaaggtgaagactttggctgagtttgaggtcggtggtctcaattgtgatagactaactacattttagtacttttatatgatcgatcaactaatctggatttatgacaatgtagggcacaataaccaagtctctgactaccagctttgaggaggttcgcgaggagatagccagcttcatcctccgcgaaataattaaccccaaaggaatgtttaggcttaaactaaaatgatgaacaatgttgaacttctatgtttaggcaatgatgaacacttattatgcaactgtgatgatgtcactgtgatgcttatatttatgtatatattttatatgtttatgttaagacttgctaaataaatatttgatccaattaactcggttttacaggtaaaatatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagctggggatattggatatctgtgtttgtttctgttatttttacagcgggcatggctagcaaaggccagaggctagccaaaaaacaatttttttttgtggattatagtcatctgtgacgggccataactaaatgcccgattgagatgaggtcatctgtgacgggctctagcttaggcccgattgaggtcactagtcatctgtgacgggctctagttttggcccgattgaggtcagcagtcatctgtgacgggctctagtttaggcccgattgaggtcatcagtcatctatgacgggctatagtttaggcccgattgagatgagtatcatctgtgacgggctctagtttaggcccgataaaggttagtagtcatctgtgacgggcgctagttgtggcctgatagagataggtcatctgtgacgggctatagtttgactggtcgtctgggtcaaagctatcggtgacgggctttacttagggcccgattgagatatattcattcgtgacggccgtttgcccgattgagataactctttacatcagtgacttctagcctgtgacggacgctgtgcccgattgagatggggcttaccgcccgattgagatgagggtatccgttctagtgttagaatcttatgcctctgcgtactagaataccacgtcaatcaaaacaaccatccatgctgccttaggattttatgtaaccaggtttttaatgttggggattcaacatttcatgtattgtggttgaaggatataatctaaacttgatgtaaaaataaaagacttaaagtgaagttattcccatgttacaaaatactccatccgtttcacaatgtaagtcattctagcattttccacattcatattgatgttaatgaatctagacatatatatttatctagatttattaacataaatatgaatgtgagaaaagctacagtgacttacatcgtgaaacggaggaagtaggaagcatctccactccctcactggaacagcctattgcactacgtactgattcactcagcccatgttgggaaaggggaagcttatggtggctgtccaaatcttatggtaccaccaaggcaccaagcgattttttgagagaaatattttttttttgtgagaaggcaccaagcgattaatcgggatatggacaagctgaatcaactcctttttaatacagtactggtcctaaagtgaacgtgaggtccgtaggttgtaggtgcgtgtaaggaattttgctactatatataagcccattctacttaggtattttttgtaagtcgtaacataaagtcatggtgaaataaaatagaagaagaatagttggattttttttaattcaagaatagctggattgggcatgtaacaatatttacggaatatgtaaattgaattgagcccaagcgaagcttatactcctactttttaatttacttctgtgcaatccaagttatagtgacatcctggtaattaaggctaagcagatcttgcctaacaaagagcatttaaaatgcagctaatccaactccaaattaagcgttcgaaccaaaatatctcattctatttataaaataaaagaaagagctagcgtagtttgtcctaaaaccaagattaagcgcacttgaagatcacctagaagcttcgcatgattttgttctacttctccgtttcacaatgtaagtcattctagcattttccatattcatattgatgttaatgaatctagacttcattaactttaatatgaactaggaaggtagcccatgcattgcgcgggcatgtattttattgtgttcgaaaaacttacatagatcgaatatcaactcaatgacattgccatgtttcataagtactatttctccataattttacttcatcggcattgcttagataatttttccaaactatttgttagcttttaaaatatataatatttaattcattcgtataaacaattatctatgatccgtataaacatttgtcatgtttcaaagtatctatttagtttgtttggaaaaaacatatctaacaaattaaacgtaaattaaaagtaaaatattttgtcttgtttaattgaatgtttagtggctttttttaacaaatcctaaagcactattattgttagtaaacatgttttatttgtaccatcaagttagtcctctttttagttggtttagattcacacaagttgttacatacttacatataaattaacaaatacatatcgtagaccatcgcttccttgtaatatgtttgacctatagtatcttttctaaaagaaaatatagttaacatgagttcaaaaatttaaatttaatagtaataaatataaattttcaactaactatatgtatactgctaccatagtgtggcttaataggctgagaaactcattataccatggtatagaatagatgcaagggcattaatatgtaagcatttaaaaaaattataaaaatagagcatgtaatgcttggtccaattttagtgaaaggtacgaacttatttgattttctccaaatagttcaacttagtccatattgatattttatattttaaattttattttataccagttcaaactatagaggttatgaacctttaaattgatgatttaattatgaatagagcaatagttagattagaaattagatgtacagctaaaaaattgcatgttttaatattattgattatttctcgctataaaaaggaggggtaaaggagagagtggagaactcaagctgagacaggagggggggggggaggggatgggtagtactgtgttgtgcacatctaatgatttaagtgaaaaccgatgatccactttttttgtcaaaatttttaatatcctttgcgtctaaattttaaggcgtaacacatggcagcttaagattttctctaatattatatctattggttaaaataatagatccacctattaagtggaaactgatggtcagatgtcttttcttataatttctaaggtcttacttttaattaagatgtaacacgtaagttacataccactgtaaatgtgctacagaggatgtacaatgatttgaggtgatgcaatacttattgtcactttttttataatgctctattttttttctatttggttaccatgcaaaggatatataggtgtgtgtgcttaaatggagtattttcatttttatggagtgaaatatgagtaatatgcatcttcaattatttatttaattataaaaaaaataacagttcaaataaactaaaaaacagttatgacataagaatcataattatttagctttgtaattattgatcattttttattattttgttaattagttaaaaattataagatagaggagttgagtgagataggagaagaagagaaagtcgaatgggacaaagtatgtgtacatataattatttttttacatttattgtgttttacttattattactttattaactaaaaataaaataaaagctttattgattgattaagatctatcttttttactcgtcttttcctacatagtatacaatattgaaaatgtgaacattacaaatctactactgttatttttgctttattataatatcataatgggaggagtaaatttttggaacaatacttagtgttattaggttcattttacctttttgtcattacatatctaattgaattattgtgaacttatatacaatgataaaatatatatcattactattcacaattttataattgtttgaatggcacataaaagtcagataatataaccccaaatatgggtctttaaatgtaaaataatcaaaatacataagcaaaaatattactcgtatgatataggggatctcatgattgagatgttatagctgcttatttttttcgtataactcttgctttctaacttatatattttgggaacattactcatagctatttttttagattttatgattgtagatataatttaattcttatgaagttatgcacaatgatagagtctataataatattatttcatatttattgtaattgcttgaacggtacgcaaaagtctggaaatataatccaaagtgtcatttttttcctcaaagttgaattattgtggaattttggtctttgcctgtagatgcagtcataaataattttaagatataagcggattaaaagttagttgtatgatttagatgttatagttgttgaattgtttaacacaaaaaatatattttctaactaataaagtatatgataataggggaagaaatatgtgcaaaaatatgaagaaattgagggatgaaggggtggatgtacgttactaacgtacgcacgtactatccttaagaatccttaagaaaacgtacgctacatacagtcccaatttggatccggtttgggggttagggagttcttttaaagacaaatctaatggtggtaaataatgggtccacataatttaatgaaaattaatgtctagatgtttggttttttcttaaaatttttagaaatttctctaatttattacagtgacacgtggtgtcttagtaagtagcgcttgcaggatgccacatggtggcttagaaaagtttgttatataatagatctaacttaatttgttcatgcatattctgtgaattgatatatgattgtgtaatctacattatcaatttttccctattttatatgacagttttccgtgttatgcaaagtttaggaggtgataaaaaattaaatatttcatataggttaaagaacaccatatattttttaattgttgatagactacgtgcaaataactatagaaaaaatatggttatttaagatttattattgtttaaaaatttgtataactaaagaaaaaagaagaagagattggataggaggggagggaagacgtacctacggacgtacgaacttgagttgtacgtccagttgaaggatgggcccatggggagaggagagggtaggggagtttgtggggttatttttttaataaaattctaatagacaaaaatattggacctaccggtttgttaagatgccatatagcggtttaggagtatttgtaggagtacacatggtggcttaggagcgtttgtaggaagtttcttggacttttagtatataatagatagatagataatagatgtggggaatgatagaatgacttacattgtgaatcggagtgagtagaaggtacactagcacaaaagaagtgagcttgttcttgaaatgtcactttcactaaaaaaatagttggagagagaggagaggccccctatcacacccgagcaactaacctgggggcgacatgcaagccctaccgccaccaccctcctccccattcccaaccgtacgcagccggagctagccgccggaaattgagcggctagctaggattgcgatggtggggctcggtttttgtgcccctccggcatggagagagtgttgccggacgacggcggcagtacgagggaggtgcgtgcggcgaactcgctgaccgagcttattagcgagtgtgttggggggcatattgcggagcagctttcgacccaggtttggtggccattccccgtcgctcctcctagatctggggcttcctcaccttgtccgtggtcggtgcgagggacctgcctttctctagctatcctcctcggccgtgcacggtgtggaagttggtggggatggtgctaacgagctcctctgagccaggatgctagatgtgttgctcctcgcgaggtggcggggtggagaggatgagtgacttctacgggttggcagcaaacctcaagggctggtgtgttgacagaaaacacgtgacctgggagatctgcttaactctagtgcaggtccaaagctcgccttcgaatgtatgagcgtgccagttgatttgatcctgtaatcaacaaaaaatagaagcaaagaaaccgcggttaaatctataaatgatagtcgatcggctaggtgccgatgacatatcatttatctttgagccgatgtcatatatgtatcgatcggcagtcatgaataaacaagaaggaactaaatctactcgatcggctgtaggtattcacaatatatactccttgtatcgatatatacttaaatcaagtgattgggatagatcggacgccatgccgagacagtataaatcacttaaatcgaaatatatattaat

SEQ ID NO: 1873 - DNA, 24244 bp, Oryza sativa
aacccgaaagcaagaactcgtcgaaataaaactaaagcaaaaagggtggcgatgcgccgaaattgtattgaacgtgtgtgttaaaagttacatagggctcgggtctatttatacccgagaattacaagatatgcccataacggacacgactaatatctttaacaaactctaagataccataagtctttacggcagacttttgcccaagcatatctctaaggaaattacataaaatatcctaattaatagatacaattgacttctcaagactctatccatgtgcggcaatcatcttgaagcgccttaattcaacccaatatcatacatcaagttgcattatcggaatcggttgtatcagcttacctagtccgactcagacccagccgatcctaatcgtagccgatctggactccagccgattcctgctctgtttctgaactcaatctccgcctccgactttgcttcgatctaatattctttcccgatgccgatattaccaaatttggttgttaacacatgccccccaagtccggaatatttggtaatgtttcggatttgctgtaaatcgaccccgagtaagttcgcactttgccgttttccgaccgttactgccatgctttaaatattaaacgtcaccctcgagaaatctcacaccgtgacttccgttttcaccgctcaagcgaaactttgtcttctctctctccagcgattcctccgacgcaaaagcgacttccaggtgacttcatcttcggcgagatttccgcctgcagcgatgtcgtcctgcaccaacccatctgatgcgccttcagccgagtatgctgaggtaagttcccgtcggcttgatcccctttcttagcagcagatcgattttctcttatcttacattgctctctttttctctgttgttttggatttgtagcatctcttcaacctagtcgcgattcccagcctttcgcacaaaatccactattttcttggcccaatcggcaacctcgaccccactgatttcatcattggtgaaaccaaccggatcccctttagactagccaaccctaacctgggtcactggaagaataccttcaagtcttggccatctctcgaaaaacccacacctgataaaagctggaccacctggtaccaacgcgtatcgtctagtaagaaagttcactgggatgagattggaatcggccaagcgcttgctctcaccatagccaattctgctaaggatgaacctctgatggctaccgccacctacttttggtccaacaccatcaatgctttcttattcaaccaagggccgatgactccaactttaatcgacatcaccatgattactggattagatgtaacttcattggctaaccctatgagtatgaacaccaagaaccaatttgacttcaagaccaaaagcataggtggctagtctggctatgtggcagcatatatgggccaagggtctgttacccctcgggaacatgtagctttcttgctcatgtggttagaaaagttccccttctatggatctagttgtggccctacaaccaacaggcaatttgtagctgaagccttagaatcaaagaaagaatttcctttgggcaaaatccatctcggctatctgtaccaaacattgaacaacgcatcggctaaaatagccgtcggctcaatagttggagcaggcggaccatggtggctgctgcaaacctggttagtcctgatagtcatgaaggttgtcaatcggccctctatgacagaagctgaattcccactgccagagccgattgcaggagacgatggagaagagcgcacccatcgcagatgcatgtcatatggagaatatgcatccacaccaaccgatgctggagcgaagctatcggctgagctacttaagaattggttctgcagctcctatgaaggttttaagaaagatgcacgaatctggtttccctatgaagactcagcagaccttgaacttccatcggactttagatttgaagacattaatcatgaaaaattccaaaaatccagagaagttcttatagctacaatcagcctatgcatcctccccgtcggcattcaccaagggagaaacatccaagtctcctacgagttttatcacccaatgagctcggccagacaacttggattgggccaactcccaatcggcttattctttgccgacaagattcaatgccgaggacaaatcacatccactctaatgatggatcggctacttaacctaccaagaccccctctgggcagcattgataatattgagttggcaggatttagaagcaaaaactttgacagatggtggggtgaatggaagctgcatctatttcatcaatcggcttcaatgtatatgacagatctattccctgacgtcataccccaggtaaactttgtcattactaaattgcataatcagttagccgattcattacttgactaatctttttctcctattttgcagacaacagagtcctcccctcctcatcaaagtaatagtggcaaggacattgaatatgctcaaggtctaattccgaatggaggtggactatctccccctgttatcagctaccatgcccccaagacttcaactcttcttcacggcctaaccagggaactagccgatgcacgcaagaaaaggaaaaccagatcatcggccatgagtaccttggtcttagctccaaagaaaaaggccaaattcaagaaaactaaaccgactgataagtcggctgatgatctacccgccttggatacatctattgaacaagctttagatgcagaggaaattggtgaagatgttgaccaggctgtagccgaaatgagtgacacagaaagaacaccatcggcttcacccaagcaaacgcctccaactccttctgcccccattcattttacaagagtaagtatctctctttgacatcttctaaaattacttccctcttcggctaattactcatagactttgtggttgcagaaaaagaaaactgctgtgaagaaaaagccagcagcaacgattgccaagtcggctccaccagtaagatgactttaattcttttacttaatcaaactcaaccggctctatataacacttgtctattctacagcctcctcttgcttctcctcctgtatagcaatcgtcaagtgaccagactccatcggctgtggggagtcatcacatcaaggaggaagaacaaccagctgctcctgctatcccagtaagttttcctttgtctcaacaattagatcggctataatttacccaactcttactttttccgaaattgtctctgcaggttctagccgatatcttctcttttgatatcagagattaccttgatgaggcagacgaagacacttcaagcaaagccctagctcccctatccgatgatgtaagaaaaacacttgaagacatctctcatcggctagaagcctcttctttagatagcttggtagttgactgtggatcaattaggtcacggctgcatgaaattcaggctctgattcccgaagatttggccgatgtcctaactccagccgcttatctcgagcaacatcagttcaagctggaaaaagccaagctaagactagccgaacgccgtgagcgcaaagagattgaggtcacaatccaagctaatcggcagcttgtgcatgaggaaaaaaccaaacttgatcagctatctgaaggtccgatcaaatccaatattgatcagcttgaagctcgcaagattgagctcttggtgcaacttgaagaatgcaatgccgcgctagatatggaacacaaaaaactagtcgatctcccaaaatcaattgaagaacaaaaaacaaggctgaaatcggctatcaagaatgttgcgaacttgaccaagtccctaaaagtcatccctggaactgatgctcaagatgcccaagctattgaagaagtagaacaaattaggcaaagggctattttggctatccagcgatacttgtctcaataacttttgtgtaataggacttagaaattttgtaatcggctaagacgttctaatactttactgtcttgacaatcctttgtgccgattaatatgatttttaatatgactttgaaattcgctcaaaaatttgcattgcattttgatatatatatgtgcccccctaattttacagtgtcaaaagcactggtaaaattataaaacaactaagggcgatataacaatatcagccactgtacatcggcaaaccacaaccgattacaccatgaaaaacaactaagggcgatataaccatatcggccgtctcaaggcgatgtaaacacatcggctgtcatgcatcggcaatgctagacgatcatgcgttaacccaaacacttgggtaatattgcttcaaatatttgccattgagcgctcgcccatagacttcaccatcaagcccttacagcatatatgctcccttagacacaactttataaatttggaacggtccttcccaattcggcgaccacttgccaaatttactatcacgagtaccaatcggcaaaaccaacttccatacaagttctccttccgaaaaatctttaggtaccactttcttattataatgccgagcaacacgttccttatccttggtaacctttgcaagggctcgcaatcgtgactgaaccagatcctccctctcatcggccataaggttgtaatactcatcgactgttaaatcgttttggaactccgttcttcgagagccgattctaacctcccacggcaaaacagcctcatgcccataaacaagtttgtaaggagggacttggatggatccatgacaagccatcctagaagaccacaacgcttcggccaaccgagcatgccattgccgaggataatcagaaattttccgcttaatcaatttgatcaaaattttattagacgcctcggcttgcccattagtttgtgcataataaggtgaagaattcaacaatttgatacccatgctatcggcaaactgaacaaactcatcggacacgaagattgaaccctgatctgtagtaatagtttaaggaataccaaatcggtagattatatgttcttgaactaattgaatggcatccccagaatcaactttcttcaaagcaatcgcctgcacccacttggtgaaataatcagttgccaccaatataaatttatgtcctttactcgatggtgggtttatcataccgatcatatcaattccccaacctccgaatggccatggcttaataataggattcatagccgacgtcggcgctcgctgaattgctccaaacttctgacaatcttgacaccccttataatatctgaaacaatcctccagcattgtcggccaaaaataccctgcacaccaaagtaaccacttcatcttatgagccaattgatgagtaccacaaattccttcatgaacttcgccgattgcaactttagcctgatcggcactcaagcacttaagtaacactccatcaatcgtccaataataaacctcatcatccaacagtgtatactttaatggcttatatcttaatttcctagaagccgattgagatggattattcaaatattgatgcacatcatacctccaatcatcggctgtcatcgctgcaatttcaactttaacatctttgatcatcggcttataccccgacgccccttgagctaaatcattagcttcaacattttgttctcgagagacatgctttaaagtaaccagccgaaactctttcattagttcgtggcacttctcataataaactatcaatgtatcattcttgcatccatactctcctgccaattgactgattattagcaaagaatcccccatgatttcaatggcatcggcttcaacttccttgagtaattgcaaccctttgagcactgcttcatactcagcttgattattagtcgcatacggtttaatagtataagcaaactcgaagcatgccccctaggggaaattataaccagaccgataccacaaccatgagtacacaccgatctatcaaagaataaagtccacggcactatatcaactgagccaattgaatcattatgatgttccacaataaaatcggccatagcttgtcccttaattgccttcaacgactcataccgaagatcaaactcggttaaggaaaatatccacttttcaacccttcctttcaatattggagccgatagcatgtccttgacaacgtgggccttgcatataacagtgcactcattggatagtagataatgcctcaaccttgtacacgaaaaatacaaacacaagcataacttctccataggggagtaccgagcttcagcatccaagagtcgacgactgagatagaatacaactcgttccttcccttccaactcctgaatcaagactgagccgattgacttctcaccggccgataaatataacctaaacggtattcctttttgtggaggaatcaaaacaggaggagagctcagatattccttaatattatccaaagccttttgctgctctgcccccaagtaaactgctgatcggctttcaatctcaaccaatggtgtaaaaggttctaactttccagacaaattagaaataaatcttctaacaaaatttatcttgccgatcatctcttgtaattctgtcttattctctggaggctaaatcttcttgatcgcattaacactcctttgagttacctcgatccccctttcatgaacaagaaatcccaaaaactggctagccgatacaccaaaagcacatttcgtcgggttcatcttcaggccatattttctggttctctcgaaaaccttcctcaaatcggttatatggtcctctatttctttagacttaacaaccacatcatcgatgtagacttcaccaaccagccgattaaattacgatgtatgtaattcatggctctttgatatgtagctccagcacttttcaagccgaaagtcatgacaacccactcaaataagccgattgcaccaggacacctaaaagctgtcttatgaatgtcttcttcggccataaaaatttgattgtatcccgcgtttccatccataaaactcaaaatcttatgtcccgaagcagcatcaactaattgatcggctactggcattgggtattcatctttcggagtggccttattcaaatttcggaaaacaatgcataccctgaccttgtcgtttttcttgataacaggaactatactagaaacccattcagtgtatcggcaaggacgaatacaaccagcatcatacaatcgtttaatctcagctttgacaggttcaagcatatcggccttgtacctcctcggaggttgttgatgcggcctaacccctagtatgataggtagccgattttcaacaatcgattggctaactccaggcatctcataatactcccaagcgaagcaatctctaaacccttttaagagctctatcagcttggttctaaactctggagataagttcttactaataaatgtcggccttggccgatcgcctggacctatgtctatttctaccagatcatcggccgacatgaaaccttgaccttgcttgtcatcgagatcatctactgtatccttagtgtagacatttgaaccctccacgacgccctcaaaataatagcttgggttctccatcttcgattggctgtatatcagaatcggacacttttagaaaatctccatcctagactttttcagataaacaatcaaggccatccatctctcaaagagctaaatcggcactggcaacattaactgacctgtcggctggcatgatctctatcttgtcgccttgccattgaatcaaacactgatgcatagttgaaggaatgcaacaattggcgtgaatccaatcccttccaagcaacaagctgtaagaacccttcccatcgatgacaaaaaacgtggtaggaatagtcttactgtcgactgtcagctccacattcagaacacctttggtttccgatggattaccaccaaagtctttgagcatcatgtttgtcttgatgaaatcctcggcatttctacccaactttctgaacgtagcataaggcatcaaatttaccgcggcctcaccatcaaccatcattttagacatcggcttcccattgacgtagccgtttatatacaatggtttaagatactgattctctgtcccctcgggtttctcgaacactgcctgttctggtgacagaaccaacttagccgattcctcttccgcctcgtcgacatcggcttgatcgatcccgaattcggctagcaaggtaaagaccatgttaaccggtgccgtcacaacactcttcccttttgccaacctctttgcctcatcggctgcaacatcatcggctacaggaaccagattcttaacacgccactcctgccttggctttgctttcttcagccgatgattaatttcttgttcaacctcctgaaggcgctccctgttcctcaatctttgaacccttctcttctgattcttcgtgaaaataccagaaggacaccattgattcttcctgattacattgtcctcttggccatgatcttgattcactggacctaatctttgatgaacggaaactcttgtctgccttagccgattacccttattatatgatcggcttgaactctcgacaatatcactgcacccaggcagttttcaatagatggcaacctcataccttcattccagcagaatctaaagaactcacaaccccaatgaggatcaaaaccatcattgtattcttcattatgcttctcctgctgcctgtcatacttcctctgatatttgttgataatcttagccgaattcacctaaaaaccccttgcacgggtcctatcggctgtttggccagctgtatgcaccatattaacaggaaaagggttaccatcgaccttcatcggctttttggaatcatcaaacctaatcttgcctccctcaatggccacctgaatctgctctctaaaaaccttgcaatcgttagtagaatgggacccagaattatgccatttgcaatacctctttttgcctaattcctcagccgatgggattgtatgaccagcagaaagttgaatttgcttctctcggagtagcagatcaaagatcttgtcagctttagtaataccaaagtcatacttctcctcttttccagaactttttacccattggcatggtatgacatttttactcctcacccattcggctgcagctatttcagaatcgtcctcgtcatcattcaacccatagatgtatggacaaacatgattaactttcttagagcttttcctaacttccgcgaacctatgttcatgcaaggttactttctgtatcggatgtgataagctatcaaagtcttcagacaagaacttctccctaatcggagcaatcataccctgaaagaccaaatcgactaactgggcatcagttaaactcaagctgaagcatttgttcctcatctccctgaatctctaaatatactcgtgcacgggttcatcatgccgctgcttaatcgctgtcaagtcagataatttcatctcatgaaccccactgtagaaatagctgtggacttgcttctccaaatcggcccaactattgatcgacccatacggcaaagaggaaaactaagtaaaagtcgatccagacaaagataaccggaacaacctaaccttcaaagcgtctatagccgatgcttcaccacactgagctaagaatcggctaatgtgctcataagttgacacaccatcttgtcccaaaaatttggataagtctggaactttgaactgattgggcagaggaactctctcaaaccagtcagggtaaggctgccgatacaagcttccagtctcttttggtttaagcccaaactgttccctcattacatcagcaattacatctgcccatggtcattgttgagctgccccttgtgactgttgctgcatgggctcgaactgaccgtattgagacgcaaactgaggttgagccaatccccctggctgatattgggcttgcggggaaggaggctgatattgataattcaagttacccccttggtaattgtgaagattcagctggatattacgtaccaagtgctcagggacaacttgaggcattaatgtgccatccggttgtacgtggtgaaccaagtgttctgggacaacttgatttaaaaattattgcaccggctgaccatcaggcgtcgcaaacccggccgatgcgcttattgaaccttggtgctggatcggctgaacaatttgctgtcttaacggcgtttgctgaatcggctgcagaggctgctgccttggtggtgtttgttgaactggttacctagcctgttgctggattggttatacaacctgctgaattgggggtgtctgctgaatcggctgctgctgaatcggctgttgctgtattggatcaacaacaggttgaggtgggagaaacatggcagcaacctgatcttgggttagccgattcgcaacctgcccactatgctgtggctgctctctcattaacaaccgagggttcaccggctggcctggcgccatggctgatgaagtaggtaggggagttgatgccggcgccgttggctgagtcgttggtgcaatggagggaaccgcctaagtagatggctgaacatcggtaatcaaagaccgataatttgggaagacacctccttgcaaataaaccgggcctacagcctcatgctcagctattgaaccatcaactattgacttcatcatgtttgataagatattgactaacaccctagactgattgatcaaagcatgatgcacaacataatcaacccgatcttggaagttattgaaaaatcctgtgccacatcgctattctgattaagatttcctccctgtagcccctgagcaccatctccatgcaccccgtcaccttgtactccacggactccttgagaattgtcgccttgatttcctagagagccgtcggtagcacctttaatactcggctgagccgagccgtctggagcttgtttcccatctccctccttagaagaactggtcctaggatcatcagcgaccacttttattttgtacttctaaacaagtgtccccttgcgggtctgcatgaatgagttcaagaactgatcccgtgcttgctgcaaaatttgcttcaaactctttcttctgctcgggtgtgaatttttcttgatcgatcggcatgacgtttccttcattgacgtcagcaatcctaacttcagcatcttgtccttaacagagtctgggcaagatggtggtggtggctatttctcagccaagaggaagaattgttggctgacttcgtaaaggtcccaccaggcatgccaaaagcgtgttgatagaaaacacgtggcttgggagatctgcttaactccagtgcaggtccaaagctcgccttcgaatgtatgagcatgccagttgatttgatcctgtaatcaacaaaaaatagaagcaaagaaaccgcggttaaatctataaatgatagtcgatcggctaggtgcagatgacatatcatttatctttgagccgatgttatatatgtatcgatcggcagtcatgaataaataagaaggaactaaatctactcgatcggctgtaagtattcacaatatatactccttgtatcgatatatacttaaatcaagtgattgggatagatcggacgccatgccgagacagtataaatcacttaaatcgaaatatatattaataatgggactacatatgttcatagcatagccgatcatatagatctagcatgtatcggctaatactccgataccactctatactaagatattaaagcaagtagaatatatcaaataaaggcctaatatacttaaatgcaataagatcttaaaataaagggcagatttaacatgtcaataaagcatatagagtaaatatagttaaatcagataagatcggctgaaactctgatgctaccctaatcagcaactagaaggcaggctagaggttgattttttaagcacgacttaatagatcaaactcaactgatacagcattaagtatgaaaagaagaacaatatctagacaatcaagctgctggaagtttcatagagtggtagatatcttatataatctacgtcaacatcgaaatctaacctaatcggctgtcctctaccgacagatgttagccgattgtagattagatagtggtattgccagagattatgtaagatatatgatagttcgacgaattacataaacgagatcagagtatcacaaagatggaagcactaatcccgagaacacaagtcgtcataacaagttttaccttttgttgaagatcgaaaccgatgcagctcaacccgaaagcaagaactcgtcgaaataaaactaaagcaaaaagggtggcgatgcgccgaaattgtattgaacgtgtgtgttaaaagttacatagggctcgggtctatttatacccgagaattacaagatatgcccataacggacacgactaatatctttaacaaactctaagatactataagtctttgcggcagacttttgcccaagcatatctctaaggaaattacataaaatatcctaattaatagatacaattgacttctcaagactctatccatgtgcggcaatcatcttgaagcgccttaattcaacccaatatcatacatcaagttgcattatcggaatcggttgtatcagcttacctagtccgactcagacccagccgatcctaatcgtagccgatctggactccagccgattcctgctctgtttctgaactcgatctccgcctcagactttgcttcgatctaatcttctttcccgatgctgatattaccaaatttggttgttaacatggtggtgtgagatgcaagcggctgggtggcggcgacgattcaacgtcccggttatcgccaaaggaacctcctctccatggatctccttccctgctaaggttagattcctgttttggtcgactgggcttggtggctggaggaacagggtggtggttcgaattcggcgatggtcattgtgtactagatgggaaagcgctagtgaaagccttgcatggcctttggctggcgtcgacaccgttaggcattattcccttccttggaagggtctttatggtgttttctatgtctctaccaatctccaagtgaaaagcttgatccagtcgctggccgacgagcggttgtagcatttcacgtcatgtcctccatggggatgctgttttggagagatctacccatgcaacgatggccgttgatggactcttgtgcttccgaagcactgtacacctaggtgtttggaatggccttagccgtcttggctactttcttgttcgtggtgggcatccagctctcttcgttcgtctttgctaggtggagtcgaagttgttacattgttacagtgcgatgaagcttggcaacgataacacattgcagtctctttctggggggtactggtgttagccgggtggaggaaatggtgcgtcgttttgttgttttggtgatgcctttgccaacgatgacgtgatctctatggagtcaaacctgttgcgtcactaggcagcaagctcaggcctcggcaacattgacacttgctttgcgaagttgaagctgtttgccgcttttttagctagcttgacattgatgtccaccgttgggtttcatcgttgtttagttggtagttggttagagttgtgtggtattccatgtgttgggttattctactagctgcgattgaggtgcttttggcgagtctcttcttgttgagagattgtttttttcttttccttgtaaagtgtctgggttttactcttgcttaattaattgaaatgaaattgacatttctcctatcggtttagtttttctttaaaaatatatcactttcacccctttctataatttttatagaaattctgaaaacttataaactaagtgagagtttcagaaatggccgtttcccccctgtaatccacggtcaaactttctatgcgctagacggctagagcctagatgtctaaaaaacaagggatagaatgacgcaccgcttggtgaagaactgaagttaatggcttccttcttccttcactacactggacaaggtcaccagtgacgggcccaaaccctcacctttgatggctttaggcttggtcagtgatcagtggtcactagtgagttcggtcacctttgacgggtggaagaccattactgatgacagtcacctctgacgtgctagaactctacggcccgtcagaggtaagtgtctgtgctaacccatgccattttgcaacccgtcatagatgactcacctgtgacggctcagagtaaaaaactatgtcacttgtgacgacatgtatgtgcaaaaccgtcactggtatggtcacctgtgacggcttttgcaatatgaaccatcagtggtgagcttacatctagaaaaaaaaataatttcccctaggatttgctaaccatgcctctggaaaaacagaacatacacatgcaatatatatgtctccagtttcagcccattgcattaaaagtttcaaactaacatcacatgaattccaagttgtcaccgaaaatccatagacattcacacacatgcattgcaagttctcaaattgagccaagccgatgcttcaaagcaccagaaataaatccagaaaaaaaagagaacatacttcgatgccaaaatactgaaaaatgagaaatacagcctaagtgccacaaacttgaacatagcatttccatctttggtttctgagcctgacgaatatggtatgacatacaaacttacaattagatcagcataagtacagcccccagtgcctgtaatgacatcattcagagaagtttaatgcaacaatatcctaacagcctaacaaccagatatatgttacagatgggatgacagtagcaggaacagcttcgatatgttacaaatgcatataactatgcaagaatagcctaacagctagataatcagcataagctgctccaaaacaacaaattaaaatggggtcactctgactgagaaggcaaaaataagtttacctcagattagtattcattagctagcttttcaaccatccttgatagtcatccatatgcatgtcagtagttaaatattatctgaaagaaacggaaatagatcaactggcagaggaagctcaccatttgtagaaagaactagcgtctaatttgttcagctagtatagaaattgggggatttgtagagtatgcaagaacacaaccaaaagaaacttctggtaagaggtctaacaaggaaaataaaaacagatttagtgatgcatcaacttaaatagaacaagaaaacaaagcgaaacaacatgcatgcccactatccaaacaaaatactagtacacaaagagcatctaactaatgatccaatagctcatgatttttgatggggttaaagctagatgcatccttggacaaggatttagccacaggaaccacaggagacgccggaattggttgactgcaagctcagatctggatgcaagagaaggaaagggtgacttctgcttagcactaaactgagtaaaatagatgaggcgacggtgactaccgaggatggggtggaaggggacagccgacgcctgctctccccacggcaggttgacctcgacgacgtggtgtggtgtggacggcggaccgcttacctcacgaacggatctggtatcgctgaagctaggaccgcaggatctggagcacccaaactcgggatggttggatccgcgacctgtgagttcagggtgtccggatctggagcccccgagttcatggttgctgggaccgtcagggggaggctgggggatgtagaagctcgtcgtcgaccggagataagcgacgatggacggaggggcttgtcgatggcgttgggcagccgcgtggtgccccattggccgatggtcctggcaccggcgttgtcttcgtctttggctcgatatgacctggatctggcgtggtggaggcgggaaggaggcggcgaccgtgggtggtgggcgaaggaggcagcgacccggaggcggtaggcgaaggagccgatgacggggtggcggagagacggcggcggcgaccatggggcggagggcgaaggaggcggcgacctttggaggtgggcgaaggaggccggcggtcggtgggaagaagagaagagagactgagaggaggaggagagagactgagcaggtggcggtgggccccatgggtggggggtgggggttccttttttatatgtcaaaattgatcacctttgacgggtgcaaacttaaaatcaatgacgggccagaagtcatatccgtcacaggtgacggcccatcacctgtgacgggttgtaactccctggcccatcacaaatgaggtcataccagtgacgggttggaagtcaaacttgtcactgtcttacctgtgacggcttaaaattctggcccgtcacaggtgaggtgatacctgtgacgggccacggctagatgcctcaccaatgacggtaaacctaacgacccgtcaaaggtgacggtcatctgtgaccaatttataaacccgtcactaatgtgccgtcatagatgtagggttctggcgtagtgcttaatcttcgctctcagctgtgatcaatgacaggaacacacacacatcatcagcccctaaaaccagcaaccatgcatgcctactctacactcaacaaataaatatacaaatcatgcatgcatgttcttcatatcggttatctggtcaatcacacaatcaccatcaaacaatgtgtgagattctcttgttacttaggtaccaagaagttatgcaagaacaagctagatcacacacataattaattatgtagctagctagccgccatgcgagcgttcaaagctatatccacgtactggatcatccacagcgcgaattcagaaatcgcaataatttaaaatattctcacgcaaaatcgtctataaattcgcatcaaaatctgaacccaaaacattccatcatcgcatgctttgcattgctctcccttctaaaaaacaatcagaagtcgcagacaagaaagagacgaaaatgtctaacacctacgtgtcccatgtcgctgtcgttgtaatcctggcaatggcttcccagtgcttcgctgccaccaccggcgccggcaatggcgtctcgggcgcggacgccggacgccgcgcgcgtgccgcgcagacggtggcggggatcctggcggtgcacaacgaggcgcggcgcgcggtgggcgtggcgccactggcgtggagcgcgggcatcgcccggtacgcgaaggggtacgcagcgtcgcggcgcggcgactgcgcgccgcggcgctcgccgctgttcaacttcggcgagaacgcgttcgtcgggaaggggcggcggtggaacgcgccggcgctggcggcggcgtgggtggacgagggccggcggcggtacgactacggcagcaacacgtgcgccggcgcggcggcggccgcgtcgtccgggtcgtcgtcgccgtgcacgcggtacacgcaggtggtgtggcggaacacgacgcaggtcgggtgcggccgcatcgtgtgcgactccggcgactcgctgctcgtctgcgactacttcccgccggggaactacggcaccggccgaccatactgatcgtgttatacatatagtgccgtgccccggagaataatcacatactcactccgtcctaaaaaaaatcaatttatacggacaaatttgaaccaatatatgtatgtgttcatctttacaagttattttttttatgggacagagagtgtaggtcgttgtgcatgcgagtgaattactattctgcccaataagccgttgtgctctaatgcttgtgcattatatatattttcttcaaatataatttaattttgaattagtacaatttgatctgtaatgtcttgagctaaattgtgaagattatgctctcgtattcatttttctgaaaaacaacgaaccaaacaatattcaaagcatagaatatcaatatatattttaaatactttagactagatatatacatgacaatttatgtttagaataggcatgaaacagtataattttatcatcaggttttgtgaagaatgtatatctatggatattattgctatactgaaggctttgtaaatgttcaaaacgatacgtttacacgacaggatgaagtaaattagaggcaatcagacagactagcatatttgtttgcaccagcgagagcggtggtgtcagacatggctgtgcctcgacgcaacctggggtatgcacagacctagcgttgccccacgaggccacgacacaaaactcaaagagatgccaaggacaaatacaagatgttacgtgtattcgaatggagattcataaatagaatgagttttttattttgtattattttgtattggtgtctattagtctgtgattgcttatgttatgtcagcatgtgggtaaggttgtttgtgagcatcatcattgggccatggatttttgacctgaagatacaaagccagaacatgatgaccataacaaccacaaacatgaaattagaggatatatcattataaacctggtagaacatttaccttgcctatctcatggaggattggaggcacaacttcatacaactttgagacctgaaaggaaataatatcaacagctcataactcccctaccctcactcttttcacagttacatgaatttattttggcttctcggattggttgtcatatagtttttttggagttgggcaaggggaaccggtggcacgccgttccagcgaccatggcattgtttcccttgtgcatggtgatcccctcgtgtccggttctgtcaactggatatgggcggtgagggcatgcatgtaggacacgcacacatgtttttttcgtaaaatcccctaataatcggagaaatcgtgaaacaatacttccaccatttacgagaaatataacataaagaaaagaatatgccgtttttagagatggcgctgaaatcctattaagaatgtccgcattattgtcattacgaacttgttcgtctcaacagtttcgactttcgagtctagtttgctcgtaaccacgagcgatcaatccaagtaataaacaacttattaacagtcattaatcaatcgaaattaacactcccccttgcataaccccggtaataaatcccatgagttaactatacaaagtaaaattcaaaagccaaacccccacaaaattaacagcagcaattaattaatcaatcaccgcagtatataataaccccgagttcaccacaacttctccacaaacaaattaatcaaccaacacaccatgtctcccttctactgctgcctcgccgccgtcctgtcgctggcgtcggcgtcgccggccgcggcgtccatctcggtgtccgccgccgcggagcctccggccaacagtttgttgccggcggagcagttcctgcgggctcacaacgaggcccgcgcggcggtgggcgtgccgccgctggcgtggaacgcgacgatcgcgctggacgcgcagcggtacgccggcgagctccgggcgagctgcgaggcgcggccggtgtgggcgtggggcaccgacggcttgtacgggcggaacctgtacagggggagcggcccgcgggtgcgcgcgggcgcggacgcgtcggcgcactgggcggagggcgcgcggtggtacgaccgcgacggcgactcgtgcgcggcgccgccggggcggtgctgcggcgagtacacgcagatggtgtggcgcgccacgacgcagatcgggtgcgcgcgctggttgtgccgctgcctgggcgacacgtgccctctcgtgttggacaccgtcgccgtctgcgagtactacccgccgggcaacatcgccggccagcgcccttactaacgcatatatatgccgcggtatatatatgtagcacatgcacgtgcgagctcataaaatgttgtggtgtaataacacgtgcgtgatcaactttcaagaacgtttttgttcttgcattggaacaaatgtttgacaaattaatactacatataaagccgtcaaaaaactgagaagcacgttctaattgttgaagaactctactccctgtttttttatatattattaaagcacagtacaagcgtggacgtttttaatgaaatgattgttacggttcgtattcctcacgccactacttaatgttctcaacgacattcaaaacaatcggtttttgcgtggacgctgccatgctggtcacttcctcctcggaagatgaaccgctatacgccgatcacgtcctccactaccatggctcgcctctctatctcccatgccacatatttttattctaataaataggggactgaggacaatgggagttttatcgccacccacttgtgctctcacttactgcgcctcatgacctcctccccattcactctagccatacagggtttcaccactccatctgcagagcatgaaaactagttaggaggataacaacagcgacaacatctcagataaaattttcaaaactttggaaattattattgtggacggcttctacagataaccgtctgcaaaattcttttttacggacaactagtccgctagtttaaatattttgaactatttaaaaacaaaccggggcccaccgatttatacaggtgacgctctgacacatctacctatgaaaagagttttcgtaggtggttattgaagacattcacttttgagaacttttttacagatgggtgtttcagacatcacttacgaaaaatcatttaaccataataatagatagtctcaagtacttcatagttctaattcctcgagtttaatccactggaaatgaccagtgctagcattatattacccgccatatctagcagtgccgccatgggtgcttggtagatacgcactctacctactcttccgctacgcctcctccacctgcactaaagcaaaggcaacgtctccacatctaggtgagggctgttttatcggatctgcacttctgtgcgcctgtacggttgtgccctgtgcaatgcgatgtcgtttgtcgagttgcctatgacgctgcaactcctctcgtctctcgggcatttctgcttctaggtaggccataggcagatactagactactagtattaggtgttggccccccaccatcatgggcccccagcgatcgcctcggctacatagccccagggccggccctggcttttcctgatccatcctgattctgcttttatcagagtatcaagcttgcttgtatgatgatagtacattgctttgttacctttttgctcgctgcctagtgctgcaatacatcgattcagtttcttgcttctatatgcttgtttatattaaatgcatgggaggaattaggaaattacggaggaaatcaattaaaggaaaaaaaatatttcactgcattttatatcttttatttggtcggtcggccacatgtgcttaataagttatgaaaatcttattgcttctacgtatgtgtatgttgtgtggatgtgataataaggttgtgatacgtgtactagcgaatcatcgtgcctaaactcttcggatattccggaattccatccctaggtcccgacattaattttattttctcctcttttattactatatctttgcgaggcaactacgaatcgggcgtcggatttttgagagaaaaatcgggtccccctcctgtgcgctcccctctacacattcattgcatgaatgctgcatgccagctacttgcttcctatgcctacatctcagctacatgcaatatccaatactaccctcactttcccctatcgatgcatatctagcttttcttaacatgtttaaattattttttctcttaaattattaatcccatatacaaataatgcaatatgattgcatagttgtatttttttaattaaatctttacaacaagatctaacataactatattttaatgaaaataattaattgatgctttatcacttataaaaaattgtttcaatttgcttcataagatgttccagagagatgcaacattcaaaatataataactgcaagaccgtcaaccattgcatatgaaagctattcacactttcacagtcggtgtagcataactcccctagtaaaaaaccatgagttaaaagtacaaattaaaagccaaaggactcacaaaacggcagccattaattaataagaacccccgctatatatatacaatcgcgagttcaccacaacttcaccccgaaaccaccatgtctccactctactgctgtctcgtcgccgtcctgtgcctcccgcgggcctccgcatcgccggtggcggcggcatccatctccgtctccgccgtgcagacccccgtcgagccgacgccggtgcagttcctgcgggtgcacaacgaggcacgcgcggcggtgggcgtgccgccgctgtcgtggaacgggacgctgcagctggatgcggcgcggtacgccggcgagctccggacggaatgcagcctgcggccgccgccgcccaccgcggcgcggggcaccggcgacggcgccgccgtctacggccggaacctgttcaaggcgtacggccggcgccacaccggcgcggaggtggcggcgttctgggcggacggccggcggtggtacgaccgcgacgccggccggtgcgcggcgccgcccggccggacctgcggcgcgtacacgcaggtggtgtggcgcgccacgacgcagctcggctgcgcgcgccgcacctgccgcaacggcgtcgacaccgtcgccgtctgcgactactacccgccgggcaacatcgtcggccagcggccatattgacaatgatctcatctgtttctgcgacacacgacacgcaatgaaatgtagtacatacgatcgatggttctggtgagtgattgagtttttggaacaaatgtttggagaaatatatgaaacatgctccaaagaaaattaaagggatactctaagataattaaatatggagatttaatgatggcagctgcgatgaggattcaaatatgtattgtcatcggagctagatttgttcgacctctccatttcccataatcttgccgaacaactctactctctcccaagtccgacccaaacacggataaatgaactttttttacaaggttatattttacctggcctctacatccaatcggatgcatgtgagcctttttaaattggaaacttaacccctcaaaacaactcaatctgaaatttactcatatggagatttgaattcagataacatttttacattaggaacttagcctatcaaacaacccaatataaaattcgctcatataaagatttgaactcagagccttgaggtgctactcaggtcacatgcccttccgcccgataaaagaacctggtgatcggtgttgcagacaccttatcactgttgcttgaataagtaggaacaacaatcttgacaaaattaaaaaaatacattttttaaaaaattggcctttttttcttttgtttggcacaaatgcaaggtagttgtgtggtttgtagcgaatccagaaattttcttatgatgtagaaggagcagctggaccagacttggcatgggccagttttcacattgaacactcatttttcacgaaaataaaacaaaacaaaatgaaattctgatggtcggtgatggctgagttaaaaatacagttatggtaatacatcattctacacattttaagggggcaaatcacacgaattccctaccttccattatgcttctagattcattgtacgtcctctatctgttgagctccgacgagtgatgaacttggcaaattttgtacatattcctcaatcttaaataaatttggttggtctatcttgaccggcccgacaaaaaaatgaacttggaagaggaagtaggaggtgttcccgacttagagggataagaggtgaggatgagagtaagggatggtgggctggtggccatggtggagtggcaaggcggtggtaccagtagcctcgacagtgggagagaaggtcggtggacttgtgttggcggggacgtgggatctagagtggttagggcgaatcgttaaggacggggaagaaggtgcaggggcactctactactgttcggaggaaagtgaagctaggggaagaggaagagaagggtggtgggtcagtggcatgctatggctggaaggcagaggaggtggggtgatccgggggagaatggtgacacgcgt

SEQ ID NO: 1874 - DNA, 15364 bp, Oryza sativa
tggggggtgctgcacgaatcttaaaatttgtgcgatgtgaagaggggaaataagcgatgtatagatagtatcataaatctaaaccagggacagttaactatttcccactgttcacttaattattacatctgcaaccatggaaccattgaaagaaatgtagccattatatatatcaaagctatatttggtagcttcttccttcgttacttttccctggatggcagaataggcaagcacacccagtgttaatacaggtcccatgcctgcgaaaaattctgtagcaatccacctcacacgtctgcggatcacacgccgtacccggagatatgaccaccgttgtgcagttctgcgcttggtccgctgccaacttgcttgccggcacttctgtggccaaaaaatgcaacaaatttatgtgaaaaagtactcttgaaggatatgcttgttcagcaaatcagtgttggagttgggtgcaaattaaagttacctgaactcatcgccaggatggcaagggccataagcatcagatgcccaatcctcatgaaactctgttggtcgcaccgttgagaatgggagatgttgcgcaaggtgacctgggtcccttggcttgtggatagttcatatatagtgaaatggcaaggctttggtttaatttgctctggaagttgatatttttttcttttcgggatcagttttggaatatatgatgatctttaatgtgcataattaatatggatatattcttgtatctagaaacaacagatacagttaataaataggtcatgggccactacaaattggagatatgcacatccagcttggcatttatagcatatattcatcagtgcagtcatggggccaggccactaattgtttgttggggcattttctacttcaaggttataatgaaacagcctcaaagatttaaggggctttttcgaccttttcattttcaaatcccaactaaaacagctttcattccccctggaagagctcgtaggaacaaattgtatccttatcacctaattgtaggaaaggttaatcatgaatgaattttaacatgtttcatcttacatatatcaattgctttgctccatatctttctctgtaaatattaacatcttgcattatatcaaaatatgaacatattgcacaattacttgaggaaaggtttgcaaacataagaacaagaagaggtagagatgaagacaaaaaggtctttattggtatatgggaattttgtgctattattgttgtttgctacacatcccttggaaaagctgaccatatttgtcaccttgtgatgacacatgaagcacttgctacgatgaaaaagctcttgcataccaaaaccaccttgcacagaaaaaaatggaatgtccaatatagaaatccttaccaacaatcgtttgaaaattggaaattgttatagggaaataacttgaatatatcttgagaaaatatatttaaagatcattgattcaatccaacaatgctaatatattaattgaaaatgttagcacacgaagacatatgtttcatgggaaccaaaagcgtaaatatgcttaagtggaatatatttttcataaatgactagtttaaaacattttgatgaccacggacccaaacatgagcaattcaacatttaaataatttttttggggggaatattagcaattccagccgggcttggtctggaggacacgacaacagtagtgatggaggcggctgtgctgcacacggagcaacgatggatgtggcggtggagggctagccctctagcttgggcttctgtggtgccgccaaccggccagacatatgccaccgtcactgtcatttgtcgctcaagcacagatatcggtgacgctagtaggcaccacacaccatcatggaggtgatatgtgaaatatcgatagtgacattcccaatgtcgtagcctgctacaaggcgtctcattagaggttccctattggtgcggcatccttatggcgatgtctgtgttggttgggtttgatggcaatggtggcatttggatgaatgactgatttatataactcaattactctccgagttatcttccgctttgaacgtcagtcacctatagttatgggaccgaaatttgatcggcaggagtcggccgctgatttctgggtttttgcttttctggttttaggaaaataaggactacatacatacatctgattaagttgtcgatagaaataatggttatgcatgaacaactatatatagaaatcttgatctctttaaggtggtaaactaagtagttttcttatactatgtaggtaataactgactacgagtgggctccaccggcctgtcggtgaaccaaagcaagacatgcatggtggcttgtccgtttgtgctagccattggcaaacaacagtgtggctagggtgtagtccacctgggaagggccatgagttcattgaactcatgtacacgtctacatagcagatctaggggtggtcctcattgtccccgtgctcccaggaccacctaaaaaaatcctagctcaatgcatatatatgtatatatatatgtgaaaataaaattttgaaaaaagaaaaaaaagcttctttattaatgtattatgatgcatatttgatcaatttatacttctaacttggaccatccatatatagatacgccggcctttgcatatctactagaggttgcggtgtgcaagaggaggcgagagagcgagaggggtgcagcaattggctcgatgtgggtctatggccccaggcatcattgacaagggtggatataagaagtgactgaaatattagatgtgaaatggatgaaaacatatggcaggttcttccactcatgcgctacctgtacatacattgctgttaattttactataagggcaggaggtcacagtgaacacacatggtgaacacatgataaaaattgcatagccgtgtatggttgtattctacatttaaccttactaacaaatttaaataggcaccaatgtatttgacaaaattatataatttgtgcagatggctatatggatgctacttcatactccctctatccaaaattcttaagcatattttattttttggttttttttccaattgagatggtcagatttgtagttttcatgtgcatagttaaattgttgactagaacccaagcaactatctgcaaatacttcattagtttgttacgtggaggatgagttaattcctccatgattttggtgacaaaagaaatatgacttttgggtggatggagtatttattagaatgtttatgaaattttgcattgtgctgaaatgataaatatttttttcaagtcttagctatttacatgcaaataaatttattaatgcaaaaaaaatagaaaccaggctaggataaattcataaaaggaagccattaatactcacatcgtccaaccatatcataattagacaataggctatattagattcttataaggaagcaattaatactcacatcggccaaccatatcataattagaaaataggctaggataaattcatataaggaagcaattaatactcacatcggccaaccatatcataattagaaaatagactaggataaattcatataaggaagcaattaatactcacatcgtccaactatatcataattagaaaataggctaggataaattcatataaggaaacaattaattctcacatcgtccaaccatttcacatttgtgaaccatgaatgaaaaatctttaaaaatagaggcaattaatgcatagcaaaaacagaggcaattaatgtagagccaactagtcccagtgaagaataaataaatgcaaaattttgtcacttacccccttcttttatattaaaattgaagataaaacctattggcttatatgtcagtgaccttatatgactcatatatcgatgatataggagggtatgtccaagaattataaattaagggagggtgtatgaccaaatctttcataataaattagatgtatccgaggcatgttgaacatgtttgcctttcttgaaagcataaaaccaccccccctcccctttcccacctcacatgtcccacctcttccccaccccatccccttctcctctcacttcagatcgacaaagagttctatatagtagagagagatagagagaaagctagggatattgagagtctgacatctgaaaattagctatttgaaatctagagagttgagaagttcaggagagtagagggggagagaaccgcgtaatcagatggcttcgtcatcaaatccatcaaatcttccctgctctagtgatggtgtatgcatgttatgcaaggtgcttacaacagaggtagagcagctgcgttgtagcacctgtgctacgccatggcatactccctgcctctccagcataccgccccttacagatgtggcccactgggtctgtccagattgctccggtgatgtcacagccagctacccgccatctgatgttgttcgtccggagagcagcctcatcgctgcgattcgtgtgattgaggctgatccggtgctgtccatccaagagaaggctcgtcgtcgccaggaacttcttggccatgccggtgatgcaggggctgcaataactgaagctgttggggaaaacgtagaggacagtgagagcaacaatcctttgtctatgctgaacaagaacatcaactgctcattttgtatgctgcttccagagcgacctgtcactgtaagtatgattgctcttttgccaaccctgtcaacctttgctttggaacagcctagaaaaatatagaaatgtttccatgaggcactacatgtcataatatgtaagctcataaagtgtaagtttgtaccattacttagatctcagatcacactgaagataggctcctattagcacacaaataaattatgattaagttgttctgattttatttgaattgatctacaattgctgtacttctactgcaaattacatcaagtatgatatatacatgaaaatacagggagctactggattgttggtttctccatctatttagcctgttttactgctctgagatatgcctctgtggatgcaattgatctcctttgacttttgccagtatctcctcttccttctcgacagttgtgtcctctcttcagcagcacccaccttcccgatgtttcttgccaactttataattttcaccttgttaagaacctttctctcttgattatcaggctataggatcttccagttaggaaagagctatgtatagttttcttctatagggacagtgatcattacatgcatggcatctcgttgcttatatgctagccctcctcctatgagcttaatttatgttgccatcgatctgtctcaacctggaaaatttacattacaaaaatgtcatgcacatattcgtagccaaagtcacatatgatcgcctcctattgccttgcatagctaatagttctgcattcagtataactttctaatacaatacctattgccatttgcacccactatgaaccatgcacaactaagtcgaatcaaccatgcacatatgtgttttggatatttgtattatctcgacaatttttaatctgctccttgttagcaagaacgcctcgtttcatagcatatgcatttgtctggtaccataatttatcacagtgaaatgactaatgatctcacaaaaagtggttttgttcatgttactttttatctccgtcctttatttaaatattgaaatttgtggaagcttcatttattgtttacaaaggatatatttccatggacagactagtcggctgagactcattattatctggctagttcattttcatgttatttttcatgtaactacattattatcctatgaagataatgctaattaaccgaatacataggaatttgaacaccatttatacctgtgtttcagaatattttactttgctgaacatcaaattccattattatagcatccatgtccatcaattgtcatcacataatattttcctttgcttacatgtattgtgcagacaccatgtggccacaacttctgcctgaaatgcttccgaaggtggattgaaaatggtaaaagagcttgtgtgatctgccgagcacctattacacaaaaagtagcacaagatctaagaattaacttggcactagtccaagctatccgcatggccaaggctgcaaacaatgctagcacaactggtgaaacaacggtttatcattataaagaaaatgaagataaacctgacagagctttcactactgaaagagcaaagagagctggaatggcaaatgcttcaagtggacaaatatttgtgactattgcaccagactattttggtccaattcttgaagatcatgacccaaggaggaaccgcggtgttcgagtcggggaccattggaaagatagaatggaaggtagacagtggggtgctcatttccctcatattgctgggattgccggccaatctacacatggggctcaatcagttgccctctcaggaggttatttagatgatgaagatcatggagagtggttcctctatactggaaggtttaatattactacctgaccttacattgcgatttgtttctgtggtttatcaaaaactagttaatccattattttctacatttggcagtggaggaagggatctaagtggaaacaagcgaacaagcaaggagcagtcttttgatcagaagtttgagaagctgaatgctgcattacgtgttagctgcttaaatggctatcccgtgagagttgtacggtaatgtttttttttctctatgtgcatccatgacaaatttagtgttagtttatgtaaaatcatcattatattatttcctatgggttgcttccgggaccatcacaaaaaatcaaagccatcacagaaggacgttcttctggtaatgcacggagaatatatgtagacctctatatgttgcaagatattatttgttccattattgttatgtaattatgatacgttgcgaataactgtactcacacaaggttattgtcttttaaggctttcagtgttacgtttagtatgtttccactacatctaatacgaacaatcttgtttcatttctttggaaaaagtaatcccaatttttgtttttgtatatgttgttctgtttgtttattaaaaggtcttttaaagagaagcgctcaccatatgctccagagtctggtgttaggtatgatggaatctataggattgagaaatgctggaggaaaactggagttcaggtatttatagttttcatgaaacattacagatattttttgtgtaggctgcaatgattttttttttagatttacaaaactgaatgtatccaaaattatagtttatcaacttatcaatataagtgatgattgttggagtttttgttttttggcctcagggtacattcaaagtgtgcaggtatctctttgtgcggtgcgacaacgagccagcaccatggactaggtttcttatacatcccttatctcatgtatacattgctattgttattctatttatttacttttccatttaattttctatatttacttgaagtgatgaacatggagaccatccaaggccattaccagatatcgaagagctgaaaaatgcaattgatattactgagaggaaaggaaacccagcatgggattttgatgtaagttgttgtattatgttctcagaaaaaatattagcttgcacatattgtgacatctcctttttcttgttataggcaacagatggatggaagtggatgattactccacccatcagcaggaaggctgtcgtaactggagatcctagaggcaagaaaatgcaaggagcagcaaggcatacaaataacttgtcaatgagagaaaggctgttgaaaggttttttttttttttgtctatgaattgcagttcatagtagtggctgcttggcattgcatttccactgatttcagtcatatattttctttattatagaattcagatgctccatatgtaggaacgtgatggaagagccagtgacaacaccgtgtgctcacaacttctgcaagaaatgcctgcttgggtcatatgataatctttcccttacagaggagagaagccgtggtggtcggaccctccgggcacgaaagattgttaaaaagtgcccttcttgtccaagtgatatcgctgatttcgtacagaatcctcaggtacagtaaaatagtagcaaaaattaattttgtatagattttagtcatttttttgcgagggatttcagtcatctttcccattcttagatgatgtattctttgttgtaaggtaaaccgtgacattatgaacgttattgaatcactccaaaaagaagctgagaaggaagatcatgctagggtgagtggagaaggcagcagtgcagcacttgtagattctgatgatgaaaatgacactgcttgggagaaccaagatgatggtaatctggatgagggaggttgcaacaatcctgaggacatgataactgaatctgttgatttgaattctgttactaatgttgataatactgaaaacaaggtggaagttcagcagcctcacaagcgtaccgccggtgccgggaaggggaaaggtggcaaatgggctaggacaagctctgcaccaggtgatgcagatgccaggaatgttgtgacttcaactgaaacattggatggaatagctgctgagaatgtggctgatttagtacaaattgaggattgcactttcactggtgtggaaagagccgaccccaatgcgttagaagttgatggcaagaatatgattccagacttttcagaagctgagaaggttaaccctaaacaggatcaagaagttcttccatgatgtgtttccttgcatacttgggatgtttaaaagtttttaagaagtagtattatcttattatctttggtgacattcagattgggatgatatcatttaatttgggaataattgaactcatagtgggggtgcaactttcacttcctcaggttcagacattaagctgctgcattattgaaacttgaaacatatgcaaattgcttgtgaagttttttttgtattcttcctcttttgttatccctttttctttgattatatttttttttgcttgccctgtttactttgcaaaaactagcttggactgaaatgattctgggtcgtgaaatggaagaaatatggtgatatatattgttgttgcattgattcccagtttctttcacggtataatgcagtggtggatttaccacccggcttgggcaggcagttgtccaggctatatgaacgcaaactatcaaactggactgatttctctacggtaaaatccatggatttaattacttcctgcacaaaccaagtagattagatttaactactctagttgggctgtacaagcagcaagccttataggcttacagccctgtagcatgcaattgagccctatcacaatgaataacatatggcatgctcaagcttatacgaatcatcttgtctttcaactattgaaaattttacatgcattttgaactaacaaaattgttttgcctttaattagtagtaaaatgagcgtataggcattacacatgtgggtagcggatttggttagactttcccatgctttgtgaaattcctggctccttcactggtataatgcattactagataagggaaggctcctatatgctaagttctaattgatgttattgggtgttcctctcaacacctgggaacttagtggtcgtatcaacagatattctcgataacatctggtgcataacgtgtgctacaaatgaagaagaggcagaggtttttaaccctctcatgagtagcacgcccaaccaggttgatatggtaggacagagaggtagagctgaagtgactttcttggaagttgaattgagttgcaggtttgcttgaagtttcctcaaggctgtagtgctccaaagtgagtacaaaaattactgtgtgatggataccatgatgattgatgagcttatgataaaaaaaatatcgaaattttacagtgcatggtttattggttttgggtgcagaaatttggctgctattttattcgaatttctattgagcttgattgttttgactgaattaattggggtaccaactcaagtgataaaatcatcaatcttttattgcaggctattcatgccacctagtatttgtgttggtgtttccataattttttcaaacattagatggcatttaatttatttttccaagttaaaataatgcatgcaaatgcaattaggaatgcgagaaaaaaaaacagccaaaaccaactaaaagaacatatattcaaaggcaagcatccacagctcatcatactgttttgaggactttgtttcggtttcttacattaagagtgaatttaaactggatttgaaatgtaacatggaattggatggttttggtgatattccagctcaatctatttaatattaggatagtggaccatgttatgatgtactccataaaatattcacatttcattccattggtggttttgctacggaataacgaaaaaaatcattggtttaaatcttaattgaaaattctaccgttgactgagctaaccctatcttgaataaaataatatttcttctgaaaactgttgattttcgtttcgtacgacaagtttagctttatctatgatcaaattttcctagtccgatatgttttatagtgtatcccgcacatgaaggtcagtaaaggatgtttgctttttaaatgttgttggtatattttgatagctctagaagagttagaaaatctatttgtaattaattttattacttgtaatcatgacaataaaccttgatataacaaatatgagttttatattccctcttattttggttgcatttaatgcggttacttggttgaattatttgtgactgacgtttgatttatctcttcttgtatgtactattttgaaactcttttatgcaccggaatcataaaggaaagcttatataatatatttcaacactataagagtaatttaacatcaagagctaaaacttgggtaagttataatgctcaccttcattgagtgaaaccattgccgctataaagatagccaattttgcttcacgacattcaaagtttatataatttactggtgaacattgaaaaaaatatccacggttagaggagacgtcaaaactaataatttgatggaaaacatgcaatcaatattttattattttttcaccaaaaggatagagaaacccattataatgataaatttgtccctcgggccaacatatgttactatgattggtttggtcgaactagaccaaaccaaaccaggccatgagtatattttgcaacctttcccccttttttaaaaaaaataggttttcattttttaccctaaatatattgctaccatatatcatattccttcttcattctagagatagcttagaagcttctagcccgaggggcaatatcgtccttttgaaatatatctcgccgattggactggaaataacaaaataatggatgtggtgtcgacctttggcaaattaccagtttttgaaggtgttctcccaccttttgctatgtttaccaacaaacaagctatgtttaagtgacctgtgtcaatattttaccaaatgataatgacaatacctataactttcacttatacatgtaacttgatctatcacctatgtctgacagttgagaagatggttaggagatatgttccatagaataatatactgatccttctcttcatgggccaatcggcctagagtatatatgtgccatcatctacttaacaccgtcatcaaactcaagatgagagcagaggatctgaaacattgaatttgagcaagtgaagttaatgttatttctcaagtctatgcattaggatgctcatcagaataagcggttctcaagatctttataaaaaagcatcaacatctacaataacaaataaatgcactatcaagacataatattgtggattgaatgaaactaaattgatgtatatattgatgcacttatttataaactcagttaatgttagaaaacaaaatgcagatcacctagcatgatgaggtctactgcatcctcatcaatgcccccttttgtgactaagaagacgagaccattcaacatcccctttttatcttatgtgtgtctagacagatgtggttctcccttttgcatcaagttgtcccttgggctcttgaaccacaacctgtggttgtgaactttgatgaatggtggaaccgaatcaatggtatggtttgtgcaagtaccaggaagggtataaacaggttgatcatgcaaggagcttggtctatatgaacgattgcgtcttcaatggagtacctccaagattatcagccatttgtggagtttggcagggactaaggggctctttgtaattatagacctcagctagggccttttatttttaagttccttttggtcgtgtaacgagttcgtgtacttcttagtgcttggtgtgtttggacgccttatttcttctcctattgacgcaatgatacgcttcttgcgtcttcaagaaaataaacttagaacaaaactatatgacttatattataaaactgagggagtactagttaaatagattctattccaccatgaatacaaattgccatgcatagtttccttgtttttgttgagaatataggcatataatgatttaatatattccataaataaatcatgacattacagatgtatactagcattaacgcatcattagatctacacatgtaaactaagcaataaaacatgaacagatcaaatatgcgcaacatatcgaacacgtaccgagatggcggaaagaccggttgctcggcaggaactactcgcggtagcgagcgtcgacgaaggcgcgcaggacgcgagcggagaggaaggcgagccgttgcggacgaaaagggagcagtcgcgcgaagcgcttcccaaaaaccttattgctgccttctcccggtgcaggacgtcgaaggcagaggttccggagacctgctctcccgatcgccggtgcacgctggcaagcgggatggagtagtccacaagcgacggcgcaacacagagtaggaggcaaaccctagattgatttcgtgtattttgcgtgaatgcggcggctcggtttatatagagataggtcgcttgatcagggcgcccggacgatctccattccgcgtaaccgaaccggataagtcgcgcgtaacttatccggatttttcggaatgtttccaaaacaaaacaaatccgaattttcgccaagggtgatgagccaattttgtggatcattcgacgcgtaacatcgtgcacgcgcgccgcaaggtaggcacgcgcgccgcctgccctaccttgccaggcgagcgagcgcgcgtgtgttccccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgaatgggtcttagcccatctattaattccaacagttttcaccatagttgacagtaacatttttccatggacatgctcccctaccaccatcactgttgaggcagcattgccaatcaaatctgatttcgcattgaaatcaacattagccattgatattaatttatttacactaatcagtgtggttttatggtgtattgttaattgcacatcagttcacaagctagaagtcattaaggaaacactctacactatttaaaatttatgtgaaaaattcttcatagtgtgtgaatattctctacttcacagtggtgtacattgcaaccaaggagtttctatattgggccgacatcagtttattaatcatcatacatagttttcacaagtatcttcatattttagtactttctagctagcgttgggttggaatccattaggaacccacctctcgaactcaaataatagcaggtatcagtacacaaagtaattgagggttggaagaaccaaagtactttatgtacagtagtggagttggtgttagaagatggaaggagtacaaggccaaaagtttgttcaattcctttgaaaaagcagttgttgttgcctttgttctcttccttgtgcttgcttgggccagccatagtgagttaatacaacaactcaacttgtattgacctgttgctagccaccggtcctagcaatcccctttgctttaaattcaggttgttcccaagccaataagttgaaacctcctagatctaatgactgaacatgaagtgtcatggcataaaaagttaccttcacatttaacaaatcactttcatcattccggccgggtgatttgcttccaggcatggtttcattcatgatattatcataaaaatggttcttatagtccatgtctccactctgcttcgtgctaggaagtaggaacatgatagaagtgttgggatattgatttgtctttgcagttacaacccattttttatagcgcaatatccgtgagcatattttcagcaaagcatcacaattgcatttaggatatgggcatagtgttgacttcatttctcctgtgatgtccctttgcttgtattactcccttccttccatttggacagcacctgaacaacggccccaaaaattcagtggatggtaactgcgaagcaaaatcaagatccaaacacttttgcatttcctgctcaaagctagcatcaattgcaatactcctattttcgtccactcatttcaaatctatatccttgaaattttagccgattccttctatgcccctgaattttcttcactcctttatatacctctgaattttgatttggatccctttcgtacccttgccatcaattgaccattagttgaccgtttaataggtatagaaaagttagttttacccttcaatatgtgagaaataagtagaaatttgtaaactgtattgttggaagtataaaatttgttgtgtgattatcatatgcataagtttgttgtacataaaaaataatatatattaaaaagtatgtgtagcactttttaaaatgataaatatagttttggaaaacattcctatataatatatacaactggagaaaatatgttgaactatcataaaaaaaagctacatatactgttttaataagtaaataaatattagttttatgtcattatataaaattaaactttttcataaaaaatacctggtataataaagtcataaatataatagtcttatattatatagatactatactacatatgaggtgtaggcgttaaaacacac

SEQ ID NO: 1875 - DNA, 3093 bp, Oryza sativa
ccagacttggaaggtgacggcgacgaagcagagaaggcgcccaccctctcccctgcggctgtggcttgtgctcggggatggatgcggcgacgggcgacggcgacgcactgcggcaatggcgagcgacgggctcggcggggctgtcccccgctcgaatccggtgacgacggtcgtcctccgcccggatccagtggcggcgggcgtccctcgcctgacctcgcacggatccaccggcggcggtgggaggagagcagcgtgcggcaggccaccttgcagtcctctcctcctcttcctcctcccgcttcttcctgcccgctgccgtcatcgtggttgtcctccaccagcttgccgcgtggccgccgccgtctgccgatggacgtcgactctgacccggccgccaagggcaagcccacccagatggacctcgaggaccaggtacgccgcagccgctcgactcgtccccacgggaattcttccttcagttttttattgtgactgcctaagcttggagagcatctcaatttctgttgaaacacttcagggaagcatttagctctcagagcattcatgagacttccatctataatcctactaaacttctggctggttcgttagttctatgtgatctggatttggtttgtgtaacactagcatccattgatattctgaatttttcaggcttctatacatctacaggtttctgtaattgataggttaagggcccctttgaatcacagggtagaaaaaacattggaataggaaaaacacaggattctgacaggaattaaagtgtaaaacagaggattgcaaaacacaggaaaaacacaggaatggtcgtttgattggagcgcaggaaaaacgcaggaatcggatgagagagatagactcaaaggaaattttccaagaggttggagctcttgctaaatttcctccaaaatccacatgtaatgtgccattccataagaatttcataggatttgaaaagcttcaatcctttgaatcaaagggccaaataggaaaatttcctataggatttaaatcctatgaaattcctatataaattctttgattcaaaggggccctaacaagcttttctaatttatttattttttggtgattgctgcttttgctggatcaagcatcatgagtgaatagtcctgatagccgagttttttttttttttgcaacgcatgaagaaccatatgctctcattttaattttcatttgttcagtcatgaattgttattgcaatatattcagaaaagtgctcccatctgaatttcatttgttcagtgatatatttgtgtgtgcaatatttggaaaactgccaatagcatcatcatcaggttctctgatattttttataaataaaaactctagaagcttgattcaatagcagttcactgaaattttgtggttcaacagagcatatcaattgattttctctgaactgctctctacatatgatcctttcgatcatagtttttcgctgaatattttggttgaacaaagcagttgtagtcccctatgagcttctttctgctgtagatgtagttcatgttctgatttttttttttttgttgatgaacagatttctcaattttggtctacttgatttttcatctatagactacaggaatgctctgaatttgtggagttttctgcacctcagctgacgatcatgggggaggctgcaactccagagaggcaggaggatgttgtccaggtggcgggtcacgcctcgtcgacagcatagatcacacatgggcagaggaagctgtggatagcatgatgggtctgctagctgcaaggttcgttgggttgcagctgagctatgcatttttttagctccttttatttttctcaagcaattatctttgtggttcaacaaagcagatcgatacatgttttcctcaactgctcaatgcatatggtcccgttgattaggctcttgattttcttgtaaaaatgcgtacaacctgtcaatccattgaattttctgcaattttatggttcaacagagcatatggattcatttttctgaagcactcactgcatatagtcatgttgatcagggtcttgatttgttctacaattgtgtagaatctgtcgatccatcgaattcttttttatactgctcttgattttgtacagttcattgggtggagctttctcttggggggtgcttttgcctgccatggcaaggccagcaagatgggatgaggcttcagctggctagtgaggatggagatgaaatcagaaatttactacctgtgagctgaactcaggatttactgccttttgtagttaataatcagcgtcgtcggccctgatctacgttgctatattagtgctggcatcgatcggtattggcatatgtattagcgggtggtgttgatttgattttgtttattagttttgtgtttttctgccgatgtatcattgcgtgcattatcagattgttgatgtaacaccgacactggatcaaacaattcatgtttgtaaagaaattattaaattgtggttaggttaataatatgaatcataattttttaccttcatttgttttgtcactaaatactccagcggccttgtgcaatctgcaatatatttactcctgtatcaggactaacttattttactaagagaagtccaatgacgtgcaaatattaatttatttactaagagaagatttgcaaaccaattgggagtactaatgaagagctgagaacgatctgagagtaatttatttacttaaaggagtaaccaaattgggaagggctgaaaataacctaggagtaattcatttactaagagaagaaatcaatttggaagtgcggaagtgttagtaactcatttactcttagaccgaaagacacaataatattgttactaatgggccaatcaccaaaaaaggtgcgggaggaaggaaaaaaaaggtgcggggaatattttgatagtaacttgtttacttatcgaacaaaaacaactgatagtaattgatttactgaacgacagaatttgtcggagagagagggatgagggagtttgtgcaggatggatgtgggtggggtgatgcgggggtgggggggt

SEQ ID NO: 1876 - DNA, 27660 bp, Oryza sativa
  unsure (1)..(27660): unsure at all n locations
tgcttgttgtggtggagggtatggtcaaatcggttgtggccatggtggcaccaattgttctgtggcccaacatgagttgaatctggccatggcgcatgccacaacacccatcctcgaaccacaccacctaagtaaggaggtggccatggatttctcttggttactccatcaacaacttcttgtcgtctttggtgcatttcatcgagcacttgtcagacatctcattttccacactgatgacggtgtcaagcttcagcccatgaactccatcaaatctgtgattaccccccagaggcctagccatgagaaggaatgaacctactacaagcgacggtgttgacttcaaggcccattattaaacacggcataagtgtgttctggtttatgttagcaattgatatgggtgccaagttactcacggattggatgaacacaacaatgtctttggacacacatgccttgttttagaacaaaaccacgacttcacacacatgccttgttttataacaaaaccacgacttcatcggtaccacccttgacgtcgaggcccaacatcaaacacttggcatccgtctccttggaacaatcaggggtttcaaggtcagggttagtgtcgaggctggtgcatttcatcgaacacttccaaggtatgactttgggaaggtgcttggtgacaatgtaggtaacgtgatccttgtccttaccatcctcaagctccaaggtgacaattagaacggtatcctcgttgatgggcttgaactcgccgtctcctatgtgacgttgttattggggcaagccgagcacatggtgggttctataggaggcgatgccatgggtggttgagatgatgccaccttgaagatggccgtggtcgggtggtaatatcctccatgattgttgttcttcaccgcatggactttctccaacaatttggttatcttctccccacggctaatcatggtgaacatggggtggttttggcagagaatttgtttagcaaagaagaggttgtgataccaatttgttatgaacccactttgccaacaaaaatattaataggtatcagtacaatgaacaagtgcttgagggttgaaagaagcagttagtggggttggagtaggtcagtcaaaaaagcttgagactcatgagctgctcgagctcggctcatctcagacttgactcaagctcggctcggctcagctcaagcttctcacaagcctagatgtatgtttattttttcttttatataacaaggtagtaggttaagaataaattagtgtatatttatgtaaaagtaagttttttttggtattatatattaatcttatgttcttctaacatttttctttagtattgttaacttaaaattattgcttttctaaaatattaacatcaaaatatgcattgacatatatactcagccaaactcatgagcctaaccgagctcaagttgaacctacttaaaagctcgtaggaggattaggctcggctcgagctccagcctagacaggcaggatgactcgagctcagctcgttgacagccctaggttggaggtagaagatatatgggcacaagactagaaggttctggaaacttttagaccatgtagaggaaggagggtagggaagtagatcagcacactagtagaggaacgatttttccgtgcggtcaaaaatgatttttgtgtgcggatcttcaaaccgtctggaatgaagtgtccctaaaaatcgctatttttgcatgcgggtgacgcacccgcacgcgaaaaatctgtttttcatgtgcggggtggttatgtcgcccgcacacaaaaataaaaaaccgtgaaaaaaataaaatccaaaaaaacaaaaccctaaccctaaagctgacaccgccgccctcctcgcggtcgctatcatcgtcgtcgtcaccgtcgcggtcaccgtcgtcgccattgccatcgccgtccgagcccgcctgctgccaccaccaccgtaggatccgggcgggggacggctgccgtcgccagatccgggtggggggcagccgccaccaccggatccgggcggggggcggtcatccaccgctgcgcgcatgcagccgagcccgccactcccggtcaccagctgccgcgcgcacgccgctgagccacgcggtgctgctggccacgcccgacgttgtgcgtgcggaccatgcctaggagtgagagtgagagagaggtgagagagtgagagaggatagagaggtgagagagtgagagaggatagaaaggataaggatgaggatgggtggacgagatgaaatttttaagtgttgaggagtgaaaagaggaggaaggatagatttgtaggcaggtctttattaagaggccagtacgtgaaaattgattttcgcgtgcgggcatcttaagggtccgcacgcgaaaatgggaggccaatttttgcgtgcggacatgaaaacgatccgtctgtaaactaaatagctcctcgtccaggaaaatcgtttctctactagtggcaatgagccaagcctagcctctaggtcgccaccactgcaattgccggattttgctatttgtttgatacctccaagagcatgtattgttgcctttgttctcttccttgagcttagttgggatagcttcactaagctgccgtatcggcccgttgaaagcccactcgatcctatcataatcttgtgatttgcattccaaaatatcagttattgcacttcaaagatttctagttagtgttttgggatgtatgtgcaaattggatctagaacaaagtgagatatgcaggtaggcacattgaactgttgggttttgagaaagtaaaaccatcattccaccactttcttatattcaccaccacaagaaacttcatcctgtaccttgcctggacagtagacactaaagctacaaatgttactagccatccgtcttcaccaatttccgtcactacttcaaaatataaattaacaatttgaaacataatggtcacaggataacattcaggagtttctttatttaaaaaaccatgacattcctgtcagacaataccgccacatagtttttaaagttcctcatagctccatctacgacattgtgcaaaaactcgctcgacgcaatgaagagcctctctacacatgtgccacacacactttaccaggcaatcaaaaagtatgtggtcactagtttctgggaatccacaaatgagagagctgacactttcatgaccttgctgacctctttttttttaaaaaaaaaaaagttaagttgagcacattatgtcttcattggtatagaaaattcactacaaggcactaatgaggcacttttgaaaataccactatagtattgtaaagacatttgaaaaatgcttctgtagtattagaaaaatatttctacaagatatttttgttgtagtaatattctacagacaccacgtggtgacatcttctgcttgaaatgttttctaagtggaattgagaatcccaaagagtaaagtctatcaccggtccctaaacttataccgttgtgtcatcctggtccctaaactcgcaaatcgaccgttcaggtcctcaaacttgttcaattgtgtcatcccagtccctaaactttcatatcactcatctaggtcctccaacttgtttagttgtgtcaccctggtccctaaacaggacggtctaaaaattttgtattaaaaaataattcataacttttttatgtgaactctaatgaagacaaactttatattaaaattgtagcccgcgacacgacctataaatttctagttgaaaagtttttgaattaaaactgtttagggtcccaaaatattgttgcatgtttatagattttgaaatttaaattttaaaattacattttgggacaaaaaatgacttaaaataaaaaaaaatcaactttataagttgtagatcgtgtcgagggctacaagtttgatataaagtttgtcttcattagtgtgaggacgacccaaagcctaggtggtgcaacgctccaaggcatgtcagcgcgaaatatctggatggatggggtctcaaataaagcccaaataaatacggtaaccatccaacctcatcgcagaccctaacatgtcttgaagagtgcactacataggctctaagccatcggatatgaaatagaagacacaaccgttggaatagccacaccagtcgtctacgtcatacgcccgtcaaccactcgatggtggcgaccaaaagcataccccaaagactcgatctcaacaaaggcatattccccggttatctcaaccatttcaaacccatcctcatgtgggactagtcgcctaggaatgcaacatagtctcacataaatcatctcaagcatgatatccaaataataagtggttctaagcaataagcataattagtcttaataaggttctaagtagtacttggcgacaagccataaatattggttcatgcggtaagcgtgctacccaaaagcacataggcaaaccgactaggttaaatccctagttagaaccatcctggaaatctgcaacatcacaagctgcatcaaactcctcatccaaacagtcattacctgcataggggtctgagcaaaaacaagtaaaagaaagcaagaaatcagtacattaatcaaattaatgtactagcaagtcggaaacaatcctagcatactacatgttggccatattcaaggataagctgtgtataggttaatttgcataaataccaattttagttcacaacattttccgcaacggaattttataacaatagtatagagtaagtaaaacttaaatgtaaatggataaataacacacatctacccctcaaggtagatcatcaccactcgccatcatctcatcaccattcaccgaactttacccaagttcacaaacaaaacattccaaccattttccaagttcacaagagtttatcaaaatcaccaactatactcatgacacttcaccatgccgctcatgaccgtgagcacggctaatcgattagttttagactctgcatagtttgtacaacttttaagcccacatgatatgaatcgctctagtttgtccgatacccgtcggtatcaccacactctacacattgagtgtgatctagaggtcataacgaaaccgttacattgtttattgtctagcattgcaccagcacgatgtgtgttttacccacgctactagcaaggtagcgccactaagtagcgggcccacgctttaacctagcgccgtaaggaacccagcccggaatccctcacgaggcacgacaccgttgtattggacagactacccgctcaaatcatcacataccacttgtcattaatcaatttcatcatatcaccaaccataggaagttccgataagttaccaaaacccggtaacccatacccttcggcctaccaagatgcaaggctaaactctaaacaacttaataggttgaggccagcccatacttagcacatgtgatttgtactgttttcattagttggtgacatagagtggggtccttaatcgacccgggcgaatgctccccctatcggtgtacaactaccaccatatgtacaccactcgccgcccaagtctaaaaacaagttatctccattttcagttcacaatactcacacatttaaatttctgtccagcaacatcaaaataaccattttcatatataacatttatcaaaacgagtaatttacaaggcggtaaccgaatataagcatataacggcaatataagcatagtataatcccaaagaacacaataattttattcaaaagcactctatggttacaaccagcaaggattcaatatttcaaggtggattatgcagcaattaggtcatatctaccattcccacatttatattttttttttaccaaaagtaatactagctaacatatgcatgtttgcaatagaatcatttagcccaataaaacataggatcaatgtggtcaaaggaggggcaaacttgccttcgtttgcaaactcctgaacctggtcgtcaacaaactcaccctcttctccttcgacgtattcttcctctatacaaaatatgcgtatacgataaatacaaaaatgcataaaaaccaaaatgcatgaaacttatgcagtgagtgtgtgctggtctcaggtggtctctggtgaaggaatttttattttgtcactttttatttacagagatatgcattttacaattaaaaaggtttaaaaagggctatgttttattaagcaacttttttgtacagaagtgaacaaaattcctttttacaaagttacagagcatgactttagaaagttaacagaagtggtttcacaatttttagagctatattcaatttgttatggatttaacaagttctaggcaacatttatggcaaaacaaaaataaaggaaaagtttgtatagaaagtacccagttttattttttaaaaaaaatatttcacagctttatggatctaataaaactggtttcacaatttttgaagttaaaatgaattttctacaaattttagaagttctgctcattctctgcttgaaaccaaaatagaaatcaattttcgaaattgaattccagcagggtccacaggtcagtgaaaggagatttgcagagaggccctcggaagttgggggaatcaacccgcactccttctaccacctggacagcaaactttcttaagagtccctattcttttgtttatttccatcaaggttctactaatatgattcatggcagttttcagattggaccctagtgtcgatcagattcaagaaatgaagtccccagctagctcacatcgggaacagcaatggctgagctcggtctacggctcacctgcggcgatcggtggatcgaatcggttcgagaacaaaagagaaaatgtagagaacgttcttgcgcatccgtgagtggtggtggtgagggaaatggtggtctgtagcccatggaacatgagctacagcggcggtgtgtcttggtatgcccatgtatgtgcatgcagaggcttggatagtgcaaaagggttagtgcatgtgctctcatatggtaccagggtgctcaccaagcagagaaacggaggcagcgaggtccagggagcggtggagacggtggttgttggccaacggcagcaaaactccggcgtcgacgtcgccggatcgactcaaggcgcgaactgcaacttcgagagtacaggggtgttacggatgagccacagagggtgcatgcgcgaggaatccggcggaaactcaccggagcttggtgttgcttcggtggtgaggaacggcggccggagcggcgtcagcggttcgggtggccggcggcgaggacggtgacgcccaccacgtgctcgacagattggcctagggcaaaacgggtacgggtgagctcggcgtgatgcgtaggtcatgttccataggagggaagagagagggactcactggggatgcacagcgacgatgactaagtcgccggagccggggaagatgaccgagctctgggcattctgggcgtggggtgtgttttcttggacttggaacgcgatgtggggagtgtgctgttgcttctggtgctttgtcttgggaaataagagcaggtacaatagcaggctataagccagctgcaaatatattttaagcagataaatgaggagagagaagggcagcgggccacagatttgtagtcagctgtagcacggactccaaaacgcagtgtgtgtatgacaggtgggaccatatattaatagtgtagtatgtaactattgtatgaataagctattagattggctatagataaattagagctagcagtgggctatactattgaacttgctctaaggaagagtggagtgggggagtgagagagagagaggtggctggtgctctcattgtgttccttgggcatccattgggcatgggggatggtggatgctgtgaggggagagtgggaggctgtcatgtgggtcccagggggtgtggggcccaccgtcagtgaaagaaattcgaaaatagccttggaggcaaagtcaaagagggttgcctgccaaggatctttggaggggattcaaggtggattttgtgcagcaagaagcctgggctagagatcctcttggtcgagggtgatgtggagagtaaatgtgctgaagtggattgggttagaagtctctggtttaggtttgatggagggatgaacatgggttgacagtgttggttagcagcagttgatagtgcagttgatagctgattggatttttggagggagggaagaaagggttagagagtgatccagggtgttccactccttagggtgttagaagaatgttagtagaagacctgaaaccaaacttcaaaaagagattttgaaataaattttacagagagagcaagtttgaatctgctaagcagtttttcaggattttggagagattaaagtagatcaacgagttagcaaaccttactgaaaaactctgaaaatttgtgggttgatttctgacatatcaaggtatttttgagaatttttgtagaatttttggatgcatataattaccagattaattatttttgtgactctaggcctatcattgcatatgatgatgagatgattaagatccaaaaacaattaaaatcactccacaaccacatgatgcatttaaattaaatttagttcttaggtttacaggcttgggtatgttacaattagagttcacatgaaaaagttatgaattatttttaaatataaagtcattagaccgtcatatttaacccagataatattcaaatccaagtttagagaccggggtgacacaactgaacaagttggaggacctaaacgagtgatctacaagttttgggaccgggatgacacagtcaaacaagtttaaggatctgaacagtcgatttgtgagtttagggaccgggaagacacagcggtacaagtttagggaccggtgatggactttactcaatggcaaaataacatgtgccatttactgagcacctatcacactaatattcatgctacttattatttttgtggatgctgagaaatgagttagtggggatgaactatatagtctatatagattcgaatttatgttggcatcatttattattttccatgatacatttccattgaaaaactagacaactgagacttattataataactcggggttatctatttgtaaccattaaccctgttagttcaacacatttaacagtaatttagctgcagtgtgatttattttttgtttcgctttatattttcatgtaactaaattgtcccatgaagataaggtggcttaacaaaatgcataggaatatgaacaccatttatgcttgtgttttagaattttgtactttcttgaacataaaattccattattacctgcaaaaaaataaaattccattattacagtatccaggtccatcaaataatattttggtttgcttacatgtattctacagacaccatgtgtccacaacttctgcttgaaatgtttccaatggtggactcagaatggtaaaagagcttgtgtcaattgctgagcacctactacactaaaagtggcacaagaactaagaattgactcagcactagtccaagctatccgtatggccaagggtgtaaacagtgcaagttcagctggtgaaaaatcagtttatcgttataaacaaaacaaagataagtctgataaaactttctctactgaatgggataagagggctggaatggcaatgcttctagtggacaaatatttgtgactattgcacctgatcattttggtccaattctcgaagaccatgacccaaaaaggaacctctgtgtttgagtggggaaccattggaagaatgtagatagtggggtgaccattttcctcataacactaggaccgccatccaatctacacatgcatggtgctcaattagtaaccttataatacaatgcagaaagtgaggtgcccattttcctcatgttgccaggtgccaggactaaggacagatctacacatgattctcaatcagttgccctatcaagagattatttggatgattaatatcatgtagagtggttcctatatactggaaggtttagtgcatgcctgacgttttgtccctgtggtcagtaaccttaatgatataaacattttaagcaaatagatatgaagaggatatatctgtagaaggaaaaagttgtgtgaaaaaatgatcatgtgtgtaccacacaaatatatattgatatttctatctttttaaataaaaaaagatattttgcttggtgaagtcccacaaaacacttctttaaaataaaaacgtaatgaacaaaaaaacatcttaattaatttcgcatagcccatcagaaacaaaataaataaaggcatgtttatgcaagattcttttgaaagtataaaagcacactagtgaccccatcttccacatcatacacaccctgatatctcccacctcaaatagacgtatatatatagagagatcattaagaaacaagtaagaagagaagtaacaaatacttcctccatcaaataaaaaaccaatccagattcattcctaaaagttgattctttttagtacaaagggtgtagctccctgaaaccgttcacgccatttatttcagaacttatgtcgcactttggtgcacgctgctacctctctagtctaccaccatcacttactgatgtgtggccgatatgatgatctggccatgcattgctctagggacattgcaaattcatctgattttgctagcgctgagagcagctttgtcactgccatccatgtgattagggttaatcagacattgtccatgttggagatcaaagccgtcaattgctgaggcttcttggtgatgccagtggttcagaatatagctaaagctcatgggacgatgggagcaccagagaggacagggacaacaacaatcctgcttgcttgctaacaagaacatcaatgggttcctctacatgctgcaatcggaacaacccatcactgccctttatatccggccgttatatatcctccactttagcaaaaactcgctcgacgcgatgaacaacctctctacacatatgtccatcacactataccaggcaatcaaaaaagtttatggtcactagtttcagggaatccacatatgagagctgacattttcatcaccttgctgacctctttttttttaaaaaaaaaagttgagttgagcacatgtatacactacaacaaaaaccttatatattgacacttttcaagatacaatttacaatttgcctttaacatttagagctatatagtctagagacactttaaaatttgcatcttccagcggcattgtatatttgtataggcaattaagaatttgctgttgggaatagtcccacattgcttatctagggggagttgaaccaacttaaaagtgaggggagcccctcatctcttgagctagcttttggggtgtagcaaggctttctcccagttgggccaacgtctcccggttttgggccaacaagtggtatcagagccaaacccacaatctctagtgcttgtgcactatcagggtggtgtaaacccaaagcccagtggaccgcgggtgtgaggcctgtatgtgcccgtgtgtggggtcggtcagtggaccgcgggtgtgaggcccgtatgtgcccgtgtgtgaggccggtcagggctaaggggcaccaatgtaacccgtatgtgcctgtgtgtgaggccggtcagggctaaggggcaccaacgtgtgacgggagagattgttgggaatagtcccacattacttatctagggggagttgaaccaacttaaaagtggggggagcccctcacctcttgagctagcttttggggtgtagcaagggtgtagcaaggctttctcccggttgggtcaatgtctcccggttttgggccaacatttgcctcaaatgtaaagtcattttcttgtgagattctaacatatgtagaggcactttttaggacattaatatgtgaaaaacatctagatataagcaacacacattaatatgtgcaaaacatctagatataagcaacacaaggcatatattaaacatgtagccacatgaggttgagatggttagtgcattgaagataagaatgaacttctcaagaggtttcgagttctaggatttaaagtagcaaggaatcataaagttttcacttattttttcacagtggtttgctatgtttgtcacacaatctaatgcccctagaaaatatctatactctctttgagaaaaaaagtttctataaaaaatgctgcaatacataaatgccagtttctataaaaaatgctgcaatacataaatgtcttcatttgtataacaaactcactagatggcactaatgaggcatttttgaaaataccaccatagtattgtaaagacatttgaaaaatgcttctgtagtatttgaaaaatgtttctacaagatatttttgcacaatctaatgcccctagaaaatgtctctactctcttagagaaaacaaagtttctataaaaaatgctgcaataaataaatgtcttcatttttatatcaaattgactagaagggactaatgaggcatttttgaaaataccactacatttgaaaaatgtttctgaagtattagaaaaatgtttctacaagatatttttgttgtagtaatattctgcagacaccatgtggtgacatcttctgcttgaaatgttttcaaagtggaattgagaatggcaaaataacatgcgccatttgctgatcacctatcacactaatattcatgctacttattatttttgtggatgctgagaaatgagttagtggggatatactatatagtctatatagattcaaatttatgttggcatcatttattgttttccatgatacatttccatggaaaaattagtcaactgatcatactcattataataacacggggttatctatttgtaactgtcgatgggggatacccgtagaccggataaatagagtggtggggtacgttggtacgaggatctacacgatacgacatcaaagcaaacaaaagacaaggattatacttcttcaggcccctcttgaggtaatagccctaatccagtttatatgagattgatatgaaaaatcacagagtacaaagggaatagatgaatccgatgataccggcaagatccttgtcgagattgatcgacgagatctcccgacggcttcggcttgaatccttcggcttcgtaaactgtggtggatgtattggctctaggattcgatgatcctaaacccctccgagggtgtgccctttataccgcgagttgccttagtctccaagtagaactcggagacaacgaaacatgcacgacacagaatagtcccaagcctttccgagtaggactctgatagtctctagcccgtaaggatatttttcataatatcttgtatatttccttctcgcttacggaaacatacctagaatatgagatacaccaatctagtatacttggttaatcgtaggataggaggtatggttatccataaccctgacagtaaccgttaacccagttagttcaacacatttaacactaatttagctgcagtgatttatttttgtttcgctttatattttcatgtacctacattgtcctatgaagataaggtggcttaatagaatgcatgggaatgtgaacaccatttatgcttgtgtttcagaattttgtactttcttgaacatgaaactccattattatagtatccatgtccatcaaataatattttggtttgcttagatgtatttgacaaataccataaggccacacactacaccagatcctcacacctttgacgaacatatcttngntggaaaacccgggggggggcctttagcactcgtcagtgatgagggtcatctttgacggttcttataggatgtcgtcatcagtgaggcatccttctgcaacccgtcacaggtaactagtcaccggtgacggtccgtaaatgaaaaccgtcacctctgacggtttccacttctggcccgtcacaggcgactagttacctatgacgggttgcatgattataacccgccaacgggatggttactgccctcaaagagcccggtccataaggccggtccaagggtggatggggaatagactaagttcagacaaaaaggaaaatcttttttctccctaacattttctttttcccttatccacacattttctccaccgcgaaaaaaaatgccttgggcgacgccgctcttgcgacggcggcggaggacccgacgccctcgggcgaggcggcgctggacggcggctcagcaatacgtggcggcggcggtggtgcggaggcgaagcggcgaggtggtgcggcggcgcgtggcggcgacggctcagcggtgcgtggcagcggcggcggcggtgcggaggtgaatcggcgaggtggtgcgacggcgcgtggctgcgagcggcggcggcagtacccccatcctcctcccccttctttctcccctcctctcccttctcttatttctcaatccggtttttcttgaagtggcagcggcgtggagttctcaacggcgcgcggcggtgctgcggtgcggcggctcgacgcagcggtgaggaggcgaggaggaggtgaacggcggcgccgcggcctccatccccgaccgccgggggccacctccatcccccaactgacgggtgccacctccgaccgcctggcgctagatccatcctccacaaggtcaggggacgcggatccggccaccggggcgtcgtctcctccgtccgccggctgcgtccccaactgacgagtgcagaactgcagattcccccgtcggctgcttccgggtgcagaaggcgaagagggcggcgtcgaggagcagtaatagggacgaggtcatccgcaaggaggaggagcaaggtcgcctccaggccgagctcaagaaggtctagcgcgccaaggagttcaagcccaccgtggtatgaagaagccctgcccggcaaaacccacaaccatttattcccttcgtttttgttgctcgtcaggtgattgacgaattgcttgcttgccatggctgttttatgtgtgatgaaatgttcgtgaagacttttctgtgtgatgaaatgttgtgtgtgatgaatgcgatggcaactacccagaagcactttttttttgtttttttttatcaaaatctacatcagtgacgggtgttgagctgtggttgtggctcttttttcctttttttttgggtgatttttctcatctgtgacgggtcacatgatacaacccgtcaaaggtgtctgtcacctctgacggagctacacccgtcaaaggtgagttaagtcatcagtgaccattgatctgtgacgagggggtctatccgtcacagaagagggtttgagcccgtcactgctagcttgttctgctgtagtgacaacttctgcttgaaatgtttccataggttgattcaaaatggtaaaagaactttccatcaattgctgagcacctactgcactaaaagtggcacaagaactaagaattggctgagcactagtccaagctatccgtatggccaaggctacaaacagtgctagctcagctggtgaaacatcagtttatcattagaaacaaaacaaagattagcctaataaaacattctctactgaaagggataagagggctggaatggcaatgcttccaatagacaaatatttgtgactattgcacctaatcattttcgtctaattctctcaaagtccatgacccaaaaggaacgtcggtgttcgagtagggaaccattgggtagaatgtagatagcagggtgactattttcctcataacactaggactgtcatccaatctacagatgcatggtgctcaaccttataatacaatgcagaaagtggggtgcccattttcctcatgttgccaggactgtggacagatctacgcatgattctcaatcagtttccctatcaagaggttatttggatgattaatatcatgtagagtggttcctatatactggaaggtttagtacatgcctgacattttgttcctgtggtcagtaaccttataagatataaacattttaagaagatagatacgaagaggatatacctgtagagggaaaaaaatgtgtgaaaaaatgatcatgtgtgtaccacacaaatagatattaacatttctatcttttcaaataaaaaagatattttgcttggtgatgtcccacaaaacacttctttaaaataaaaacgttgggaccgccgttcaatctacacatgcatggtgctcaattagtaaccctataatacaatgcagaaagtggggtgcccattttcctcatattgctaggactgtggacaaaactacagatgattctcaatcagttgccctgtcaagaggttatatggatgattaagaccatgtagagtggttcctatatatatatggaagttttggtacatacctaacattttgtttctgtggttagtaaccttataatatataaacatcataagcaaatagatatgaagaggatatatgtgtagaaggaaaaaattgtgtgaaaaaatgattatgtgtgtaccacacaaatagatattaacatttctatatttttaaatagaaaagatattttgcttggtgatgtcccacaacaaaacatttctttaaaataaaaacgtaatgaacaaaaaaatcatcttaactaattttgcatagctcatcagaaacaaaataaataagggttaattgcatacatgacattataaattttatggtttgctaatatgccattattattcatatatttggtaccatgtcatttcaatttcacaaatattagagatatgccactacataccacttcacagtattatctactttctccgtttcatattataagactttctagcattgcccacattcatatttgtgttaataaatctagacatatatgtgctagattcattaacatctatataaatgtgggtaatgctagagcagtggtggaggactcgccatacctcgccgcccgctcgtaccaacaccctctacctccaactccggcaagccgctgacggcagtcaggtgcagaggcgaggtgcggcgtcaggcgatgggcgaagacagggcactcgctgctgggccactctccactcaatcgtaggcccattgggctcgtttcgtgttaatgtgggcatatgtggatgattcactagacttaaccctagctcagaaattccccatctccgccgccgcggcggacgatgaggcgacgacggcgcggccgtttggaactgcgggaggcatccgcatccagctccccgcatgagatcaacaagcggcgactgggcgccagagctggtgtgcggtggcgcggctacgcggctaggacagcagacagcaggagcgatgtggtaggcgtaaggcaagcagcagcaggtaagctgaagcaagtggccttcctcccgattcaatcgtccctaatcaatccttgctctccttttttcagattctatgcatatctatcctctcccttgttccagtgattattgccatgctgaatattgatacaatgttgtgccgtacagtatagtgcgattaggtatgtgtccatgagttatacctcttttttttccgtcctccgctactgtgctattagaaaatgttatagtctgaaacggagggagtattttttaggaccaaattacccttttcttcttcctttctacttcccctctcttctctctttttagaatttgatgtggctagtggcatgcagccgtgagatcagttgcttgcttgcacccattttagctaggattcaggaatatacagcatgcattggcctatgtatgtgtataactgtgtagatgtagagacgtacagtgactgaaccacgccatgtatgagcgtaagtgtacaggctagttccgtatagttcgtacatgctgggcagcacctcggctccaacaatgtggcgggcgctcctgccgtccacgccaccgaccagcctgtgaacggaccaaccaccaccgacggcatcttcgaactttgccgagaccacgtcggatgcgccagtggagggcactgatgcagcgttgctcgcggaggtgttttgggagatcggcggtgccaagctgtagtcctcaccgtgcagtccaccactacaggatgcagccggctacataaacctcgtcggatggtcagagtttgttggttggatgacatgagagaggagaaagaaagggatgaagcagaagaagggtaatttggtcctaaaaagttagatataactgtgaaaggatatgtagtggtatatctccaatgctcgtcaaattgtaatgacatggtatcaaatagataaatattaatggcatatttccaaactataaaatttataatggcatgaatctaatgaacccaataaataaagacatgtttaagcaagattcttttgaaagtataaagggacaattatatctgtgcccccactttgaaagccaattgttgttttgcccctactttttagggtttgtatttttatcctcactttttgaatctcaagcagccgtctacaatcacttgtgacagccgtttggtggcggcagtgggcccgcagtgcgcgacagagcgaggcggccgagggcgtgcgccggcgcccactcccaggatggcagttgccgcgtcgagggcggtcgggcggccgcgtcgagggccggccggcgcccgctcctaggaggtccacaaccggcggccgcgactcttctacgcaaagccccgtgagatctccggccgccgccatggacgccgtcgactcagtcgtcgaccctctacgcgagttcgccaaggacagcgtctgccttgtcaagcgctaccacaagcctgaccgcaatttcaccgcaatttcagttgaacactttgtagtttgaagtttaactcaattttattccacaaccgtgttaagtcaattttatttgactgctatcgtttactcagtctttggtagtttttcttaactgcagaagtttgtcactttgtcaggtgctccatcaaatccaatattaactgatttttattttactgttgagaaaatttcaattgaatatacctctattcaatctagttccagaatcttcatggtttgtttgcttttggacatctatctatatgttgtgcacttttgtgcatatatagacttagtaatatgatctggactgtaatatgtggtaatttaccctctatgttgtggatatgtgatgtgtgcaattatgtttgtggacactcaatgtttgtggttgatgacttatatgtaccatggctaatttgtatgggacactttgtaatgcttgctttatatgtgacttgtgctagttgtgtcaaaattctatcgaaatgctgtccaaattttatttaaatttcggtcaaattttgtaattgtctagttttttgtgagtttttttgttaaaaatacaaaaacatcatagcagattctcacatttgaattattcacataagctgaagtcacaaagtaggggcaaaatcacacaaagctgaaaaaaatggggcaaaattgcaataacaaccaagggtataaatatccttttctctacaactaacactgttaaaaccggctgctagaagtgggggtacatggcttcttcagatttaaaaagtaagggtaaaactgcaaaccctaaaaatttggggtaaaacagcaattggcttcgaaaatgggggcactgatgcaattgccccaagtataaaaacacactagtaatcccatcttccacatcctaggtacccttgatcctcccacctcagatagacgtatatgtagatagagcattaagaaacaagtgataaaagaagtaacagctacttctataggatcgaataccaataactaagctaaccagaggagggtgaatggttggtatacccaaaaaccaaaacttttagtggaaataaaagttaccctcgaattcgtcggatcgcggtctaaccgaagtagatgcgccggtctgaccgcctgaatgttgttggtctgaccgagattgcatctccggtctgaccggcgagattagctatcgtcgcctgaagtcgccaccagtctgaccgccacgatgccgctggtctgactgatggtatttcgccggttagaccgccgaaaccgagcaaacacaaatcaaagaactcttgatgtatatgacaactttattacttctttttgtgtttacaaagtgcaacaacaacactcctcgaaaatttcgactaaactcgaaaccctaactcaactctcaattcaatgctctcaaaagcgatatcgggaggccacaccctccctctatttatacatgaggtatgcagtctaaagccacaaactaaactcatagaagaagtcctaatccacctaggaaacctttccgtacaagaaaccaactttacaaactccaatcataccaaatttggactccttccaaattcgactccgcatcacatactccttccatcgtatgccatatggaatcttcaccaaccacgtgcattgatctttagcctaagtatcccgcatgatatctgaccgtccggacgtcaccttatctccaagttgaattccgatccatcactggcaatactctccggaggcattaagacacctacacatgaatcaaacaaagaaaccatattctaagaccaagctatctccaatttgactcattgttagcaaataacagtattacatacgtatagtatctatctagaagccataaacatgaaacatccacggatatccaaacaaacaacccgaaaccgaaaccgacacagagtcggccggtcagaccacgggctggccggtctgaccgctcgcatagcatcggtctgaccggcctcaccagcccggtctgaccagacccgacaaaatagcaaaccctgttcatcacatgaaaatcaatcatatccaaaactacttcgccaataatctccaaatatcaaaaccaataaactcaaatgccaattgttcatcacagaataataatcaaacacgctttgattttacaacttcctccatcccatataaacgaacatctagggatgaatcttgacaagttcataactagaagttgattcttttcaagacagagggtgtagctccttgaaacctttcacgccattttagaatatatgtcgcactttggcagacgctcttacctcttcagtctaccaccatcacttgctgatgtgtggccaatatgatgatctgcccacattgctatgtggacattgcaattttatactctatatttgattttgttggcgctgagagcagccttgtcactgccatccatgtgattagggttaatcatgcattgtccatgctggagatcaaagccgtcaattaattcctgtagcttctttgtgatgtcagtgattcagactgtagctaaatctaaagaatcaaattaagacatatcgattaaaacatttcggtgaatcacgattaaaacatttgggtctcacacaaaacataccgattcaactgatgaaaactaacacattcagaaacaatcaaagacaaaaatataaaacatacaccggaaaaaagtccagtgcaacattatattgatccaacaccagaaacataaacatgaaagatctatggcctaaaacatagaaaatccgccaaatgtacacgtcgggatctaacttcttcctcacttgcgtctctggatcagactttttctatttatcacatctaattaattctacagaaacctcacagttactcaaataaaacgtgaatcacttacaacagttcactcggttactaaaacaatcaatttgagacataaagtttcaacttaatttcaagatcagtttcgcatgcagaagatctttccagtatatatcgccacatcaccctagtgtactgtgtgagaaccacaagaaatcaaccatgtcgtcttctttgccctgcctcgccgtcgccgtcgccgtcgccgtcgccgtcctatcgctgctagctctagctaattccaaccacctgccagctgcctccgtctccgccgccgccggcctcggccgctctgcgatcccgcgcggccacatcgcggccatgaagttcctgtacgcggtgaacgacgtgcggcatcaggccggggcgccgccgctggagtggagcggcgcggcggcgcggcactccaaggagcgcgccacctggctccgcggccccggcgggtgcgacctgcaggcgcagaagggcggggacccggcgccggcccacggcggcgccgtgacctacttcctcagcgacggtggtagccgggcctcgccggaggacgcggtccggctgtgggcggacgagcggcggtggtacgacgccggcgccagggcgtgcgccgccggcaagcagtgcggggactacgagatcatggtgcagccggcgtcgaagcagctcgggtgcgccgtcgccgtgtgcgcgtcacgcaagacgatcatggtctgcgagtactacggtgggcaggcattgatctgagcctatctatgctagtactacaatcatgtactaattaagctccatttttacaaaatactactaataagatagcatatgctgggcatattaattttcttcttcgcggcttgtcttgaatataatgttccgttggaatttgagaccctgtaaactccattttgacatgattatttcactttcggagtacaacgttcaataaagattactacaccccactattctcaaggatgactcaaatttatgcgtgcagtatcttgaataattaatatattaaaaatattacgatttaatatgtcaaaataacaatatatttgtaaatggcacttttatattaattagaaaaatataatggtagaacctatgcattcaagattgtgtcgatatcgaagacaagtaaaaaaagaacaaaaaataatatgacttaagagagtacttcactacttcagtctggaactaaatgccaaccctgtatataattgcacgaatattatatcataatagaatttgtttcgtagataatcggtttcactttatcttcgaaattaagataaaatttattatttgcacctttgatcaactatcaaattgctataaataattttggatgatttggttttattaattagagaagagaaaactgagaacttcaaaagataaaaaaatagacaatttgcatcttaaaccaatggtccaatggttaaaaatagttaatataatgagagcatcaattacatttagtagggtgaagacactaatataggagataagttagattagctctaatatgtttacatgcaagatttgtctcttatcaatattgtaaaagtaagttcataaagttctgttgcactatttttcttatgggtacaaactcttacatccgcactatagtgaaaaagcacgtattccctccgtcccactaactaaggcgcacacatattgtaagatttaactctttaaatatttgatcgataaatagtttattaatgaaattatatttgattaaaatagtatcattggattatcatttaaatttactttcatatgtttatgattttgttactattatagtatatgagaaatttaaaaatagtatcattggattatcatttaaatttactttcatatgtttatgattttgttactattatagtatatgagaaatttaaagtcaacgattagtcttgaaaactgtaccaagtttgaccacgtcgtagtgagtgggacaaagagagtaacaaagaaattaaacattaaatgtgtctttggtaccactacatattatgggagtggtaaataattactaccaagcataaggattttatggataatcccaccttattttttattatggcagagatctaaaacggaaaatgtttcaatccggttgtccgatctcgagaaaaaaatcggacgcctctcgctatgactttgatgcatgcagcctactcctttgtaggctttttgccagatcctctctttgcacacatgctacatatgcttccttactgagcattagtatgcatgaaggagagaggacatgaggttatttgcatgtacataacacccttttagcaaacttgaaaatgatttttcttctagattacttatccaatctatgatccgattacaccaatgtattcgttacaattaaatctttacaacaagatttcacatgactatattataagaaaaaatatacatatgttttaaccaattaaatttaatgtttcacatatgagaatcagatgtttcagctgaaattatattatgttgtacatatttaattagtgtcgcactgtatatatcttttcttagtgtatcacatggtgctatttctatgtttcagtaaatagtttattatgtttcactggtttatttgtaaatgttgcatatgtgttggttgagtgtttaaataagtattcactagttaattaaaaatgttgtacacggtatcatccatacatttcagcaaatattaaaaatgttgcaaatattatataattggattatactatcatatttgttgtaattaaattttacaacaagatctcacatgactaaatcctgatgaattttaaatttagcttaattttatgttgcagttaatctttttctgaatgttgcacactgatttatttggatgttcctataaatatttttccgatgtttgtttagtttattttgcaaatgttgcatgtcatattatgagtatgttttagcaagggttgctttatgtttcaatagttacaactcgatgtttcatgtacatgtgctataaaaatatttcaataaaatcaagtatttgtaaatctatagtatgtaccgtactatttactattttcttttgtgtttcatttgttaagattcaatgtttcatgtagtaatttctagtgttgcgatgatattaaatattatatctctttgaaacataatttgaaacataattaaagacgagttgaaacatttgacctcaagtgctgaaacatttttttataaccgatgaaacatcttttttgcaattattttttatcaaaataaaatcatgttggatcttattgtaaagatctaattgtaacgaatataacagtgtaatcgaattatagattggacaaataattgagaagaaaaaatcatttaaagttttctaacaaagttagtttgtgctattatttaatgggagagatgagagagagtagttaattcaccatgtacagaaataataaagtaagaatgaaatagtgcatagctacatgcatgtagcagagccatgtgagtagcgtacaccagcccatagtagcatccgatttttgtattccatcagacgtccgatcgctagtactctcactctaaagtatagatgttggatttttttagatgatctcacttatttctccatcttcgcatgcacgtatacgtattatggtgtctctctaacatgctaatgtcacttgacacgggcagcccacttattgtcgagttggacaataaacattgaggaacctagctggtgattagaaagtattttaaacataaaccaaaacatcatatttggcattcacatgtatattttttatcattacattttctaatcatgtaattaatatgaaatacgaaaattgttggaaacataactacgtgaaaacattattaatttttcatgacaaatctactgatattatttttatataccaaatcttatcattttttatatagtagtgatctctaaaatgttacgttcaattgtccgtacgcatcctaaaattaacagcatccattgtgaacagagttgatagacttcagttgattttgaaacgtaaagtgtcacagagatataggtaaaacttaattatatgacatagtaccgatcaatccttttgcttgtaagttgtaaccgaatgcgaacgttttattatctactagtatctcagaactcacttgcagttactcgcgtagtagttaacacgaatcactggaagcaccgtcactcggttactaaaaaatactccttccgtttcaaaatatttgacaccgttaactttgtagtacgtgtttgaccattcatcttattcaaaaaatttaagtaattatttattcttttcatatcatttgattcattattaaatatacttttatgtacacatatatttttacatatttcataaattttttaataagacgaatggtcaaacttgtattaaaaagtcaacagtgtcaaacattttgaaacggaatgagtatacatttgtgtaacgaaagaacaataaatttttttaacagcagatgtaggagttctacctgatatattaaaataacaataaatttgagacataaatttcgagggtttcatacaaatctttagttactatataaacaaatcttcatcatacaaaagaaaagcacaattaaccatgtcgtcttcctcctcctgcctcgccatcctgtcgctgctggcgctagcctcccacctgccggacgccgcctccgcgcctcgcggcatcgggccgctcagccccgccgcggccgcgaagctcgtgtccgccgtcaatgacgcgcggcggcaggccggggcgccgccggtggcgtggagcgcgacggtggcccagcgcgccaagctgagggccgaatggctgagcgacccgaccaaaggccggtgcgacgtggcgaacgccggcctcgatccggggctgacccgagtcctgctcaacccgatcgtggccctgacgtacttcgtcaccggcggcggccccgggcgtcggcgcgcggctgacgcggtgggggcctgggcggaggggcggcggtggtactacgccggcgccaaccagtgcgtggccggcggcggcgaggagtgcgcgagctacaaggacatggtgcagccggcgtggaagaccgtcggctgcgccgtcgccccgtgcgcgtccggccagacgctcacgatctgcgccttctcccctgcgtaaattaataagaaagcgtgcgggtttgatttcgcactaataatgttccggaaattgaaacatttgttatttttgagagtccaaaattttggaaaatcatatcacagtgttgagattttccagacctcttaagtccagacaacccctctcctgtgaagacccttgaaaactgaccaaatttatatgaagtaccactttgctattcgtatttccgccaaaaagttgcattccaatttaaagttttaaatcgttgacagacactggtggagaaaccatctttaatcgttcggccaaattctacaatagtcccggttctaataaaaaccggaagtaaaaaacatctttagtcccgatttaaaagttgaggggtactttttaatctttagtttcggttggtattaccaactgcgactaaagatcttttttagtcccggttcaataagtcgtggggttcaagacagaccccaattatttttactcccggttggtataaacaaccgggactaaaaatagatctttagtcccggttgtttatactaaccgggagtaaagagtaccccgaaccgcatgccagatattatccgcgtgccaccaaaataattgtttataccaattatttttactcccggttgatataaacaactgggactaaaaatagat

SEQ ID NO: 1877 - DNA, 16607 bp, Oryza sativa
  unsure (1)..(16607): unsure at all n locations
gacgacgacgatgactacggtgaccacggcgaccggtgacgacgaccatggcaaccacgacgatgggccgggccaggggcggcggatgtgcggtggcgggagggggtggaggggccccgcccggaggncntcntcntcntcctcccctcccctcccctccctctccctctcccagatctagccggaggaagggagcggcggacgcagcggcggcaatggcaggcgggcgacgacgattttaatgtccagtttgatgtttatttgtattactgtttcatatatgcatgtattgatgcttgtttgtggaaaatgaagtgagaaattgatgtagtgttcttttgaggttggatctgatgtggatttgaattgttatggatttgagatttggggatgtggatttgggaatgcaggtagcaacatgtgggcatatttatttttgctggcggctgaagggaagctacataggtttttttttctcaaaatagattatctctggtggccggtataacacaacaaccaacaaaaatcgattatcgctgacggccggtataatacaaccgctagcgaaaatcgattatcgctagcggccgataaccgctagcgaagatcaatattttctctcgcctttgctccgccaaggaaaacctaaaatggccgccacgaaagatgatttccgtagtagtgtggagtcctctttcgagcagatctgattttatctcaaacttccttgtgagtcaccaacaattaaaataataaaatgttgcgccacctatcatgggtctttgggcttataacttagtttaggtccccaggccaaatggagcccaagtaggctgcatcctaacttgctgatgtacgaccttaagggttcctttgctgtcctcccacctcttcacctccttaaatagctagggacctcttcaggttcttgggttttctttagattaacgtttagtcattgttacttttctgggtaaagccatgatcagttagatcatacctttctttttatggaaccctaagccgtgatcccaagtagccttcatggcaaattttcttatttctttcacttcctagctagagattaacatgtcagcaaagaacacatcatatcaattttgaacgagtaattttatggttctttagaatgtaccaggtgggtatagcacattttctagcaactacaaattagactagctagaaatttgattactgatcatgaatattctatttctataaattaagaatggtttttttttcaaatgataaattaagaatggttctagtcagaaactaatattagatagtcttttgttcccagtaactcctcgataaccaaaaaaaaaatcaaacaaaattacataaatatgtacatgtgaataatgtacattgtataccttaattacaattctggtcccacaacttcatcatttatcatactacaatacctgagcagtctagctacagcacagccactactcccaatatatacataccaccatgcatgtatttttcctgaaatactggtacagattacaagttcatttttcatttgcccattttatgctataaaatgtgataagaatgagaagtcccaggaaatcgcaaaatcctcgtgccaacgagccaaaccgggtgcttgatgccgccagctgcatcctactacagctgcatttctaatttttagctgcgcgcctgcgccagcttactagcatccagcttactagaatctgtttctttctttggctgtgtttagattggcccaaagtttaaaatttggttgaaattagagacgatgtgactgaaaaattgtatatatacgaaaggtttgatgtgatggaaagttggaagtttaggaaaaaactttagaactaaacacaccctttcatccttttgcttggcttaggtctagtttgcaggagtaggctggctcgtccttgctctgcgcttgtgctaggattgtaaaaccggatgcgccggtgaacttgctctggctgtcaagccgtgtattcagacatctgttatgccttctataaagttgggcagtgagccttttctctaaaaattatgtttgccaagattttagtgaaaacggaatgtgtattaaggtgttgtttggatccgggactaaattttagtccctgtcacatcagatgtttgtacactaattagaagtattaaacgtagactaatgataaaactcatttcataaccctggactaattcgtgagacgaatctattgagcctaattaatcaatgattagcctatgtgatgctatagtaaacatgtgctaattatggattaattaggcttaaaaaatttatctcatgaattagcttttatttatgcaattagttttattattaggctacgtttaatactttcaattagtgttcaaacatccgatatggcagtggcttaaaatttagtactgtatccaaacgccacctaaaccaagcatgcagatcatgtaatcttgggctggatggatgttaactaaaatacattggtttctacatcaaaaagccatactggtttggaacactgttcttaaatcagaggtcataaaggttcattatatgctttaaaaagacactttaagagagaaactgccggttcgaaaaaagtacaaaatgccataaacagatgtgtttatgtgggaaatcttcaaagatcaaaacatggaaaaactaagaaatgatttaatcagaaaaactaaactaaaatattttggcatataatatatacttaaaaaggaaaaaaaattaatgttttacactactaaactttcatcggagtccaggaaaacggtctttgaacattgaaatcatgcacgtgtaggagttactccctccatattgaaatgtatgacgatgttgatttctcaacatagcattcaaccattcgtgaatgtgaggtaattatatattggggtgtttagattcaggggtgtatagttttaaagtgtcacatcagatattatatagggtatcacatggggtgttcggcactaataaaaaaactaattaaataatccgtcagtaaaccgcgagacaaatttattaaacctaattaatccgtcattagcaaatatttactgtagcaccatattgtcaaatcatggagaaattatacttaaagattcgtctcgcaaattagtcgcaatctgtgcaattagttattttttagcctatatttaatattttatgcagatgttcaaacgttcgatgttggcataaagttttgggatggaatctaaacagggcctgtgccagtattcactgcaatgtattaccacaaacgctgtgaagaagtacaaacatatgaagaagtacatccaatcaatttattcaagctttacaaatgtggctggttcgggctgtcttccagcagtttgatatcacacctaccgaacaactggataaatttcacatctattaacaacatgtcctccattcgcaatttttgtagaaatacttttatcatgttcttcacacacttcagtgccctaacttgattcagttcgtttccaaaaaataggctttacacaccacttgcaacagtttctactaatggattaggttgagactgaaatcccacaatcttttggcgaggcccatgtcgagcgcatgagattttaattcagtgacattgcagtcaacaaagtatttgccagtgactccagcaacctgaggatgcaatgccacatagcacactgtggctgcaccctgcaaaaacaaacaatgctaagcagtgattatgtgtttggatagtttgcacaattgtttgttggtaattggatggtttgcacaattaaacatgttatgaattactgaattagtaaaatttcaaggagactttgtcctggtgccagttagttcatggatttaataacattaactctacaaaaaatagtccctggtagagtcatggtaatattgcagctcctgttttttcaggttgcaggaagatgttgaatgatataagcaataaatacattttttccatatttatatatttattaggttaattattccatgatacatccaattatttaggagcagtcaaaaagttttagaatgtacacttaccactagtactaggattaaagttttagaattattttgtgtgtttctgttgaataaaatgtttcagaaaacatatgtaatgaaatagacataaattgcatacacaataaaatacaaattgaatatacaataaaatagtgaatataactgtcacaagaacatatgtaatgaaattgacataaattgcatacgcaataaaatacttaaattgaatatacagtaaaaatagtaaatacaactctgtcactttagtcttgtgaaaggaacagaaaaaaaatgatccaaaacttacttgttcaacacctttaacgaaaaatttaccaagtgtagatagcatacctgaaattaaaaaacaaggaagaacaatcactgtgcattgtttccagttcattattcattcaaataataaagcacaaatgtggggcttttacaatttgcactggacaaccatagtgatcttcgatgaatgaaatatttctttaataaggtaatgctctcaagaattttttgtatatggaatgatcatgcactttaatgaacaaaaaagttctggaaaaactctttatacaactggaagagaagtaaatcagattaataggctagaaagaagatgtatccatgcaattaagataatagtgatggcaactgaagcctaaacttatgtgactacatagaagaaatggatgtctcatagctgtactatagatgaatatgagcacaacgaagcaaaaactcaactagccagaaagataaaagcaaatactgtctgagattcgatgaaccatccatgaagattgatttagctttattttgccaagaactatatgcatttgtcagatatgcccataccatttacgaaataccagtgacgcataatgttggtgacaacagctccaggatgcagagagttgactgttacttttgcatcttgctccttttagcagacaaacattcatcatcaagaaaatatgtgaaactttttgaaatagtaatgcgatcattgatatcatctattcacagaacagctccataacaaaaataacagggctttgacatccatcctctgcatagctttgctattatgagatctattttgtgataacttcatattactgtctcagccaaagatctacatgatttagttaacagcatgtctaacatattacagttagtaatttcaagaaaaatagcctactacaatttcttttccattttacaagattacaaaattgtgtaattttgaggacaaacagtgtgtacaattaaataaacaagagttagtgtgaaccaccagttgttccaaatacgagcttaaaggaaaacaagaagaaaagtggaaccttcagattgctagatagtaaattggaatgcagtatgttggcaagcttggattggccgtaagcgaagattttgttatacctagcgggagagaataaaaataattaatttcgaatatgatgtttttgtgcagatctgttttcttacctttgatcgattgaaaaggtaaacaaatgtaaaaaggagtatacgttgggtcagaaagtaatacccagattcatcattgatcttatcaaaacgaatcccctctcgataagggtgcttgtagctgttagaagcaactatcacaacccttccttctatcccactttctatagctgtaactttcatcttctcaagtaaaagatcggtcagtagaaaatgccctgcattgcatgattaattgcacgatgcagttacacaataataacagaaattttgcacgtttgtaaccaaacatggttacaagatcagtcaagtgaaatatgaccacacacaaatgtgtaaagtacatctgtcttagtaacaaatagaaaataaaacaataatattctatgaattttggcaaaacctacttaaaataaaaaagttttagtatgcagtttaagggactgtaagagggggcctaccaaggtgatttgttgaaaaatgcagctcaatgccctcctctgatagcttaaatggtacaaacgcaatccctgcattattactttaaacagagaagactaaaactattttctcaaacataaaatggatgacgtattcctcgccaaaaaaaggcaatgtaaaaaaagaacacttcaacatagatggaataaaagttttttagtagaggtctgatggactgttttatcttccagaaaatgactgtactaatgacataacccagtaatacataaatactgtctattaagcatgctttgagtgtctgaatcccaatagccagctcaaatgctcattccagtttatttagcacccaaattctctatgttgcagaaggttttgctgctacaataattctgtaaaacagcataatgttttttttttctttttgcgaggaagcataatgttttgttctaccaaatatttccaatatacataaacattagatctgcttacaccaggatgttcagaggaagattcagagcattgaaattctccgcaaatctcctcacagaagacatcaagctgaggtcaagatccagcatctcaatctttgcagccggaagctgtctcactatctcatccctcacacgcgcaccggcagatgagttccttacccccatcacaacatgcagtccccgcatcgcgagaactcggcatgtttcagcaccaatcccactggaggcacctgcaagaaacatctccaatcagcaactattccaccagcatttcaggccttcagtacaaaattcgattaacgaagcaggaattggagcaatatgcaagatttactcctactgcttgcatcagcctgaagagtaaatattggggaaaaattgattaatggttggtaaaactataaatacatttagcatataaatcatctttcataatttccccccagatttatctactgcaatatgcaagatttttatacaccgaacagtaaactttgccaatttcccctcaaatcgaagagaatcactaaattcctcgagcaatttcagttcagaccaacgattcttggattcgagcagggaatgttcagaagaaacaggagtcaaccgagaaccaggggacgctatgaagtatgaaccgaaccaagaaacgaccagctgctggaggagagatgagagtacagttcacttgccggttacgacggcgacgaggccggaaccgtcgacggcggcggtgacctcctccgcggtggacgacggcgagaacccggaggggcttcgccgcctcagtaggccccacattgtcttgtgctgccgtgggaagtgggaacagcttccggccggtggcttaaattaagacactcaacttgcttaaatagaacgtttcagcttccaatcaaacgtataatactcctgttttgtaagacgtttcaattttaaatggttcaactccatagaagttgacgaatggctattggtcaatttgtaaactcatttgctccctccgtttcatataataagtcactttgatttttttaaaaaagttagaagtttaaccaaatttacggaaaaaataacaaaacttataatgtaagttagttttattaaatttatcattaaatatatgttgataggttgtgttgaaaatattgctaaacttttctataaatttagtcaaacctacaatagttcgacgtaaaataaaatcaaaacgacttataagagatggtagcatatcaagacggtccaatagggttccattatgtagcaaattttatagcaatccaacttttgctactaaacacacatactgccccttctgtgcattaacccttttattagtatggtaaattttgccaaaaatattgtgacttcgtgattttaaccttaggacatcatacgatgagttttagagaagacactctataaatacgataatttactcgtgtacaccacgctgattattttagtgtattcttagataccatctattttaatcggtgaggtcattaatccatttcttttctcttcctcctccttcccgaagaaacaatcagcctctcaagctagttctcccctccaatttcaccgagccaccgctaaagtcatttgcccatccgccatcgtcagcccgctccagaagcaccatcttgccaccaaggccagcattggagactgcaaaccctctttctctctcctcaaacgcaaacgtgttctaatcgttatcattctccttgttgttgccatcctccgtaacctgtagatgagtcacgttgtgggatatgtagtcctgccgccatcctcgttgtcgtttcacggtcaacacgttgaggcccgcgctcactgtgctcgtgttgtatcaagctgaggaagaacattgccggatatgccaagggcaattctgcctcatcatgtacaattgtgggccctctcacgcgttgtcagatcgaatacattaaaaaaaatggcatgatatccatgggctaattaccacgtttatagattgtcatgatttcctgtagcaaatattacctattagtatgtgctcccttcgtcccataaaaacctaatgttgagaatgagtttaaacctaattttttcctggaaaccaaagttggtcaggaacttattttcctgtatctgttctcttccagcaattatttcagctttacatttatcatttctgtacagccagtgctccattcacaatttatctttggagatactttattttttctaactagttttggtttatttcccatagtagactttacatagctattgcgacaacaatttctatcaacggatttggctgagactgaaatcccacaatcttttggcgaggtccatgtcgagcgcatgagatttcagttcagtgatattgcagtcagaaaagtatttgccagtgactccagcaacctgaggatgcaatgccacatagcacactgtggctgcaccctgcaaaaacaaacaaggataagcattgaatgtatgagtatgagtggttttgagcaattaacagaaaaaggttatgaattagtaaatttttcaaggagattttgccacttcataagtttaatataacaccaactctacaaaaagtggtgtctgagtctcctcaattctctaagtcctgtctactctcccttctccctcatcccactcctatcctccgagtggcagcgacgagaggcgaaggcaggggcggatccagaaaatagagtcattgggatcattactgaaatatggtggtgtcaatatatatatataagagagtaattcttgtttctagagtgcattagcaaagagattagtaagaagtcattggtgtccgctgacaccaatgcttacactatggatccaccactgggcgaaggcacagctggtttctagcagcggcgatggttgcttcgggctgcggatcgatgatgacaatggttgcttcgggtggtggaggtgtgtcaagcttcaagtgatcgtgacgacggaatcaatggcggtggccgcgtacaggagcggcggatccggcatcaaggatcttggctacggcggatcaggcgctagcgagctcggcgatggtgggtgtggtggtaggtgatgaggacatcactagcttagatatggtcatggctaccttaaatatttatcaagcaaaggtacatgctttctatgtaagatttacatgtcatatatttgaacaaacactattatactatgagtcttgcatgtgctcgtttgtagaggaacttgctttgggtgaaggaaaggggaacgcacatacggagtgattgaatgatctatgaagttaattggggactaaccaatatccttcccagagtttatccccatgttaccacgtcacttttagttcatagaagggaatagatgaaattctacatgttttagattcagattcgggcctcctgacagcatcaacttcaaacggatccaagccaagggggtatgcgccctagagattccgtttgaagttgatgctgtcaagaggcccgacttaggttagagacgtcctagggatagtcctagggcgcacaccccttatgacgtctctaatcatatttacagagattccttctataagttgtgggctaagcccaagggggtgtgtgccctaagactaaccctaggacatcttcagtcatatttgttcaatagttgtcatagtttagagttggattttgcttaaattatttctgccattgaagtttcgccgctagtttggtttgtgaaaccccaactttaaaatcttaatcattcatctacatattaagttgcaatctaccttgttcttgcttatgttcttcgattcgtatgcagggattagccttctcggcgaggtcaatcgggttttcgacaggattgataacaagaggaagtgtggtgctgcgattgcagggttcggatcatgttaattggtttgtcgtttgtaaaatcatttatgtagtgcaataaaaatgttggcaaaaaaatatgtgttacctatcaagtaaacacatggacttagattgcatataaaatacatataatgcatataacataaaacagaactctgttacttttatcttgtgaaaggaacaaagaatgttctaaaacttacttgttcaacacctttaacaaaatatttaccaatagcacggatagcacctgaaataataaaaaagaaggaagaggaagaatataactttctatctgcagtagaaaaaaaatgcatttcattctctcaaactatttcattggagcagttaaccctgaactagtagaaacagtgcaccatacggtatttctcttttttctctctatgtaaatcgtattttgcgccaaaaaaatggtagtgttgatagatgaagtataacctacctctccatttttttctgaaatttttaatcactgctgtttacagagattggaagcagtaagttgacttaaacatcgaagtcttaaattttaagcaaattgtcatattttttaaaaactttgttaatggtgtcatgtatggcttaaaaaattttaacttacaataagacttgcgtaaagaaaaacaaataagggagatgctattgaggattaaagtgaaccaaattagccaaaaaatagttcaggggttagcaatctaatggaagagtttgggagtagtaaaattccagcccttgaaaccaatatgtagaaggaaaatgtcatgaagctataagacctagattagttgctagttaggcacgatacatcaaactaaacattctacgaggtgagattcgaccaatcattcatgagtattgaacttgctttatttttccagtaataacttgcactcgtgagatatattcttaccatataggggacaccagtggtgcaaaatgttggtggcgacagctccaggatgaagagagttcactattacttttgcatcttgttcctttcagcagagaaatatttatcatcaaggaaatctgtgaagcttttagaaatagtaatgcgatcactgatatcatgtacttagaacagctccataaacacaaataacagggcaattgacttccatcctctgttggtgttttaccactaggaggtttatttttatgataacttcgtattattaattcagctaaagagccgcatgattttgttaacaacagaatagtttaacatagtactaccatttttttataagattacagaacaggcaaacgatgtgtggaacaaaaaaaaattaactagagttagtgtgaatcaacaggtgttcccaaagtaaaggaaaataaagagaaaagtgagaaccttcaagtggctagataataaattagaatgcaatatgttggcaagcttggactggccgtaagcaaggaatctgttatacctagcaagagagaataaaaatatatagttgaatgtgatgttcttgtacaaatttgttttctcatgttttatctagaaggtaaataacatgtaaaaaagaggcaaaatgtgttgtgtcgcaaagtaatacccagattcatcattgatcttatcaaaacaaatcccccctggataagagagactgtagctgacagaagcaactatcacaacccttccttctttgccactttctatagctgtaactttcatcttctcgattaaaagatcagtcagtagaaaatgccctgcatggcattattaactcaagaatgcaatcatacaacaaaagcagatgttttccacataagtaaccaaaaatgggtgtaagatgagtagtccagccaaataggcaaatatgatgaggtacaagtgaaattatgtaaagtatgtactgttttggtaaacatgcaagtccatggattgaaataaactgaaactctaatattctacagtataaatttagtttcatgttttagcaaaaccttcttgcgatcaaaagtttcagtttggagtttaaggactgtaaaagtggatcataccgatgtgattcgttgcaaaatgcagctcaatgtcatcctctgaaagcttgaagggcacaaaacaaacccctgcattatttctttaaacagagcagaataaaattgtttagtcaaagatagggcaatatgtaaaaagataaagataaaacatattcagtagagatggaatagagttttttagtggaggtttcaaagtcacttttaccttccagttatactgtcctaatgctcaacctagctaaacatcaatattgacaattaatcttgcttacagagtattttaatattattcaatatctcaaactctcaatagccagatcgattgctcaatccagtttgttcggcaccaaaatccctacattgcagattatgttgttgcaattatagttctgtaaaatgcgcaatgtttctttctaccaaaacatgccaatgtagccaatttagtactattccctccgtttcataatataaaactttctagcattatccacattcatatagttgttaatgaatttaagcacatatatatgtctagattcattaacatctatatgaatgtgggcaatggtagaatgacttattttatgaaacggaggaagtacatccaaacatagatttgcttacatcaaaatgttcaaaggaaggttcaaagctttgaaaatctctgcaaatctcctcacggatgacatcgagctaaggtcaagattaagaatctccatctttgcagacggaacttgtttcaatatctcatccctcacgcgtgcaccggcagataaattcctaacccccataacaacatacacaccccgcatcaccaggactcggcatgtttcagccccaatcccactggaggcacctgcaagaaacatatccatcagcaatgatgccaacagtaattcaggtctgcaatacaatttgattaggattttttttatggcgcattaaattactgtgcatcatccatcacccattgaccaaagggattaatgttgcatttacatcatggatggtaaaatatcatatatttttttactatttaaattctaccaaaggcaattattgtagtccaaattttccttaactaatttgacattcaggtttctaatactataaaaatacaaaaatcatgttccaaattgaataaaaatttccatagcggaaaaattgaacatggaaggttcggtttataacaaaagttaaaataaattacttttaattgtatatagttccggaatagttgtttgatttttatcaaaattcagatgattatgcaaagcgatactcttaaatcttcataatcaatctctagaaaaatttcagtgcccaaattatattttgaacaacaaagctttggtttataacgaaactttgatttaaatattttttttgcttttttttcaaattaggatgattatgtaaagacatatatagctttaaatcttcaaaatagatacttttagaagttcaaaacgaattgtgaaaatcttgaatgagaattttcaaatccgcataattcaaattcgacactagaatattaatgctaagattgactagaaaaaaaatccatttgaatggatatcaaaattctagtatttataatctgaatcatattttaattttatgtctcctatttggaatcaacgatttttaagtcattcatttatctcttttgtaaagtataatatttgttttgcacattcattctgtgcattagaattccttgcaaccactattaaaattctctgatggttaaattttggaaaatattctatgggtactaacgttttccttttgttatgtattttattaaattaggatgtgaaaatatatttgttaatagataaaggaaataaaaagtaacggctaagatttctttatactgtatcagtcccaaaatcagcatgcatgaagagcaaataaaaccaagtgtctctgattaatagaaaataaatattggtgaaacagaagataatatattttctaaaaaaacacggtataaacgaaggcgcttacaacacatacatttacccttgaaaactcacacactatctttatgagcatctctgggagacttggtcatcatatcttgagattgacgaagtcaccacgggaatcccgttatcgatggatacgtcgcttaccactgaagaacagatagccgtaaatctgagcatgcatatcaagtttaggacatgaacccgagtgggctagttccaccacaagtaacctaattaaggtacgatcacctcgcaataggtaacaaatatcgaatgaatggaatttctttaatttatagagcaagagcaggtaagataatagaagtagcaattatcacaagctagaaataaatttattttggaacggaggaagtggctcgattgattagttaaggacgacctggagcaatacacaatatattcactaatagatgaattagttagcatgctccaatagattgattagttaaggaccactttgcatgctctaatagatgaatcacttggagaaatacactaatagattgattagttaaggaccactttgcaagctgatgaattacttagctaccaaaccaaaaaaacagaaattctacgagcaaagccatgtttcagaggagtcaatcaaccaagaatcaggggatgagagtacagttgaggcttaccggtgatgagggcgacgaggcccgagccgtcgatgccggcggtgacctcctcggcggtggacgacgacgagaacccggaggagctgctccgcctcagcaggccccacatggcgtgcggtctttgagtttttcgccggcgtttaatagttttggtgccggaagtcatgaagaagaggcctttcagctaccaatctcaacacaccgctcctgctcatctacgatttttataagccacatattttaatttctaattatatactccctctgtcccaaaaagaatcaacattgttctagcttgattctttttgagaaatgttgattctttttgggacggagaaagtaggtgtaaggttagtagtaatataaatgcatttattataccaaaatacactggtgacttggactgcggtgtcacttaggttcatcaacttataaatcgcaagtcaaggtccacgatcttgttcaatgtaccaactgtggtccaaactacctttaatcaaaggtactgccgtggttgtcaacggagaaaaacattttgcattcagtccacaccataaataaccgtggcaacaaatttgtatttagccccttttgtatgcctaaatcgattccaccaattcggttccccgcctccctgaagtagggagtaatgattagagcagtggtgattattgatagtcgaaggttctcggatcaaaaaagagtaggagagggtgatctcatgagtccagtacggacctcatcttcgtgaagaagataccacaccacaacagttgtgccaccttcctctctctagtacaccctactctcgtcgcactttgtgccaccctagccattgccgctttccccttcctaattcaaaagaggagaagagagaggaaaactttgggttgaggatgaacttgaagcgaatggattaaatgcatatttgtttctacagtaggttttgaacaggggtaaatagaaaaggcttgacctattaaaggtgatttcaacctcgagtcgtatattaaactaaaattacagatctagatatatgatttacaagttgatcgattacattagtgacacagcggtcttaaattggccatgtcttttactctaagttttaatgaacttagcgtttgctaagaaaacaagtaaaagaatctataatattcttcaaaaatcaatttttcaaatttataatcatcttttgtttcgaagtggaagctttactatataggcaccaaataaaaggaacacatgatctctactaagatggagattggtccctccacccaccgctcacatcactccatcgtaaaaccgtataacttttatttaagcatcgataatcatttaagcacaatgtcagcgccagtcccgttggcgctgacacggccaacctcagcgccaatgcgcttggtgctgagctgacggcctaattttggttgaagtttttggcaggggttagtttcgaaataagtttt

SEQ ID NO: 1878 - DNA, 17620 bp, Oryza sativa
  unsure (1)..(17620): unsure at all n locations
cgccaacgggactggcgctgacattgtgccaccgtggcggccgggccgatccccagctgacgtggcagctacctcagcgccaaccggactggcgctgaggtgggacttggccgcaacccccaaggcccagaccagcaagcctgctggttcgcttgcgggctgggacctcagcgccagccataatggcgctgaccgtgggacactcagcgccaaccggactggcgctgaggtgggacttggccgcaacccccaaggcccagaccagcaagccttctggatggcttgcgggctgggacctcagcgccagccataatggcgctgaccgtgggacactcagcgccagcccacctggcgctgaggtgggacttggccgcaacccccaaggcccagaccagcaagcctgctggttcgcttgcgggctgggacctcagcgccagccataatggcgctgaccgtgggacactcagcgccagcccacctggcgctgaggtgggacttggccgtttcggccatggcccagcccagcaagccttctggatggctgggctgggacctcagcgccaggtgcactggcgctgagtttggacatgtcagcgccatttagcatggcgttgacgtcccagccctgctaaactttagcaaaactttgcacacaacacaggcaaacatcaaatcacagaaatttacaggcagtaatatatccagagaaccatacaaaacatacatccatccatcaatcccaacatcattccatacatccatagaatccatcaatacatccatatatgaagtccatacatataagaaataaaaacatcccatcgatcctcgtctatacatccagtcgagtccatacatccagtccatacatccatcgaaccatgcatcaagtccatccatctatccatccatccattgaaccatgcacttacctcctcctacctctagtgcgaggacgaggcacgtcgagggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccatatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttattcttccgaaggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcaagcacttcctgtgcctgatatggcatccacaccacctgcagcaacaaaaataaaacacattgaagcgaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaactaaaacaatgcaaaatatccaataaaactttggggaacttagggtttatagaggggtttaccttctcttccgatcccaaactcaatgccgcacaaatcaccttcgattagagaggtttttgggggagattggacgaggagaacgtggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctaattttggttgaagtttttggcaggggttagtttcgaaataagtttttgaaaagggtcaatttgtccttgtatagctagcatttataatatatgtaaggacatattatgcgtgataggaaaatactttcatgaactcagcgcgtatcaattcctgattggacaagattaggagcttaagcatgtagttggaagataaattaattaatgatggttcgttggaacttggaaggtggagtagtcaagaaaaatgtttacatttgtgtaggaattttaaacgccacgaatacaaataaatgttgatggagggagcattgactttccatttttaagtaagagatgtcatttttatgtttataaggatgtcacataaacaataagatatttaaataataattgaaatagcttgtacgtagttttattttttttcataggtaaacatgcaagcacaaacaatattgaaacagtgtatacatagttttgactaaataaaacatatttcaccccctcactttattaatttctggtcacatcgttaaaaattcacataatgataataccattagaagtgatcgtcttaaatggaaaaaacacgtatttgtgacaggatgaagcagctataaataaatgcaccagatgctcctttctatgtttaatcaaattatgaacagtgtttcaaaaaaaaattatgaacacagtatatgtatatcccacttgtttactccacaatagttgattttttacagggacatggacagttggacacatgtgggacaacaatgctttgaaagttgatagggaagttcgaactaactctggtcatcccaagcagtaaatggtgcaccctatctatctatcgacagactaatagttccatgccatttgctcaataattacatatgctatttttttcgttaagtacttatacgtgcattacttttctgtgattaagtgtaagtttcaatttgaggaattaaataacttttctatgtaagtataaaatttgttttgattacaccaacacaaacacatactactactacgcacgtacaccaccaccaagacgtgatggtaggtgaattgtaggatcttaccatgtagtaaaaaccacacacgcttatagaagcaaaaacaacaaatccatcttccaatatttaagcgtaactgttctaaaaatacaaatatgtaccagtgttcaaacaaatattgtgttaaaccatgaagcaaacaatttttaaaaagtaaaaatatagagcaaactcataaatgatacatgtccatcgctagtttgtttgcttctgcacctatcacacacctaccaatttactcctctgtaagtgtgtgataggctatgtcgatgtgccacagaggtgttctcagccaggggtgggcctaccatgattcatgggtattcagctgaatatccaagattttagattaaaaaatttcatatatgtaatatatatttcatatgtatgtggaaaagtatgcaaaatagacttgttccttcagagaaagcctaacttagcaccatcccacctccctcctctactcggcccattggcccaataacacaaatcaacccaaaatggatgtaacccttacctctccagctctccttcccaatctcctccttggcatggcaccctggccccctccccgaccccgacacgatggcacatcacctcccacccacccccttcctcaacggcggcagcgcccagccagctgcgacgcagcagcggctgctaatctcacgccacgcgtccgtgcccctaggccggccgccacgaaggcgccattgcccacacgccgccgcccctgccctgtggctcccaggtggtgggccagccggtgcccgcactctgccgcccgtacctccaccctccaccagtccacctccagtccctgaaccgccttagacttagacagccagacccacacgacggtggaaggttagaaacattttggtaatttggttggattaggattttagtatttagttcatagttgaatccaagatggttcatttgatttaggatttaggatatctttgaatctaggaatggttcactgttgaacattttttatttaggatttgaatccagtcattcagggatggttcatgattgaacaatcaaactttgaaacttgtgattcactgattttgtgaagctttgtagcagagttagtacttataaattgcatcagtgcacatattcagcagagttagcatagttagtacttaaattggaagaccatattgttgttttataggtttgaaacgtgaataggaaaaatgctcccacggttaatttaaaggcttttttagaaacagctgttgcaaataagagaactcaaaaacaagttaagaagcaagatgggataagaatatttgaatgattgtttgattacattcgttgaaagtgatctattcttccaagttaaggatatagacatcattactcattttcaaaatatcaagaaatggaaagttcttatctaaattgtaagatttcttatcattttttcattttctatgctctataaatttaatatgttttgtcaattaaaactttagtattgtactttaatatgcttaacacattcaatttatgatcaattatatgaatctataactttaaaaaatcatgcttataccgttatatattatacagctattagactttatgttgaaaaaaatttctcttccagtttcaaatacccaagttgaaaatcctaggcccgcccctgttctcagctgttactttacaaagcttgcagagttgaagtcttgtctgggctttggctaggttattgcaggagatttgaagggctttgtggtggtggtgactaactcgtgtagggttacgatttatttttgttcagtaaattgtatttttttatggttttaagttttaatgcaaatctggcggaaatgtctttttcaactagaaaaaaccatcacattttgctattaaatcttcatatgttcacttaatccgttccaatttactatgttgttctggagaaacctcacccaattgccaatctaaaatccatgctagcaagggtgctgatgtattcatatgtgattcttgactacaattcagtcagaacaattctaaacccgcaatgtatttaaaaattcacgatagtttgtaacacaatgacaattggctcaacaaaaaaaaatcatggcatttggcatatgtttacatgtaaacccatatgcattataccgttggtttatatcagtttacatcagctataataataaacaagtttttattatgttgaggtgaaagagagggtgtgttaagagagagaaacgtaggcgcttgtttggccagcgctagcacaagctctcctatccgtgccatgggatctactaagagcacccacttggtaaagtaagatgctctctataaaacatgtacatctcagcaatagagtaaaccacctcaatagtatgtctaatagtatgtctatatggatatctatagctctctaatgcattgcctcgtttttctctataggttatctctaggttagtagatagctttactcaccctcttcatttaatctcttccaagtagaaaaatatgctgacatggatctcttgtagagagcctatagataatcattacgggtgccctaatgcctaacctatgggtgaccaacaagatgaaggtttgttgagtaatgaagtcgcatatttgattaaaatataattttgatatttgtataaaggtataacaatagccactagccagctattgtacatatctcctttttacgtggctgtgccgatggcgatgcggactttttaagtagcaaccaaccatactattaaactacttgctctaatttgcaaccattaagttgagttctgataagtaaatgcggtctgaaaaggatgaggagaggattagcagttattcagaactgcagagacgtcccttgacattagcactatcccaattgctgacaggaatcgtgatctggagctgaatttcaccgataggttttatgttcttggtcgttttgtgtggccatcgcctgagcatatcattgttgggcattttcggttggtaactttttctctcctttctttctttgatgatatatggagttgtttgtttcaattcagtttagttcattattttgaaataagattataagggatacactaatgtccaaatttagtccctgactggaagtgaggaattatcctatacatgtggggaatgatcatatcctccgtaaaatttctaggaaatttcaatgttataaatggggccttgatgttatctttacactacttttatactatctctctccgttccaaaaacgactttatttcgagctatacacgactttgtaaccagcctgatgccctcaactcaccaagcatattgtttgtcaaacaggtaaaggaaaaatggtcctgaaggtctgcaccggatgacaccccataatccaacctgactagttccatttattccagccaaaattgcatatcacaagcatataatctctacattgcatatcctatccagataatcttagtattgaatatccatatactccctccgtacaaaaatataaggaatttcaataaatgagatacattctactactacaaatctgaacatgatatatctcatctattaaaaacccttatattttgggatatagggagggagtatccatcaacataagttagaaatattttctttttttaaaaaaaaaaaactgttcgttccgcctcattgaatctaaaatgtcaacagatggacagagtgaggcagcatccagcatcatgaaaccacgttatgctttctctccgtatgattattattacctgcctgcactccatgccttcagcgcaggatcaaggagaccaaatccttttaagagctaaaactcaagaagtcaataatgaaaagaaagaaatacattgttgttatgaaaattgcacttattatttgcaacaggtaggagtagccaactataatcagaagtacttgcctcaagcatagctctggttagtctttatctctaattctctattactgtccaagaagtgctgttggtttcctgagcaaccactacatgacatgaatgtcgacaaactaaacaccctacattcaaatgaaaaaaaaaaagacataaccagctccaatcttatgagaacttgattgtaaactcttatggttagatcatgtgtccaaacaattgaagactatatgttcacagacgcttgttaataagatgccaaatcaccccatgactcccgacgcgctggcctgttttccttcactggagaaagcgtccaaattatttgtgatatgatgacaaggtctcagaaattgcccaaagaatgaacccactgtacacattctagcggcgtcgatgtgagcaaaacaagttgagaagttttatgaaggagcatctcctatgcgtattcttacgggtagcggtctagcaatcagaccatccatcacccagccaccatttgaaccatcaagtttgacatggctaaattctctttgagtataatcgagtgatgcttcaagccttccaccaggtctacacgctgaggcaacatcacttggtttgatgcccagatatttctccaaccaatagagatagttaacatggaataaagatttgagcatatcttcaggagaagatccctctttaaggatgacctgtaaatcaaagggtaaaatgtcagtaactttgtatgatagcagaatggcatcttgaaactgcttggttcaagataaactcacacaaaattttcccttgtattctgtaagaaggtattgttcgtttttgtagagatcaaacaatgcgcatgcatcttccttgttctcaattatttcactaagtttagaacccaactgcaaccgccgacaaattatttctgcagcatcttttgcctgtggtgacaaaatcttgctttcctggtacaaaattcaaggaaccacatatagtgggacacataaataagtgcaagaatggcacatattgtgaatttaagatgtattaagttgcagttaactcttgactagttaaagcgtgccttgggaatgggaggctgtaagacctcaacaatatgaaaatatagaggacaaaaagtatcagtgatttgatgttagaaaaatactttacttactttacgtgaagtaccaatagatagattcaggaaaaggggttcctcgtcgttaacctctttgactgaaggaacttgtccactcaatagatactcactgaacaccaaacctgtgagacaggagggcggcagataaattagttaatcttatcgattagtaatgaaaaccaaggaaagacagaataatcccactaaaactggatgattttatgacacaattgctgccttgcgagaggccacttatgcaattaatcctcactaaggctccgtatgccattgaggtgaattctgataatctaagttacaaacggtaatattaatacctactaaaaagttggaagttttgtgggaatgaaagttgcataattgtcttaaccttaaaatgattaataaaataatctacaatgattatatatttacatttctagatgacttagaaaagacacacatttatcacaacacaacaaactgcaaacagaggctaagcctagctgtagtcaatgccatctctcatccacagcaaaccaagacactaaataatctggaaaacacaagtgaccaagatttttcacagattagctccagcaaaatccctctccttgctgtctcatctcacgcggagccacaacatcattaatctgatcgttggatcagtaaagttaaaaccagatatctggcatgactttgctaatgcaaatacccttctttcagtgctgttggattgattcctaattgactgccaatttaatctacagagtagtccattttatattacaatgtatactgtgcaaagctgaccatcaagacctcacgagttttcaatcatccattcaaaaaaattacaattcaaaatatgatttcaaccatcaattctagaaaaacatacacatgttcagtgacaactgccatgcacttacaatggacaattttgcaggctatcattgcaagggagatatcgatatttacccaaaagaatagtgacaaaacgtgatttttttaaaaaaaaaatcgtgtgatgttttgctgagttcaatcagctacagtgcagttttggtatttgtatgtattgttaatatattgatccatccaccagtttatttgtgtttgaacatcaattaaacaacattattcatataaaaattgtgagttgtgatcatatgaaggttataaaggaactactgaacgggataagcagcagtggataaaacattacttgcacgataaggattcagtgtcctcagctgaatcgattgataagacttgaggttgcaatacatgtgaactgcagtaactccagcaaatgaaataagagctaatgatacagaagagccaatgcgattagctaatgctatccctagcattatccccaggaatttgctgaccattccttgtgcctcaccctttgcaatgacctgaaatgtaagatccaattggtatttaactacttgggtcagaatgcaaagtgggatgcgtaggttgaattgactaaatttaagaatttaaaagttcaatttctaaaaaaaaaaaaagaatccctcataagaatacaacacgggcacagagtaaaaaatctagggcatttggacaaagttttgaaaagttttatcacttcgaagttcgaaccaggttttgttaccaaacagttgcactttagatgactggtccatgtgcaagtgtgccttgcatccacatcgtccttagttccttacacattaagcaccttgcagttgatgctaacatgcttgtcctcgtgtgaaaactagattggctccttaacaactcttaggctcttagcacacatgctcaatatctcacattaggcaaccaccaccagcatcactgaagcaaacaggcactccctgatttcaggtgtagcatcctcaactggacctcaacagggtgcaccttggtgtcgtgatgctgcccctgccatcacctgcttcacggcttcctcattgatgccacaccatcaccactaaacgatgccactcccattttttctcgcggacggttgggccactggtccaatgataaaatttgtaaaaccttgtccaaagtgccacttcgatgagaaaaaagggtcaaaattgaaacttaacccaaaaaaaaaaaattgacatggtcacaagggcgatgcaattatacctatgtaccgaaccgctgcctgtggggtttataattgtaatgtatatacccaataggaaagaatgaggattcctggtgcaggcaatatagtgaactgtgaaaaggacatcaaacgaagaaaaaaaatggagagcagcaaacaaaggtggtgcatgcatgcaatccaggagcggaagtcatcaattcagcaacaaagacaaacttgctaccaatgctatagtccacacaatgctgtcatagcaaaaggcagagaacaagaccaggaggtaggagtaatttggtccagtgtgagcaaaataaaaagtacagtggcatcttttcagaacattaaaggttcgcaatggtatatattttcttgcgtaaaaatagtatcagcaatatctgatataactgcagcttacccgtaggattggatatagattgcaaggctcatacatgagaaacaaaaattattctaacaatgacatctacatgctaaacgatttgttttcatgaatgaggatagattgattttacctcagcaaagttcctttgcacagcaaatccagcatagaaacaactcctggtggcagcctacagaattgaatcattgcactaatagtggttcaaagaaaaataatgaattggcaagtacaaaatattgttgggaagcaccataaaaatcaattcataggcagtcaggctcaaatttgcagaatagagtaataatttcaaagcattccacaagagtaagcaacatttcaaatcacccataattcggtcataccatctgccacctatccatgccaatttactgatttatccattgcatccagtagaatttcagtgaagaggtatgcaggacatgattagaagcaggatatcttcagttattatgttctttatgtagtgagcaagattcaggagacaaggcaaaaacaggggaagaatcaagaaagccgaacaagcagtacagatctgtcaggaggagataatatattggaaaatatcccaaaaaaactggactaccagaatgatattgcacgttcaattcagtgtatgattaatgccaaaatatgatacctaactacaaatttggatgacacatgtttccatactaagtgtaatctgaacaatgctgaccaaatctgtaggtggaacataatacgaagaaaatgacatgctgcagcagatttcacatgaaacaatatgaccttgcgcatatggtttgcattttccagcatgaaatgggtaaatatggtctgcacaggtgaaggggtacagcaacaatgacaatccatatcaaaatcaacagttctgacctgtatcaaagcagctgctgatcgaccagctccagcggcagccccaattggaacaaacaggtgaggaaagaccggagttaaaatctccagcccataagccgtgttctccagaagatcggcgaacaatcgccacccctttgggttaacatcgaaatgccggccgaatttcgatagcaatatcttgctcaggtaccccaacccatccttcagcacccaattcaccgctgccgcggtaggtatagcgcctttccccaatccaaccgcatacaacaatgcctagacaggataaatacacaaattcaccaatcgaaaatggcacatttcaactaatagccggtgaattgcacacagatggacgcggctcaggcgccacaaccgtacctgcgtcgagagcacgccactgatctggctggcgatgccctgcacgccgcgccacagcgagtactgcaggtagtcgctgctcacgctgtcagggtacccatccgggagcagcagctgaacggcgaccgtggcgcaccgccgccacgacagctccagctggcgccgcagcgcagccagctcggcacggccggcaccggccttctccgcatcctccccctccgcctgcttccgcctcccgtctcccgcgacgacgtaggaggtcccggtcgggtccggcacgagcagcgtgcgcgcaccgcccctcacctcccagacgctcgctccctccctgccgccgctaccgccgatggcctcggcgagcgcggccgggatggcggcgaaggcgcccgagtggaggagcacgaagaggaggaggagctcggggtggagcgactggagccaccgccaccacccgtcgccggggtcaggagggccactccccccttgcctccaccacccacctcctcctcctcctcctccgccaccaccaccgncattacagccaggagaggagatcgcgaggggtggcgggcgggagaggttggcggcgaggcgggggaggcggggagcggaggtgggaggagggggaacgaggcggggaagggtgggtggggagagaggggccgcgaggaggaggagagattgcgaggaggacatctcggaggagcggtttggttatggccgccggcggcggcggcggaggaggaggaggggtttgcagcgatggaggcgaccggcggcggcgacggcggcggcggattggaattttcaatgttggggggatatgtgcggcatagacggaccccgtcgtcaaagtttagactgggctggttaggcccggcccattttccgtgaaatgggtatcaatgcggcctgctgaggcagaatcggacggtagtacagtatcatttagcaacttttggactttgagatttacgtggctaggaataagttcattttaggtaccttaactcaacgagttcgattctcaccctcaaaccaaaatagcagatagaacgaatccctcaattattaaaaccggtgtaatatggaattataacggatggttttatccgacgtggcaatttgacatgagtcagcagcactgagtcagcatgaacccacatgtcagaatctcttcacctctctctctccctccctcagtcctatctcacgaagcagagagcagtaagggcctatttggcacagctccaactccagctccacccctcctggagttggagctcagccaaacagtttcaactccaccaaaactgggagtggagctgggtggagctctctcacaaaatgaactagagtagtggagctgggtttaggcagctccacaactccactccagactcaactcctggagctaaatttaggagttggagctgtaccaaacaggccctaagccagtgaagagaagatcggctctagtgtgggcccatgccacctaccggggaacgacggtgacggacctgcggcgcacgtgatgtctagtagaaggaggactcccttggaacgacaaggagaggatccagcgccgactgctctgctctgccgcctacttcggcaacgtagcacgtcagcttggtcgtcttcaccgcagcgccgattgctgcccaaatccccccagtgtcgggatgcctcgcttcagtcatcgtcccacctcatttggggccgatcggcaagcgagtgaactccttcgtcatcacctccgtccaagacaacgactagggcaaaggcgatcgctcgtgataaggatgagggttgggcggccggttctgacaaaggacacctcggtcgctaccgctcccccttttcccagtccaggggcatcctggcctaatcgggtcctcgtgcaaaatattaaaatggggctctagtagcctagtaaattttttatagtaaaactaaaaacgggcgtggcgatcagccgatcatcagcgatgaaatagaagcggatgccggaggagactggggagaggagatgaagaggctgcggcgtcgggatttcgactacacacgacgacgcggacgcctggacgggaatacgatggaaaatggatcggttcaccttctgcagcgttttgggcattgttttactacttcctccgtttcacaatgtaagttattctagcattttctacattcatattgatgataatgaatctagatagatatatatgtctagattcattaccatcaatatgaatatgtgaaatgctagaatgacttacattgtgaaatggagagagtactatttagggcctctttgatttgtaggaaaaatgtaggaattttggaggatttcaatcctatggaaaaaaaaaatcctatgaaggcctttgaaacaaaggattggatcctatccaatcctttgaaattcctaaggaatgggtattcctatgcacattttggaggaaagttagcaagaggtctaacctcttggaacatttcctctgagtctatctctctcatctgattcttgcgtttttcctatggtccaatcaaacggccattcttgtgtttttcctatgttttgcaatcctctgttttacaattgtattcctgtcagaattctgtgtttttcctattcctttgtttttttattcctacgattcaaagactgcaaattaacaaaattaaagcctctaatattattatatatatatgacatacttaatttggggggcctgttcggtcgcacagcccgcacgggcccaaggacacccctgctagtcgttccacccaggtcaagccctgcagcttgctactgctgcggctagtccggccaccgcctcgagaactgcccgctggagcgttgtttcctctcggcttgttgccttctacaagactacaagtgttgaagtgccccatggccatcgtgccagaatttttgcgcggcatcgcaggtcttatcgccatgctagctgcaggcggtcccagccggcgcttcggtcgctgaaccaggacccgccgaagcctgcccgtcatactggcccccggagccacatcgcggttcgcacatgtcacgtacgtcgactcgtcgagtccctactccctagagctcgagctttcgaacaagtccccgggccagcagtgtggtgctcgtgcgcacatatcgtaccaggtcacaaagccgaagctccgcgacacgtgcgaggaggtcggctccatcttgttgctccggctcgccgtcgacaggccacgggcaaaccaaggggctttttgttttgtcgattacaggtcaacgacgagacatcccgtagtacctgccgcaacggtgcaacctcgatcgccacgccctccgtggtagcgtgctccgcattggccttgccgagctggaagcgggacggtgcccgcgtggcgatggctgtggtggcggtgagctgcacgagccagtgggcatcgaggatgccacacacgccgcgtcacccggggtgttatctagcgccactatcacggattcacggtgtccctttgtggggctgagccaacggcaactgtggcctgtgggtgggagacggtggataccgtggaggcgcagggaaacgtcacgcgcgccaccggccgcatagaggccctgagacgtgggagccaacgctgactcgggtcaacttgccactcggacaaaatcactcgctatgttaccataggacctatattacacaggttttaatagttgaggtacctattgtatatggtatttcggttcgaggatgaaaattgaactccctatgaagttaaggggcctaaaataaacttattctaggactataatgaggctgatcggtagtgctatgtgcgcagccagctagtcagcccaaatctacacagaacaattgatttgtagcagcatcaacaagggtgtgttacttgctgaccgatgcactgttgtagccagcccaaacgattatttaaggttaatactaacaataggcttttggacggtctagatcgatttgagattcatcttgata

SEQ ID NO: 1879 - DNA, 864 bp, Oryza sativa
caaaagggttgataatgttggaggtactccattgaaaacgcaatcgttcatatagaccaagctccttgcataatcaacctatttatacccttcctggtacttgcacaaaccataccattgatttggttccaccattcatcaaagttcacaaccataggttgtggttaaagagcccaagggacaacttgatgcaaaagggagaaccacatctgtctaaacacacataagataaaaaggggatgttgaatggtctcgtcttcttagtcacaaaagggggcattgatgaggatgcagtagacctcgtcatgctatgcatggcaatttgtattcatggtggaatagaatctatttaactagtactccctcagttttataatataagtcatatagttttgttctaagtttattttcttgaagacgcaagaagcgtatcattgcgtcaataggagaagaaataaggcgtccaaacacaccaagcactaagaagtacacgaacttgttacacgaccaaaaggaacttaaaaataaaaggccctagctaaggtctataattacagaaagccccttagtccctgccaaactccacaagtggctgataatcttggaggtactccattgaagacgcaatcgttcatatagaccaagctccttgcatgatcaacctgtttatacccttcctggtacttgcacaaaccataccattgattcggttccaccattcatcaaagttctcaaccccaggtgtgtggttcaagagcccaagggacaactggatgcaaaacggagagccacatctgtctaagcgcccataagataaaaaggggacgctgaacggtcccgtcctctgagtcacaaaagggggca

SEQ ID NO: 1880 - DNA, 543 bp, Oryza sativa
gggttcctccaaatatccctctcacggtacagccccttcttattagggtcatgggaagatcaagctgggtcttcaaatgggctactctgtctgcggcttttgggccgtgaacagcttccccaccttgtactatgtcacaattccttctctttgcttcctcaatggcatctccctctttcctgaggtaagtttccatatgctttaacgtttgttcagacatttgtacgcacttggcttaaagtttaacacaagatttacatctgcaattaactcagaaaactagcccctggttcataccctttgcgtacgttatggtggccgcatactcctgcagcttagcagagtcactgcaatgtggtgacagtgcagtggagtggtggaatgcacagaggatgtggctcattagaaggatcacctcatacctcctggcaaccatcgacacattccgcagaatattgggcatctctgagtctggattcaacctgacagtgaaggtcactgacttgcaggccttggagaggtacaagaaggggatgatggaat

SEQ ID NO: 1881 - DNA, 392 bp, Oryza sativa
taaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccatcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacct

SEQ ID NO: 1882 - DNA, 2801 bp, Oryza sativa
aagcaacttcttgcggctagctaatgaaaccttatccataatgcttcatcgcgaaatatcttttcgccccgctcaattcataaagatatacactgccaatatcaccacagcctatcttcttgaacaacctgaaatggctcaacccaatgatcccatctctcaccctgatcgtctggatcgcctcccaccgtgaatcattggacttatgaggcttcgtggtgctgctcatgctgctacacgaactctcatcactgatatcactgctagtgcttggcctgcatctgctactactacccctttcaccggtctcggatcgatccgtcatcctagcacttccacttgcttttcctggaccactcccttcgcatgtgtgaaatgaggtgaggttcccattcacactctcatactccccacccttcttttttgacctgccataccttttgaaaccatttttttgctcatttctgtcggacacttggccgatgaaacatcaacagactctttcaggtggtggtttggcttttgttcctttggctccaatttatgattcaacttgccgcggtctgattcttgtagcaatttaggtactgaagaacgagaattgtttgatttggggatgtctggagcagtcttagtatactgctgtggttctggggtggttgggatttctgggagggtttgaggaattatctttgaagccgttgtcgccatgactggttatttatcaggcaagatggccaaatactgccacaagctatagttaatcaaaatagcaaccttggaatagtgatgaaacttccattcacatctgcaaaggagaaaaaaaaatctgataaattcaaaggtgcattcatgaaaccaactatcattccatgattggactaggaggtaaagattcaccaaacaaacaaaagagatgtagtggccaacaacaaactaattacctgattaagatatttaaaagtaggcaagtcaatcaatggtttggtttcagtcaagaaaactaaacatcaagaaatggcctccacagtccacacccttctccatcaacctcccctcaaatggacacttaacactattgtgtgccacacacaggaatttgtctgcttaactacgaaagctaaagccatggagagctccttcctatggcattaaaaccatcaatcctgcctaaccctccactaaggccaataatcatgcaacacactacagatctagcgttccctttcacaataaacaagtgtttgatcagatgagagcacatgaaaggggccaccaaaaaaaagagagaaatggcaaatggagccttttctttcttctaaattaaacagcatcactctagttgagcaaaagctgtgcctgttgatgtattccttccgagaggttgcataaacaaagtggtagcacatatcaatcggcctacctcgttccagtaaaatgtcaacatgtcatttgtgagcgcagaaaggtgaggaaagcaagaatcaagaacacgcccaaaggaaagcccttttctcgtctctctgcaaaatgcagcagactgaaatcttacattctttgcaagaaagataaaaacagagaggaaaaggtttactacgatcaacccaaggcagatctacagggccaaagcaaaggattctctgaagaaccgaattgggcaccaaaagaagagaaaaaggcaggagaagagaaatctcaccagactgaactgagcccggaaggctgaacccaactgctcacgaatcaaacaagaaggaagatgccgagcggtagcggttttctactcaggagaggcgttggatttagcccggtttttccacgagttctcgtgactgtgtacttgagctgttcgtggtggggttcagcaatgtgctgcaaaaatggatgcgaggaggagggcaggaaactggtggctcgactgtattaaaggttggcctcctcatcaccttccctgattttatttttctattgcttttgttaatcccaaatgcaatgatcttgtctatagttttgggtccctgaatatgatttttctttttaagaaaaacaaaagaatgccttgttgatgttgttgctctctgtctcaattattagccgaccagaatcaccaagtttaccatttttggagcttgacgatgtcaatttctacgtagccacgttagattagatattccttgggctaggaatttgaatctaacttgaaagttgaaacatctggaactgtacattattttcaacacgttcctgaaacagcccagggcctaattgtacattattttcacatgaataaattccttgggctaggaattattgttatcagcattaattaagaaaaaaaaacattccaacaaattcccaccctgggctaggatagaaaaaaaaattgtaagccgtaaccaaaatctaaattctgctagacctttttttatcgttttgtttttttaaaatcatgatttttaagtcctatcctgacattatttttctttgcctcatttgtttttctaaggcttcaaattaaagccaaataatcaataagacatgacaaaatgcattccggcctcctttctcaagtcacttcattattttattttatttttatagatggagtcacttcatttttactgcaactcccaacagaactttttcttgcctctaggagtagtactctagagacggaatcagcgccaaaaaaaaaatgaagaggaaaaaaaaagaactagtacttgtgccaatcaccagctcatgatcgatcgatctgcttcgaagtccgggcggaaagtaaaaaaccgcgcggtgaacgg

SEQ ID NO: 1883 - DNA, 2059 bp, Oryza sativa
cacgccatgccattgcagccgcagctcagctcagctagcgccggtcgccgtcgtacagtttgcccggtaaagggtcatgggacgccatgaagtgtgcccatctgcctccctgtcctccctctcctttcatcttctccaaggcttcaagctcaatgtccccagcttagccaatcatgcatgcatgcgtgttagttgttagtttacataggagtactacacttgcacgttgatgaaaaaaaaagctttttctaagagtatatatcatatgaatgtccattgtttgcaagaaagtaacgaaaggagagacagagacagggacaaacagatagtacaaggtcgagcggctatggacgttgtggttaaatagaccattagcatatgcatgtgtgccactgtgcagctagttaattatccaaaacggcacccaacgggtgtacgatgtgcacgattggccaagctattagcatagcatggagtacaggataacaggaacccgtcgatcaaggtcaaggcgagattattgacgccatataaattttaatcaccgtagggcgataggccaattgtcagctacagtattaacgtagttaattacctcctctctccaccagccgttgcacaattgcatgacctgacgacggagcaccttaattattccttggctaatttacaagctcacaagcagagtttgattccgatttctgacctcttaatagtctttttggaatttctgctatgacgttcggggttaataccggagacaatattattacttatttgggaaaatccagaaaaataccatcgacaagctttccaatccaaagaaatacattttttttgcgaacgccaatccaaagaaatatcatcgacaaatttaacttcttagaaattaatgtcattgtacaaatgtctttatcccataaataccatcgctgttaggtttccgttagcaatcatttgttgagtgctataaaaagatcattttacccctacgaattgctaaaagatgattaaaaattttgctcttttcataagcttagactaatttctaggtcgttatttgcactaaactgttgttagttgactcgaagagcaaatgttttgatgagttttcaacaattcgtacgggtaaaatggtctttttacagtacttaacgaggatctactaatagagacctaacggcgatagtacttttgggacaaatgcgtttgtatgatagcatttccatgaagttggatttgtcaatgatattttttgaaccgtgaggcttgttgatgatatttcttgaattataacaaaatttcattataccgattacgaaccccaagacgaggctaactagacctgaagttcatataattaagtatataacacctgacaagttatgatcaaactactaagtccagagttttatctagggagcacacgcagtacgtgtgcgttggcacatggatgcaggcatgcagccgcttaattagctaggtacagtactgttcttgatggcatcttaagaatccataacctcacaacgcaacatttcaacccctgcaattactcaatcaacagttgctcccccattgaataagctgctcctgccttgccccgttgagaggaggcatgtgcagggcacatggttgatcagtatagtgcactgtcaaggaagcatcctttggaacggagacctgtcactgtcttcttgtcaagtccaaagtttctgcagcgccagtgagagagatttgctatacatccatcatccatgtgagggaatacatgaaagtgtaacgctgaagagaaaaaaaaaacttaattaacacgttacattcaaacatgcatagcgtagtgataaagaagccggcaataattgttcttggagagactgttcaagagaataaacacacacatcagtgtttacccaagaacaatgatgcgtccactggtggagaaaccatctttcgtcggtcggccgatttccacaatagtcccggatgcaataaaaaccggggctaaagatgatctttagtccgggttcaaaaaggtaacgggcatatttgatcttta

SEQ ID NO: 1884 - DNA, 7342 bp, Oryza sativa
  unsure (1)..(7342): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaactctcaagaagtggggaaagaagctaacatgtgaaagtagtgtcgaccacgaacaacaaaagattatatttgttttttttcgccgggcaagattatatttgtcggagcaaacgttttcaaatccaccagaccagaccaccacaacattagtaagaaatactccacttcaacaattttagcagatacggcgtactccttacatcttgaaccagcgccatctgaaagcaccacctcaggggcaatgcacgccgtgactccaacctcaaaaaccaatgctagctgaataaaattgcggaagagcgcttacttacgttcatcgttgggaaggggggggggggggttgggacgcgctgacggcggagagagccccgccggcaggtgtcgccgcctcgccggagccggcgactggaaccgccattggacgggggaatccgaatccctaggtgaggccctaattgatttgaggcccaagaacatgggaggaattccgttcgaggccttacattcacatacggcccatgaggaagcttcacactgggccactttctaatgggcctctgagtagcacggcccaatactccctttgttctaatgcgacgctgtcagactgaaactacgctgaagaaatctcaatctctcggtcgatttttaccacccgatgttatcccttcaaccgaatgaatggattacggatctaactcatctgtacttgccacacacacacaggatgaactgaataactatgaatgctccggatattgctgttagctgccaggcaagccattcatcaccaaaatgatgggaacaattcatgctctctctgtccctctctctcccggtctgcagcggcagccagccagggtttcattacgacagaaacctgaaaaagaagaaaaacgtcagcacttgagagagcatggggttgggtgacactgccacgtgaatgcggttgcatttgggccggaattacctgtgcttgggttttgcctgccatgtgacccgcctcgtttcgtttcacccttgctcggcccgatcgatttgcagctctgcacatgctcttgtccggccaccatggtagtaagctatgctatgttagtataggaacccttttggagctgttccaacgcagatggtgccactccagttttgggccaaaataatggagcctgacattggttctaaatgaaactatggtatgtttgagagagcttttggcagctgcaacctctttcaaaatcaaaagctctccaaacaatacaacttttcattaagattttgtgaatgatttttcttgagtaaaatacaccaacagtccttaaacttgtcgggaggtttcacctaggtccacgaacttacaaagcacatatcgagatccctaaatttggtttattgtatcatccaggtccaaagccacttttgaccgtggtcttacctacgtgacacgctacgtggacgatgacatgattttttttatttttttctctcttatcccttcttttttctctttctatgaaaagacgatgacatggacgatgatgtgtacgaggcattttcgtcttttcgacaaggaagaaagagaaaaaaaaggaagaagggagaaaaaacaaaaaaaaaatccatgtcatcgtccacgtggcgtgccacgtaggtaagaccacggtcaaacgcagctttggaccgggatgatacaataaatcaagtttagggacctcgatgtgcgctttacaagttcgtggacctaagtgaaatcttctgacaagtttaagaaccgctggtgcattttactcatttttcttcttagcagctgcaacctccctcagaatcataaactctccaaatagtacatcttatcatttagattctgtgttaatggttttccttacggcttatcgaaatatatttgaatgaaattttcggcagatgaagacattcctatgcttgcatcatcaatgcaactggaccaaaaaaactaaaaagagggagaatgacgtcaaaattggaccccggaagaaaaaaaactcacagaaatgtagaatgtgacacattacgacatattctgtcacgacccattttctggccgcataggacagtcatgcacaacgcaaacggcgacacgtaagttttgcaggcgcgacgcgcatctggcaaagccaatttcgcccttaaaaaccaagggcgcgcaacggctcgtcgcgtggagagcaacgctcgctgcgacctgcgacgccgccccgcgccaacttctctccctcccacctccaccacctcctcctcctcctcctcctctcctacagcgccacaatgccgcgcgcccgcgtcgtccacgtcatgctcctcctcttcgtcgcgctcggcgcgtgccgtgccacccacaacatcaccgccatcctcgccgaccaccgcgacctcgccgagttcggccgccagctcacggccacgggcctcgcggacgacatcgacgggcgcaacaccatcacggtgctcgccgtcgacgacgcccacatggcgcagctcagggcgcgcgggctcccgcgcgaggcgctgcgccacgtgctctcgctgcacgtcctcgtcgactactacgacgacgccaagctgcaccgcctccccggcggctccgcggtcgtgtccacgctgttccaggcgtcgggcgacgcgcccgggagcgaggggatggtgaagatcgccgtgcgccgcggcggccgcgtcgcgttcgtgccccaggacgtcgacgacgcccgggccaacgtgttctacgtcaagtccgtgcacgaggcgccctacaacatctccgtgctgcaggtcagcgccgtgatcacgtccccggccgccgaggcgccgtcgtcggcgacggagtcgaagcccaactctacggacgcctcgtccaagcacgggccgccgaatgctggtgcacacgctgcaccgtcgccggtggggcaaggttcgtcgtccgacgacggcgccgacgaggggaagaaatccggcgacggaggagatggtggcaagaagaacggcgccagcgtcggcgcggcaccgcgtgggctacccttcgctctggcgtttctcatggctgccagtgccatcctcgtggtgaattggtgatcgtgtgaaactgtgaagttgatcaccaacgttgtcttgtgaaattcattttgggtgaatttgcacgtttctgtgccacttttgttggggatttcgtgagtttttccactgttaggtaccttaggttcatggtgcattggtgcttggaaatgtgttgaattgtggtttgcaagttagtagtaccattttgtgtcgtcaacttaatttgcacgcgaacgtatgatcattcatcagctgtattctgagtccaaaactccaagtcgaattatgtaatgatctgatcaaactgaaatgcatctgttcttcagatatgcatatacgtgaacgggaaaatgactctgcatgcagctgtagacatgtaaaatgcagtcttaccaaattgtctttctgctgcacgcgtcttctgcgcaagattacaacgtgagaggtgaaacaaaaagaagattactgttaaatcaagcttgctactgaacagatatgcatcaaaagaacaaatcaaattccaaactgaatgcgcctatgcgtttctgaaacaagatgcctgacacccacaagaacactactgtcagtatagcaccaagcagtgcaactcaagtactcaaccgtagcttttgcccagatcaggctcagcaacctttgctgctagccaatagccactgcccactggtcacttcacttgtatcagtagcatcttcctgtacagcgaagcacatgcttgccttccatgcacggacgagccaaagctgcccatgcatggacgagtgcatcagttcgggaagcagaattcaaagatcatgacaaagcgtagctaggcctagctaagacggtcttttccttcttcctttcgatcctttccttgcgtttttttccccttcttcctttcgatctttttcctcacgctgttcgtcgaaagtatctagatctgaggcgaggtacgaatgttattactacagctgggctgcagaaactgaaggggaaactgatcaccgactcctagttatctttcctttcctttgcagccagattgagcaaatcagcaaggctgcaactgcaagcctgcaaagaacgcatctccggtcttaatttgcttgcctggtacgttttggatcttgctaaaagggcactgcaagagctgggagagtagtagtatacacaatagtcagcagtaaacagagtaacagagagcatgcgatctttgcttaaagaagtgcaagtaggagtgtggtaaagagatcaaagcgaagcaaagtggttcctgcaaaccgagctggactgtgcatggatcggattaggattatacggaaagatgaacacgttagaacgtagtagaagatgtgagcaccggctttagctgccttcctactctcccttttttgatacggtgtactaggtagacatatggtttactttctccggggatgtaagtaccgcaacacagagatcatgaaaacattggacatgcataaacttgttatgcataaacttggagtagtagtctattatacattcaaaaatggacagttttcgttttgaactcttgattcagttttacaagtaaagctcgagcctcaattctcaaaaacagacatgacagtgcgctagtactcccttcgtttcatattataaaatgttttgacttttcctttctaatcaaacttatttaaatttagtcaagattatagaaaaatatagtaacatttttttacccaaaacatactattaacatatattcaatcaatgtcaaatttaataaaactaatttgatgctatagatgtttggtaattttttctataatttaattgaaattaaataaggttaattaggaaaaagtaaaaaacatattataatatgtaacggtgagagctatggtttccccccacgttcatattgtcccaggtagataccaaaacgacgatctccccccaaaacccaacttttgagttttgatcctatttcaacgtatgtgggtcaaaataatggtcaaactaggtagaggcatgaagcctatctagatttgagaatcctaacttactataaaattataatccactaattttaaaaattcataccacttcatcatccactagcaataatttcatgccaaaccctatgccaagcgtaattctaataatccattgaattttaggaatcacctccattcttctcctcacaatatttttcccaaaattttttaacatgtatatatccatcattttcatagtcctctctctctctctatatatatagagtaagactattcaataccccctcacgatccccccccaccccacgcgcctcctcgagattcctcctccccccacctctcccttttttttttttcccgatcccacctccacccctccccttttttgagagagaaaaaaataaaagaaaaatttgccttcaatgggaatagaactcaagacctttaattcaaattaccatatggcactaaccagtaggctatttctcaattgtgagagagttttcttagtaaaaatttatcttctcatacgtgctaaatccttgtagtatttggcacagaacatgtagtaacgatacgcgtccggttactacaaaatatatatgttgttattatagtcaagtgactggtattactgggttaaagcctcacatactaactatatacttgttattgcacaaaagtagaagtgttactacatgataggtgcatgttaccacttccaagtagctatgttactgcatgataatgtagttttactatgtcatgtttaagagataaggatcgaataggtgggttataggtaaagtctgttgatggctttgagcgaggtctgattgatgtaggagtgttttgaacaattttatacatttggtaaaaccatgttactgcatatataggcccttgttactgcaagttacacattctgttatggtatgtggaggattaaagttcaaaatgccagtttttgaaaagcaatatctcacaagatatgtattattttttaaaaccgttttcacaatgatactgtagtgcatgtggaggtttaaacttcaaaatgcatctacatattctcctccttaagaaatcgctcttcctccttcttcttaagaaaactggtctcctccctccaatatagtgttactgcatgcatgtatatgacgttactgcacttttgacagtaatattgatgtgaattacactaaaccagaaattgaaataaaaatatatgggttcaaattcttagattctaaccatatacttgttactgcacaaaagcaaaagtgttactgaacggcatatacacgttaccacctgacaattacacattaccgcatgtttacgtagtaacactatccaataactacagtaaaacactttgttactgtagaacatatataacgttactgcacctttggcagtaacatcatggtgaaattatagtaaaccagaaatcaaaagaaaaatatgggttaaaagtctcacatgctaaatatacatgttaccgtacaaagtggaagtgttactacatggcaggtacacgttaccacatgtttatacagtaacactattcataaattgcagtaagacgcattgttactacaaaacttatggtttttactacacacttacagtaacgtcgcgatgggattgtagtaacgcataacagatagtactaacaagtagtaatgctatagtattgctacttgtggagagttaagatcaaaaaacccaagcttcgaataacaatatctctcatgtgatgtatgattttttaaaaccgtttgcaccatgatgttagaaaaaaatgcttatcaaaaatagatccgtcatgactatatttcaactaaatttgaatgttgttactgcacgtaagacacagtgttactgcacgatggctgtcgctttactgcactgtttcgcaagacgagagctgagaagaggtgggtggtgggggagttggaggcagtttgaccgggttttgaccgacgtcgggggtgctcttgactgacctttgactgaggtgggaggtgggtttggcccttgggagggagggggggatat

SEQ ID NO: 1885 - DNA, 9614 bp, Oryza sativa
cttttagctcgattattacttaggaatttccgcagcaaagtgcggggaatcacctagttaattaaagaattgagtcctcataaaataccttttcaatatggcctgaatcattgtttggttttttggccttctgttctatttggtccaaaaggccatctttctaagttggactgggcccatggtttcgttatgggccaaaaacaacaatagcattttgttttattctccccttttgaaaacagtatgcaggggtgatgcttgttcattataagaggcaaagggtagcatatgatatataagtttataatttattatagatgacaacctcaaaggtaactatcgttgacatatgtaaattatgctacattacaaaagaaataatgtgaacattgacattggtacatacgtggacattatctataattatagactgacatctacattccctatggttatcaatcggaatgtcggctcttgtagccttgtgaacatacgtactctctcgcactatatgtgcattgatgtgaatcctccaatttgctataggaatgtcgtaggtttgagtagcctatgtattcattgtcagcaaatgcgcaccgtgaactctttacgtcagaggatctacgtcagtccgctagtacgctcatgacatattccccctgtttttgaagatgcggttagttactccttctgtacactccataaaatgtgctatcctacaatacattccccgcttcaatgtatgagatatttttccccattttgttagaaaatacttaagcaatatgttccaaatataatgttatattgggttgatgttgtgttaaaatggagtggttaagcatgagccttcatttccctcataactgtttttttagaactcctcgcaactgttgcactcaacaatttcattttccttcctgttattcaattaaggttctccttaaaaataagtctttcatgaataatttagtattttgaaggtactattgaaagaattatttggagatgtctaatgcttgaatgataagtaatttggaaggcatctactcctacaaagttgaatcttctaaatactccttcgcttttaaatatacggcattgttaacttttgaatatgacaatatttaacaatttatcttgtacaaagatttagtgcaaatatgcacaatgcgtaaagtacctttaatgtaaaacaagccacaacaaaacaaatgatacttagagcattttttaataagccgattggtcgcatcatgtttaaaagtcaaccatgtcatatataaaaaaagggagatagtttcatacatagctctaatatattttgaaggtactaaattttaaaaattgttgttgcagattgtaagtcttgcatataatttattgtttcttttacttagcttattagctctaattaatcacaccctatctctcctatatttatataataaaaacatcccgacacaccaacgtacattttctcatctatttctaaggtatggatggtattgtcatgtcaacttatcttctttctagttatgcaccctccttaattattgtaccaacttaaaataagccatatattttgaaattatcataccaactcacaatatgccatatattttaaaattattatgtcaactcacaatatgctatatattttgatattatcgtgccaactcacaatataccatatattttgaaatgaaggtcatatttaagatgtagagtaaatgtatgaaatcctcccatccatatcctcattattaattgcttccacctaccccaagcatttatagttaaagtaaaacagttgtgctcttgcaccaaaggatgacatgtaggagccatgcctacgtcccctggccacccaagccccgttgataaacatggtccctcaacagaaacatccatttttgatggggtgcttccttcttggcgaccttactggtaggggacatgcttaccaaaactggacaatcattccagggaggggcccggcaaaaatgaagtcccttctaccttgattggaacccttatctattggttaaccgctttggcggaatttggcaaccacttcttcttcttttggggccacaactgcacctttgacgtggcttgctgcttgcatttgtccaagccggggcagccctgatgtaagtcctttggtataaatactgcccaagcatagagcgagagagagccatcacaatccaatacaagttcacaacataagcatagtacaggtcattgagacttgagagagcatggcagggaacaaaaagcgtggtatagtagtatagtcagtactaggattagtacttgataactagcacaacaaaaagctactatcatttttgcattcaaagtggtaattaagaatcggatgatcattttgattgttcctcttcatttgttttggatgtcaggtggcaggaacatggatcaggtcaagaaggcggcagtgagatcggatggggtgggaggtagtgcgaccaacgccgagctgccgatggccaacctcgtacgcctgataaagaaggtgctcccagggaaagcgaagatcgggggagcagccaagggtctcacccatgattgcgcggtggagttcgtcgggttcgtcggcgacgaggcctccgagaaggccaaggcagagcaccgccgcaccgtagcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcactgacgcagagctgcagtttctccggtcggtgatcccctccagaagtgatgatgaatatagcggctcatcaccagccataggcggctatggctatggatatggctatggaaaaaatatgtgaacaacttgatgcatgtgtgtgtgtacactgcatgcatgcgtggagggtcaaacagagtcaagactcttgtggtggtttcaataagtctctagtgacaatataagttgtgtatcgttgtttcctttgtaaaaaaaaacgtcatgtatcgttgtgtgtcctcatccggtaatcctttacgtgggtgggttatgcgagaaaaagaaaatgacgttgcatcaaataaaatgcttgatgtttgcgtatttactgtatccattgcatgtgtgttaaaatcatatcgcaaattcaactatcctgtgcgtttattctcactggtggagaaaacgtttgtagtcccagtttgtaacccccctttagtcttggttttcaaaccgggactaccaatctgggactaaagatcgctatctttagtcccgggtgaaataaccgggactaaatatcgatctttagtccctgttggtgtctaaagatcgagctgacattttgtttttttttgcatggccttgttgctgcatggtttatatatatatatatatatatatatatatatatatatatatatatatatatatatatatatatatatatatatattatttatatatgtttcaaacatatacatgcataatatatatgtatttatacatatatatgttatgcaaatgcatatatgtgtgtgtatgaccaaaatatatatttacattaaagaaaatgtgtacatgcatatagaaaaatagacatgtattaattacaatccattatgatgtcctagctagctacaatttcgacgtagtagtagtcgttatctcagaagctaaggacctatgaattgtatttccatcgtagtagaattcacccttgggatcaaggatttgttcgttgatgaatcccatgagttgttcttgaactgccgcgataaattccttgtgtgtgatcaggttatccctcatgcgaataaactatatgaatgtatgaaattaattagtaattaaacaacaaatcgatacgtacgcaatgaaattttgaatttatttgtacgtacatcgagctctcttgtggtgatgatttggtctgcaaggcagtggcaatactcgcacacgtagtagccgcacaagttagttccctgcttttgctttgcgcactataaataaatgacaaacggcgagagatctaattaatatacacttgtatgtatttgaattggagattgaatataaatgtagagcatgtgtactcacaggaaaattgaacttccgtctaagtctttctctccatttgccacggaccaaatggcggaacctataccaagccctacatagagtttaaagctatgattcgtagtagcaattaattataacaagattcttaattaacataggaacttatgacagtacctgtctataagttcaaaaaccttgtcaaacatagactcttttttatccattgagtcatatacgttgacggtgcaggcctccaggtcgaagagtaaaaggacccagtggaatctgcaatgtgcgtgggatgcattacatatgaaacacttagcatgttcgtacgggaatgaaatttgttatagcaagacagtaaaaactaactctgtgttgtacggcaatagtatgaatgtcttgtaatgctgcgccttcaggagatggacgagattgtcctctgtggcttgcggatactggtcgagtattgcgacgtttactttccgagggtcgatgaatctagtatcgaaaacccctcgctgtcgggccctttgaatctccattctacaacgataaaaggaagtatatattatatatagtctacttatatacaaggacctaattaattaaaggaaacgtaataagaaatctaactgaacgatacttacaaaatccagcaactcataatagagacgtcgagggcgtccagctggtatagttcgtagatacccttgaaattgatctagagaatgtcatctccttgcaagaagtccgtgtccctgatcctcgctccgatcatccctctaccggtggcgctcatctccatgtacagttgatggaacttgtacatttgtgtgggtagggactgcagctgctcaggcttgacaaacggtttaccgaattcgtacatgtatttcacttccgccttttcgattggtgcgcctcgtagcaattgatccgtattagaactatgctaactcaaacaatcttatatgctaagttttattacaaatctaataatcttatactatgctaagtctaagtgtcgtataaccctaggtaatcatatatgctaagtcgtctaagtgtcgtacattacaaacctagataatcatatatgctaagtctaagtgtcgtatattaaatctaatagtcttaattgcattaaaaatctaataatcatatatttacatcacttgcctgcgcgaattccttcgagggctatctaccactccggcttgagggacgatgacgacaacgtcttttctgcaacatacaaaaagatgtattaggataaacgcaaagtaacatatattgtatttcacgttcgcgttcttgttaagttcacatttcgttcacgatcattcacgttcgcgttctcgttaagttcatgtttcgttcacctacgttcgttcgttcacgtgcattcacgttaacgtacgttaagttcatgttcgcgttcttgttaacttcacttttcgttcacgcacgttcgttcgtttacgtacgttcacatacaacgttaagttcacgttcgttcacgttcacgttaggttcacattcgttcacgttcacgtacgttcattcgttcacgttctcattcacgtacgtttcgttcgttcacgttcgttcacgttcgttcgttcgtttacgttcgttcgttcgttcacgttcacgtacatatcgttcgttcacgatcgttcttcgtttcgttcacgtggcggcaatggagcggcggtgtggcaggcagctagagcggcggcagtgtcgggcgccggctacgggcttgagcgcgacggcgtgcgtggcgagcgcggcatcgcgcgtggcgcggcggcgacgaagcgcgcgacgtggcagtggcggcgtgcgcggcggcggcgtgacggtgcggcggtggcgtgccgcggcggcgtcgtggcgtcccggcgtcgtgccgccacggcggcccggcgtcgtggcgcggcttcgtcggcactgccggcgcgacgtcgtcgccggtgacggccgcatcgaggtcggggtcggcatcgtcggcgcggcggagtcatgttcggccgcgacgacgtcggcggcggcgtcggcaacgaggcgaccggcagtggtttggggagagagagagagatcgaggtcgaagagagagagagggaggcggcggcggcggctatcaccccagagatgcggcggcggcggaggcggcgacgacgacgcgcgcgagacgacggcgagatacgacggcggcggcggcgcggagatgccctaggcagtggcggcgaaggagaagccgagagagatcgatcggggaaaaaacttctaagtgttggtggagaatacgagggcgcgtatcgggaatatatatacccctagatcttctcaacaaccgggagtaaagatatctttacttccggttgttgagaacaacatatctttactcctggttgttctcatcaaccgggactaaagatattttcccgctatttccaaattctttttaaacccggttagggttaagaaccgagactactgataagcgcactgaatattaatttccattacatatgtgtttctaaaatagaaaataatgcattaaaattatttaaagtcgaaaaattaatgacaattacttcgaaacattattgttgtatgtagtaaattaagtggataaaacgtaataagcaaatatatgatttaaaattaataaaaattctaataatcatatatacttagcatatgaatgacattaaattgttaaaaattgtaattaacatatgtatatacatacgacatgcatgatttaaaattaataaaaattataataatcttatataattagcatatgaatgatattaaattgttaaaaattgtaattaacatatgtatatacatacgacatgcatgatttaaaattaataaaagttctaataatcatatataattagcatatgaatgatattaaattaattgttaaaaactataattaacatatgtaaatgccacatgcatgatttaaaacttttaaaaattctaattatcgcatataactagcatatgcatgatttaaaattgttaaaactctaagtatcatatgtaattgccacatgcatgatttaaaacttttaaaaattctaattatcgcatataactagcatatgcatgatttaaaattgttaaaaactctaagtatcatatgtaaatgccacatgcatgatttaaaacttttaaaaattctaattatcgcatatatctagcaattacatgatttaaaattgttaaaacctctaataatcgtacgtaattaacatatgcaatacaacaattgatttatatggataattaatacatctaaaatagtttacatcgtgtacacaataattacggtaatacattggcggtgacggttgaccgcacgtactttctcctcactattgttccctccttctgatcgctacgtgagtaaggggtgtcttcatttgataggaggatgctagggtcaatcgtcaccgtgaaagggggttgcccatccaactgataataatcctcatcagtcttgtcctcaactccgacgatttttcttttgcctgggagaaccacgtgacgcttcggctcgtcaggccctctgcccttctttcctttgctagacatgtccttcacgtaaaagacttgcgttacatcattggcaaggacaaaaggtttgtccgagtatccaacctagttaaggtcaaccgttgtcatcccactgtcatcaatcattacgcctccaccagtcaacctaacctattggcaccggaacagagggaccttgagaggaccatagtcaagttcccatatgtcctcgatggcaccgtaatacgtgccagttgttccatcgtgtcccatggcatcgatacgaacaacgctgttttggttcgtgctcttcatgtcttgggctcttgtgtagaatgtgtacccattgatctcatatccctggaatgttgcgatcgacccagatggtcccctcgccaggaaggccagttgttggttgatcgtctcgttacccatgagatgttgtcgtagccacgcggggaaagtatcaatgtgatgccgtgtaatccatgcatcggacttaccgatgtttttggcgcgaactagagccaagtgctcctcgatgtaaggagctaccaatgaagattattgcagaaccgtgaaatgggatttacggaataaattgttgtctaccgtcattattgctttccttccgagagttccctttccccgtagtctcccttcatggcgtgattcaggtaccccgattgggcgaaggtcttcaataaattctacgcaaaattcgatgacctcctctgttccataccccttggcgatgcttgcctctggacgagcacggttacgaacgtacttcttcagaacgcctatgtacatctcgaaaggaaacatgttgtgtaggtacacaggcccgagaatactgatctctttgacaaggtgacaaagcagatgcgtcattatattgaaaaatgaaggtggaaatatcaactcaaaactgacaagacattgcaccacatcattctgaagggcttctaatctatccggatcgatgaccttctgcgaaattgcgttcatgaaagcacatagctttgttattgttgctcggacattgtctggaaggataccccttattacaactggtagcagttgtgtcatcaacacgtgacagtcatgagactttaggtttgtgaactacttctccttcgtgcttattattcgcttgatattcgtggagtatccagacggtacctttatgctctccaagcattcaaacatactttccttctctgccttgctaagagtgtagctggctggactcaagtaatggcttcctttctcgtttggttccgggtgaaggtcgccgcgttgttccatatgcttcagatcattacgtgcttccagtgtatctttcgactttccatatacacctaggaagccaagaaggtttacgcaaaggttcttagtgaggtgcatcacgtcgattgtgtggcggacgtccaagaattcccaatagtgtaactcccaaaatatagagttccttttccacatcgccgcgtgaccatcttcgctctctataggctggcttccaagcccctttccgaacactactttaagatctttaaccatagcaaacactgttttcccgctgtgatgtttaggcttcgtacagtggtccgccttatgttcaaagtgcttgcctttcttccgtaccaggtggtttgcagcaaggaattgacgatgacccatgtacacaaccttcctacagtgcttaagatacgtactttctgtttcatccatacagtgagtgcaagccttgtaccccttgttggactgtccggaaaggttgctaagtgcaggccaatcattgatggttacgaacagcaacgctcgtaggttaaact

SEQ ID NO: 1886 - DNA, 2050 bp, Oryza sativa
tatggccgctgctcatctctccaaaaggattcatgccatccgtactcaaaccaaaccgtatgtttcgtgcgtcctttccaaattctttaaattttctgtcgatgtttcgccactgcgaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgacgttctgtggtcctctaacatcttgtccaatttatgggcccccttttcactttcgcagtcctccttggcgtcctgcaacatctgatcaagatcatccgcaacgtcgttaccatcagcatccctttcctcctcgcccgtttgatttccttcaaatccagcgtactgaccaaagtccggaatattgtcgtcttccacttcatcttcttccatttcaaccccttgctctccgtggcaagtccaacagttatagcttggcatgaaccccgactcaaacaagtggaaatgaatagtcctggatgcagaataccccttctgattcttacacttattgcatggacaacaaataaaacccttatacctgttagcttcggccattctcaaaaaataatgcacgccatcaataaactctttggaccgccggtcagcgtacatccattgccgatccatctacatgagatgaaaaaaactcgtacacaaataattattcttacaataatgacagtcatacaataattataaaataattacaaactctttcaacagtcatacaataatgacatatcattattcatacaaaaattataaaatattacaccaaatagttcttatttagtatttctaaagttttaaactaatattaatgtgttgtacttcttttaattttcattttagtttgttttctattatttaagattaactttcactatattttccttctcaactattttataaaaccttctttagcaaataaactaaatttctatatattctttcttccccacacaaattttctctctcatcaacttacaactaaattttggagacaaaatagtatgcaaaacatagctgcaaatgtaatatgacaaaaaaaacattggaggatgaagttgctaacctttttagacacctccgatttgtatataatcaccaaaataaattcactagaaattttggcatgacctcccctcttttttgaagaaattttgaagcttgctcgggcagctggaggaggaagaagacatatatataggggtgggactttagtcccggttggtgttatgaaccggggctaaagatccccgtgatctttagtcccggttggtaacaccaaccaggactaaagttacgatctttagttccgggggggggggggggggagggttgacaggccctaatagcatttgagccggactaaagatcaaatatgcccgttaccctttttaaccggaactaaagatcatctttagccccgatttttattgcaaccgggactattgtggaattcggccgaccaacgaaagattgtttctccaccagtgtctgttgattctaaccaagaatatactatccgtaggcaatttgaacatgtaacggactggacaaaacaaacaaaaatggtcaaaacattaattgtagtagatatcaacaaaattgttca

SEQ ID NO: 1887 - DNA, 3387 bp, Oryza sativa
  unsure (1)..(3387): unsure at all n locations
aacaccagcctcagcaagggttccctgcttcaacaatgctggtatggactcaagtcgggaaatcgtcttcccggttaaaccacgacgccgatctccacggnnttttcccccccctcccaaatgaccggaaacgagaacgcagtggctacaaaccaaggcgactccatgtcgaaaaatccacccgtcgaaacggaaaacagatcatcgacgacatccaagctcgggaaggattctgatatggccaaaccttgtccttccgacatgaaccacgagccggcaaagatgacttccgaagccacaaggtcttggtgtcctatccaccacaccaagaaacacaccctgcaagattgttgggttttcctcaacgtccgtgctgaaattcgcgcctacaaagaacgtggaattcaacgtacttctccaactcgggatgtctattgtcctattcacaagacaaagaatcacgacctctcgagttgcaaagttttcctcggccccatgaaagctccgtttccttaagtcatacgtccccgtcagggataacggcaaggaataaggagcgactccagcctcagatcgattcgttggggtaatcgatatcgatcctcacgaaccatcggtcttacatcttctcgaagactatgggtcatcgacaacgagcgtgccgcgggaggtattggctatcgatgacgttggcacgtcaatgcaagccaacgcagaagcggcgaatcaatcgactactccagcccaacacatcagggccgttcaagctatactgagggaaactccttacgatcccgttctgaacgatgacctcgagcgttggacagaacgactacgggaatcggtgaccaacctcagtaacgcgtttgaagaagccgctaccgcagcgcaccaagatcagccgccaactggcgacgccaatggtgaagatccggaacggagggaatcacctcaacgagccactcctccacctcgcggcgctggcgatctccgagatcaaatcaacggccgccgagaagcacgacgcatacgagacaatgtaaatcactctcggcgtcatgtctcttcacggcgccatgataacggaaatcgaggagaccgctcaaacgaggaccaggatcacgacaaccaccacgatcgcaacgatcgcgaacgacgggggccagacaatgctggtcatggccgccgccgtaacgacgacgataatggagatcggtgccgagacaacagcgagagacaacgacaggattctcgagatccaggctgtcatcctcgtaatcatgcgtcggaaccaagcgacccatcgtcatcatcatcatctgcgtcctcctcatcgtcagacagacatccacgaaggacacacgaccgccgacaacccaccgcccccaacgctgggtgtagggctttcggtcgttccctacgtgatgtccgatggcctgagagattccgacccggagcaattgaaaagtatgatgggagcaccgacctagaagaattccttcaagtctactccacagtactctatgctgccggagcagacgacaacgcgctagcaaactatttaccaactgcgttgaagggttctgcacgttcatggctgatgcatcttcctccctactcaatctcttcgtgggcagacctgtggcaacaattcgtcgccaatttccaaggaacgtataagcgccacgcgatcgaagacgacctacacgcgttgacacagaactcaggtgaatcattgagggaatatgtttgacgcttcaacgaatgcagaaacacaatccctgaaatcaccgacgcttctgtaatccgcgccttcaaatccggtgtcagagatcgttatactacccaggaattggcgacaagacgcatcacaaccactcggaggttattcgagatcgttgagcgatgcgcccatatggacgatgcgctaagacgcaagaacgacaagccaaagaccgggggagagaagaaatcagccacagacgcatctgagtcaagcaagaagaaaaatcgcaaaaatgggaaaaggaaagctcaagcggaagcctcgcagcagaatgcgcgaaccctcccaagcgcctagacccacaaggcagcgacacaaagaaatcttggtgccccatacacaagacggacggacattctctagaagattgccttgttttcaaaaaatcgctcgagaaggcatggcatttgaaaaaggcaagcgagtacgcgttgtcgagaagaacgaagagacggctcctcatgaatcggattctgcgtattcagactccgacctccacgtctcacacattttcggcggctccacaacgtactccttcaagcgagaatacaagaaagtggaacgtgaagtctgttcgacatggcggggggctgcacccaagatgaagtggtccgagtagaaaatagagttctcggaagaaggccaccccaagaccgccgttatcccacgacgatatccgatcgtggtcgaacccactattcggaacatcaaggtagcgcgagttctcatcgatggtggcagctcgatcaatcttcttttcgccagtactctagacgcaatgggaattccgcaaagtgagttgacaccaactgatcaacccttccatggaattactccccaatcatcatccagacctttgggcaagattacgttgcatgtgactttcggccaggccaacaacttccgaacagagcagatcaccttcgatgtcgctgaattcgatacaacttacaacgccatcatcgggagaactgcacttacgaagttcatggctgcatctcactacgcatatcaagtgctcaagatgccgggaccgaagggaacaatcactattcagcggaacgcaaagctggcggtgcagtgcgacaagcggagcctcgacatagtcgagcaaacgcccagcccacccgccacgactgagccaccaaagaaagtgagcaagacaaataaaacgccgaaaccggacggcgccatcaagatcgttccactctccagtgccaatcccgacaagactgtcaagatcggggtgacactaaacgagaaataggaactcgcgcttatcaccttcctccgcgacaatgccgacgtgttcgcttggcagccgtccgacatgccgggggtccccagggaggtgattgagcacaaactaatggtgcgacccgatgccaagccagtaagcaaagaatgcggagatttgcaccagaccggaaacaagccatacgagaagagctcgacaaacttctcaaagctgggttcatcaaaaaagtactttatgcagagtggttagccaatcaagtcatggtgcggaaggcccacggaaaaatgaagaatgtgtgtggatttcacggacctcaacaaggcgtgtcccaaggatcactttc

SEQ ID NO: 1888 - DNA, 3538 bp, Oryza sativa
caatcgagaacatgaagtcgcccacgagactcaaggaggtacaaaagctaaccggatgcatggcagcactaagcagattcgtcgctaggatgggagaacgaggacaacctttcttcgctctattgaagaaacaagacaaatttatatggacactggaagccgaagaggcatttattgcactcaagcgctacctatcaaacccccctgtacttgctgctccccaacttaatgaagaattattcctctatattgccgccacgccatattccgttagcactgtcattgttgtcgagagagagaaagtacagcgaccagtttattacgtcagcgaagctctccatgacgcaaagacaagatacccacagatccaaaaactgctttacacagtcatcatgacatcaaggaagctgcgccactactttcaagctcacagagtcacagttgtatcctccttcccccttggagaagttgtgagaaacaaagacgttgtcggccgcattgcgaaatgggtagtgagctaagccaatttgatgtccactttgtgccgcggacagccatcaaatcccaggtactcgccgacttcgttgccgattggactatgccagacaacaaatcagacaaccaaggtgacaacgaaacatggacaatggcgttcgatggcgcactcaacagccaaggagcaggggcaggatttatcttgacgtctccctccggagatcaattcaagcacgcaatccacctcaacttcagggcgaccaataacactgcagaatacgaaggactactcgccgggatacgagctgtagccgcacttggggccaagcgactaatcgtcaaaggggactccgagctagtcgcgaaccagtgcacaaagactataaatgctctaacccccgagttatccaagtatctcgcagaagtcaggaagttagagaagagattcgatgggatcgaggtccgacacgtctatcgcaaggacaacgtcgagccagacgacctagcacgatgcccgtccagacgagaaccgctcgaacccagcacctttctcgatatcttgacgaagccatcggtgaaagaagttagcggcgaagttagcccgaacacccccgacatcagctcggaggtcaccgaggcagaacgcgccgttgctgatatcgaaaccacagacgactggcacatcccattaatcaaattcatcagcagtgaggagttgccagaggacgatacagaggccgagaaaataacccgtaaagcaaagatctactgtatggtcggtaacgatttatacaaaaaagctctaaacggggtacttctcaaatgcgtctctaccgacgacggcagacacctcctcctcgacatacatgaaggcatatatgggtcacacgccgccagtcggacattggtcggcaaatcttttcgacaaggctttttctggccaaccgcccttaaagatgcatgcgatatggtccagcgatgtgaagcctgtcaattccagagtaaacacacaaagctacccgcgcaagcgctccagactatccctctgacttggccgttctcgtgctgggggctagatatacttgggccattcccacgaggacagggtggctacagattcctatttgtggcgatcgacaaattcaccaaatggatagaagcagtgcccatgggggaaatcaaggccgacaacgccatcaaattcatcacagggatattctgcagatacggactaccgcaccgcatcataaccgacaacggctcccaattcatcagcgctgacttccaagattactgcatcgggttgggagtcaaaatatgtttcgcctcggtctctcaccctcaaagcaatggacaagtcgaaagagcaaacgacatagtactacaagggatgaaaaccagcgtctacgacaggctcatgtcacaagacaaaaagtgggttgaagaactcccatcagtactatgggccgtacgcaccacaccgacaacgtccaataaggaaacacccttcttcctcgtgtacggctccgaggccatgctccccggcgagctacgacatcagagtacacgagtacagaagtattccgacgagaaccaggaggaacaccgagacaacgatgtaaatcttctcgagaagcatcgtgagcgagttgtcgtccgagcagccagttatcaacagtccctccgccgttatcatgagaagcgcatccgagcacgcatactttcgatcggcgactatgtcctccgacgagttcaaacccaagcagggcgaaacaaactctcaccaaaatgggaaggaccttacacgatcacacaagtcttgcggtcaggggcattcaaaatcgcagacggcgacggtcgcgaattagcaaattcttagaacattgaccaactacgtaaattctatgtattagtcaataccactgtacctgtaagtacccttacagtatcaataaagcctatttctaggtcccatatcacaatcaaagtgttttcacccgatgatcccttactctgatgacacctagcgttgaaacctgtccttatgtccctttacgccgtctcgacaaggcctccgaggaacctaagggatcttcggctggggacgcccagagccgataaagccttgtcagatcctgtagagaaaaaagaccatgtaagatctggtcgtgtaagagttctcgccgtgcgtattaaccaaactgtgaaatcggaaatcaactttccaacctcatggctgggggctaggatcagagcttattcaaccaaggcaggtcaagggtccaagagccttatcctccgagaaaattcctccgacgacaaggctgggggctagagagagtgtacgactcaaacggctgaccaaagtcgttaactgagaacacactcttacacacgacatctagagtaagatacatttgtttaaggaatatttctttattcacaaaatgattcttacagtttttacataaattttccactacattacatctttccctgtcacgtcccaaaacgaccctaaaatatatcctctaaattatgcctagaataattaaaatccgtgtgaaagcctccaacaattaaaatgtgcaaagttaaaagtcaaataaggcttagaggatttttctatatttcctaaaagcctaaaatacgtaaataaattttagtggaattctcagagcacaaataataattattaagaaataaacaaagttaaaatgattttataaaaagaaaaaccctaaaattcctcctctctaatgggccgaattcggcccatctccctccccctctctctctctctcctctcccccgcggcctattcggcctccctccccgcgcgcgcgctactgacgggctggcccgcccgccaccctcgctgacgggtggggcccacccgtcatccccttcctcccgccgttcccgccgcctcccccgcgccctagcgctgccgccgccgcgaatcctgctgcctcccgccgtccccgcgtgcaataaagttggggaaatcactccccgtgatcccctttccctttccccccaa

SEQ ID NO: 1889 - DNA, 36251 bp, Oryza sativa
ggatttgagctcgcgacgtcgctctctctctccgccatcaccgttgagctccggtccaccgccgtcgtcgccccggaccgcctcccacctcggcgccgcctccttcggcttcgccgcatcctcgccgacctcgtccacctctccgtttcggtcgccgaccgccggagcgccgcagtccccgtcgacccgagccgcgccaccgcctccctccgctccggccgcctcctccgtcgccgccgtcgccccggggtgagccgtggaccatcgcctcctttcccccttccctcccctctctcggccgcagctccgccgcgccggtggtcgccggcggcgaccatcggggcgcgggcgcgccgcctcccgccgaccgcgccggcatgaccgccctcgggcgcgccgagtggctgccgcgtggggcccggccgtcagccgcccgcgccctcaggtgcggctgacgtgtggggcccacggcgtcggccggtgtgagcccgggtgcaaccggtccaccgtggaccgtgaggctgccgcgtgggccccactcccgtggacccggtccgcgcgccccctcccccctctcggctgacgcaataaacccatttttaaattaaaatttaaatgaagaaattcacaaatattcatttaaagagcatatgaacttcaaatggacataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcatggaggttgaagccgacgtttgggaaagcgagcaaggcaagacacatcatccttgagcatattgaatcccagtttataaaattattttgatttaaattattgcattatcgctttacttaaattcccgcgttatcactattttatctagccatgcctatttaactttgttatgaccttattattgttattgttattattaccttgttcaccctaggttaaacaaaaccccaactagtggacactctactcatggtaccactagtatgattttaggtagatgcttcgctggttaattaggcaacattaggtggttttacaactctagactttgggatatttatatcacctggacactatggaatggttggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacatggatggagatggacgaagtcgggggttgatggacatctctaggacaaatgaaggctacacgagctgcggcccggtagtcgagatgtcatggcacagggccggtgtcctgctgctaggagctcagtcctgccaacctgtcccgggggttccggccgtaggtggggttggatcggtactcttgtctatggctaggatgggttggaaactatgtcacgtcttccgtccgtataccgtgggggtatgtggcacgtgattacacgtgaggaagatgtgtcttgtgggtaaagatgtacacctctaatcagagtataacctattcgaatagccgcgccctcggttatgggcaagccgagcaatgtacccaagttagtgttttaattcttaaaacctgctcaacaactaaaatgtggaatggttggcctgggttagcttgggacgagctgggacccagggtcgggttgccagttcggtctgaatcatcgtaggccttgggttaaggcaggttcgtgtgggttcacgaccttgattaataatattgtatagctctaggaccatgtttacaaaatagctttgagcaactaagtgtcttttaatgatgtttactgcaaaccctaactccctatattatggctcccttgtactcccttgcatttattctgcacttgtgggtgtgtcttgttgagtacggtggttgtactcagtcttgctcaattttttcccaaacctagaagaggagttcctggaagatgaaggctttggtgtctagctcgtgcctgccgtcaagcacctgtggtcgtcgccctagtcttccgctgtttttcgtttgtcttcttgtgtgctgggccttcgccacccatgtaataaattaattaattacgcttccgcttgttaaactctgaattgtatcaacttttggtgtaccttgcctcctgggacaaggaataatgcacgcacgtaaggaacgcccgttgggttatttccggtcgtgacattcactaagatatctgtgacagggcacgagtactatcaagaaggccaatgccagtccatagactggaagattttctcggccagcggcgacattgaccttgccagatggtctatctccgccggagttctccgagaacgagcaaaaccttcgcggagaaactcgaggtccaggcgcgggcggtgatctcgtaggcaagccagcacgtgccctccggcgtattgactcactcgacgacactcttacttcaaggcctcgtcgatatgcttgccgatgccatcgagttgggcataggccccgtttagccaagagatgtacccggccgtcgactcctcgggatcactgcggactactcgaagttccctgcatactctggccatggaggcacagcaactcttcaagtaagaattaaaccacacctcgcgacctcggagcgtctccacagcctgctctttcttcatggccagcatggttctctcatgttccgccacttcaaatttcgtcttccagtattggatacgacgatcttgatttgcaagggcaccctcgagatctgctaaacatgacgaccactaagacaagctggatacctcctttacaacataaataacctaatcaggaggtcactaagaggtgaaaaggctactcactttaggtggccgttgccatcccggcctccgcatcaagagtttgatccacattgtcagacgaaacatgtggttcaaaatcgagtgccagaatcatcgccagtgactcaggctgcccgcgctgctggacatcctcgtcatcaacatctctacaatggataaaactcccgagatcaacatacaaaattggacaagggtggtaatcgcacgcacgaaggcggccagagttcaagatttacacaatatgtaacaaatacaagaagtcctactcttcaaaaagggggagaacaaactcccccatatcaccgacttcttccatcacctctttacgcgtgtcgcttgccgccccctgatccaagatctcgcgcagatcgagttcaggacgcgacaatcttacacacgcgaggacgtgacacgcctcggtgtagatgtcgttcgacgtctcctccgcgatcctggccgcatgcttggaggggatttcccccatcgccgtcgctagttccgcaagagaggaagtcagcaaaaactcgtcgggattcaccgggatcgtggacttgacgccgcactcctcggcgagctgatggaagccagtgtaggtgacccgcaacgagtgacggatctcggagagattgttcccgagtttcgacattcggtcctcgagcccctttcgttgacgctcgttgccggccaccaactccctcatcttcgtgaggtcctcacgggcttcagctagctcgcgcaccaatctctcagcacgcgtgttcgccgtcgccgcttccgacctcgcctccgagatctcgcggccgatgccgcgagcaccagcttcgagaaggtgccccatctcgacttggagctcttcccaggtgagaacggccgctggcagaccacgacctgcagcgggatcgctgacggggccgctaggcgtcgcctcccggctcccggtcacgagcacgacatctgtcgaggccgtggcaggtgacgcgctggaagctcccccggacttggcccgtgcagccttcgcccgcgcctccctacggacaaccacgaatcaaacaccatttgaacgagaagcacgagaatccacgaatctgtttacttacttctcgccgatcgccacaatgcgctgtcgtcgtggaggtggaggggacgcgtctgaagcctgaaatacaatcaatacagagtaagaagaaaccctccttgctgcacgatctgacgacaagatgaaattaccgagggggtcgctgccttgcggcgatgtccgagtacagacgagaatttcctcgccttggtcgggacttcgctagtggtggccgcatcagatgtctccttgacaaccttctcctttagagatgtcgccacctgatggtccgcgagcggcccgatgatgtcagtcaaaggaagggcctacgcttaatcaggtcataaggtgatttcgaaaggagaatacgggatgcttatcaaatacacttacgttgatggcttcatcacgttccgccgcccccttttcacaaaggggcacgaggatgtcgctagccgtagtcggaccgctgatcatcatttgaccgacgcgccgctctacagcttcgctgctcagacctgttaaacgggaaccaacttttgataagtcaagaggaacgcgagtacaagcacgccaagatgaatacgagaaagataccccgaggagaaacccgggtcgcgtcattcggcccgaaatagttataggttggatgggcccgagcctggagcggctggatccgcctaccaacgaagtctgcagcgacttcatatcccgacaagccccgttctcggagatcatcgatgatgtcgataaacgactgaagagagggggtcaaagggggcttggcggtccaggccggaatcttgtccggttgatcctcgggaacaacgaagacagggttcgagtccttgatctcaaaatagaaccacctattctgccacttactgcgggaagaaggacactggaaggggatataacgtgacttcatgccatcactaagtcagaacccgacgcaaccagacaccctattggattccatccaacgcagttcatagtagaaacggaagagatcgagaaaaggctctaccccaatgtaggcctcacagagatgaacaaagatactaagaaaggcgatggaattaggattcaaatggagaagagaaagaccatagaaattttcaacaccaggagaagaaactccgaaggtggaggaagaaaaccgcagacaacgtaatcttcgatcgcaaccatgcgacccaagaggggctgaggatcagtacctcctacttctctctccatgtcttcatggccgggaagggcgccgtcctcctgaaggttcttcaacgtcgcgccggtggaagacgacttgccgagatccattgctgttccaagatcgccggaaaacgagcctgagttggcaaactaggttttcttgcggcggcggagaaggcaaggagcgctggcaggcggtatgtttcaacaagattggcagacttcaaaatgggctcccaaaattcctttaaataagcgcactaccgacggtgcgaattccaaggaacggagagagatccccgccggaaatctctgggcccgttacacgcggcaattttctggacttcagttcaaaattcactcgtgaccgttgggcttcaaacggcatgctcgactacgttctatctccgcggtcctcgcaccaggaatgacaacgttctcgacacccgaagtcgtaaatggttgcacgagttcatttaagcagaagtcgggggctactgtcagggttacaggtcaggcataccctctacccttcgatatacgttacatatcgacatggcatacccacgcgcacgcggatatttcctacgtatcctaaggaaaactttcacgaaatctacagatgggaagagtccttctcggacagaactgggtcgtcgacgtatcgtattgggtccgatatctccgagtcctacttggagacctccagatctgtgatataaaagggaccccacggggagggcataggggatcgaatctcagagccaacacaacccacacagcctacgaagtcgaagtctgcgaggagccaagtcatcgagagctagtcgaatccactcgactacgatctcgccggatccgacaagttccatctttccctttataatctgtgttttccaccatataatcccatatcaactggattaggtctattacctaccaaggggcctgaaccagtataattcttgtcttttgattgttcaatgtcgtactacgtagatccttgtaccaacgtaccccaataccctctatatccggtctacgggtatcacccgtcgacaatatatatattggaattttctaggctttcaactatttccacatgagatagttgttttagcaatgttactgtagcaacagcaacaaaaaaatatactatgaaaaatattttgtattgaaaatcaaatgaaatatcctgtcgatatacaattcgatcttatacatatatgttttacactgatgaacaaatcccaaaagagaaatttacacatgtagatccaagatgttatttgatttagtttactgcctaggatctctctctctccgtgtgtgtgtaatatctcactggagtaatatccagtgttggcaaaaggtgtgttacaccccaaactagcaataatgacatgtccatatatatacgtgaagaataaaaacaattgttccaacaatgaatgcatttatttttttagtgaagtgcatgagcggtttctaaacttgtatgtgtgtgttatctagatccttgaactatcaaaatgttgtatttttgaatctccaaacttgtcttagatgttatatatataggttcaaacgggctctcaacccgctccatacgctaaaatggcatgccacgatggtgcctatgtgttagtcagacccacatgttagttacatagaaaaaataaaattaaatatatatatatataaatttaagtttaccttttttttctctctacctaagaggagaaaatatggttttaaattttatttgttatacataactgacatgtggatcccactaacatgtagttgtcaccgtgtcatgccacgtcagcatatgggacaatttagaaccggtttagacctatatgctacccaagacaagttcaaggacttaaaaatgtattttggaagtttagatgacacaaatgcacaagtttagcgaccgcctatataattcactctttatttttctagatatgcggaggacataaatacatacaaacatcagtggaggcgtggagccaacatgttaggctattgtcacatggcatcaatgaatcttgatttaacctacgtagacattatgttcttcaatgaattacattagtatatgatttgccttttgacgccaccatgttccggcagagttagcccatccatttgcttagcccataaattgatttaaccatataagttagcccatgtgaccatgttaaaattatctactaaatccgttctaaaataagtgtactcttgtaattcaaatttgaactagaaagtgtactaggagtaggggattagacagggtcgtcccgaagggagtgccacaagtgcgactgggcccccattctccggggtagaaggaatttgttgaagtcgcataggccgaacgcagcacgtctattcattttcgctgcgtgcgttgattccctcccaaacacgatattaatccaagtaagtcttgacctcggtgactctgaattatggatccgccctgttaaagtattgtacaagagtacattaatttacaaatgatagtactccatccgtttcaggttataagatgttttaacttttattaaagttaaactgctcaagtttaataaagtttatagaaaaatatagtaatgtttacactatcaaattagttttattaaattaataattaaatatattttcataataaatttattttggtttaaaaatattactatttttttctataaacttgatcaaacttaaagtagtttgactttgaccaaaatcaaagaaattttttggtttttgtcataagaaattatggaacaagtatgtttgagttttggatcgtagacgtgctccattcatgcaggcacaacgaaaaaaaaatactaacacgcacgcatggctaccaacgcattgctaccgcaccaaagaggctcttgtatataagttagagtaattacacaataattatactccatttatcgaaaagtcttaagcatattttattttcggggttttcaaatgagatgatcatatttgtacctccatatatgtaagacttaaataaagagattgtatttctcgttttgccatattagaataaatcattaaccggaacccgagcaaccatcttaatattcgttagttacaagcacacgtataatttttttttgtctctgttatagatgagttagtttttttttcttgattttgttaacaaaataaacacgttttagttttttttatggagggatttggattaaacttgctctaaaccaaatcacccaatctttcgttccatccgtttcttcgcatgtgacagctcatccacaccgatggagcagtgacgaatttttttatttttaattttatttattaaaatatttacagaaataatttttaatttgaaaattttacaaaactagtcgcccatcgcccttgcccttccagaagacgttttttccgaagtagtagatggccgttggctctaccataacggcgggccatcgaggacgctcaaattttacaggcggcccccttgccaccctcccagagggcgatttttggctctagggggccacctacaaaagggttgggagggctacctagaatttttgcaggcatctcccttgccgccgcctaagagggctattttctactataggggagagggtggtatttttgcaggcggccccttttacccttttgggaggatgattttctacagtgcaggggggcctttcgtaggcggccccctgtaaagtaaaaaatcgccctcccaaaaggctacgagggggccgtctgtaaatttctcctccctcgatgccgattattatgggagggccaacggctgtctgccacattagcaaaatcgccctcctagaggacgatggacgactaatagttttgtaatttttttaaatagaaaattatttttaaatattttaataaataaaattaaaaaattcgagcagtgaccacagcgaagccggcgccacttgtcacgaacaggcgccgtgccacctcggcgcatgcctctctacggctagctactcccatttgtggtcaacacctcgtagcgtccctatttaacgtatccacacgcatcacaagatcgaccaccaccaagcgagcccagcaacagtttcacactttagctgctagctagtgctaccacccacaggaggcaaccctagctttcccacgcagccaatggaggccggctacccgggcacggcggcgaacggcgctgccgccgacgggaacggtggcgcgcagcaggcggcggccgcgccggctatacgtgagcaggaccggctgatgccgatcgcgaacgtgatccgcatcatgcgccgcgtgctcccggcgcacgccaagatctcggacgacgccaaggagacgatccaggagtgcgtgtcggagtacatcagcttcatcaccggggaggccaacgagcggtgccagcgcgagcagcgcaagaccatcaccgccgaggacgtgctctgggccatgagccgcctcggcttcgacgactacgtcgagcccctcggcgtctacctccaccgctaccgcgagttcgagggggagtcccgcggcgtcggcgtcggcgtcggcgccgcgcgcggcgaccaccaccatggtcacgtcggtgggatgctcaagtcccgcgtgcagggctccatggtgacgcaccacgacatgcagatgcacgccgccatgtacggtggcggcgcggtgccgccgccgccgcatcctcctccgcaccaccacgcgttccaccagctcatgccgccgcaccacggccagtacgcgccgccgtacgacatgtacggcggcgagcacgggatggcggcgtactacggcgggatgtacgcgcccggcagcggcggcgacgggagcggcagcagcggcagcggtggcgccggcacgccgcagaccgtcaacttcgagcaccagcatccgttcggatacaagtagtaacagcagcagaatggcgatcggtctgcacctgcatgcacacgtatcgcatgcagatcgagctagtagtgcaactggctaacttgaaccagttaaaaacttaagacttagtgatcgtgtgtggtttaattaatttgctacgttcaggtagtgatcgatgagattttaatttcctactgtcagtttaattcaccgttcatgtactcgatccagctagtactactcctagttacccttgttctaatcttaacgcaattgtgtcgatcggacgatcgcacgtttatcttcaagtggaatttgtcttataacactaattaagcgcctggaagcttatgtacacttactcaattgtgtattgatccctcaagagttgtcaattactattacaaggttcatataaaagcaaactcatacagtgagtaagtagccaaagtaacaaaactaaaagtaaaagcaaactaataaaaaccaaacaatataaagactaaccattactgaattctattggtgaatctccaccaaaagttggtagaatgctgcataatcgttgactcaagtttacgacacatatcttttattagcttgatatgatcaccgtacctttatagttgagcctatttctgaagtcagtatgtctctaaaaagaacctacaaataagattttgactgctcaaaataaagttaccaaaacaaagttacacttgcgcactcgcactgcataccaacccaacggagagagacggagagagatctagagagagagggagagagatacggcgccatatacgggtggagtactactggagtgtcgcgtgatttgccttccccggccggacggacgcacgcgtgtccggtcaaggactcacggtcggtcgcctgatcgacgttgcgtcgcgccctcgtcgtacgtactacgttccgagcccatcaccgggcaccggcgacacgcacgcacggcgcgtacgtacatacggatcgtgaatactaacatatctacccaacccgaatagattgctacgtatccaacccgagtgttcagtctgcatacatacgatacgggcatgtacagacacagctgttgctcgtcgggtccgtattatgatactctaagaaacttaagcacagtaattggaggacgcgatagagtcatatgcgaatcatattatctagtcatatgtatagcaggattctcagatcgtataattgggcacgcgcgcgcgctgccacaccagcggatgttaatttggatggcgcgtcacacgaactagcttgcttgcggagggtacgtcgtctcgctgccggcacacggacgtatacgcgtcgcggagggttgcccggttcttccgccgcggcccgcgggcgtacgttaatatatgctgctttcagccgcgtggatcagtatcaggggcttcgtttcgtttaccccctgcatcggtggccagtgcatgcccgtctcggctgcccgctttgggaaccgcaggccgcagcatcgcctagttttgtgagctctctccagcatcgatcgcagctagtagctccttccccatgtatgcatgcattgcctacgggggccctgtcgatcgatcgatcgatccatcgatgcatcctcctctgtatgtctctctcccctactgtacgcacgaccgggtgaggtcaggtcagatttttttttattagagcaggtacaatagtatgctataagccaactgtaatataatatattttaaagagataaaaaaagagagagaatatcagcgagctacatatatgtagctagctgtagtatggactccaatacataatatgtgtatgacagatgagttattaatagtataataaacaattattgcatgaatgggctattcccaactcaaaacactagacatagttttcataaactccacatcatcaagaaactagtattatacactactatttcaatgcaaacaccactattccatacttgactttaatgctacttatctcacatgatatcttggatgatgtgtagaaaccatgtctcatgcaagacatggtttccttctctttcctcatttattcacttgtcatattattttttattctaagtgacagcttatttaattctatagacaccatattagtcattgggttgagaatgaccttacattgtagagcagtggactataatattaaacttgctcttattattctctttctttcttgtggctgctgcacctgcactgcacccgcaacggcgctgaatgatgccatgcgtgcgtgacgaaacatctgcgtcccccccccccctgtgcggcgctgtagccatgcatgcaggtgtgcagcgccctgcattcgccatgcgggagagcagtgtactcctccccattttaccaccgactgtttactagctgcttccaggggcacgcgcgcgctgctagtggtacgtaccacgattcctggctccaacgtgcgcacgcatgctttagaacgaatttagctgtgcgctgccgctttcgggcccgtcaacaatttgtaccaaccgtagtatccttgtggctgtaccctcttctaggttctagtgatgacatgcatgacaactttcccagtgaacactgaattgcagctatcatacaggttcctaaactcaaaaactactcgagggatgtgatgtgtgtttctgaatttacggatgagaagaaagcactctgttcacatttgatgttttggattcccttgggtaaacatagttttaaatctctcgctatagctggcgctatctcccgctatagttgtttgaaaaagattctagctatttgatctcatgtacaatttagccgctatagctctatttagcctactataactgtttgagaagctaaccgctaaatgtcttagcccgctatttaaaatattggtaaacatcactggccaaacgcttgcaggcattgcaacgggttcagggctaccttgttatagtcatcaatgacaagagtaggctgtcaaacacgactgagatacacgaaaagagagcgctccaaacaatgtacgcccgagttaaaaccccgggttaaagaaaagcagttctacagaacagtgatcatacacctgcagtccagtcttcttcagtcatcggcaccattgctttctttactctgctcagcctgggggagagcgcctccggtgggtgtcgtcgtctctgctgctgcaccgggagagtgatcctcagctggcctggtggaggcatcctctgcctcaccattttcatgtctaatacactgctttttcttagccatatcggtgtcttcctcttgtagttcttcatcaacaacatcgtcatcatctacatcctcatcaaaaaccttggtaaggtcaccttgattctcagccccttcggcggcatcaacattgttcatgcttatatcgaccccatcatttccagcttcagcttctcctcttttcctctgtgggatcacatgaaagaacgaagtcttccagtcccttgtttccacaaactttagcattatctcgaacacttggttaactgtcagaacctgcataaattacataaaaggagagtcagcaatcttcaagtctttagcacaaattctccaacatccaaattccgggccatttttataaactagggttgttctaaataaccctctatttagactgatccatgataaatgattgccataatattaataataagagccaatcaaaacacataaaactcttactactgcactaacacgtttgaagcctttggagaagatcttaaaaaaaacgtttctttttctaaaagaattttcaggatcatttaacatgcggagagataatataacatatcactgtattatctgatagaagatgtcacaacatgtaggcatactggattattttgaacccttattggaagtatggatgaaacacaaaacaccatttgattgaaagaaatcaggcaagccaacattctgtactgggaaaaacatatccatatgatcacctgagaacttgacatctttaaataatttccaatagggagcttggcacattgaatcccctgatcaaccgcctttttcagtgtaatacctttccatctgttccggtccactaggccaccgatgatgtatatttttgacatgtctagatcatcaagcacagtttcagcatcggctgtaaggtacacaaggttttctttacgatcttcaaatgcttcaagataagacttggcctccttttcaatcatccacttatcatacccaggaatcctttgaagatgggttgccatttctccattgcaacctgtcaaccatagatgagcagggttcgtagacctcccattaactgcataacagtacatgatctgtaacttgcattagtacaagggtaacaattttgctcgaactagacattaatgaaggtagaatgctttttttttttagaaatttctaggtagaaggcattttggtacataaagacattttgatattaacttttgtcaatatcagaacatacttcagatagaataagagatcaatgctatagcattagcacatattgatatatatgattaaaaccagatagcacaagccaccaggttgtcgaaatagaaaaatcatatatgcaagattcatataactggtttctcttacaggtctacacttaacatccagttgacacatgaataaaagattcatacgtgaaactgctaacatccagtagaaattatggacaagtaataaaagtataaagatttatttatttttttggaaaaaaagaatcaggatatttttttggcacctttaacaagccatgccaatacaaatatgtgatctgccatatacatttcacaagtaatcaagttactggaatgtccttcggatatcatatatatcaatacacacatgattcgcatattagcattatttcaagcatgaagtttagtttcagcccaaaatgtacaaaagcgagaagggcaaagcaaatccacctgctgcgtgaggctgtgaatctcgttgggccgcatgagatctccgaactcgaggtccagcaccaccttctgcccggcgccctcggccgcgcggcggagccgctcggcgcgtgcgccgcgctcctccgcgcgccgccccacccgctcgcgccgcgtctgccgccgcgcctccaccatctcggcgcgggcctcctccgagggcgccgcggccagcgcctcctcccactcgcgccttcgcctctctatgtcggcgcgccggcgctccttctccgccgccttccgtgccgccttctgcgccgcctgcctctcctgcttcagcagcttcttcctcgcgcttttcgacatcgccggaggctgcccttcatccgcggccccggccgcggccacgtccgtggcttgctcactcgccgcgtcgtcagccatctcaactcgccgccgccgccgccgccgccggagcagtggctcggtttggagaggggtttttggtttctcggcaccacgtgaccgaattaccgaaataacctcaaacgtattacaaaagtacgcctcctagtgaagttagcgtacatcaaaattccgcctcaatccaggatgcaaacctatgggctacgcgaatcttatttgccacggcccaaatagccatgtagatgaagcccatcttggagcccataagcgaaatgtgtgtgctgtactgctgttccttcgagccattgaccggttgatccgttcggtagcttcagagcggttagactccccccaacgatctgcatggtgtggcatctcttaccaagtcaatcgccaatcacggctgtccatacggaagccagtaagagatcaacggctctcagtgaagcaacgtctcttctccaaacccaaccgcccggcgcgtacgcagtccactaccaccacttccgccggcgccactcgctttcgtgaagaaaacctctatataaactcccccggccagagacaccgccacggctcacgctcgcaacaacacaaaaccctagacttgcacagatcgagacgagagaggctagcagcaacattcttcgacaatggctagccttgcaatcttcgccgctgtagccttcgttctcctcgccgcctcggtgtcgtcgtcgtcggcggctttgtacaccgtcggcgatgcgagggggtgggcagtgccgcccacaggctcagagtcgtacaaccattggggtctaaagaatcgcttccgcgtaggcgacgtcgtgggtaagtacaagatcatcgccgatctgcgaacggcgatcattatcacagttcgcatcattttgcagagttcaagtacgtgaacgaatcggtggtggtggtgaaccacgagggctacaggaactgcagctcgctgagcccggtgatccggttcacggacggcgacaccaagtacctgctcgaccgcccggggctcgtcttcttcatcagcggcgtgcaggagcgctgcgagcgcggcctgcggatgaggctgcgcgtcaggcccgccgctccggggccggcgcaggcgccggcgccggggccaacgagggcggcgctgacgctgcgtcgtccacccatcggcgctcccaggccggccgccgtcaccgccgcgttcaccccgacatcgccgtccgcttcgcgcccgagcgccagaaccagcccgagtcccagccctgggccggcacaggcgccgagcggtgcatctggccgcgcgctcacgggcttctccatggcagcagcgcttctcgtcgtgtgtgtcgtctccgtgttcatcttggtttgaggttatttggagaggtttaattagctctctgtcggtcggtagtatcgtcggttttgataggaattaatgctataattctgagatccaagaagaagaagaagaagaacgtgtcatgtcatctcgcggtagatgacaggatcgagtccatttttgttaattagggtgttccaatgttttgtctagggtacttaattaaacccttatggccttatgtacgtaaacccattccctcaataaaatcccaccagttttattgtgaagatcgacttggcaatgccctcagatccactggagtgattgtttgatttgccatggaagttgaactgtgcagctccctatgtttaacggcggataataattttctacttaagtgtcatggcacctatcatttacatacaacaaaaaaattttaaaaaaaattcagtacaattgatgatacaaatttatacacaaacatatatgactatgggcctatttagttcgcgaaataaaaaaattttgggtatcaaatcagatgtttgaccggatgtcggaaggggttttcgaacacaaatgaaaaaactaatttcataactcgcttggaaaccgtgagacgaatttttaagtctaattaatccggcattagcatatgtgggttactgtagcacttattaggctcaaaagattcgtgatttccttcctaaccgtgcaattagtttttcttttaatctatatttaacgcttcatgcatgtgtccaaagattcaatgtagagaaacaaaaataataaatcttatatgtatgacgcagataaaaattgttatttattgtttcttcacatgtagattaattttagatttgcatgtttgtaatagtgtcttatattatcatagtttatcttatcaaattttataaaatttttatataactacttaaattacatgtacatgtgtagaaaatacattcatgttaaacggcccagtcgatctcactttgaacaggcgaaagaaaagtccggaacagttcagttccgcgcgcgcgattccaccggcgaaacgggagctccacgtccgcgttctgttgcgcctcgcacgcccggttccaccgctcgcgccgcgcgctcggctcccgtctcgtccacatcccccgcgaccacgtacgctgccacgcccgcgcccatgcccacgcccacgcctgcggccgccgggccaccggttggttgtccgcctctagtttccaggtcgtccagaacctgggaaaatcaaccgaaaaaaactcaaaacaggcgaagtaatcgtttgaaaacgaaacgattttaggcagcgtcgcatgcaaagcatgccacaagaaacagggcataagtaggcgcctccatgcagcgccccatgaaaagcattccgattcctctgctcctcttcctgttccccccccccccctctcttctctccccccggccggggaagaaattttgcccccaaaataattttctgcacggacgatcaaagaaagggcaaaatttttctgcgcctccggttgaaggaagccgtgatccatgtcggtgagtgctcgtcctctgcagggtttgttagaggcgttgcatctacgtacgtgcaatttgatttggattctcggttctttctttcttgaccatatgcattgattgatcgatcgatgctgccatttggtatatctttgcattataccgtttattcctttgaatcaattgagtacctgatggcaattggatgtgtggagaaacgttcaggggttttccgattagctatacaaggtggtgatagacgatctgggttcgaagcctcagccctcctaattatttgatattaagtcctctcctaatatccatgtctttttattggatgtgtgacgaggaacttctcgcaaattggatcgacaggagcaacctagagagattgattacaagaatgaaactaaatctatagaaacgtagattgggactttttccctctgttctctaatcgggacgaaacagggcaaacggtacaatatgccctcacgctattgtgacccttaatttgtattgtcttcaactcttcatttttcaaacttgaccattccgatttgtcttctaaatagcccaattgatatgcgtgatacagaagcaatctgcaatagcacgctagcttactcgtatcatgcataatcacactgatcttgtcatatacatgggttggtttttttttttctcatcaaggacgagactggccgcaccattccaaagttcggcgcatgggacgtcaacaacccggcctctgccgacggtttcacggtgatcttcagcaaagccagggatgagaagaagggccccgtcaacgtggacgccagcaccaggtcaaactctgacatgaaagactccaataacaataaggcaacagagaagatcaacccctaccaccgcaggacaaactccgcatcagtatatatatacttcctttcttccatttccttccttagcatcacattattgatctcaatgaaaatgaaaaaaaaaagagatcatcatcagatctttggcttgttacatgtaagttactattgtttattgatctgtttttgcagaagaagtggttttgctgtgtgtcgcccagccccacccaaccttgaggaagcaaaggaataccaaatataacatgatgctgctactgccgccttgttaatgcatatagtaatgattatacacacccagttgaaaatggcccggtgttattctgtgatggttgctctgttgttgtgaggaggctggtcttgagctcctcaagcctgtctgtcagtgacaacagcgccatgtatgatttgttttccgccgggccaaccatgtacgagtgtatgactgttacatgagaaatttatgggtatatgatgattaaaaacgtcatgattttgtgtgtactcgttgacgtttgattgtaattatccattcgctcttgtcctttttcttatggttctgcagtgtgatccttcctcaacttcatcaactgtcaactagtaattctgaaactgtactgcccagtgcccaattcagacttctgatcctgctgtaacttcagtaaggttatacattggtacccacttttgttggaacctgcatgggaaaaaaatgtagggagaacctagaaactacctaaagagtaaaatgtataggtggtatcacaacttgtgaggtgggtgcagtttagtcactcaatcttacaaattgctcaaataagtcactcatcttacttcgatggtgcaaattttaccgaatatattgtcacatggattatttgtttttagattggaggtcgtattagttttaaaaaaacaattggaggttgtattgacctcacatcttacattttttttaggaaaaattggaaccatgccattataatttcgcaaaatttgagatatgccatcctgacccacgtgtcattcttttttttaagccatgtgggtagggcaagcattacaattacaaattagcactcatatttttcatgtatatactaatactcccgctttcaatgaacatggccatattatgcttgacaatcaataaaaaattcatctttaattggattttaatactggtagtattgtacgttggcttatttatggatcgtgtgaccatgtttacaaaacaaattaacatagcacataacttcattgcgaacatcccacacaacacatgttttgtatgatttgcatcctaaaacaagatgagtaacttgtttgagtattttacaagatgggtgactaaattgcacccatttcacaagttgaggtactagcggtgcattttactcctacctaaaatacacaaatacacgtctaagatttatccatgtcatcccggcaataaaaaatttactcgtggtgaattactcgggtgatgtgaataaatcttagatttctatttgtgtatcctaggtaattttcaggttttcattacacatggatacatattttcccggtctgcacagttttcagaatgtaacctcagaagagaacatctatgtgccacccctccacagtattgaagctcttttaagtttaatttcttcctgatatatagcattgtacatactgtacgtaatatcatttacatattgagagtatacagagtggcaacacaaagcaaatggaaactcgagcgacagaagctggcaagctgcccttgtccctgcggaggaagagcgcctcataaaccggagaattgatggctactatcagtacacacagaacagcctggagaaacaaagtttccaaaccccctgggctttcttgtaacaaaactctactaattcctaacaccatgcatgccaggttgagcagcgcaactgtcgtaaggattacaaacatcgccgagaaggatccgaattccatcatccccttcttgtacctctccaaggcctgcaagtcagtgaccttcactgtcaggttgaatccagactcagagatgcccaatattctgcggaatgtgtcgatggttgccaggaggtatgaggtgatccttctaatgagccacatcctctgtgcattccaccactccactgcactgtcaccacattgcagtgactctgctaagctgcaggagtatgcggccaccataacgtacgcaaagggtatgaaccaggggctagttttctgagttaattgcagatgtaaatcttgtgttaaactttaagccaagtgcgtacaaatgtctgaacaaacgttaaagcatatggaaacttacctcaggaaagagggagatgccattgaggaagcaaagagaaggaattgtgacatagtacaaggtggggaagctgttcacggcccagaagccgcagacagagtagcccatttgaagacccagcttgatcttcccatgacctaataagaaggggctgtaccgtgagagggatatttggaggaacccttctgtccatctcttgtacaggaccaggatctggcctagtgaggtgggtgtcatgcctaagaatccctttcttttggggttgtagtacactgatctccatccacggcattggatttgtaatcctgtagttacatcctccagtgggcacccatacctaacccccttctgcaattcagcaacttgaagtcagtagctgtaatcagtacaaaatgaacaaagttctgtaactatgcgaatgcccattgctggttgatggctatagaggataaaatccaacagtttacatgttcagggtatgaagtaagagactaacatacctcaattccccagatggtgttatgctcatatgtgcaagtcacaagtgacctgcccatttcttccaactcattagcatcttctgttctccctgctaccctagtccaatcttccttatattcttgactatagattcgtccacatagggcctctctccgatggaagcatccagtgccatagtaacacattccaccccaaccatccaagcaaggatgatccaactggtgatcaacggaatgaaatcacaaacaaagttaggtccaattgtgtaagtatgtccactgaaatttcaggagatgctatgctatcttactactgacctcgttgacaacattgattgggtggccatagatgtcattgtgcaccacattttcaaaattctgaggatactgtacaaaaccaatatcttggccttgctcttcatctaggaaaaaacacaatgcgtctctgatggactctgaattgtttgagtacatatcacaatcaacattcatgatgattggactgttgcttatcactgatgatacccttatctgcaaatattgaccataatttaaggaattctagaaacacgataaggttgactctaaattgttgcggtagaaaatcatggaccatagagtggctaaaagacccaccaaagcattcaaagatccagctttgaagtgatgctgtttctggggtttcttctcacgtgccatatatacaagtgttggcaatgcatttccatcaatatcaactgccttttgtttgttactatcgattaaaatctagccatggagaacactttgatcagcagaatccacaaatatgttgcagacaagaaaaacaaatttcatatcccattaaagtttcttgtgcatgtacattcttatatgttagcaattatgattagagccaacacaccagctttgttttaaaattttctaatcatctcattattctgaattttgaattcaattaaatgttcttcatctgttaacctggtcatcaccacataacttttacctgaactatagaagggtgatcactagaagtgaaattctcattccactgtgagaagcctctggaatggcatcgtggaacctcggggatcctacctgaatttactactgagttcacacgatctgtcatgtctttgtacagttcctgaaacacagaaaaaagaaagtaaaggtaataagtagacatgtaaatcactagtagtgcaccaaatggaagccagtaatagtgcacagactaaattgataacctgaaaacaacctctcgcgtcgctctcgcgcgggtggctcagggggcgaaaaaaccctagccgcccacgcctccactccctccccaccgcctcgccgccgccggagctcgccggcggcaaagccggcagcgagcagggaaggcggcggcgaggttcttcctcccggcgactccccccggcgtgacgtggacgggacgacgacgccggcgaagaccctccaccgcggccggaggtggcgatggcggcgcggtgtggggaggcagcagatccggcgcctccaaggccggatccgaccaccccacgcctggatctggcacaacggcggcgcgaggtggctgggggggcggcggcagcggcggcagggacggcgcggctggcccggtgcggcagcctgggcgcggtggcggtggctcgacggctgggatggcggctgcctagaggcggcggcggctgggagcggcggcggcagctcggcgcgcggccggtccgggcagcccgggctcgcgcggctcggcagtgcggcggcgagcccccatggcgcaggcaggcctcggcagccgggcagccagggtgacgccgcggtgccctcctcagccgggtgggctatgcggcgcggccagatggggtgcggcggccgggcgacgggggcgccggtgggttgcgccggagccggagcagcagaagcgtctctggcgtcggcgcaagcccagatggcagtgtaaagggagctggcggcggtgggtcgtcttctccgttgccggtcggcaccctcgcccttcctggagctcctccccttctctgtggggagtttctatgttggattgaggcggcagctcgtcaagcgggggaaactcaggctgccaaagcaatgccatccagtcccggttctccttttgtccaaagctggcgaggaggccggcgggtggtggaacggaggggtcctgggccagctctcaggggcggtggttgatgtcggctgacggaggggcgtcagtgcggtgtggttcgatgaagtcggtcgatggaggggcgtcagtgcggtgtggtggaagctacgtgttgccatttgtctgtgtagtggttctgagttggtggacggcgatctacagtcaaggttgtagggtcccaggcaaaagcctagtccggtaattcactgggccggcagcggctatgtcttcgggcgtcgtaacctccttggggcgttgtcaagggttaccctcttcctttctcgataagcttctctgggtgaaaaccacatcttttttagatgggcgatggcggcatcctggatgtcgtgaccaccgtggtggcttcgttttcggagtcttgtctctgtggtgttgccgtaggcctagcggcgttcggccattcttagcgggggtcatttggtgctaggcttcaccctcagcggtttgtgcttgggtggtagtgcgtgctgtgaggtcatgcaccttggtgcattgtgatgttttttttttcttgtaacttttactccttcttaatatatttggatggcctccttcggccttcccggcgaaaaaaaagtaatagtgcacaacagcaatttagttgaagatgaactacattacatcacaacagtttcaactctaccttcatggtaaaccactctttaggtccacacccatcaggaggggaagctactttagcaaagtaagcagctggtgatctgggttccaccttgtacttcttgcaaaatggaatccaatgctttgcaaactcggatgcctcgcatagaacgtagaatgttaaaaccgaaccagcatcatcagataagtagatgttcagcttctcaggcaggtagtcataagccatgacagacaaaacagtggagatgacaagcatcggtggctctgctgttggatccgctgtacagacaaaaatgtccacactgggaagctcgtcttcactgtagctgtttgcaatcaaaattctagcatcatagcatgtctttcaacaacaattctacatatcctttttgagcaaacgtaatcaatactacatatcttttttgagcaaaggataatcagtacatatccaatgaaagaacaaaccaagcaaggagaaggaattgcgacacagattaaccttgatagcagttgctggtactatcgagagccgggaggtacctttgagcgaggcggtctttgaaggtgcggcggtagacggggcaccaccgcacggacagcgtcaggacccagtagaagccgaaccagagctccgccgcgagcatcccgagccacgcccaccgccgcacgccgtcgccgccaccgggaggcaggtgagtggctctgtacagccatatcagaagaactcccgcgaagaccgtggccgcggacacccggtacgccgccatcgccatccgccccggtttctccgtcgcgaacagcgggggcccgcgctggcggccgccggagacgacgccgccgccgctccccgccatgctccctcctacctgcgaagtatggagcagatggcactgggacttcagaggagtgggtgagtgctactgctgactactgagtagcctagtagatggtcaacacaagcgaacgtccaaggcttgcacccacccgcggctgcgctgcaaagtttgacgtctagtagagcagcattactgttcatcaggagaagatgatgaaatggacgttgcaggcatggaagttggggtgaaaacagcagaaatagaagggatattatgctatagatatcgaggggaaacccctgaaacaaaatatacacgagatgactccactggtacattgttgcatggtgctatagtagatttaaaccaagatatggactgttcaatcgcaagttacaactagtgtcttctattgagctgtgaccacttctagtcttctagcatcagttgcttgtcggctgagattgtaatctgatttgtcaatttccttttcttcaacagtctgagcttcatcagcaacaaagacaacctgaaaggaagaagctgcagaatatagtgcccagtcagtaatatggtatccaacagctgaaagtggcttaacatgagatatattgagaattaccaagatactagagattaaacattgtcctcgaaatcttcagctaacattgaaaaacaaatccatccttttatttgaagagctttctgagcccattgaacaatgacagagctttaagttcaccacctctcatgtccctcagtctcctacgcaatatctgtaagaaaaaagagggttgtaacttgtaagaagttaagaataaccacatgatgaacacagagaagtaacaatatagcatgcattattgacttacatattgtgtacgatacaggattctccgttcactaatgcaaagatctcttgctagttgttttagcagtaacgtccggttggcttgctttgaattggttgaaagttgcagagacccactgctaccctgaaacattattgattggcgtacattagtttgttagcactcacaaaagtatccataggatcatcagagaactagtttgcataatgtactgtttaaatatcacgataaattaactagaagttctgcaagatcttccatggaaaggatctcacctctaggaactttgtgtattttgctatgttagactcacaacagtccaagataaactgaagagcttgttcctccagttcaggataattaagtccaggcttggatggacttttatttgatgcagcgacagccatctgaaaggataagctttgggagatcactcatatagaataagtgtaagctcaatttatcttcaacaaacccctagttttacctcagtcaacaagatcccgaaatatcggtgcaaaacagaaatgacaaacctcttcaaaacgttggctcatctcgggagggctgaccacaagaaaggcataagccatcaactcaactggccatcctgtgacgcgtaaagggaaactttcaaacctgtaagtaatgaatcagtgatcagatccacttatattgatagcaaaagtacgatttgatagtgacagagatgtgcactgtaagataatcgcaggggagttgaaacaacactgcatattctaatatttatgaaattttactcatttttttttcttctgcagaccacaccagttacacaactaaatactgttttcagacttcgttcttgatggcatgttcaaatggcgataagagagcaaacatgccacaaaatactccagcctaaggtctaatggatgttcattttagcaagatgatataaaggcacaacaacgcgacagttaagagaacattttctttcactcactatgagttgttagcacgcaaggatatgatcgcttactctgacaatccatttctttttagtgcttgtagcttctctttgtagcacttatcagacttattaagagacaccagcaattcaactgaatcatttgggtttgttccctcttttggaacaaaaccatatgaaagcaatagctcgccactggatttcttgccataggatataaacacctgaagaggatattttagaaacggataagtttaagagttaactgcatgaaataactacacctagacataacccacagaaaaatctcattaactccattttaaagaaaaggatggctgacagatccaaatgttccatgaatcacacttaagtacagtatgctatgtttgcacaaaacaaaatttataaaatggatgaactccagatgttttgggaacgcatcctaaaactagtgtcaagattcaagatgatttgcttactactccctctggtcacaaataagtaacgttttggaatgcgtccagtcaacatgttctctttaaatatttctttaatcgtcaccatcaatttctttaaatatcttgattcaacttttgaaagtgatatggttagattcatcttcaaaaaatagtttccaaatattataactttgatatatattttatgagttttatactagtaatttgtataaaacaactgtaatggtgactgtgttgctgtctagaatgacacttatttgtgaccggaggtagtaataggcagagataccaatctattggtagaaaacaaggatcctagtaagttgaattttttttgacgtaataatttttttttgacgtaaagtaagttgaatgaaacagtaaaaaaaattgctatcatattcacaaggttaagttaaaaatccccaatcttgaaacagcaatatagggctaaagcataaatgaaaagcgttacctgctcacctggttgatatgaacgatcggtagtgaaaactattccccctgaggatttatcataatccaagaatgtttccacctgaaaatttattttgcaaaaaacttatgaagtaatctctaacaataagaatgtcatgaagacctatgaaattgtacaagtaatgaaaactatgggagacagagtgcttaaggaattctgtgcactattcataatgattctttgttactaacatacaaatcgaacctcaggactatggttaagcatatctgcccaaggaactagtgcaacccttccatccattgatggcaatcgaacctgcaaatcattccaatgaacattcttgtttagcagaatgacatcaacagcaagcaatgcaaaagccttcaattttgtaacaaaacaggtaactggagaatacatggtggaagtaaaaaaaatgtttttactgcatttggtaagttcatagtactttagcttaccaggcgtgagaagaggatgccgaaggaccatctaaacgtctctaagttgtaaacctaaaatagtaaagttaagttatattagataaaccaaccaggttacactaaaaacacatgatattttagaagtaatatgtgatatctctcatgtgagtgaaccagtacatttcttagtgcgtagtatgtagaccactttcacatctttgtgttagtactgaaagctaaagaatgatataatccttagccttgttatatattttaacttgctgagacttaaaaagtagaatctaggtcggaaaggcctcttgtgtcattagtctcaacaaagaacatactaacttttgtgaaacatacctcctcagggaacaaatctgaatgcttagaaaatattctgtcacggagatcattgtatctgccaaaaccaacagagtaagattttacaattaaggctaaatgaccatcaggactacagcagaaagaaagaaaaaacatacgttccgaccacatcagtgatcctctgaattgcgcgttccctgatcggcgaagccaccaagtatgcatcaagctcaggcctagtcctgcaacaacaaataaaggctgtacaagattgagaatgcaatctccaagccccaccgaacttcccccatcaacaataatcgtcaggctataccagtacaacagagagtaaggctgccttggcaacgccgctatgtagctgctccacctcgacgaactctctaaactagcttcgcttataaggtaggtagcaataagcggccaatccggcacagaatttctcttcaacacattccccacctcagggcagccccattcctatacaagaagcacaacaaaaatcaccaaattgacagtaaattcatcacatgaagcacctgaaatccaccattaaagctatcaacgagcgggggtagtgactagtgagagggaggctagggctttcttactgagtcagctgtaatgacgagggagggaggcacgaagagcagcttctcccccttgcggatgttcttcagcgcgacgaggccgcgctcaccgacgtccacccgctgtatccccaacctctgctcggggagccccgaatcggtgagccacctctccagcgacacggcgctctccagggactcgatctcgcagccccacgggactcccgcggcggcggcctcccgctgcgccggcgccgacgccgacgccgacgcagccgaggcgcggacgggggatcggatgaggactcctgagggtaaggctagatgctgccggagacggcgaggcgagcgcggcggccggaactgcgtgtggagcgcgagcgccgcggcggtggccatggcggaaccgcgaaatggcggtgcggttgtgtgcgggcgcggggggcttatccgctttgccagtcgcgggcttggcttttttatgcgacacttttgtgggctggctgcaattattgggcctttttgtttattaggccgtgaggtagtactacacggaatgaaataagttcaatattactcccatagctagtggtggaatctgattcgtatcccaaaccataatatcgatatatcgacccccaactattaaaaccggtgcacatttgacttcctcgatgattttggaggatggtttcgctgatgtggcgactacgtggtggtgttgacttagtcttcgtcctacgtgatgccaccgctatgttgaccaagtctcggccagcttcacatctcccccgtctctccctactacaagctctcccggcgacggtagccggcggcggtgccatgtaggataaagaccaggtcaaacaccgtctcgtagttaccacgttagtgaaactgccatccaaaatcgttgagggagtcaaattacactgattttaatagttgagggtcgagatatccagtattgttcttcaaggatacgaattagatttggccaatagttaagggagtcaaagtgaacttattcgtccacggaatcttactgacaggtgtggcccactggactgacagtgtgacacgcgctcctagttgacatcaatcgccctcctcttgtgggccccgctctcgccaaaaagaaagcaacagaattcaaacgcaaaacgtcactgacaagtgggaccctatacgtgggatcactctttcccctctcgcaagaacatctcgagcaataaaaaccccgagagaaaaaaaaaagaatgctcgccattttccccaagctcccgaagcgatttccatttcaactgctcttcctcccttcgcagcacgcacgtcgccgtagccacatggccgacccttccagatcctcccccaccgcggccgccgccggcgacgccctcctggcggcggcggcggcgcccggtgacgcgccggacgcgaccgccctcgccgtggcggccgatgcggacgcggagttcgggttccagcgcgcggagctcgggacggagaagctggccggcacggtgcagttccacgagcgccacgtcttcctctgctacaaggggcccgaggtgtggccgtcccacgtcgaggccgcggagtctgaccgcctcccccgcctcctcgccgccgccatcaagacccacaagtcggacttgaagaagaaagtgagtgtttcttcaccccctcccccttttttgggggctgagataagctgattcggtgctttcatgtcgtattcttgattgtggtaggtgtttttttttacttagatcggtgtgtagtgggaactgcttggtggttttggcccaaccctaggattgtgctcgccaatagagttcgattagcttgaactatcatgtggagtagtgtgattttgcttgtcaggtggcagcatatgatgaggtgatatttcgtgtacgaggttttagcccttgctaacaaattggtcgatttgatgggtgttttgccagatggtttaattgttacctgcctgtgattgtaaattgagaagtagagcttgttgacgttgcagtgatccaaggtgcagtgctgttcataagctgatgtttcatgtcagtttatgctatatggtcctcgtgtcacttgttaccatttctattattgtgttttggttaacgatgtggttatcggtattctcctttaaggttagggctatttcagttggacatgtgaattgtgttttgggagtttggacattttcaggattttacttattctgtttgtgtatattgtggctgtgcttactaaaataaacggtgattcagtggtatcatatagtattgcagttacagagttaccgaaagtgcagcaaaatgcttttggctgttgttttgtcctaagagagtattcgcccctgtgttgccaggttatagaggaggcagtatttattgtttgttagaattgggggtatggcattactcagtattatcaaccaacctacagttgcttattacctggccttatgctagcttcattctcattagttatgaagaaaattctaggattggaagtatttctaattggtatttttcttgctaatgagtggtgtattcattcctcagaccaaattgaccatttgtgaaggagaagatggcactgagtcatccaatggagacgtgttgatctttccagatatgatcagatacaggtaagttctaatccccaaacaaaataaacatacaatctttcttcttgtgttagatattctgataaataagccagttgattatctctattcaatttgtcatgtaatgtttgcagagggctgacccactttgatgttgacaactttgttcaagaagtgcttgtgaaagatactgaatggcttcctggatctcctgaggctataaaaggttcctatgtttttgtttgctgccatgcaagcagggataagaggtgtggtgtctgtggacctgctttgattaagaggttcaaggaagagataggtgtacaaggccttgctgatcaggtgtcagtcagtgcatgctcacatgtgggaggccataagtatgcaggaaatgtcattgttttcagtgcagatgccaagggagaagtgactggtcattggtaagaacgaaagtgtaattaaatttgtatgcaccattgaacttaatgctctaatgtagctcctcattttaattatatgcactataactcagtgcttgcttacctaaattgcatttgtaggtatggttatgtttctcctgatgatgtgcctgtcttgctacataaacatattggacaaggagagatcgtggaccatctatggaggtaccctcttgtacttaaatcacaggctgatgtcaacaaggttgatattagttctaccaatcatttgtatcttgtgctgtgtggtgccatttaggactgtcaacatttcaatttacatctttctcttgctgttgttatcagcatgcatgtcacatgatatgcttatgcaaacgcacatcacagcatgtcagcatctatgactaatagtctaaacactgtacaaaatctgctttgttgttctagtttgatactttggttgtacgtcttgcagcatttatttttttatcttatataaaaaaatggttaacttcaagtgcccctcacaatcttcaaaattattattattttattatttaagggagatacgataccgtatcagaagtctccatttgaaattttcttgagcattataataaagtaggccaaaaccatgtgctacaagcatgtgtggagatgaactctgatgtagagttgactttgacttcatccagctgaattgttattcattcaggaatgcttatttttgtttgattccatcgccaaattattgtttattctgccttctagtttgttcaaattacccccttgttgatgtgagtttttttttctcaaatgagtatggttgaagcatcggtgcctatattatgtgtttgtcggctcacatcttgtctataaatatacgcaaggataaggatattttgctatatttgttgcatttacaaatctccctgtagatttaattgtggcaacctctgaaataaggaaataacttttatgtggttattcttttccgcctcaaagaatcacaattctcattctaatcattaacaaaaacttgtaatcttgctttccatatattatgcaaaacccaatatgtcaagtatgttcaagtgatccttctctttgtggttcttatatgtatcatcctattttgcaggggtcagatgggtttgtctgaagaagagcagaggaaagccctggagtctaaacacgtgacaaatggtgtgaccgaggatggtgcccatgaatcccctgaagaaactaccaacggttctgcttgcaaccctgtcgctgcaggtggttgctgccagggcaatggaggctttacctgctgccagagtgatctgccaaaggaggataagagcatcacagctgagcagaaccagaagagctccgagaagggggctgacaaagagtgtgctgctggcagcaagaagaggcacatgaagatgtgttccatgccaacctggtttgagacatgggaaacggctgacacctatgctgctcttggtattgttgcagctgctgcatcggtgttcgtcgctttcaggatctacaagaacctcaattgagaatcctcagaacagggctaggttttgtgcactaaggacagtctactgctgtaaaacagtctgctgtgagaataatatactacgtgtgcatagtaatgcaagattagaactttaaagtagctaatctgaagaaagtgaccaaagttgttttgggtaatgtcgtcctcatgtgaaactctgcttaatctccaagttttcccacgccttgcctatttgtttaccttcgcaaggcagtgaccctgctgttcgacatgacgatgttatctttattttgaactggaggtgttcttcagcatgtggatgcatgctattcagaaaatggtcagcttgtatttttgtcgctggttgctgctcctgttgttgaatgttttgagcactccatttatatggtaataaatatttcattttcaatttgccgtggaccccgtggtggctctgatcacaatattaagaggatctcaagtattctctacatggcaattctgttcttagccccctttgttctcgcagaaaggcaccggaggtggctgcggcgtctggagagtggagtggagactgacgctccggcaacacagcgtttcaggtccaaacataaccgcttcgtcaccactcaccagcacgcccgatgcaactacttcactgctgcttcttcctggtacgcctctacagcgcttgattttactggcaagatactgtgctaaataaggggattgggatcggagaaatattaggtccataaaagtaagaaaaaaatattaggacaaatctaagctggtgaagaagcagtgaagaaaaaaatacagtacattatttatcacaggctcatactataaagcatcaccgttccgatctcagaaatctcctctgtacagcaaatagctgtggacaacagaaaactagactgcacgtctgcacaggtagagatgagagagcacatgcccaatgcagtacatcgtttgctgaaatagtgaaatggatacgtgatcgattggtatctgtggtccgtccaagctaggatgtgtgtaagcagaaatggaggcggcaagcaattgctgctgcagatattgcagtcgcagatacatgtgctgaactgccagccattcttaaatgatggtggcaaacattcagagatatggtgtgcccacgatttaactttccatttgtgttgaagtgtgatcctcagcttaaatgttttggttacatatagtgcaagccgttgtaattctggcatgtggccatcaaggcatcaaatagttacagtagaatggccactggcctggttagcaatcacatggcatcatgaaccccctgcattggactgaactgggataataatggctcacatgcaactttggcatactgcttggccagaagattagggctgcaggaat

SEQ ID NO: 1890 - DNA, 742 bp, Oryza sativa
atcaaatctcttgctgagaagctgacaattgggtactccgggaagcgcaatggctgaccaatgacattgaacagtgttgccctgttgccagagcccttgaatggtgtctttccaaacagaagttcatacaagaatatcccgaaggtccaccaatcgacagcgctaccatggccctcgcctttgatgatctctggggccaagtactcatgtgttccaacaaatgacattgaacgagcatcgctgggctccgctatgagctccggccaagggctgatctgggtcgcaatttcaggcttcggtttgcgatctttcttggatttggagaagaatcgagggccaaagcaggttgtaggggctgcacatgatggctgaatcacgcaggatggctcgacgcatgctggctggacacagtaaccttggctgttcttcctgagtgcttcagcgtccgggttggatgattttattagtgttggactcaccgcgcaacggagtgagaggtcaaagtcagatagcatgatgtgcccatcctcccgaacgaggacgttttctggcttgagatcacggtatatgatgccgagcatgtgcaggtactctaatgccaagaggatttctgctacatagaatctgtaatatgacagcaatgcagcattttattagtaaggctcctaagacagtagaaggcaaaaggtcataaattatagtaagctagacttgccatttgtcactactgatttcacatgaa

SEQ ID NO: 1891 - DNA, 5576 bp, Oryza sativa
  unsure (1)..(5576): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattataagtagctgataattccacattcaaggtctctcaggttgttatgatgctcaaatgtactctctctggtttttaatgtttgacgctattgacttttaaacacatgtttgatattttttcttgttcaaaagaaatatagaattatcatttattttgttgttatttgttacctcataactatggcttttttgtatatatgtatagtttttaaaataagacaagtggtaaaggtatgtttaaatgccaacaatgtcagccattaaaaactgaagggagaaacgtcctggggttttccggctagcttcacaaggtggtgggttagacgacctgngttcgaagcctcacccctcctaattatttgatattaggtccttccctaatacttgtgtttttcattaaaaaactgaatgagtaacanttttcagcttgggtggagacagaggattagcacaccacatcatgtcaactatcaagaagtcctatttatcatgtaccatactattggttcctgaaaacagttggcccatcttcacttttcagtcatggctggcacaatcactccatttctgcaataaaatgcagcttggagatcacttctaactaacttgctcttgatcgttgcagcgcaacatcagctctgtcacacgttgtgctggggcaattcaagaccatagtcataatgctctcaggttacctgatcttcagctcggatcctggaatcaccagcatctgcggagccatcgtcgctctcggtggcatgtccgtctacacctatctgggtctgaaagagtcgacgacaaccgggaagaaaccgcctttagcacagaagcccaaagctgctggggatggtgagaagcctggtttggagcatgaggattctgtatgagctgacgaggattattcatcctggttggtcgattgtactataagcatacttaggtgattctccaagagttgtacgccattgctgagtccattgtacatagaaacacttcatgattttacccttttacagttcttaaaaagttcaaaaacattgcctcacaattctcttcgtttcttttttcttgctgataagttccacagttgatgtcacgtaagatgaagaacatgtcagcatgtcacataggataggaaccacgtaggaggaaaccacgctctaaaccattcgggaaggtaaattggtccggttttaataattgacggagcatctatacccggttttgtagttcatgaacatgaattggactcggcctgcagattgagggagaatatatgaaccttttgccatattgtttttctaagttgaaacgggggacgcgtgcgaaactggcccattatttctttggatcaatatactcaagttttgggccggcctggcccatctagcaagcgaggtagttatagctctctcgccgagggcccgaggcccagcattaaaacgagcggctctttcccctctccgccctctctctctctctctctctctctctcccatggcgaagaagggcgcgccgcgcaggcagccgccgccgccgccgcctcggcaactggccgcggggaagaaggggaaggcctccccgaaggcggcgaagagggcggcgcccaagaagcagaggctgctcgagtcgtcctccgacgactccgagctggagcagcagcaggggcagcttcaggaggtggagtccgggtcagacctcgacgtcccctctgattccggcgccgaggagctctccgactcggacgacgcctcctttgagggaggagacagcggcgacgaggaggaggaggaagacgatgaggatggcgacgacgaccccctcgctgacgacttcctcgccggcagtgacgacgaaagtggtaatgcacggattactattgaatcgaattagctttaacaacgtgcttttcagccttttccccatcaagtcattcgattgtagcattcacgcgagctagtattgtaataatcgataatgggaatgcaatgctgtattgtacatctaggggaatatctattgatgattgtattgtgttttgtagacggaggagacgactctggtgtggactcagatgagtctgatgacttagaggcgaagtcgcgagcgattgatgaagagaaagagaaggcagaagaagaggctgaggaggagctcaagctcaatattagatcagaatctgatgagttccgattgcccacaaaggaggttgatttttccaccttcttttatgtcttcagttttacgtgccgctgaaggtccgcaagtgatgtgcacatatatcatagtttgtatgctctgcaggagttggaggaagaggcacttcgaccaccaaacctgccgaatcttaaaaggaggatatcagaaagtgtgttcatatatatattttgcattaccaagtttatgaattttttagatgaatcagagaaaactcaattgagatttggcataatattagtgagctaacaagatgtagctgttctcttgtgtaaactccaaggcacttcgaccaccaaacctgccgaatcttaaaaggaggatatcagaaagtgtgttcatatatatattttgcattatcaagtttatgaattttttagatgaatcagagaaaactcaattgagatttggcataatattagtgagctaacaagatgtagctgttctcttgtgtaaactccaagggcaaatttaagctttataactatggtcattttgcattgtgatagaagcattgaatatttccctttctgacttttctttctgcccattggtcttcccctctagttgtccgggtactctcaaactttagtaagctgaggcaaaaagatgtgccgcgaaaggattatgtcaatcagctgaagacagatataatgtcatactatggatacaatgattttctcgttgaagcatttattgaggtgagcttggtgccgtttgtttctttccattgagctgtgcgtttccccaactgcatcaggttataattagaaattattgtctgacatgcttattaaaatatgatcatggtttacctgctatgagttaacagtatacatatttttactgcgcagatgttcccagctgtggagcttgttgaactactggaatcttttgagaaaagaccgcctgaatgcttacgaacaaatacattgaaggtaactatttcagatctcctgatatgtatgtatgtggtgccatggaatacatgattctttatatgtgcttcagtcttttctttgcgttcttcatcgtccttacctgctttgttcatgatgttggcagacccggagaagggatcttgctgctgctcttataccaagaggatttaatctggatccgatagggaagtggtcaaaggtatgctttgttcgatcttctcctttactcaagtaatatatccaacatcccaaagcaactctcctggtataaatggcaggtaggccttgttgtatacgactccaccatttcagctggtgccactgttgaatatatggctgggcattacatggtaccttcttctccgatatcattgtgtgtagattatttcatttgctctccttccactaatgttggtattaaaaaatgtgactacagaaacaaggtgcaagttctttcttacctgtgatggctcttgctcctcaggagaaagagcgaattgttgatatggcgtaagatgttttcctttgtctcatacacttttggcaattgttcactatcatgacttctaagttattatgtgatccttttttttcaatgaacatgtaattgtaatatgccatgtatgtaatctagtcatgctgtcttgatataccactttgcttctgaatttgatgatacattcaactgaattaattaccttgaattcatggaattcatgtcctcgtttctgatcaggaactcattcttttcttgtttccagggctgccccaggtggcaagactacatatattggagctcttatgaagaatactggtcagtatgctgcctgtttttaaatacattttgttcctccattggagtaattttgttttgtgtggtttcttgccaattgaaatgcaaatatactgttttattcatttgtcatgcacaggaataatttatgcaaatgagttcaatgagaaaaggctgcatggacttttgggcaacatacatcgcatgggtgttaccaataccatagtttgtaattatgatggtaaagaggtgagcaaacagtacaaatattgttaacgtgctatctgatagccgaaacacaatcaactaattttatgcattaagaaagaatcttgatttgtggtatttgtcaagtacttagtataatgtaactacagtatattgttttgtacaaaacgataacagaatgaaaacacattataagtattgttacataatctctgaccaataatttttggtccattttaatcatggagaagataaatgtcaagtcctaataatttttggttgcttgaattgggtgcagcattttctcattgaaaacctattttgtgataacattctgtttatttcagctacctaaagttcttgggatgaattcggttgacagagttcttttggatgcaccctgcacaggcacaggggtaagcatcatatagttcgtataagctcctactcctgtcatattttctcatttatttaaacagatgcttactttttctgcagaccatttggaaggatccacaaattaaaacgtcgaagggcattgaggacatcagagactgtgcttttgtacaaaaggtgcatttcttgtatttctaggtcttgtttaaattgaacctacttaccatttggcatattcccacctaacaattctaaatgcaattcttcttatgttatcgaggaaaagaactgcattccactcacattattccaattttgattcttaaccaagtcacttgcttaaaacattattggttcgtcctcgtgttgagtttgttttttgggggtcatttctaagcaatttatattgtgcagttgtgctgattcttacatggaaataacatataaccccagaattgctatgttctgtttgctcatttttatggattatgtttacttaatctgtatttgctaagctatgtgattgtgttcaatcataatttggtcttttaagctacacaatttttgtttggtcagttttttctaaatcgagctgttattctatactggttgagtacctcaatcaccttgaaattggtatgtataccactatttactgtctaactgatgagttgttttacagcaattgctattagctgctattgatttggttgatgccaactccaaaactggaggttacattgttgggctgcaggaat

SEQ ID NO: 1892 - DNA, 12499 bp, Oryza sativa
ccgtttatcctacagattcatccggttccgagagcatcgattccatacttctttagataaaacaaggagattttatccccatgtaaacaacatggatggtttttttgttgcgaaggtaacaccaatgctaaacttcatggtgaaatatctaatctattaaataggttgtttgatcaggtgcttatttcattattaggatgtgctgaatgtattgaactctattatgaaaagtttaattttctttgcttagtttggacataccatctgattagggtacttcctttgacgcagcttaaaaaattgagcaatacgatcccagtggcatctgagtcatctaatgtgcctgaagaagcaattgagaaggctgatcctagcagtgacgatcctcaaaaacagcccattcagtcaaaaaaacataaagatgtgaagacgacgaatgaagagacaagcatccttgatggggtgactaaggacaaaaggcagacacatgagacactcaagaaccacaagaagggtaagaaacgcaatggccctgagagtactaaaataaagggagaccagaaagaaacacacaacgaagaagagcctacaagtgaaaaaaagcagcctgtgtctgttaaaataaaaaaatctgttcccaagagaatatcaggtaacaaaggaaagaagctggatacgggcaaaggagagaagaggaaaagaaactggatggtgaggcgagactggtgagatagtacaatgatgttgtgccttttcatgccttggaattgttgttttcgttgctttattctgatttggtgtaatgatcttctaacagggaagcttataagaagtcgaggagtaaacaagtatgaaaggcacggatgaaggagctctagccgtagacaaattgcagttaaatttgaaaacccacatacggggaagatgttagaaggagcgagaatacacaattttggcgttggttcaagttcgaggcgaaggaaaatttttgttgtacttaagtctagtgaagtgatcgtctgtagttttaccctttcttttccgtcttggtttaatgtaccaatactaaggcacttctcggacatgagttatgggagtatgtgattgacttcgtcatgttgcctggtaagtactatgctggccgatggaacagtatgatgttctgcttgctaagggcgacgtgtggttgtgctcagggttaggggcggaaatcgtgctggctccgctttttattgagctttctttgaaattaatttaccttcatatttaaatataagctattcctctgaaaaatatataatcctgtggtctttgtgtgtaactctgatattgtttttctattaaaatacaacgataatatctaacataattatactaatcgtatgaaaagtatttagaaagaaaaatctacccaaatcgttcaaaatcgaataatttttatcttataagaaaccaagccagttaaacgactaattaaacgagtgggtttatcgctgcttcatatagttatattccttatgtggtggatgcaaccatggctgaagcagcagctttaagagatggattattattggcacaacaaatcggtcgtagtcgtgtggaattccaatcggattgcatggaagtcgtcacaacaatgcaagagggaggtttttctgccacggcagcagttgcgatttatgatgaatgctcccagtattggaaagattttctttctatctccattagtcattgtattagagatagtaatgtcgtggctcatgagctagctaggcaagctttgataggcaaaaattcttttgtttggatagatgatccccctgatttcattcggcaacttcttcttaacgatgtaactattttctcgaatgtaaagctagctgtgagaatttaaaaaaaaaacgagtccaagcagattagcgttcgaatactcgaattgataggttcatgacgttgcgggggttcaggaaaatgaactccgaccagggatggatccagaaaaggctcagggcctggttagatcccactctaaaattttttactctgtcacattgaacgtttgaacatatgtataaagtattaaatataggctaaaaaataactaattgcatagattgcgactaatttacaagacgaatcttttaagcctaattgcttcatgattttacaatgtggtgctacagtaaacatttgctaatgacgaattaattaggtttaataaatatgtaattagttttttttattagtgtcgaacaccccatgcgacaccctatataatactccctctctacttttgataatcatatttctaaatctaaaaaaaatatttttataggtatatttcaatccaacaatctatcctcttgaaagattgactacatggacatcgagaaatgtaaatattaatgaatcgcttatttatgaggaatgattagtaacatgtttaaatggatgataagtagaattactaatccttggtctgtgtggcaatatgaaatatgactatcaaaagtagatggagggagtacccgatatgacacgctaaaactttacacccctcatctaaacacctcctctgttcgatgcccagctatagcccaattatttatttatttatttattgcggagagaaatattcaattttgatggatcattgcagtaatagccatgaaaccaagcattaaacatgggatctttagcggaagataacattaacacgaaaataccaaagaacaacctcacacaaaaccactatttattattccatttacgagaacttacatgactgtaactcagtaacactttgataactaatcacatccttaacctgctacttagggcaatatattcatcctaataaagtaactcctgatactaactaagacgaccgtggctgtggtgaagcatcagatataccaaggcgacacacctgccaaaacacaaaaataaaaaaaggtgttagatccggatcactttttttttaaaaaaaaacagattgttcaaaattcagagaattccaaacatgaatttacctgaagatctatggcgacacggaggggctagcaggcgctggagcggcaggagacctcggaggcaccaatggcggcaccgatggagctgtcaaacacaacaacaacagattagattaatcccttcatcaaacagacaatgcgcattaaaaataaataaacatgatttgtgctagggtttaatgaggtgtaattaatcgaattttaacttacaggagcacatgaacagcgtctgcagtggtggcatggcgccgcaggtgatcgggaggagcatcatcttcatcgggtcgacgggcgtggggaggaagctgttgagatcgccgttcatgccgtggcagaggcagatgggcgcggtgctcacgagcgacctgaagccgtcgcagcaggtggccggcggcgtcggcacggcggtgttcgtcaggtagtccgcgcacggcatcacggacatcagcggcgtcatgcactcctttggctgcggctgcgccggcgagctaggttgcgggagcgggaacggcagagggaacgggagacccgacccggacgacggaggagcgccagcggccggcgagccatgcgccgggagcgggagcggggacggcattgggaacgggaaacccgacgacccagacgacggcggagcgccagcggccggcgagccaggcgcagggagcgggagcgggaacggcaacgggaacgggaagccgccggacccagccgacggcggagcgccgccggcgccggccggcgagccagggatcgggaacatcaggaacgggaacagcgggaacggcaagccgggtagtaatcccggcaatgtcgtcggcggtcgctgcgctcctccgctcaccgacgttttctccacggcaatggccggctcgaacccttggaccctcgcttccgcggccggcgccagcgtcgccgccacgacggcgaaggcgaagaagagggcggcggcgagcttggacgacggcgccatctctctcgtcgggatcggtggctttgggtggaggtggagaggtggctgatttgctgtgaagagctacgtgggatcgctcgcaatatatagtgcattttcagttagagatttggggtttgaaactttgaatattcatgtaatgacattggactctggattaattttcgtacgtaattaagcaggtaaacatatatccagcgaactcacgagttcaaaatatgtttgatgcttttgtaaaaaaaataaaatctctgctctcgtttgcctgtagggctgtaagagatgatacagcgtacttgcacttgcaaattgcaatgcggatataatgtcaggtacgtgaaattcttcacatttttcagataaaagtagccagattttaaatgtttcccgttgtttttcatccctaagaggagaagactaccattgttaccttacatgcatggtgaagttggagctaatacttctgtttgtaataatgagaattcaggactttacactgaagaattaactagtccaactagtatgaggttctggctctggttttgctcttcctcgaagagataatacagcccctaaaaagttctgaattttctgacgatattgagagcatagaactcttcagttttcagataaatcgcagagtctagttagtggagtatgacgttttgtctctgatttcgcttgcgtcaaagagataacataactcgtaatagaaattatgaatctctgatgatattgagaacatataactcttcattttcagataaagtagagagtattatcaatttcttaattccataaggtagaagtacgccattgttgcgacacatacatgatagtcgagagttatgtaggagtactaatcagagctatgctgaagacatgacactctgcagtcctgaataaattcaaattgcgtcttgtcataatatccagtttcttactccctccgtcccaaagtaagcgcagccgtgggaatccgtgttcaacgtttaaccgtccgtcttatttgaaaattttatgagaaaattaaagtaagttagtcacacgtaaagtactatttatgttttatcatctaataacaataaaaatattaatcgtagaaaaatttcaaataaaacgaatggtcaaacgtgagacatgaacagtgcaaaactgcacttatttagggacgaaggtagtagatggggtctttgattcttactagtaatttctattttctggatcacaaattcaaaacgactagatacgggccattattgggccgtccctgcgtaacaggcctaagctgagcccaattccacggccttttcgggagtttcttgatagaacgggcaggaaggggcggagttttcttctccgaacccctccctctccacgcacacctcgccggagcagcacagccgccgcatccttgccattccctgcttcggtccaacaccatggcactcacgaacgacagagaaaagctatgtagagcgtcaacttggcaaagttctagggcgaagtagaaaaatgcctctgatcttgttagggaagatattttgttcttttcgaaaagagggtgctgccgtagaatttcatggtcccattgttttatgcagctagcacagagttatggtttcgagaattgcactcaataattcagatgtggctaatgttagttatttcagcactgtcttggttacattgacaatgtgatctgactgactacatgtttttagcggatacacagttaaaaacgttagctttggaaggccatcagagaccccaggagggtcggaattcggatctccgacccgtattttccttctccgctgccatggcagtccttgcttgctctccctttacagctttctttcctcatagtggactccggactccatgccaccgccatcgctgccgcctgccgcacgcaccaatatgcatgtgtgctgatgtgtgcaaggagaccgtgataattgtcggctcatctgatccgtatactccgaatcgaacggccaacggggtttggagttttaatcctcgaaccccctcgggcttagcacgactggagaaagtgtgtgattggttaaaaagagaaagtaggtgaaaaataagggttgtgattggttgagagtaggaggtagagaaatagcttcattttaggacaaggtgctgtactagaaatacctacattttataatggaggaagtagtagacagaccaggccacatcctcctcttctttcggtctttcatacctgcgtcagaaaactgaacagttggccctgaaagttcagttaggcccaggaggtaatccgcgaattctcttcagatttcagcgccggcgcccggcgggcgtggcgtgcacgacgaggagcggccgcgtccatgtctcagcctcgtcgacaccgcatgggtcggcggctcggcgccgccgcgcgagcgccacggcacggcacggcacgagtccgtaacacgacgcgatccgcgcgcggccgtccgctgccgtccgcattttgcagatggagagggacgtgtacgtccgatccacgcgcgcgcgctagcttaatttcaacaggtcggcgcgcgccgcgcaacggatcgacgccgcgtccccgtccgtctctcccttcccatctcctgctgcagcacgcctgcaccgcccgcacgccatcgtcgtctccgcgaaggcgattatcgttggaaaccgggaacagcgcaatggtgtgtttgtttttgttgtctatcgtctctcgtggagtcgtggtcgtgctatgcagaaggagcatctttctcccacgcatatgaccactagtggagaaaccctttgtagtcccggttcgtaacccccctttagttccggtttccaaaccgggagtaccaatctgggactaaagatcgctatctttagtcccgggtgaaataaccgggagtaaagatcgatctttagtcccggttggtaacaccaaccggttgagccatctttagtccgggttggtgttaccaaccgggactaaagatagagctgacctttttttttttgcatgcccctgttgctgcatggtttatatatatatatatatatatatatatatatatatatatatatatatatatatatatataaaccatgcatatatatgtttcaatacatatatatgcatacatatatatatgtatttatacatatatatgttatgcaaatgcatatgtatatagatatatatatatgaacaaaatatatttacattatagaaaatgtgtacacatgcatatagaaacatatgtagtcatgtattaattacaatccattatatatcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctttaccgagttcgtacatgtatttcacttccgccttttcgattggtgcgactcctagcaattgatccgtagttagaccggtgtcagtaataattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcaaacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttatgtgggcaagcggtggagctggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggttctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcaactcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcaatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcaaagtaacatatatatatatatatatatatatatatatatatatacatatatatatatatatatacatgtatatatatatacatgtatatatatatacatgtatatatatatacatgtatatatatatacatgtatatatatatacatgtatatatatacatgtatatatatatatatgtatatatatatatatatatattgcatttcacgttaacgttcgtcctcgttcgttcgctcgttcacgttccctagctcgttcacgttcgttcgatcgttctcgttctcgttcacgttgtcgcggcaacgtacgttgacgtgttcgttctcgctctcgttcgttcgatcgttctcgttctcgttcgttaatggcggtgtggcggcatcggggaggcggttggcgcggcggcgtggcgacggcggcggcgaaggcggcggcggcgtggcgttggcatgcggcggcggcgttgcgcggcgtcgaaggcggcggcgtcgaaggcgacggagagagatcaagatcggagagatcgagatgcatgaagggagatgcggcggctctcaccccagagatgcggcggcagcagaggaggcggaggcggcggcgaggacgacgagctcgagacgacggcgagatacggcggcgtcggcgcggggatttgccctaggcagtggcggcgaaggagagaggccgagagagatcgatcggcc

SEQ ID NO: 1893 - DNA, 1518 bp, Oryza sativa
ttcttctccccaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaatttgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcagcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacaacgctgttttggttcgtgctcttcatgtcttgggctctcgtgtag

SEQ ID NO: 1894 - DNA, 968 bp, Oryza sativa
caaacaattggagtcttgggtgaagacatcactttttgttcccaagaacctatctccgactgtaatttccccgaaggagtacaagataagattcagggcattcatgtctcagtatttcctatcagttccagatgcttgagttgatgagttctgaggcgttgaacacactctggcttttggtggctgaacttatgttgagtatggtttggttaaatgcctgtttggcatacagtaaatcatctcatgagttcaactttaagtttcattttattcattttttcaagtgtgggtctatcaccatccatactgcttcgcagctgctgtacatagcatttaggatataggttccgtgggggaccacaaattttaagcaagggagcggtgactggacctacatataaccaacatgttccttttttgatgagcattaaggtggagttcaccttttggacaactagcttggagtgttatagagaatatggcattcatgtattcatttgtgttattaggagtaggtttctggaatcaaatacatatctaaatatgtgtcaattatagcttgttggttaagcatccatagtggtatgacgtgttattgtcgtcctaaattcctaatgctatttaaatcagtcaatgtctcttataaactgttcacttatttataagttacctcctaaaagatctgtgacaggtgatcaatcgaaaaaaatatttccatgatttgttaggatttagaaaaatgagttgtgattaatctgcatatatccggacaattgtattttgttgatttacatatatggacagaagtatatttctcctgcacctgtgtaaactttggggtcaacatccaatcctacacttgtacctttgcattctttagctgttacacaggtctcctccccaaagaccaccacgggacttgagctgccttctggtggtcatgtaagctgacgatactggacaccaag

SEQ ID NO: 1895 - DNA, 15210 bp, Oryza sativa
  unsure (1)..(15210): unsure at all n locations
ccgtagtctctttaaccactgcgatgtggttacatcaactaacaagaatctaacaggtcctagaggtggtacaatatttttcaggagaggaaaaaattaagaaagaggactgttcttttttctcaaggggatgaaaatgaattgtgactttcaggacaggataaattttgttgttttccattcaaaacaactatgccaggacgggaggtccccatgggatatattgcttccttggtgataactctgaagcaagttgcaacacctgaatataaagcatagattcaacaagttaagaaaaatgcaaaagttttggcaacagctttgcttagaagaaaatgcagaattgttactattttagatgatggaaaatgattagtacatgccgactgctgggcgatggcacagataaccactactttgggatttaagaacttcaggcctaaccggtataattgtgcctaccattttcttaattaatttattttttaatccgtgagcacggttgtatattcatttcattaggcctccctagaaactgaaatgtcattgcatgataaacatatactccttccggtttcataatttttgatttgtttgacaatgacacggtctgtgtttttctattataaatgtaatgtattcctttcttccaaaaaagtcttatttcttttttcaccaggatcaaggtgtaaactcattcatcgtgtaacacaaccaatgaacatgcaaccaataagtattaaaatgacttattggattccaataaaaaatttaatatagcacatattgactccaaataggacttagacttttagaaaaaccaaaaaataaaataggacttagaattttggaaggagggagtatacaataaggctcccatcggatggcctaatcagtaaaagaaaaagccagattttgaattttcaaacttaattttgagattgattttgagatattttccacgtaggtttttttaccacattggcttttaaagtcacccaagaaccacatttataaaaattttcatctaataaaatttatttttatatttcctaataaagccgttttngacttattaggaaataagccaaacgatggggacctaaataaatacatgtttacttttattatagagctttgaaagatagatccatatatgttattctagttcttttaaactaaatacgtttaaagttattgatagtcgaagtgataaaagattgactgcaatctttgtccaaaacgttatttcctccgtttcataatataagacattctagcattgtctacattcatatagatgttaacgaatctagacatatatacgaatctagacatgtatatatgtctagattcattaacatctatatgaatatgtgagatgctagaatgacttacaatgtgaaacagagagagtaactattatggaaccagagggagtatgcttactaaacttgaaacattagtgcctgttattttcttgagttgcttaaagtcttgtcagtggcactattcctcttggacccatttgtttctatagattacatgatgtgtacatgcatatagtttataagtagtatgtaaactagatggatgggcgcgccctggcgcgccgcctgtggatagttggattgccgggtgtaaacgttaatgtcatagcattatcagttcagttaatggagtggatatggtgcaaagaaactgacttagactgtaagagtataagtgtcatattactaaggtttatgaaggtaataaaatgatcagcaacataatataacatagcaagttatacagaaggtggtgcatcgttcattgggtatatgagtaaacaaaatcgtcaatgacagtgataaggttgttcttaacaactacactacaacagtaggtgaagatgatgtctttaacataacatttacagagaaacaagcagcatatagcagggatataaaggttataaatacttagcatagtggggttgtcttacggcagctagtaggtgttgataaagtattttcatgatagtacaaggatggttcttctgcagcgcatgatcaatgcattcacgttatatgtattgttgcttgtagctgattcgtttcgtagaagtggaaaatgcagattattcccacttgtattttattggccgttgcaaactctgaccatcctgcttttagattgtaccgatcatctgttgacttgtgaagaaccatggtggttgatgtgtttcctgcagtatgcacttgatcctttgttgtcttgtgttgggtgagtggctgaatgtatttttctgagaattcttttgtgaagtactgttattaaaagtggatgttaggcatttatattgcataagagtggaatggtagtgagcgaaagatctctccactcttgtcttacttcatgaatgtctggttgatagtaacaagtagaattagaatttgcttgagtgatgcgggaatgtcgcaatatctttcacgtagttctttagttcgcttgatagctttatacttttgttgtagtagcacatatctttgacagtcctttttggttggctgtgtaaaacaaaagtagaaataatagaagtagataagtatttcagttagtatgggaaaaaatattgatgaattgcattgcaattagtatgtaaagtatttggacctgtagaagatgatccagtatgtttgttgaggctgagttggatgtggtggtttgtgtgctgtttagtcttgctagctctatctgctttttctacgtttgaccaaagcttcgtctgaagtgcgaacggagcaagaaagacctgaaaaaaaagttaaggcaatgtatgaacgaatttgaatggcaatctgtaaaaaaaagagaaagaagtggacacgtgcaattggaccaaataacagaaacaatcaaccatagccgaaaacgtggtcagaacataaaggaaagcactaaacactcgaaatggcaggaggaacaaacacgggcggtgacacagaagaagagtaggatgatgattaccaacagcagatgtcctatgaaagaacgaagctataaaaaaaacaaaacaaggaaacatatcattggaacgaatataaatataaaacggggtaaaaattatagaacaacaaaaaaaaagagataggagaatgtgcatttttttattccaaaagaaccaaatagataaatcaaatgacacaagcacgatggaaacatataatcaatgagaaacaaatatcccccgacgaacaaaaacaaatcaaagcaaaacgataagaaatggtaaatataacaaagaaaaaaaggcaattaccaagcaagaacgaaggttcacatgatgtgatgaagatggcgtacgacgaatcactgccttgtgatgagctctagcagccgatgcagatggcatgaaccaatgaaaccagcaacagcaccaaaaacctgacaaaaaaacatgaaaaaggaccatgacaaaacatgaacctgaactaaactaaataaaatgaaggggacaaaaaaaaagaaaaggaatgggaaagaccattaagagaacaacaacaacattgcaactagggtaactatcacgagaagccattcagacatacttataaaatgagagaaggagcaggaagaacgagaacgtgtacaggcatgcagcaaagaaagacatgcacagtgacacctaatcaactaacagtaatagaactcgccagcacacccacgcaaaacagagaagggatcgcatgattgacacgcaaagagatggatcagcacaaacaagacactataataatcaattttagcctctataccccaacatatctgtgtattccaaaaaaaactcacagaaaacaaaattttatcttcttcacattatataatcaagaaagacaagtactaaacgaaaaaacaacaagacacagacagaaagcacaaaggagccatagtgaaatagaaggaaaactgaaggcttaacaagagagagaacagagggagttaaccggaagaagccgtttacaataaccagcacgcgtgtgtaacacacggcgctaatccaggagattaaccggacagccgtgattagccagttataaccgcgggcacgaggaggcttcaacgcaaaccagcgacgtgtaaggcagcgaaatagccagaaaacaattccaaaaaaatgagaaaaccgggatagttaggagaattatcattaatcatagctgaaataactctgtttaacaataagaagaagaaagcatttcttggtacctcaaggccaaaagcaacattttattcttacatcagcactaacaaacgaaaacatccacttgtgtaagatgaataaatcatttttccccaactaaggtaaaaagcacagaaagatatgcatggttaacatactaatagagtgacgcatcaatgcacagtgctcaatcaagtcgaaaaatttcagaaaggtagcacaagtgctagtgcaggaatcacactaaaagcaactgaatcacaaagaacaaacatcccaatagaagacagaagctgacacatgtaaatccagggcgaagaacagacgcgtaaatgaaaagcaccacccgaatctctacttgttttgttggtcactgctacctgaggagaaaaaaaaggcattagcccgcgaaggcgatgtgttcgggcagcgcaatgcccaagccgcacggcgacacagcactagctgctgcagcaaagcaaaaccacacccacgacgccgcggcggcagcggcggcggcggtggcggaaaccaaatgaccggaagaaaaaaaacccaaatggctcgcccgcgatcgccggggcggctgctctcaacctcgacggcaaaataagagcccccatcttacacaagcctctcagttgagccccagaaatcatctgacattcagccacattattaaataccccctgaattcttatagtttccccatgttcttcatactctaaccatttctgcaaccaatcaattttcatgacccccagcccttccaaccaatccatgcctaatatggcatcatacccatttagaggtattagcttaaaattggatcgatagcatctaccttgaagccaccaacacagtcaggaagttgtttatcagcaaccctgaccttaactggcggagttgtggacaccactcctggaaaatggtgaatcatctgttcatcgacaaatgagtgggtactcccagagttaatgagcataagaagttcagtgccttgtattaatcccttaactcgaagagaatgggctgaatcagtgccattccaagcatgaactgagatggtcatgaggttgttctcctctgggttagactcaaggattgtctccaaactgtctgtttcttcctcaagttgaaatgcctctaactccaccacatgcaactggacggtctgagcacacttatggtccttactccaacgttcaccatgggtaaagcataaccccttagaacgtctataagaccttaattgagaaaccttgtcatccttgggagtagttctggcagactccaagattctcttttcctctccaggcgttgccacaggactcttctgacatacagtgccctgaactggtctagtgaaagccttggtgaagctagtaccctcagccttcctgaaagaaattttcttattcccatccaagatttcctcctgaagcatagccactgagcaagcagcatccagatccactggtttctgaatcatgaccactcctctaatctcatctttcaatccatccacaaacttggttaaaaaataaggaggggtgagagcattatcataagaaagcaggtggtgcattaagttgtcaaacctttcaacatactcagctacactgccagtctgtcccacatgaatccattgccttatcagggttgcctgtctatctctggtgaacttatgacagaccatgtcacacagctccatccacgaaatgcccaccatctggtgccgcaccgattgcaaccaaaatgaagcattaccagtgaaattcagcaaagccaccttaacccaattggctggatgcacaccatacacatcaaagtaaatttcacaattatctcgccataactgggtattctcaccatcaaattggggacaagacatgggggggacattaccaccgttgctagccataccatagtatccatatgctgatgactagaattttcaagagtgaaagggcttgcagaagtgaactgaggaaggcgatttccctgtggagtaaacaggaaaggatttggggaattaccattgagatcatcttcattcaacatctgactgggtccttggctgccttctgccttgaacaacaccttctgttgaacatcccgctggcacttctccaaccctgcctggatcgagttcactctctttgccaaatcgctaacagatccccccaactcgctcaccttctattccaccatgggtatgcgcgattccaccaccgccttcaacgactgcagctccgctagattcaacgcatcggactcctcccgtctcctccctcttcttctctgcatcctccatcatcttcaacaagagatcgagcttcccttcttgagccatgatttgagctgcttgtttcgtgatatacctaggtcgctccaggatgaatttttcccggtttcacctcgaatccagccaaccagatcaagggagccccaaaagcttttgcggaatcacactgattaacagcgaattcccacctatctaatggaattttcacgggcggaccaagggaatcaatgaaaccaggaaaggaatcgagggctctgataccaattgttagctacctaacaagaaaactgaacaagaactcaagaacagatagatcaacggggattccaacgaatttccgccgtttccgccgccaccaatcgccgcggatttctttcttatcatcgatagccaaaaacagagttttcttccggtctcacctcaccaaccctcccattacaggccaaaacataggctacacaataacacacgcttacagagcccattccggcccagacaaacgaacattagcctcgcgaagttttctttccctcccgccatcagcttccttctgcatactacttccaacatcctggctatcagcagcaggcgccttaacagttcaccgcgggaggacgccaccgctgggtcaccttctccgttgccaccgctgtacagacctctccaagctgcggtcaaggctcggtgagcatcctggacacccaagaaccccatgcatacactccattcacttagaaactgcctccaactcgacatgcacgcacatccgagatcttccaccgctcggacccaccggcggcgctcctccgatgtccactaaccgaggaaagtagaggaatggaatcgcaatatcatgctcttcatttcgtcttttggtcgcgcccccaaacgagtcaccatttgttgccggcgccggcgagcagaggtgccgccatggctgctctgctgctagatcgatgggagaagaaatcaggacttcactttgtaaatttaacaaactgtagagtcttttcctcaaaagcacaagacacatagtactgttgcaggacctattcgtaattattaaaaacaggaaggactcttaatgaaaacagctattcaacaagtgctgaattgttcaaatctactttaaacttcaaaaatgcataactaattcatcttaactccaatttaggtgaaaccaatttctgtagattcacgaaaatatgaacttaaaagttatgacataaaaagtggtactcacagtatgaaaatttatcactaaaactcatctaatttaagtcacacataaagcatgcacaaacttataaaatgcatataaaattaatcttagctcaaattggtgcaaacttaatttctatagatccaccaacatattatctaaaaacaaagtaaaataaaatatgtacatattttacatcaaatgccttaaaactaatatctttaaaatgactagatttagataagctgaactttagaaattcatatagaattcatcttaactcctttttgggtgaactcagatcctatagaatcatcaaaacatatacttccaggttgtaaaataaaaatatattcttactctataacaatagcccttaaatatttatataaggaataaacaacctagtgtacatttcaatttgtaaaatttgtagaaaattcatctttaatccaaatgaagtgaaccaaatttttatagaactggcaagtaatgagcttcaacatagtaaaataaaatatggcagcttctatacagattatagctctaaaccttaataggtaacctaagagctaatcacatagtaatggttaggcattatataggtgtagtggtatttaaatgcactctaactaaattcaactaaaacttaatagaccagataaaccatagttccattcctatgcatcaaaacttatcacacttagctcatacataaactacttctagattagcatagtgaataattaacatagatcatgcccctatttataaaacgtgtagtaaaatactaaaaactctaaaattatggaccaaagttaaattagttaactcaattactcattttgtacatcactggcaagatggaacaagttatggacctagaacctctatatcatacactatagggaccatatgcctacaacccgttacaacttgtaaaatacattagaaattcatagaaactctaaaaattgtgaaaccaaatgtgttagtcttagagaactcatatattcaccccagcaaactcaaatataataaatatcaccttacaaaagcatttcatagcagcacctaagcaaatactatactataccgataaaacttctaaaatccataactctcaaatggaatgagataaaatggaaattctttcacctaaattcagtttaaaccagcacctacccactgtgcacagatcatgcattttagagcattttggattttccgcatatttcggtgtttaatcgcataacatgtaatttatatagattgtcgcaataacggtgaagaagtgaattaggccctgacttttaccattaacaaggcaagtcccacctccctctctttgaatacattgctcctatgttttggaggttattgaaaatgtttgcaaatcctgcatgtcgattgtacattaatacgctaaaaccttgtaaaacttgttagaataacacctattgattgcattatcacttgaactccacatatatccataacctacattcttagccctagaaacaacaagactttatctttatatatatgagttataatgacactatgatactacgatgcttagccatgcttagtatgattttacttgtcatttgggatcatattaacatgaaaaatgattttatctaatttctggacaaaaatgaataaatggagaatttgagaaacaaaatgatgaaaaaccatgaattttaagtttgggcctcaagtggtacacatgtgttgattagttgtataccgatagggggagagtgtgcccaagctacttaaggacttcactcaatgtctgttcattatgtatatagtacaaccacatgtgctagttatgggatagtcctgtagatggccaaaaggcccgaggcccgacggcccggcccatggcacggcattttggcccggcccaagcacggcacggcccgatggaggtcgggcccgtgctggcccggtccgaccaccgggccgtgcctgggcccctccaccggcatgttgggtcggcccggcacgatgtgccggcagctaggcccgatacacaaaaaaataagggagtaaaaatagacatattatatgccatagatgaaagaatagggatctaaaatagactttttttatctacatatgtcagccaaagaggagggatggaaaatagacttattttagctatacatatgtcagcccaaagaggagggacggaaaatagacttattttagctatacatatgaaatagcccaaagagaagggatgaaaatagacttattttaaaaaaggcccgatgggccacccatgccttcgggccggcacggcacgacccaacagctggtgggccgtgcctgggcgggtggtgcagcccatgggccggcacgacccggcacgaagtgcctatcaggccgtgccggccggatggctgctgggccatgcctagccatggctgggccgggctgtgtcgggcgggccctttggccatctatagatagtcctagcttagtaatctatttatgatttagccttacattctagtaggctggtgtgtatgagttagtggttagctcagaggagcttcctgttacagctgaggcagtagtctaggtgactaagcgtgtccaatacaacggtattgtgccacgtggtgggtttactcgagggtagttcgtcaccacggcgttaagtttaaggcgtgggcccgccacttaatggttctaggtcatatttccagtatgcctaggatggaggaacgcgtatacccttgaattttgtttttgatcttgttcatacccattccgttagttgactgtttaattcccttgaaaaggaccattttgtccttagacatgaaggaaacatgaaaattgtaaactactcattccttctcaaattgatcatcatacaatagaattcaaaatttctcaaattgatcatcctataaacacatggacacgaatttcatcaaaatacaattaatgcagcatgagagaaatgtgtgcatgctaaggtgtaattgggatgatgttttaatcgatacatgcattgcgggagaatgtgtgcatggtgtcttgattgatatggtttaaattattcttggtcttagtgcataaacttatatgatgatcaatatgggaaagagggagtataattttgttacataagactactatattcatgattttttgttgtacaaggtattattcatggcaaagtttatttttacataatgacgtaaaaattaatatttatttacttattaaaacagtatatgtagcatttttatggtagttcaatattttcttttcccagttgtatatattatatagaaatgctttccaaagctatgtttatcgtttataaaatgctgcacgtacttttttaatatatattaaaatttttatgtacaacaaacttatgaatattatggtcacaaaacaaatttctatacttacatcaatatagtccataaatttctacatattccacatatattgaagggtaaaactgacttttctacatgtattaaacgggaaatttaactatttgtcacatttaggtttttcaattatccaaatacccttcttatatttgctcatattttttgcccatcttagatggtggcttcttaactatttgccactttgcctatgtggtatgccaaagtggcaacacaagagaaaaaacagtgtgggacccgcttgtcattctctcccctagctgtccagccggcgacgccagcgaagaggccaaggcggcggccggaggaaagtttgacggccgcggcagcactctcctcggtgcacagagtgggtcctcgtcttcctgcaagttcaaagaaaacgaaaccccttcgttcgggagcgcgttttgatgcattcatccagtggtgttcaccatcggaggtcgccgttgtcatttctctctctatcaggaccatgttgttggtcgcgtttctgcggttctgattttctttattgccaacctccatcatcaatggatgagtctaatcgtggggcacatcctaccatagtccttattaccgtttgatcatcagagcatccacacccatgttgagtattacgagaacatgagtatactatatatgcaatagtggtttttattcatcctaattatcattaaaatttctaatcaatacttagcctaagaaataatttatctgtagcgaagcatgtgtatttcgctagtacagtcaaaataacatatattttgggaccgagacgatgtttttaatttttttttaaaagaagttcaaacaatttgctaacaatcagccaaaaaaaaatatccgccgacctggcccaatcaacgcctcccctcatccacaccaaccatctgcgctgcgctccgcctccaccgccgtccttctcctctctcccccaatcaccgcccacgccacccaccaccatggcctcctccgcctccgtttctcccgccgccgcctcccaccaccgcctcctcctcccctgctccccgcgccgcctcccccgcccccgcccccgccctcgcccgcgcctcctccgctccgcccgcccccgcctcgtcgcatgccacgccgacaccctcctcccctcctcgtcccccgccgccgccgccgccgcgtgcgcctccaccgcctccgccaacgggttctccgactggctgcgggagcacgggctgccgccggggaaggtggccatcctcgaccgacccgtcccctgcttccgggagggcaaggacctgccgctgcactacgtcgccgcggggcaggatctcgaggtgcgttagcaagcggggatttcggggttgattccggtggtaaatggtgtgagatctttgactgtggtgggctgttgcaggctggggatgtggcgttcgaggtgcccatgtcgctcgtcgtcacgctggagagggtgctcggagacgagtccgtcggtgagtgctcttgtgatctattctagtgttgaattctgtagtttggttgctttggggttgagaggaaatggcgatttttttgtttcctggatgcacatttcacagtatatgacctgaatttagcactgcaatagtcctcctgttgggggcattttgtgtaaatggcagaatctggttttaatttatctgatgtccaccttataagtacaccgaaatcagtaaagtatagcttcacttcaaggaattcataattgttagtaagaagtaagatataggttgaattagttgactttgttaagtaatcttctatctgttcacttcaatttatttcaaattttcaataccatgtagggcactggatttgatattgttaccatcaatattaatatgtgtgtgttttgaggaatgctttttgaatgtttttaatccgtgttcaactggttcaagagtctgaatctgccggtttgatatgcaactttagctaatcatatctttcttgcgtatcttcaggatataatcaagtattatcaatctctctttgtgtgaaatgttgtgcattgtaattaaacaatgggtttatagcaatttcatctttcaaccttaggtgctgattcgaattttctctctttttaagcagtctcttcacgagattgcattttctttactattgcatttgtcataaaaggtaaggtcacaatttttaataaattaatcatcaaacaatgttagcatgagagtaatataagaaagtagccctatgtttacaactttgttaaaaatagtttaatgtgaaattgtggatatgtttacattggcatgatatttctgttagataggtcttccatgcattatttcttcagtccttgtatatttgtttgctaatacctgatctgtgaaacttatttgtggtttatgtctgtccacttgcgctaacaccaaaagaagaatatggaaattgatatgtccttttcatgtatggtatttgttttcatttttgtactatggtaaccagctgatattttgaaccatacagctgaattgctaacaacaaacaaattatctgagctggcatgcttggctttgtatctcatgtatgagaaaaagcaaggacaagattcattttggtatccttacattaaggagcttgatcgccagcgaggaagggggcaattagctgttgaatctccacttctgtggaccgaaagtgaactgaactacctgaagggtagccccatcaaggttagtgttttttcctatccactatatgtcaatatattatgagcacattttatgcagtgtcaagtaatatacaacttagattttctaatatttcaggatgaagttgttgcaagagacgagggaataaggcgagagtataatgagctcgacacactgtggttcatggcaggttcattgtttcaggtgctttcttttgaccttccaaaatgttcctgtctctgggattctgttgcactagctgcttgttgttctcatgtcaactgttatgcagcaatatccttttgacatacctaccgaggcttttccatttgagatcttcaagcaagcttttgtcgcagtacagtcttgcgtggtccatttgcaggtaacataatgagcaatgagatttcatttatcaaaaaaattagatattaccccgattggttgttggttggtttaaataattatctctggtgttgaactgaagtttaagatttacttagagtgtacaccatttatgaacagaacagtttagtgctaaataccttgcccatataatagattatacaagcctcgcagtatttttgtcaaattcaataaatttggaaatttgcttcttcaaattatgtagatttgttctgtaagtatttttttttgtttcatatgttttatttgcttaatacttcagtttgggatcaacagttcatagcatgccagccttttattttattactggataaatactgaacctgctcgtcgctaagttatttttatttttcattgaagaacagaaagttagtttagctcgaagatttgcgctagttccattgggcccaccactattgacctacaagagcaactgcaaagcaatgctgacagctgttggtgattctgttcggttggttgtggatcgaccatacaaagcgggagaaccaataatcgtctggtataatattttcttcagatgcattaaaattcttgttgtacctcatcatatttggcaacttcagtgcttatttactgtttgcatatttcatttctgttgtttgtgcatctccactgtaacgtcaagctatgcaaattgtacaggtgtgggccacagcctaactctagattgctcctcaactacggttttattgacgaagataatccatatgatcgtatagtgattgaggtggaatttgttttgctattgttctacattcatcttcttattggatttgtgtaagcaatactgaatcattgttacaggcatccctaaacatagaagatcctcagttccaagagaagagaatggttgctcaaag

SEQ ID NO: 1896 - DNA, 3043 bp, Oryza sativa
tacatttcagatccagatgaaatgcaatccatactttcttcagaaggtgatacatgtccagtaagtctacttgcccttaattggccttactattagaattttcagaattttcagttacggttagaatttttaattacacatatgagataaaatggagcagggcaaggtgacagtgtcgtacattgttgttttatttattacatttttggggtcattatgcttgcgcagttagccagtttatagtttctgccttttttctttacaagactccaaaagcactttccaatgggctcagtttttatggggcttctgcctttaaatattgcttcaagccttgaagacccagaagtattgatctagtgtcattagtcattactatgtttgtaacaaattgaagctagacaaacaggcatttgatctgaagatcttgtgttatgtgaaatgcaataattacatctggttgaacatttaggaagagagaacatttcacaagtagataatttggaaaatgcctttacatttgaagctttcttttaggccatcacatttgtcattccaggtttttaggatttcattcaagttataagttcatctaacccattatttatttttagtcgggttgatctaaggtgcagattgttcaaaactaaaccggcttgctacaaagcaaatccatcatacatttaaagtgcaatattttgccatgcaaatatcccacagtagcatgtagggtttccattgagtttttatggaagttgagcaatggttctaaatagactatgtggtaatagtagtgttatgcataacactgtgtaaattgtgacatgtttccaactatgattataggtcagtccatgcacagagcgagcagtacttgaccaacttgttggatacttggagtcacgattggctgattatccaacaactttggatgaggatgatgctatggtaacgagttgcaaagcactatgtgtatgtttttttgtaaaatctctgatacgtaatgtaatgaagagcatttcatttctctggtattgggcagttggcagatggcaatttggaaccaaaaaaggaagtcgctactaggcttgtaagattggagaagaaattgttgcatggttgtctccaggctgctaatgagttcataaatgatttgcctgaccacactgtgtcaccttgccctgctccatttgctcctgaattgaaataaggtaggcaaagctcaataagttttcactgcttcccaaagtaaatttattagaccgtttactgtgtaccatgttgatgtaattgatctaatagactgaattttatggatgtgcagaaaagtaaagcatgcagcgagcattaattcttgcaacatgggtgtcacttctaatggtgttctcattaatgatcacatccagttgaagtgcattagaaggtaataaatctgataaattgttactcctttaaaatacattcaagtagtaggatttaaaccagtactaatattgctctggtattataatttttttattgttagaagtttagaacctactgaaagtgtgtaactgaaagataaaataccaaataaaacttatgattcaactattacattgttacttggggtacattctcccaacccttgccgtgcttttttttttcttgttgtgcgcgaacaaaaaatttaggaattgtctatgaatctctgaatattttttttctatttctgaactttcttaattttaaaatttaaaaatagacccttctaaaacttatttccaaaatctgaaccttttaggcacgcgaaccagggtggcgtcgcaaaacaacactgaccccacccacagcgggcgtgatagttttattctaccacgccaactatggtggtgtggcaagacaatgctaaataatgctaccatgccagccaaactggcgtggcagtattgtttttcctactgaaagtattgtttggcgtgaccaaaaggttcaaatcttgaaaataagttttggaagggtttatttttaaaattaaaaataaagaaggttttaaaaaataattcctgaataattggtgaagataacaacatagctatgtcaatggtagtcaccacacctaaatcactcaatactttttaacttaactaaagtagtttcttgagcataatttagctacttcatttcttcctaaaaatagttcctatagttataacaggtcatttggaacataaaaatggcaagaccagaataagaggcacaggaaatcagtaatgcaatgacagaatacaggaatgccctctgtcctgtacgcaacacaggaaagcatagcatggtaaaaatagtcccatttggtctgtgccttgttccttagtggttgggcactgtaaattaaatggccaatttttgacatataaagtagcctctattctctcttatcccagtcctgtcttttgcatctccttatccctcttctcacctgtgcaaacttgaggggagaagccagaccatccgctatgctgcatcaataactttggctaggttgcactgcaacacgcacaacagtaggagtatgtactgtgtagaacttactgtgagaagtcggatgtgtgatcccaggtcccagctgaataaatttctctcttttttttcattttgaaaaacatgtaatttgcagccatatactgcaatcgatttggggaactaaatttaaaagacagatgcatgaatgaaccacaacaagaaatcaaaatacagcagcaagaagtatctgacaacatcacaacaaatgagcaaatcgatttcatgattcatgtgcatgatttgagaaatcaaaggtagacctctagatctgatgcaaagacaacctaagcaaagtatgctgcttttaatgatcaagcatacgtctctgttccttggtgtcactctggaaaatggctcgagaccatcatttctcatgggagccctgaggtaatgccaaaccaaggcacacagctgctgtcactgaagggggggatggatgacttaatgctggagctgggctgctggggacctttctgaactg

SEQ ID NO: 1897 - DNA, 12697 bp, Oryza sativa
tgaattgaaattcaaatttgaatcggatataattcaaattcaaatttgaatcgggtatgtaaacttgtgtcttataaactttgggtctataaactttaggtgtataaactttagatgtatagaaatactatgtataaaaaatatttgaattcaaattcaaatttgaataggatatataaacttttgatttataaacttgaggtgtacaaattttaggtgcataaatttactaaaaaaggaaagtaatgcggtgccaaaaaaggaaaccaggtggagggaggggattgatcgatcgccgggtagcaatctcgagtgtagactgtggaccatatttggtgtgcattgcttgtttagtgtgaagtggtaaagataagggcacatcagcagagtgtagactgtggaccatatttggtgtgcattgcttgtttagtgtgaagtggtaaagataagggcacatcagcagttgcgtgacattatgtcggtggcatcatatagggtagcttcccaaaagttagttgtttatctgttctttcaaaattttgtaaatgaatcctcagtagtgcttctttgcaggaaatctgaagcctggctgacgggtgtaatagggatttcactgcccgcatgcagatttggcgattagttgcattgcacacaagtgtgcacggatgttttgttaacctagtggcttttatattcactgagtagattctgtacattctgatgattgactgagatggtaatgccaatgtacatgttcagtctcatttgtcaatagagattctgtacatgttatatttttgggtgttggcatgatttccgccgttctcttttcatggcctgtttgatttttagctgtctgactacacagcagagaattgtatgcaacagtttactgtgatggctgccaaggaatcgcattcatttgaaatgctccaccatttttctgtctacagcaattagtctccctaccctgatgattaatacctttttactgggctgatttcaaatctggatgatccacaaagcatgaacttgagaacaaatcgtgctacataatttgttttcttcacattctgccactactgattaacagatggatgaatcgtgatgatgaaccatggcttgatactcgcgggacgatttgagagcccggtaatattagcagagatgataacagaaaggaagaacttggagtaaatttaggtgtcagtcattttattgatcctttgctggatgaagaatgctcctgtttaactctctgatggaacatgcccaacgcagtgatacaactacgatccttcaaacaaattcgtgacaccaccaaacaggaacaggtcttttttatagtccactcttacaagcagtgtaagtggtggcagctaaacacatttatttcagtgggcctcaaaaaccaataatctcatttaattcttttaatatcaatttttgtttgtgcatctccttccaactctctctctctcacacacacaccatctatgagatgaaataacatgatggcaagaggtccatttcccgagagtaaactagacaagagttgatggccatgctactgagtgcctgagagtcgtttccatctgattatcctatttcatttccccttgctgaaatcctctaaatgattttccttttcttcttgcaatataatgcatatgtacatgatgctcgaccacgaagtctgaccaatattggattgggagccaacaggaaatgataaagcgatttagccacatgtcgcacatcttagtatttaagatcaagtctccttgtggggtgaacaactcatgagtgaacagtggcttgcgctagttcattgctgtagtgatgatacagattgaaaaaacgccggctgggagaatgaaggcatcttcatctccatccatactcttcagcacatggattctgggctgataggattctactacccagcagctgagcatatacacatggtgaaacacataacattttcctctcattagctagggaaagagcttgaatgcttgatgcatctgcttggcctgagcatgctaaattaatccaatccgttatcatgttttcttcctcttgtaatgtattaagttgcttgtcgcgtgcatgtaatcaagtaaaaaagaactatactaattggattggaaggcgcagtgaaatgttaataaacaatattccacccaaatcatgagttaaccatatcgattagttcctcggcattaaatccttacttaattagttgcagattgatatatcatgcccatgcaacatgatttcatcctcacctttcaagtaagcatgtgtggctgcattgtgttatatgtgtaaaatggccaaattcaagaggaattgagcggatttgttaaactatgtgaagaagaattatacgatacatataccagaaccatgcctatgggttgataaattatctaaaagtattggacgttaaagtaaattttcaattaaagtatattaaacaagacataatttccccgcaaaaaaaaatcaacacatataattatgcaccaaagatgggtacacaagctacctcattttgtcttgttagaatctttaagaaattcgtccagcggagaattgatttacgcctgtttgatttttagctcagtctgactacccagcagagaatagtatataaaacaaaaggagtaaattgcattggtagtacacaaacttgttaattgcgtgtaatttagtacataaacttataaaatactcgttttagtacataaacttgtctatttgtgcaaacgaggaccaaaataacttgccaatgttgattttacgaagttgatgttgattaggatgtgatgtacacgtgtaatgagtatgaacactgctatatgtacgactgctctatccgaccggtgtatgacggaacggcagagcagcacaatacttaacggcgtaagtcggaacagcaccagcagcacagctcttgacgtcgtgtaatacgcagtcgtacgtcggtcggacacttaagtggtatgtatagcattttcgaatgagtatgcatacttacatgaaaaagtttttgacagcgtatatgaaacaatttactgtgatagctgccgaggaaccgccattgatttggaatgttccaccatttttctgcctccagaaattggtctccctaccgtgatggtaaataccatttactgggcggatttcaacatctgagtgttccacaaagcatgaatttgacagcaaatcactacttcgaaacaacacatcagtatcggttcgacaaaacctaccactgataatggtttttcatcctataaaacactcgcactagcattgatgagaagataccagtgtcggatcatataaacactactggaaaactgatttttcatgggtggtgtaaaattcacaataatcccggtttaaataggaaccgagactaaaattatttttagccctggttcaaaagaggcacgacactttatgatctttagtcagattggtgttatcaacctggactaaatatcatttttagtcctggtttaacacgttgtcaggctgtgtcaggccctccactatttttagtcccggttgtttataccagccgggaccaaagattgaaaaaaaaaccgctcccacacgcacctcctcttctccttttgtccttatctccttgtgctccccgtccttagtctttatctcttcatcctcgtcctccactcctcctctcctcccctcgatcccagccgcctccccttcccggccctctccgaggcgacctccccctcccctctccttagatccctcctccccttaccggccctctccgtcagccggcggtggctggcgaagccgcgtcagtggcgtcgggcggaggcaggcagcggcagacggcgggcgcagccgcgtcggcagcgtcgggcgaaggcaggcagcagttgggggctagtgacgtcgtcggagccgcgtcgacggagccgcatcggtgggaggaggcaggccacgggcgtctatggcggttggtggcgggcggagccacgtcggcggcggcgggcggaggcgcgtcggcgggaggaggcaggccgcgtcagcggcggctggcggaggcggagcctcgtcggcggcggcgggcggaggcgcggctggcgggaggaggcaggccgcgggagtcggcggtggcgggcacgattcggtggtgggtggtggcgatttgatttgtgaggtttttgtgaatgtgttgtgatgtaacatttgatctgtaaattttttatttcaatatgatctgtgaatttttgatgtcaatttgagtatgtttgaatttgtgatttgatgatttgtgatgtcaaattgagtttggtgtgaaatcaatatgcaaacaacaaaaaaaacaatgaaaaaaaataagaattttagtccactaaaactgggactaaagatgagtatatttagtcctggattaggcgtcccggttgtatactcggaattgaagggagttacgaattgggagtgaagatggtttctccagtagtgaaacaaccggcactgattgttccacgtaccatcagtattaatttataagaacattgatactgataattaaccaatcggtgtcggtttaagtcgcttggagtggatgagctggcgtattggtgggaaaagtcacctgtcacttatggtcattacttcctctgtccaaaaaaaactcaacctcgtactacgatgtgatacatagtagtacaacaaatctgaacatactctacgtccagaatacaagcaactgctattctaatgattggacaattatgacctaaactggatgtgtcagatccaactctcatcatgatggccaagtggaaataacccgatctctctcacatacttcctccatctaaaaatgcaacctacaaggagatgtgacccctccttcttctagtacaataaatcatgtgacccctcctagtacgacatatctggacaacgtatgctcatattcgttgtacagtaggttgaatttttttgaactgagggagtatgcaatcagcgatatcgaggttggacagtatacttgataaaaaaaaagattggacggtgcaggtaacgtgctattacagaaacaaaagccgaagcgaacgaaatcaaacagctgagaaactgattgtgatcaaggagattttatagcgacttaaatttagtaaatccgattcctttataagttttgtttgtgcaactccttccaacttgcttatatatacaccaccatctatgagatgaaataagctagaagagatggtggtcatgcttaggtgagtgcccgagtgtggtgtatccatcttattatcctatttcattttcccttttgcagtagtccagtaaaaaaaatgtcctttcttcttgcactgcataaatatgtgatatttgctcatgatgttcgaatcatatgggattggaagccaccaggaaatgataaaatgatacagccgtatgtgttgctcgccgtgtgcatgtgtttcacacatcttacctagtgaaaagtaaatttcaaaatgctactaggatgagccacatcatcaggtgaacaatagccattggatcgacaaaaaaataaaatagagagaagagagttgaaccattgattatagaggaaaggaaaagacgaagaactttcgaagctttccagcaatgcggaacgcgagagaaagggaaaagaaagaaaagcagtattgaaagagagtgggggcgttggctggtttatggcatgtgatataatttgcactatgcacactcagtaaaagttattttataaataatccttcaaaattatttataaatggactcttggcttataggctcatatgttatctatagataatccttacaacctactaattctaaattatcactataacgttaatatcacaaagtttgttatcacataaacatctaataaaattttctatgattttaatgttgtaccctggatcacctctttagcgtaaaagctactccctccatcttattttgatcatctctaaagagcacaaaggccaatattgaaattaattcgtatccaataaggtgctctatcgtttcattttcaacaaaaattaattcacactttaaatgttgcatgagttgagccaattaaaattaatatttattggttgcatgcatgcagggcgttgctccatgcacatttactctttacacaaataaacaaagaaatactttgttaggtgatgattattttgggaaaacctcaaaaatctaatgtgatgatcaatttgggaaggagagagtgataggtggggcttaagaactagtgtttcatctatacctgttgctttcaggtcattactgatccattacacttctcccaagcacatacttaacaaaatgaactttgtttactgatgccaatttaaataacatgctcatatacacatataacatgatggttaaagtcgtgcgaacgtgtgacatcataggccaattcaaactgaaaggtttgaagaaggttgcaacaaccaactatgccacgtcagatagacataccaatctcacctatgcatttaatgtttttaatcttaaaatatgtgaatagctagctcttgcatgagacccaattctctttattttttaattttttcttctccacataagtttatagcctactattatacttgctctaggaggtgagctaggctaggtactatttggatcgggcttttctttcatgggttgcatcgggagctagagagtagtgcaagcaaccggcacatcgcatctttatttcctcgctcctcatccgcagcctcgttttctctttcctctggcaccacagtctaccggcgatgggccgacctcgagccagtgacatcgcagcctcccaaagaatgagatgctcttcgtcaacctcaagggaatcatcgctgttgctgcttgccacagccgatccaagttcatgctgcggctaacagtgtatctagaatttaggatattgatggtccaacttaaattttttttaaacaccgtagatctaatgatgctaatatataatacaagtatagataatgaaataaaccaaaagtgtaccatgataaataagacatcttaaaatacataaaattagtaattaagtaaaattttgacttatatggacaaaaaagtttgaagaagattaccatacttcttctagcttcttcttatcgggtctacgcaatatctctatctttctttatttttaacaaccagtaatctacaatatagtactaatatcacaatgctcattgcacaaaagttaaaatcttatatagtgaaagtagcaagctttcttgcacaaggatgtgccacatcattaaaaatatattagccgtcggataaagagttcggataaataatggtcattagatcgaaaaagtgtatgtattaaaaaaaatcacaaatgagctaaacatatggaaatttttggaggtttctgttatctattgtcctagccaagtatatatactttgtaaacaaattaacttatattaaaatcttattaagggttaaggtaaactaatagaccatatataaaagttcttaaacaggatcaaaagtcacgcagagcgcgactatatgactagtttaaaactgaaaattgaaaagggtaaaaaacctaaaattgaaaaatcaaagtcatcccgtcggccgtcgcggtcttgcggaacagaacggagagagtcggagacgcgcgcactcgcagccacgcaggccggccgggcaccgggcacgtggtggcgcggcgcagacagcggctggctgcgggcggcggcagggcgggccggcggcggttggagtaggcagcgtcagttaagccgtcggccgtcgcgtggttggtcctcactcatccgttgcgaatgcgatgcgtgcagcggcagcgagaggtggtggcactcagcatgcggcgtagcagcggggcggccgtgcggcgctcggcgagtcggcggccggcgctcgcggagtcgcccgtcaatgaagccgtcgccgtgtcgcgtactcgctttgcctaactcgcgagtcgcgtcgttaatcatgatgcgatacaatgccgcgcgtgagaaatgaggagtcgacgaggagaggtgcgtgagtgcgatgacatgtcatagacagtgagtggtaaatcattaattggcacatcttaaaagtgacaaataatcaaatgtcccgatcattggagtcattgcaggcttacagctcaccgggttcactcacctcacaccttcacccgtataaactaaaaatgtccgttccaacacctacatggagaaggataggatagagaacagccaacactatgataatagcttaacaagaacatgcatatattggggataaaatgactccactgccaagaagaaatcaagccatgtccagaagcttttattccattcaggattcagctcatcatttcataaaaaaaaaagaaagaatggaaaacagcaaggaacatgcatgtgattgaatcctgattcccctccgcggttgccttgcctgcatgcactcgatcagcagcagcatctgcagtggcgcggtgctcgctgccgcagagacctcatcttggctttggctccaccgatgagccgtggtgtccccttcactttcttcttcccaagaacgccatcatctacttctgtgaggctcctcttttgccctccagaacaatcacaaaccaaagacttgagtttacggagcgctcctgctttaagtctagagagttcttcaagtttatcggccttgcgatttatggaataatatagtgagcaatcaactttttcccgtgcatcatctgccgcagcatctgcctcctctatctttcgtaccacatcagctggaaaacactgtgtcaatccataaaaaaacacatttatttgttttatctatatatttcataaatattttttggttgcgaatgttaatttatacagatatgaattcatctactaccttggagggtaaccattttaccatcatttgaggggtcagaatcatcaccataacatttgcatacttcgcgtgatccttgataatcgtgccaatgccaggaacaagcttgtcacattgctcacgcagcatcttgccgtatgcatttagcagaacatcagctcgacacagctcaccagcacaagctataaatgttcttctatcaatctggatggatcaacatgaacatgataaaagaaagcattacagaacttggtcaggctgtaaatgacaattgattcaaagcagcatcaaccatctctagccattaaaaatcctggacttagaaataaaccagacactaaccattctgaattcatgaatgaataaatttttcaataaaaaattgacatcaattagacacaatagagatatcaagttttgttttctctgggtcatcgggccaaccaaaaactcaattaattgaactaggtcagaattcaatgaaaggaaagtgtgataactgataactactgtactagctaagggcaagttttatagtaaggacagttgccacgtttaattttatctatttaagataagatgtgatatatatatatatagacaatacaccacatctacactacctccaacatactaagccaaatgattttatttgtttgtccaatcccctctttctttcatctcatttttcttagggtttgtatggaggttgcctctaacatgaggtgtggctcacttactctttcctcacttaggcccggtttggttcccaaaaacatcacatcgaatctttagacacatacatcgaatattaaatatagataaaaagaaaaactaattgcatagtttgcatggaaatcacgaaatgattcttttgagtctaattagtccatggttagccataggtgctacagtaacccgcatgtgctaatgatggattaattaggctcaaaagattcgtctcgaggttttcaggaaagttatgaaattagttttttcattcgtgtccgaaaaccccttttgacatctgatcaaacatccgatgtgacacctaaaagttttcttttcgctaactaaacaatgccttatttcttccacctcatcatccaattctatttggtatttttagaggcaacaaatcaaccattacagtacttgccctaaatgacccacactatgctaccaccattggtttcagtgtttcactacttggatccctacacatacagcataacaactggcacaacagtaagtctgaaattaagcagaaaatataagggtgcacgctagaaaagggcacaactgcaagaaagctcagttcttaccgttattttggacatattgattctaaatttagtcatgcaatcttttaacacttgaggtaatgggccaagatactggctagtgatgttttccctttctgctggtacaaattcacacagaagattccttaacccccacatcagttcaggcataacacgggtggagaagtgctttttactcccggttcgtaacccccctatagtcccggtttttcaaccgggactacgaatatgggactaaagatcgctatctttagtcccggtttaaataaccgggattaaagatggatcttttagttccggttggtgttaccaactgggactaaagatccttctttttagtcccggttggtaacaccaaccgggagtaaagagagaatagcggcagttccagatggtccccttttttttattttctccctattaacaaccaaatttggtaatatcggcatcgggaaagaagattagatcgaagtaaagtcggaggcggagatcgagttcggaaacagagcaggaatcggttgtagtccagatcggctacgattaggatcggctgggtctgagtcgggctaggtaagccgatgcagccgattccgacaatgcaacttgatgtatgacatcgggttgaattgaggtgcttcaaggtgattgccgcacatggatagagtcctgagaaggcaattgtatctattaattaggatgttttatgtaattttcttagagatatgcttgggcaaaagtctgccgcaaagacttatggtatcttagagtttgttagagatagttgtcgtgtccgttatggacatatcttgtaattttcgggtataaatagacccgagccctatgtaacttttaacacacacgttcaatacaatctcggcgcatcaccaccttttttgctttagttttatttcgacgagttcttgctttcgggttgagctgcatcggtttcgatcttcaacaagaggtaaaacttgtaatggcggtttgcattctcgggattagtgcttccatctttatgacactttaatcttgtttatgtaattcgtcgagttatcatatatcctacataatccttggcaatatcgatatccaacctacaataggctaacatccgtcaatagaagacagccgattaggttaaataccgatgttgccttagattatataggatatctaccactctatgacacatccaacggcttgattgtctagatattgtccttcttttcatacttatagctgcatcagttaagtttgaccttatgagtcgtgattagaatctcaatctctagcccgcttcttggttgctgattagggtagtatcggagtttcagccgatcttacctgatttaactacttttatccctttacgttaagatcttgctgcatttaagtatattaggcttgtgtttagtatattctacttgctttaatatcttaatatagagtagtatcggagtattagccgatacatgctagatctatctgatcggctatgttatgaacgtatatagtctcattattaatatatatttcgatctaagtgatttatactgtctcggcatggcgaccgatctatcccaatcacttgatttaagtatatatcgatataaagattatatattggtaatatctgcagccgatcgagtagattcagtccttccttatttattaatgactgccgatcgacgcatatatgacattggctcaaagataaatgatgtcatcggcacctagctgatcagctatcatttatagatttaactgcggtttctttgcttctatttcttgttgattacaggatcaaatcaactggcacgctcatacattcgaaggcgagctttggacctgcactggagttaagcagatctcccaggcctcgtattttctgtcaacactcccaaatcttattttctcccaaatcaagtgggaagcatatccccaaatcaaagtaacatcccaaatccacatcacaaataaagtaacatcacaaatcttaaagttacatatatacacaaatcaaatacatcacaaatcctaaaaaattacacacaaatcaaatacatcacaggtcatcttagatccatccaataaatcacaaaattatacatgtgaatcacaaattaaaaaaaaagagaaaacaactccgttgctgccgcccgccatggccgccagcccgccgccgccgtcgccccaacccgccgccagcccgctggccgccgcctgccggatgggaaggggaggatgggcaggaaaagggataggaggaggtggaggagaggggatcggatgaggaaggggaggaggtggaggggatggatcgggatgaggatgtaggaagcggaggaggaagggaaagaaggggagagattcgatctgtggaggtgaagata

SEQ ID NO: 1898 - DNA, 7368 bp, Oryza sativa
caaccgaaactaaagtggtgatctttagtcccggttggtaacaccaaccgagactaaagatcctcggccccctgacatcaatctgacaggggatgaaccgagactaaagaaccaactgggactaaaaatcatagaatgcctcttgggttttcaaccgggactaaagatcatttttagtcatgggattattatggttttgggtcgacccagcaaagatcatttctccaccagtgtaatatgatctttctgggagacatcaactttctagcaagaaaaggttacagagattagtcaactgtgactacgattcatgcaaagacaaaaaatactactccttccatttcgaaatgtttgataccgttgactttttagcatatttttgaccgttcgtcttatttaaaaacttttgtgaaatatgtaaaattatatgcctacataaaaatatatttaacaatgaattaaatgataagaaaagaattaataattacttaaattttttgaataaaacgaacggtaaaacatgtgctaaaaagtcaacggcgtaaacatttcgaaacggagggagtactaaaaatagatgtaccgaccagatcggtttcgatggcacctctaagtttttcatcctcaacaatcaacggttttccacatttacagtatctcaagatgcgctcagcaatctcctcaggaagaccatcacaatgccacactgtcgactcatcaatcttaatgaatttgatcaataagatgagctggtaacaacagtcacagcatgatattaggtatacaaaggttaaggcgcaaagtcacaaatgaaacataggagccctgcatctttccaacagattgctttttgtcattattattttctggtgtagggtggctacttccgcattattattttgcagtctaagattatttgattttagtcgtgatgtacttttagttgtagcaaactctttaaatgacagtgatagccaaggaaaccacataaaactaaattaagctagtttatctacggatatgagtaataatcctggatgaaagtaccaagcagaaaactctctctaatgaaagtaaatatggtagaatcaggaagacccaacttgtctaacaaaatcaaacttggcaaaacgcgaccacagatgctgcaaaataacaatacagagtgaaaaatcataagaataattacagacaataacctgcaattaatgatgacttgggatatatattgcgtatacatacctgttcagaacaaagtgtttgaaatgcaacgaagagagcgaatcccgacggcgtcttcagcaccactagattgtccacgtattcgagttccatatatacgctcaggccttctttaattgatccagttcacaagagcacaacaaattaatcctagttagttcagcgcacactcaactcgattagggcaactattacagtgacgctttgcatctggatatcacaaaaaacgtacattaaaatcagtgggactgtggggtacaccagtttacaacaatatatatatatatatatatatatatatatatatatatatatatatataattataatgattcgatcatatcaggaaatgcctcacacaggaaagaaatatttgctcatggatagatcgatgctagagatgactaaatcaacaagatcgttgacatggaccatcgataccaccacagctcgaatttgactacaatatcaagctactacctatatacgatatcccgatccagatcatcgatgccaagaaaggactcgacgatgcatagcaaaacgaggacccaatgctattacaggagaggtgtaggaaggaagaaagcccgtggacgcatgcgcccgcgtacgtacctcgagtgcaggctgcggattcagcccacggtgcacacgaggtggagggtggggttatataggagcattcctagccgcaaatctaaatttgatccgttatattttccatccaattggatggctatccagaaaaaaaaaatcctctccccatattcctttttcactttcttctatattttagtattacattccaactaacgttaataacgcaatatatactttataatggcaatatctgtaaatcttgctaaaaaatccaaatttattgcattacaaatctatatctatatttatatctatacctaattaaaaaatacataagggttccgacaattttttttcgtccgtgcgtattcttttcgccgttttttttttcgtcgtctttttcggttttattcccatccgcttcttttcatgggttggcatggctgttgggcccgaggatggtggcccgaggaggaggaaaggaagagaggtggctgctgggcccaagtagagatagggatgacggcccaagagggagggatggcagcccaagagggaggagaaggaagaatgggccagatttggcccagaattaggagagggtttttagtttgtttttactttaaattaattattaaaattatatttgtattattaaaattagcaattgagctttgaaaaattcaaaacaagtctagatagtatggttcattcgtgaagaatttaataaaaaatatattcagtattttattttaataataacatgttatttaattctaattctaatctatacctctatacctaataaaaaaatacgtaaggatttcgggtgatctgtttaattgtcgggtcaaaaccgcggttgatatagtatatgtatcttccatgtaatcacctctctcctttttacacatatattacttgcactgtgtatatgtgggcctctcctggaataagtctactttccctccctcctgtcaaatcatatttgcgcgcaaatttttttttcctcgaccactagcacggaacatgcacatccggttgatgaaaaatcaaaactatagcacctctttcttcaacaattttttgatgattataaaatcttataatgaactagtttttaattcaaaattttaatttaattatattatgtacacaaaaatcctaattgtaactcatgatttttttaaaatatatatattcaagcaaattcccacattgaatttcaccttaactagaccgtataacaacaataagattaaaataaatttcagccgttgcaacgcatatacattttttctagtatatatcaattaccctaatctcatttttatgttcctctgtcatatttgtccaatcatatttctcttcctctcttctttatacctatcgacatgagagagtgatagtgcaggctcaagtgtgggcgcgggtggagaacaaaatgtcgacaagggtggcacgggtgcgaggcacagtcggcgtaggcacgggaatggggagctagggtcggcgttggcggcacagcctcgagcgttggtggagcaggcataaggcccgggtggcacggccacaggcgtgggcggaggagcgggctaaatttgggggtttctttcaccgggatagtgggcgcgctaattttggaggcactgatgcgtatcagctgcaatttagttgatggattggatgggatagatgagctgctgagaatgctctaataagataatgttgtggtctaaaaatggtgaggtattggattcggttttgacagtgttagtgatatgccctagaggcaatcatagagatgattgtatcatatactatgtttacatatttatccgatattgttccttgaaatagataactcattattggttaatgaatatgtgattctttcatgagactctttatgttatgtgttactatttctaaaggattcctgatcaaatatcatatgtggaacaaatatgtttagatgatcagcatatgtattaattgatgatcatgtctcatcgatcatggtatagagataccaaaataataatgtggacacatgttagtgaacatgttattagatagacccaacatgagacactgcaagagccatatgtgttgtgtcatcagtgatctcatttagtgttggtgttgaatccatagacctgaggttatcatggtttctaacatgtgtagtaacttactcagggactgctaaacgctactccgtaactggatagttataaaagtagttttcgggtatgctatgaaacatgcagtgggatatgaataatcaagatgggatttgcccctcctatggagagatatctctgggcccctcgatgttatagattatggaagtgcatggccataccaaaggtgattgaggagtcaatcacaagttatataatctatcaacaggttcgagtgaatgattaagctattagaggatgacacatatctagccttgagcttaatcgatatcgtgaggcaaaggggttcatacaagtatacactataggttcatccgatatgatctttatgtatgcccggtgggtcaatacgttctgctaggggcagctgttgacgcgtggaccgaaaaggagttttcgggttacagccgagtatatatgaacctacagggtcgcacgcttaatgggccggaataaggggattgcatagagatccaatatgagcttaattcggatagggatccgaataggagtcctacgggccttggaggcccgagtgatagatcctatatattcgtgaggggtgtgaccggcagaggcattgcatcacgtgagaaaccctagccgtcacttccctccccgagtaaaaccctagccgcgcgcgggtgctagcacatctgcgcgtggcgttccgtccctgtacgtgtggataccggtagaggcgccgctggtttgcggtgctgatcggcgtgggagtacggcgaggagaacgcacgaggaggagaaggtcgagccggtgcgatcgactacttcctctacatcgacgcgcactgcttcgcgagagtttcttcgacttctcagcgtcttcttccgctgcgcagcgcgtcgagtggtaacgatctatgatctaatatttgcatggttcctggtttacgtgatagaaaattttgatttatgctatcgtagcctacgcgtatcccaacagacagcataatgtagcttggtgctctggcggcttggctgatgttcaaagtggatagtcggtgtcttgctcgtttttgcgatgcctttggcaacgatgatgtgataattgtggagttggagctgctgtgtcgctaagcgacaaggtcggcaacaacacttgcctcacgaagtcaaagcctttgaattacttgcaacaagctctttatcaatggctgtttttttgggctctgctattgtccttttttcacggtcttagttagaatgttgtggttgtggtttttgccagtttctcctaattaactgtgcattgtaaggtttggtcatgttttcttcttaaaatatgacacattcttctctatataaaacgccgcaacggcatgaccgttcgaaaaaagacaacataatgtaggggcctaatgtgcagcaaacatatatttttgcatacaactattggccaagttttagttaactccattaactatccaagctgtgttattttattggctcctttttgtgatttgcatactggtttacgctgatgtgctaatgacatgggactaaatgagcgggtatgttggatgtttagatgccatatggcatttaaactctcttggtgcgcacgagtagcggcaaaaggagaggaggaggatgagcgccattttataggccgggggaggaggggaatggctggcaagcaaggtggccggccatcaatggcgacagtttgtcggagattaaatttagcgaattaaatccaaattgaaaggggcaaacatgggaaaataaagaggaggaagagaggaaccgatttttacaatcaactagtaaggtagcccgcgcattcgcataggcatgtatcgtagactgtgtttgagaacttataatgatgaaatgttaatcggaacttataaaagatcattttatttatttatattatttgagcacatttaaaaaaacattaagtaattggactattttctctaattaaaggaactcgatgttttatgcagtggctcaaactattcatatttcagttagttatttttgtttacgaagtgtatgtttaatttagctatacatgtttcaaaacatagcatggtgcgactctatgttgttgagttatttctttttcttttggcaaattaaatataaaaattttgttctggtactattgatttaatttagctatgcatgtttgtagaatttttcataatgacataatatttattgtcaaaattttaaggtatttagatgtggtgcaaagtgcatgggtggactgtgcccaaatgctataattcttatgcagcaaaatatatgcatatataaatattacattgttagtttaattataaatagagaataattagatagaaatcagaaatgtatagcttataaaaaaattgtagttgtttcaacattgattgtttctcttctagtttagtagctacaaaaataaggaatgggagggcagtgttttctacatgtgagatagaggaggtggagggattttagtgaaaactgttgatgcaaaaacacgaggcctggaaaatctgcttaacttcagtgcaggtccaaaaatcttgcttttaggttcgtgagtgtgccagttgatttgatcctgcaatcaacaagaaataaagacagaaaccgcggttaaatccataaacgatagccgatcggctagttaccgatgacatatcaattatctctgagccgatgtcatatgttaattgatcggcaatcatgaataaataagaaagaactaaatctactcgatcggctgtagatattaacaatatgtaattcttatgtcgatatatacttaaatcaagtgattgggatagatcggtcgcgatgccgagacagtataattcacttagatcgaaatatatactaacaatgagattatagatgtttatagcatagccgatcagatagatctagcatgtatcggttaatactccgatactactctatgttaagatattaaagcaagcaaaatatatcacacagaagcctaacatactttgttgtactaaaatcataacataaagggctgatttagcatgtcaattatgtcaattatcaattatcattcataagatataaagctaaaccaggtaagatcggctaaaactgctaccctaattggcaatcaaaagcaggctagagattgagattctaatcacgacttataaggtcaaactcaactgatgcagctataattatgaaaaaaaggacaatatctagacaatcaagccgttggatgtttcacagagtggtggatatcctatataatctaagtcaacgttggtatttaacctaatcggctgccttctaggggctgcaggaa

SEQ ID NO: 1899 - DNA, 7317 bp, Oryza sativa
ttccgctttgattctatcctcatctccgatacttggatttccaaatttggttgttaacacatgcccctcaagtccggaatatttggtaatgtttcggatttgccatatccgtgtctccgagagtatcgctcattgccatttttccgaccgttaccgcctcgctttaaatactaaccgtcgtccccgagaaatttcacaccattagctccgttttcaccgcttaagccaaccttgtttctttctctccggcgatcccctcggagcaccatacgtccccaaggcgatttcccctccggccaaatattctgcccgcggagatgtcgtcctccgctagtccgttcgtcgcgccatcggccgaatacgcagaggtaagtatccatcggctagatcctctcttttcgcaatagattggttcttccttgcctcatcttgttttcatcttctctgttcttgtttacatctgtagcacttgtccaatctggtcgcgatcccaagtttgtcacatgagcatcactattttcttggtccgatcggcaatcttgatcccactgagttcatcatcgccgaaaccaataggatcccttttagattggccaacccgaatctaggtcactagaagaataccttcaaatcttggccttctcttgagaaaactttccctgagaaaagttgggctgtgtggtataagtgtgtatcggctagcaagcaagttcgctgggacgaattaggaatcggccaagcgcttgctcttactctagcaaattcggccaaggatgaacccctgatggcctccgcagcatacttttggtccaacaccctcaacgctttcttgttcaaccaagggccgatgattcccactctgctcgatatcaccatgcttactggattggatgtaactgcatcggctaaccccatgagcttgaacaccaaaaaccagtttgattttaggaccaagagcataggtggctggtctggctatgttgctgcatacacgggcaaaggatctgtcacccccgggagcacacggcttttcttctgatgtggcttgagaaattcctcttccgcggatcaagctgtggccctaccaccaattggcaattcttagccgaagcccttgagaccaagaggcagttccctctgggtaaaattcttctcagctatctgtaccaaatgttgagcaatgcatcggccaagatagccacaggctcagtagtgggtgcaggtggaccatggtggcaattgcaaacatggcttaaccttgttgtcatgatggttatgaatcgaccacctttaacatagtctgaatttccaaggttggagcccactactaatgatgatggggcgccgatgcctatcatatggtgaagctgcatcaacaccagccaattctggagcaaagctatcggctaaactgctcaaagactggttctgcagtttctatgagggcttccagagagatgtagggtttggttcccatatgaggattcagtgaattttgatctcccggtagacttcacatttgaggatatcaattctgaaaaatttgacaaatctagagaagtcttctcgactgctattagtccatgcatccttcctgtcggcatccatcaaggaagaaacatacaagcttcttatgagttttaccatccaatgagctcagctagatagtttggaatgggacagctatcaatcgacttgttctttgccgataagatccagtacagaggagaaatctcatcaacattgatgatggatcggctgctcaacatcccaggacctcctttaggcagtatcgagaacatagagctggcaaggttcaggagtaggaattttgacagatggtgggggtgaatggaagcagcatatattccatcagccggcctctatgtacatgatagatttatttccagatgttgtccctcaggtatatttttactttgtcaattctgttggaataattgttagccgacttgaatcttgactaacttctttctttgccttgcagacaacagaatcttctcctcctcgcaagagcaacagtggcagggacatagaatatgctccaggccttctaccaaatggaggtggattagctcccccagtcatcggctatcatgcccccaagacctcaagtctgcttcaagggcaaatgagagaaccagccgatgttggcaggttatgcattcgaaatcatgaatgactaatgcataaaataaagatatagaatatagggcatttatgctcaaaggagaggaataataacttgccttgctccaacgcaataaatccgagatagccaacctgattatccaatgcttgaaataccaaaggttgccatccaattataatagactctactgaagaagaggaagaactaaattcaataaaagatcgataagcggctaggagagctagggttcagggtatagtatctcctttatagggtatagggattattgggctatcatttgttggcggtaggtttaggtagtataatagctagggtttagttatatgagagtcgattgtggaataggatagcatatcggctaggctctatattttatatggaggttccagagggttggaggctagaggggattaagcaactactgtcacttatattttatgtgaaggctctcgtggtttggatgatagggaatatactagatatttgatatggttaaataggtatgtggctaatatgggtcaaggttgggctttggtagaatagtggttagggtttagttgtttaggccggtatcgagataggataaatatcggctagggttttgggtgtttgctagtcgtcattagagttgggcaacatgacgactagatttggtatcttctctagccggtgtcggtggataatatatcagctagagaaataggaggtgggtgcaggtttagtggggcggaagtgttactccgacaaccgtgagttgtgacggagtggctaagattacacagagcttgagagcaaactgtgtggcctgctgtggaggtcgaggaaatagtgaagctccaaccgttgtacgcgtcgaggcgtggggtgctagagtatcaattcaaccttgggtttgggttttgctaggttttacaaccaacagtttgacgtcatggccagtagaccgtacggacgtccacatagaaggtgtaaagttttaaccggcggcttttagtggctaaagggtattttaaaaataacaggaaatatttgaaaggtaaatataagtttcaattataagtttaaatcaaatatttattcaaatggtatttgaataaattaaggaaattcaaataaaatcttaaaatagcaaatttgatatcaaaatgaaggatttgaatttaggtccaagttttactggaatcggattacggtttaggagatatgggcttctaaagattggattttgaattaaatctagaaattgcgaaatagtactgtagggggcccacctgtcattagctgtcctttttctttttcttttttttttctcttcttcttcctcccgattcctcttctctttttctgttggcaaccgagagggagagagaggagagggcgagcggggcgccggccctccggtggccggaatgcggcgacgccggtggcatatcgtgttcccgctcgatgcgtactcgaggaggtcggtggctggtagagaggaagaggaaggaaaccagaacggaggcggcaagaacttgctctgaccgcttaaagaagtgatgatggtggctgctatggagtgggagagaagggggaaacgggaaaaatgggctcgtcggagggaggcgaagccggtggtgcgaggagaggggaagaggagctacggatggggagatcgaccgacgacgtcgacgatcggccatgggaagagagagacggagctcgaagagatcggtcgatgtgggaaaaacagagggggttcgttcacttatataggccatgagaggcggtggcggatgacggttgtagaggagaaacacaaggacgattttgcgacggcggcgtggaaaagaaggaggcggcgccggcttcttcctgcgattggttgggcagtgatggcgtgaggacgtggcggccgtggaagagttgggcggcggagtagggcgcacggtacggcatcgacgtcggcgtatgaggtcagcaggtgacggtggcacaaaccacggcgacggcgacgctgtgggcggcggcgcactaatggcgcacggcagcggcggctgtggcgctacatgcgcccacaggaagaggagggaggtgggaggatgcggctcagcagtctgggccggcttgggccgcgtgagtgagagaaattcggtccaaagttaaaaaggaggaagtctaattttcctagagattcaaataattgatttagaggaatttggacggctagattttgaaaaggatttgaattcggagatattgatacatggagaaggattttaaaataaggatgctctaatttatttgagtgcaatattttgagagatagaatataacgggatttatttaatgcactcaaatgagagggaggggaaataaataggatgttagccgcaaattatttggcaaggattttggggaagtatttgaggctaataggggacttggattttggatgaaaagataaaacctattttcttggcacaagagtaattattcacaatatttgtaataatattattcttgcaccgagaagggtattctagccacacgattcaaatcggtggctaggtcaaaaggaaggatttggatatttgaattgaggtttaaggataggtttaagatcaaaggattggttaacaattaattccaataagattggaattgctttggtttaggttctagcacaatatgggaaggtttcttggaccataattcataatagtaaaaaggttttcaaactaaatttaaataaaagaaattttaggaaaaagaaggttttagattgaaaccaaatcaagaaatacctcaagataaatttaaaataaaaatcacaaaagattttgaacatcaaagagagattttatgcaagttaattttaggagggccctctaattatattgtcctaggtttaggaggttattgagaacataagaatcatcatgatgcaagattagaaaatagttaattttcaggatgttacatgtcacttgaacacatacatgacgtgtgaaggggtgggaagtgggtcttttccgtttttatattgttaagatagcagtagaaaataataagtataccatgtttaagttaaaataatcgatggttaggtgtattatgtaatttctttagaatttctaagatttattgtaaactactggaaaaaccatctttggtcggtcgcccaaaaaccacaatagtcccagttcgaataggaaccgggactaaagattatttttagtcccggttaaaaactttttgatctttagtcccagttgatgttaccaatcgagattaaagatcatttttactcccggttcaaagaagttattgggtcaagttaggccccaatcatcttagatctttagttccggttctttatactacccgggaccaaaaatcctcccgagcgcacgtcgagtcctctctctcagttttatagataagaccgataaaaaccatatccacttcctctctcattaaaaaccatctccactctccagcctcctcgatcccatctcaatctcaggtgttctccttctcgatcggctctagcatttttagtcccggttagtaacacgaaccgggactaaaagttgattttttttttgtctcggttatttcaccagggactaaagatttatactcccggttgcaaaaccgggagtatagggggttgtaaaccaggaggaaataccatttctccaccagtggtagtgtcacatggtggcttaggagtgttcataggagtcccgtgtggtggtttgagagtattttgtaggaattttagttgacttttagcatataatggatagatatggcatgctaagttgtcgaaatgtgtgcctaatatatctctacatgtttctttagggaatatatttctacaagtaaaattatactggtgtaaactacatttttctgacattgtagatctattttatttacatgccagtgaagttattatatagcatgaaacaatataataatgtcactttcttttcataatttttacaagctaaattatagttaagaggtgtattaaattctaatttgtgattttagttataataatgacacaaatagaacatataatttcatccgatagcaaaaaaaaaaacttcctttaaagagaaacagagaggagttatgtacatgcgtatgcacgggaagaggggacacctctttgtaagaaatagaaaaatcaaactaatccaagtatccaacggcttggagtggtgtgcctattaattttagtgaaatcaagggctaggtttttttctcagattttttctaatttattggagcgtcacgtggcattatagaagcatttatataagcatcatgtgacagcttagaagcatttatagaaattttcacggacttttactatataatataatagatagattggatatcatcgatataatttagcgaaacatatttgtagaattattgaaggtgacatataatataatatgccaactagagatgaggggagagagggaatacgtacgtacaggaggccaggaggggaatgtacaggtggtggggaccagtgtggagagaggaggattttatttttttatttgatctaatggttaaaaatgttggagccaccaatttaaaagaaaatcaacggttatatttttagactgtcacttggcatcttaggagcgtttgtaggagaacacgtggcggtttaggagtacaggtggtggggaccggtggggagagaggaggattttattttttttatttgatctaatggttaaaaatgttggactaaccaatttaaaggaaaatcaacggttagatttttagactgccacttggcatcttaggagcgtttgtggagaacacgtggcggtttaggagcgtttgtaggaagtttaatggacttaggaggattttattttattttatttgatctaatggttaaaaatgttggagccaccaatttaaaggaaaatcaacggttagatttttagactgtcacttggcatcttaggagcgtttgtaggagaccacgtggcggtttaggagtacaggtggtggggaccggttgggagaagagaggattttattttttttattggatctaatggttaaaaatgtgggacttaaccaatctaaaggataat

SEQ ID NO: 1900 - DNA, 17279 bp, Oryza sativa
ggcagaggctgtccctcgagatatggcacgtgaatgtggtggggccagcagggactgacgacttgttgacggtccataagtaaaaaatatatgaccatcaattattgcataaaaccaattggaataaaacatcaaacttagtgatagtggtcattactaatcatttccgcacgagttggtgaatatttgtttgtaggtgaattatggacgaaaactactagccatgcgatgaaagacacccccggacaattggaaacgagtacatggattggaggccccacatgttaatcaaaatcacctaaaattaaacccatgtaaggtacaacatgcagatggcccaccatgcaacctctcagccgaaggattaagtttgttttagttgcatttaatttaactttccttcacaaaattgcgagagcatcgccaccggttggacagagcaccactgtcggggtgtgcagccatagtcgctagcatcactagagcatgcattgcttatcacctgatgcatacccagagggcattggttaacacctgatgcatacctagaggttagacaaaggagccgacaaatgcattccaattggacctccatgtagccgaataatagattctcactgcatctagtgtgttgttactgaaaaaaaacagatatacggttttgtttggaatctatagagctggacaaatagaacattttctaactagtgtagctttatagcaactagattgtctagtgtagctttatagcaactagattgtccagtgacgttaggggatttcaatataataagaaaggaaagtgagaaaagtaaaaagggttatagtagatagagtttcttaatgcaataattgagcaaaataatttaatacagtttatgagaaattagatagtattttggtctcaaatgaatcattttcccatggtcatggtgaaggttagaagtttagaaaggttaatagagcaacgctccgctgatttctacttgcagtattctactacaagaagaattaatctcgaccctttattttaaagggtagattagtaatctcttaataaagattaggggtaattttggcatgggatatttctctgtcttgatcgctcgcatcaggtccgatcgctactcccctaaaaaaagattattgctactcctggccggtggcggagcgactggcggcgctgccagcgttgatggaaaatcgcttcaatctgcttgcacacatcgggcgtccctcgacgcgaaggaagccaacgcggtgatcctgcaatcaaatcaacaagaaataacgacaaagaaaccatggttaatcctataaacgatagccgatcggctaagtgccgatgacatatcatttatctttgagaagacgtcatatgtgtatcgatcggcggtcataaatagataagaaagaactaaatctactcgatcggctgtagatattaacgatatatactcctcatatcgatatatatacttaaatcaagtgattgggatagatcggtcgtcatgccgagacagtataaatcacttagaccgaaatatatattaataataggactatatatgttcatagcatagccgatcagatagacctggcatatatcggctaatactccgatactgatctatactaagatattaaagcaagtagaatatatcaaacaaaggcctaacatacttaaatgcaacaagatcttaatataaagggcagatttaacatatcaacgaagcatatagagtaaatatagttaaatcagataagatcggctgaaaccccgatactacctgttggcgatatagcatgaggcccttcgaccaaacctgccgaaaccatgcgaccagtgggcccatgaacctcaattatattgtgtacccatgtaaatgtctctttcataagggcaactatgtaaattcccctgtataaccaaaaccctagtagtaagaacctataatggggctataaacatgtaatagggggatcccccaagaaaaattctcaagttaatacacttcttttccaactactgttgagtaaccacgtctttcgacgtatgcagttgtcgtttcgacaacactaccctaatcggcaaccagtaggcaggctagagattgatattctaagcacgacttaatagatcaaactcaactgatgcaacattaagtatgaaaagaagaacaatatctagacaatcaagccgctggaagtttcatagagtggtagatatcttatataatctaaatcaacgttgatgtctaacctaatcggctgctctctaccgacagatgttagccgattgtaggttagatagcgatattgccaaagattatgtgagatatatgataactcgacaaattacataaacaagattagagtgtcataaagatggaagcactaatcccaagaacgcaagccgtcataacaagttttacctcttgttgaagatcgaaacagatgcagctcaacccgaaagcaagaactcgtcaaaataaaactaaagcaaaagggtggcgatgcgccgaaattgtattgaacgtgtgtgttaattgattacatggggttcggggtctatttatacgcgagaattacaaactatgtccatatcggacacgacttcttatctctgacaaagtctaaaataccataagtctttacggcagacttttgcccaaacatatctctaagaaaattacataaaatatcctaattaatagatacaattgccttctcaggactctatccatgcgtggcaatcatcttgaagcatatcaactcaacccgatgtcgtacaccaagtcgtattgtcggaatcggccgtatcaccaaaccaagtctgtctcgaatttagccgatccaatcgtagctatcacgcccagaaatttagcccaaatttccagactattttgtgtattaaatccctgtccaggactagccagggtacacaaaacgacaagtaataaacagttccaaacgtaaataaagcgtaaaatacttacaggagaggcacttagtcctcacaccgaaacaaaagcagcggcagcggaaaagacgatcctagcggggcttcagcaccactccacaggcaaaactcaactgaggtctaagccttggtcctctaacttcgtcctcagctcagaagcactacacttctgaaaagggggaataatagcaaggctgagtacaaccaccgtactcaacaagccacaccaatgatgcaggcgtgcaaggggaatacaaggacggtttgaggctatttgcataaaggcggttgtaaaacattttattgagcaaaaccgtaaaactattgagtaattaaagtagcattaaatctccactgatcaacgctataccacgttgaacaggcccaaccaacccacctgaactacagtgcattgagtcgatttattaaggtgggactaatcacggtgaatctggtcgaccgctcataaccgcgggcacggctattcgaatagttttactctgatcagagatgtacaactgtacccacaagacacagccccacgacacgtttccgtgcgctgacatgccaccacgacataccggaaagaggccgtgacaggacccttcgcataaccccctctaaccaagcacaccacacctcaggtttcacccccaatcctcgcaaggcagcgggcagtcccctctcgtgcctaggtgaatccggaagccgcataggctgtcgcagggcccatccaaactccatcacgcccacccttgtctggatgcgtcagctagaggaaagctacactacaagcccagccgttgcccacgctggcttgtggtaagcacgataaattcttccagggtttccgcgaaccggtccttaatcgccatgggcacgactagcaaaaccatgcagccacagcctaccatgtagtcacattttagttggataattacgaccatgaagcatggccagatgtctcgagcacgcagctcattctgatactaaaaaggtctaatactgtaatcagctcatcaactgagctagtggtaattaagcatggctaagcatatagttctagctaggtcacataagtaagatgagctagtcgatttattacccaaggttgacaaaggacagatatcaagtaaatatggcacaagcaaacagataggtaatacccggatcccatgtaattagcaacacatgcaattttatttgcaaacgataaaacatttataaattaggatcaaaatgctcaaggggaatgtgtgacttgccttgcttcttcacttggatcttctgaactcttttcctcgcgaccgcgatcttccgaaacgacggattctacacgctggcaattctacacgctggcacgcaaaacgaagaaaaactctaataaaaaccaaggaaacagtacataaaaagtaaaaaaacatgtagatctcaattttagatgaattttgcaagttgaatggcccaatttggagttcgaatgaattagatatgaattttagaagttctgagccatttaaatgaatttctataattaataccaatttattgcgcaattattaaatatttttccaaaggaaatgataagtgctgacgtcagcaaaggggaagggtgccgacaggtgggccccacacgtcagcgggtcaaagggggtggctcatggtggactcggtccaccgcagcacaggcgcgcgggcacaccacgtggaagaccacgtggcggccacgacggcacggcggggcgaggtggcaaaggcatggcgccgaggtggcgccacgtgggacaccagcgcggggcggcgccagagccacgtggacgacccggatcgccccgaaggggatcgggcggccacagctagcgggaacggcaaaactcgccggccgaccggccggggagcgacggcgagcagcccagaggtcgccggcgacgaccaccggcgcgacggcacgcgcgagaggcagcggagggaggcagaggagggagatggggagctcaccaagcgcacaaggcacgaaggcggtgcgggagagcggccgacaacgaggaaaggcgacggcgtttcctcggggaggcacggctacggcggtccgatggcagtccgcgagcgaggagtggcggatgacaactggaagagcctgaggaggacgaaggggggattagaagagggagaggacgggcatggcgaagggcaatagtggccgaaggccgaccgtgagtagaggagctcaccttgcgcggggaagatggggttcgagcgacgattgatggaggcggagggatggccgggctgcgggcgacggccgcggtgccggggaggacaacagcgcagcacggtgtggaccggagaggcggcgcgacgcggccggaggcagcaaaagcggcgccggcctcgggcttgcggtggaggtggtgattcggcggtggatcgaaggagcggtgtggtggccaggcttgcccgcgcaacggcgaagctagcggtggcggcgacgcggcgcggcgacggctagagcggcgagaggcggcggctggaggcggtataggcggcggtggctcggcctcgcggtgggacggtgtttcgcgggtggaagagggaagggaaacggatgccggggtgaagcgtggggcggcgatgccgatggtggcgacgacgcagtgcggcgatggcgagaacggcggctagaggcggccggagctcgccggagagcggcgacggctcgattttgcgtggggagggcgggggagagtgcggggagtacgggaaaattggggaaatggacgagggtcacatgggaaatcgtggccgagaggggcggaatcgggcggcaaccggccggcgacgtggggtggtgtcacagcctgaattttcgttttaggatttataaattatctaataaattattaatagaatttttattaaatgttctttaatttacaagtgaagttaaatgtgggatataaaatttcctaaatataaagcatggatggatttaatttttattaaattctccatgattaattacactctctgaaattttctcggatttttcagagctcaattcctaaatgatacaaagaacagttcagtaattagttaatcaattaatgatctaattataattatgttaagtgcttttcttgtttaaaaatccttaatttataaattgttgtctaaaaggaattattagaaatgatcttaaaagcctagaagagaagatctattttttttaaaatttgttaaatctcaatataaaagtgggctagaaaaaaattcattaaatactttacttgattctatagttcctagatttttctgggatttatttgagccaaggaagtatttttaatcaatggaatatcatttcatgaataatttaaatagaaaaaggttttaaaatctttcttttggttttgggccgaaagtcagcccaagtctctctttctccctctcctcggactgcttgcatctggcccagccggcccagtccgccgcgcccctccctcctctctctcagccgctgacaggcgggacccacctgtcggggtcgtcgccctcctctcgtcgcccggccgcgcccgagccgccaccgctgcccttccaaattccgttgcccctctctatttccggtcaaattgattgagggcaaatgatccttgagatctcctcttccttttctcttttggaaacattggctaattttctttggaaaccagtggatttgagttggattcggattcatctctctcctctaaccctagagtttccttctcgccgccggtcaccgtgggcctccgtcgccgcctcctagccactataaaagcatccccgggacctcctctatccgccgccacctttgccttagcccgccatcgcgtctagcgccgcctccgcgtagccctagccgtcgccgtcgttgccgtcggtccagccgtgcgccgccgtcgctccagtcgtcgccgtcgctcggggaggtcgccatcgtggtcgccgttgcgtcgccgtccccatccaccgcttcgccgccgctgtagcacgccggagcaccgccgtcaccgtcgacccgaagaccgccgccgcttcaacctcgtcgccgtcgtcatccgtcgtcgtttgtcgtcgtccaagagctcggtgagttcgccgcgtcgctctctacccgttggtgtcctccttttgcgtcgtcgcgccgtcgttcgccggcgagcatgtgttgccgagccgccgccggtgatgacgtcatcgtcgctgtccccgtagacccgctgtggaccattttgaactcggccgcccgttttggatagaatcgatctcggccgttcgtttccttagactgtcccgtgcacccggtttaccgtggaccgccttggatgacgcaataatcctccttttccttttcaaaaataattcattattgcgtcataattcaattaaaatccatataaatgctttaatccggtttaatctttaaaaattcatatctaattcattgtaactcggtttaatgtggttcaagttgcaaaagttgtgtaaaataaagatctacatattaaaattatccataaattgaattaaatttatttaattctttttaaatgggctttaattagatttaatctagtaaaattcataataaattcatatgaagtcagaatgaggccgttcaagtctcataattcatctaaaattatgatctacatgtttgtttactttttatgtactgtttatttggtttttactagtctttttcttcgttttgcgtgttagcttgtcgtttccgtcgttttgaaggttcgcgagtgcgccggaagtattatttaatgatggcttaataatagttcacgatggtcaatcgtgattggttaattaattacttgccaactaaaacttgataatggtgggttgtgagcacatggttttgagagtcgtgctcatgacaattaaggaccgcttcgcgagctactattgtgaaacattaaccgtgccaaccacaagccagcgtgggcaacggctttaccttttgtatagcatggttcattgcagagcaccagactgagaagtggcggagataagcccacgggggtcgctggggagtccatgccttgtttataagggggtgattatgatccaggaacggtgcactgctttgagttgtgttgtgcgaggggtactgtcacagctcctttccgaggtaccgtggtggtattgaggcgcatggtgacatgtcgtggggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttggagttagatctgtacagccgggtatggttgttcaggatggttgggcctgtgcagcatgggtgtgctgttcagtgttgattaaaatttctgattaattactctactgttttactactcttaactctttgctaaatgctgctttcgcaaatgagactatattatgccatcctttggtatccttgtgcacttgcatatttgctgtgtggcttgttgagtatgtcatatgctcattcttgcaataatcaatcaacctcagttgaagaaaaaggatccagaaggggaagacgtttggtttataccccagttgagctgcttgtgggagtggagccggagcttcgctagaccgttattccgctgcagttttcttttcttttgtaagtatgtaacgttattattgatgattctgtatattaaattgtcagtttgtgtacctcggttgattcctggacgagggttttatgcacaaattagttcggaaattactagtgaatttctgggcgtgacaggtggcgacgtggagcttgagagaggtcaaaccggcgtgatttttggggaaaagtgggggaaaatgaggaggagtgggtggcgaccacgtccgcacggtcggacgtgcgcgcgggaggcggcggttttagcggcggggtggggcggcaatggcggcagttgccagtccatggcgatggggtggctggaggtaggggaaggggatgacatgtggggtcgcaggtcccacctgtcaaccaatggaagagagaggggaagccgggtgggggttttctagactttgggggggagaggggagccgagctgggccgagcggcccaaagaggagaggggagggaggcgggccagaggggaagggggaaggaatttgggccgagcccgaaagggaggaaggggaagattattttcttttctttttatttaaattgattaaatgaactttgtattattataattatttcttgagctttgaaaattcgcagaaaaatcctgagagtattttagggcacaaagaatattacaaaatattctcggccaatgatttttaaaggaaaatttcaaattctcccattatttcacttgattgaattgacttaacttttatttaatttctagaaaatgcattatttaatgatttttaatcctgaatgaaaatcgggtcgttacagtagccgatccgaactccagccgattcttactctgttctcgcgataatctttatctctgattccgccttcctttccaatgccgatgttaccaaatttggttgttaacaccgcggccggcgtgccagtgcctcgcagcgtgcgcgcaactgtacatgtccgtcatctcctagctccaggagaaagatgtacctataaattacaatagtacccctacgcaaattattatccctggacgaatatacccctccatatttctactaccactaactttggtggaagtagaactaaatcgcaaccctacaattaaatatgatcaacgtctcagattactttctactctaagtagaaagcaccggagcaggactctattttctgatcatgtgccaattctggtagatacagtacatatgtttgtccctcagatatacataggtttatttgagcaaactttattttaacttaggttaggttagtttttttaagtgtcctaatttacgctctttccattttaattagcacatattcattttaaaatagattcacttttatcctcttatctacccttcgttaataaatccatgagttttatttccccaataccccttatctacttattcactaacactgttttcttgttaattagaaatactttggtcttttccctattaatttgaacttaattggcaagaaatgaagttagtttcacgtacggaggtggtaaaactttaaaaggagtggggtcctggataatggcatggatgaatcgggatagtttagactgtttttcctcacccaaataactataacttgaccaatatagcatccgtaggaaatacgtagtccatcttgacgatctagctagatacgtaccatgtcgcataaattgtcacttggggtactattttttgtcttgaaaaaatgaaagaaaagacggtacatacaggactttttcatcagtttgcaaacttttcatctcaggcttgtaatcattaacgcctggcacacgtggcgtagagtggccgacgcgttaacagccaacgaaagagtcatcagtcacggaccgcatccacgactgttttcacatgtacgttttgctagctacaacaacaatttcaccgtctcctagctcagatacgcctgctacaacaacagagttgaaagcatttgcctcatactcctccgtggtgttggaaacgcccatgagtcaattgggagcccaagggacaggaaactccgagtcaaccaaggcggctgttggtgaggtggtgtactccgacgaggtttcgacacagctagtgaagttggcaacgactaaggtactttctactgaggttgctgtgcagctagcaggaacagatgaggtggttacgaatggcaaagagcaacaacaagaacctgtcagcattgcacaagaattacagcatgtttcagctagcttgttgtctcccgtggagcatgtattggattgcaacgtgcagtctgaattgttccccgagaatagccggcttgcaggcgatggaagagtagcatcgactaagaacttgatggcagtactagcaaccaatgaagaccaacttagtgcctccagggctgccacatctaaagcccaggattcagcacaggcagttggagctcgatccccgacaagaaggcgacctcgtcgcccagtggaccctattccaactaggcaaagtgaaagatagaaggcgatagcaaatgcagatgcgccggtggcaaaccgggcagagctgctaaaaaaggttcataaccttgagacgctaacaggtaacaagtttaataccacaaattctgttgtttcaattccagataagactcttgctacaaatttttctaaattaggggtttctctaggaaagaatgatttacaaataaaggaatccattaaccagattaaaatttcagaagtggatagatttgctactctttatagtagtgctgtagcgtctactagtaatgtagataaaaacaacgatgaattgttaaaattgtcttctctccagcacttatgtagtgactggctagaagaggctgagagtaatgacgatgagtctatggattctcaggccatacctcgaatgaggaagatttcgaccaaagtcaaacataaagtggtatgtcctcttttgactggtccaaaaaagaaagctaataagtttaagaaatgaaaggaatattttggaatagttgtggctttggtgatgcatctaaatttagatttatatctgaatgtgttaaggagcaaaatttggattttattgccattcttgagactagaaaaccatgattcaccccttcaaatcttaaaaacctttgtggtggaaaagattttctttggcatgagaaacctcctatcgggcgatcaggaggaatacttttaggagtaaatttaaatgtttttgatataggtgaaatttcagaaggggacttctatgtgaagtttcttctaagaaataaagaggatggtttcaaatgggtttttaatggcagtagcaccaataggattacaacggttgctcacaaagtcattcgcccgacccaaacggcgtttttgccagatagaaatatcatggaaggggtggtgattttgcatgagactgtccatgagttacacacaaagaaaatggatggtatcatattcaaaattgactttgaaaaggcttatgacaaagttaaatggcagttccttcagcagacattacgaatgaaagggttttcacaatcatgatgcaattggatttctaactgagttgaaggaggaactgtaagtgtcaaagtcaatgataatgtatgaaaaaatttccggacatgcaaaggcttgagacaaggggatccaatgtccccaattctttttaacatagtggctgacatgttagccattcttattgaaagagccaaagccgatggccaaattagaggggtaattccatacttagtggatgatggtttgtccattctccaatatgccgacgatacaataatatttcttgaacatgattttgaacaagcaaaaaacatgaaggccattgtttgtgtgtttgaacatctctcggggctgaaaataaacttttataaaagtgaatttttctgctttgggggagccaaggaaatggaggaccaatatagacaactgtttggttgtaattctggttcctttccattcaaatacttaggaatccccatacactatcgaaaactcagaaattctgattggaaatgtgtggaggataggtttcaaagaaaacttagcacatggaaaggcaaaaacagctcctatggtgggagattggttcttcttaacttggttctttcgagtcttcccatgttcatgttatccttttttgaaatacctcgaggtgtacttcaaagactgaattactatcgatcgagctttttctggagcagtgatagccagaaaaagaaatataggttaagaaaatgggattatatatgccggccaaaagatcaagatggactgagtgtcctaaatcttgatatcatgaatagatgtttgttgagcaaatggctattcaagcttcttaatggtgatggtctatggcaaaaccttttgcgcaacaagtacttaaagggtaaacccctctcccacatgtcatccacagagagagagccatctctctggactgcactcttatagtcgacagctctatgtggcttgtcaaccaccggaccgtagctcctcacaccaagaaacccagtcttcccccagaagactgtcttcctcgactatacattctcctaccccaaacactctaacccagacagcattcgttaaacggtagcttccgcgcccttctgcctgctgaaattgatgtgaatgatcgtgtcttcgacatcaatttcagtctgattagatatgtcattgaaacaaatccgttttgtctctgttttcttttcggatgagccagaaccaggaacatcccaattttgggctggcctaataaaagtaaaagatcaattttttcagtatggatcttttaaacctggtaatgggatggaaataagattttgggaagacatggttgggcttgcaacctctcaaatatcaatatccttctctgtacaatgtggtccgaaaaagacattctactttggcagaggttatgagcacaacaccgttgaatgtttcattccgacgatcaattgtaggaccaaagttagttgagtggaatgatttgatctctcgactagctaacataaccctgtcaaatgaaaaggattgctttatttggtcgctacataaaaatggccatttttcggtcaaatccatgtataatgcgatcatcaattccaatgtaagaatccacaagaggatcttatgggaggtaaaggtaccactaaaaatcaaagtatttatgtggtttcttcacaaaaaaaaaagtaatcttgacgaaagataatctcataaagagaaattggagaggaaacaagcaatgttgtttttgtaatatacaagagaccatccaacatcttttctttgactgtcatgttgcacgttttgcttggcaatgtgtcttctttgccttcaacatcccccctccccacaatgcaaaagatatttttggtgactggctaaggggagtgcctagacgcacaaaaaaaataattttgtttggagctagtgatttatgttggtcaatttggcgttgtcgtaatgatatagtttttaaccataaaaaatgcctaacatcatgcaggttatcttcatgtattccaattggctccactcttggtgtatgatgctttcacaggaacaacaggatactatgcgcaatggtgctacacgcttggaattagtagccaaggaacttttattccagtttggatggcgtagtacctacagaatttcgtgatagaatctacgtgattttgaaaaaaaaaattattttagtagatcatatcatcggcagaagttgggggtttgtcccagctcgccttttttaacttttctgttcacgtctgaattttttggctgtgtgcctacgagcagaggctggagatgtaacccatttccattatctaaaaaaacgtttttcgagctacaaatcgttgtgtttttaaaaggaaattctaccttagagattgttgttatggagaattaattactccattttttttaatttaaaataattaatacttaattaatcgtacgctaatgactcttctcattctgcatatcttcatagttctctcacttttcattcactccgatggtcacacatctcatcctgacaagtatcaattacagcaattgagcaacgaaataagtgttaaattgtcttttttttccgtcaaacacacaccctaagttgtcgtgttccaaacataaggggcttgtcttactttctaggatcatcatcgtcacaattcgatggacttgactgatgctagagctaccgagtcattggtgactgctgaaatgagatgtttaaattaaggttgaatttaatgtagtaaggcccggcggctatgggcatcagtacaagcaaacgataaagaccttgtacatgtctaattatttaaaaaataaagccaaatcaaagctctactctataatactcctccgtgacaatgtctagaaatatagctacctaacactacgtatctggatagggttatgtttagattcgtagtgttaactagctactccctcgatctattttaggatttttaatttttagtaaatattaaggttaattcctctttagtaaaaagatttctttctaactaattgattggcttttaaatcattgaaatgatgaaaataattgaaatattagttcaagaacctataaagcatttatatttttgaacagatgacgggggattatcagtcaaagaaaaaccaaagagactgcaactagtgcaatgcaaacacttggagacgatggaaaatggcggttacattctgtcgtcagtcgacctatacaaggttgcagttattaattaaataccaaggtttccggtcaatccttccagatcatctactcactctactacgtcagatacgtctccatcaatctgtgattctaatgtaaaatagtactcacttatactatttttggtcaaataatccctctaggcggctgctaacaggttccaaatatgtccaaattagcctttcgtcatttattctttgaatgcgatgtaactaaattcacacagatctgttcacattggacatcacttcgcctatagaatatcacacatgtattgggtcatggtttgatggtattaaaagaactatttcgactattttaacaggtactagtgctagtcaagatgccaccttgtaaaccatgtcaatttaaatgttatacatttataatagggtggatagtcaaactagtcctccaaatttcacctacatctcagtttgatccttaacttttcaattctaccttccatattagtccttaaaatttttattttagttcagactcatccttagagctatttaggaagccacatgactaaatctaatcaacatcataaataaccctaatacctctctcacacatatataagaaaagaaaaaaagtatatatagaaactatatggcaggcatcacccttttatttttactggcggaataacaaaacaaatgcttggaaaatttattggaggattctaagtcacgagacgacagcaaaaaccaacttcccatgacgtgcacttaggaggtccgccataaaaaataactctatttttttaggtggacctcttaagtgtccgccaccaaaaaagggtagataaagagcaccgttgtgaaaaagattcatggttttaaaagttgcacatccactgcccaacacccaccaaaccctccctctcctctccgccctatctccgctccctcgcctctcctccttcctctcccttaccctcctttcttcagcttctcctcggtgctctcggagatggtgatggcagccgtggtgatgacgacgacaatgatggaaacgagaggtttgttcacggcggatccgacagtggggcgggacgtgggcaatggatgtggcagtgaggaggcatccaggcggtggatccggcggtgggaggtgcgcaggcggcggatccgggagcaggaaggcacgcggctatggatccggcggtgggaggcatgcgggcatccgatccagcagtagggaggtacttgggtggcggatccagcggcggagaggctcgtgggtgggccggtggagcatggctgcgcgtgtgggcgggcaatgaagctcagacggcggcggatccagtggcagggaggctcgcggtggcgagcgggctggtagagctcgggcacgactatgtctacggacgaggcttgcgtgtgcgggtcctgcggcatgtcggccacagcaaggacaactaatcagcgacatcgacatcgcccctccgcaccggcaagaggagctcgacgccggcgtcaaagagtgcgttgaggtggtcgatttttttatcttagtgtgatacattttatggtttgttatttgtgatttcttgaatttgtggttgtgggattggaggatgtgatgtttaatttgtggatttgttattgtgggattagatgcaaattcatagaatctgtgattgtgggatgtggtgttcgatttggatttatgattgtgggactagagacaaactgatctggactgtgaatctggtttggttggttctaaaaatatatata

SEQ ID NO: 1901 - DNA, 2446 bp, Oryza sativa
ggtcatctattaaaaaacgaagggagtagaatatatatagattcattagcatctatatgaatatgaacaatgctaaaaagtttacattgtgaaacggagggagtaaacgttacactaactatatatattaatccatgtcgacactccatgtgcatgcatgtacgttgtttaataatgctttaatcaacaaatcaatcacattcatcaaggcatccaacaggagaaatagttacatactaaatacaacgaacaccaactcgcgtcgcgatcttcctgtataattggtcttcaataattgtatatatatacacccgatctagttagtcaaaagagtaattgattattgccttattgtcttaataaagaaaaagtctaaatacccttaaaactttaataaaagtccatcttacctaaattgtaatcattcatatgaccttaagatgattttacaaagtggtttttatttaattcttttcagaaataaagtacaaatgcattcactaataagagatgcgcactttccctgtaagtacacacgtacactgtaccctacccttatgagcaactccaaaagactaggttaatatatcttgatattgataaagtaaccacgcagttgtttgtgtcagcggccacgtcacaaaccattgaatgaataaatcgcataaatactagcacgcatgccaaatctagtacttcaacccacataagtatgttgcgccacaagaaacccaattatgttggatcaatttgactatttgacatatgcattagatatatgttaaaatctctacctaaatatttctgtttagtcatatgtttgctctctcttaatatcaatataatactagaataacatcactgtaagcataaattgagaatcgaggattgactatgtgtaaataaatatgttatattcattatttaaaaccgtccgtttaagtgtccaaatccacaaaaccgccgttcaaaaccaacttaaggtgtaatataaacaatactataaagtttagagattggatgtccagttctaacgtacgttcagtgtactaggtagattttcatccaaaatttatggagtatatggacttattcctctcaataattaatgcaacgttcttgctgtaattcccattatttatagaaaataatttggactacaaaaagaaataattgagggtaattaatataatcgtccggacatcgtgcgtacgcctacaaaagaagactctagctaattaagagctgtccacaccatgcatccgtccgcatataccctgtcaacaatgtcagacttaatttttgactttattttttcagaacactctatatatatatgacaccgatgatcgatggctttgggtgcctccctttgcctgccttcattcgtgaattaaaagctttgggtgcacattgccttcaaagttcaaacggtgcaagggcagggcaggtacgtagctctctggcctgtgggctgctggtttcttcctccacacctctaaaaagtactactttttttctactgtattgcttaggccatttcttgtaagcacttaggttgtgttattccccttctttcccaactcaactatctttttcttccatgtaagcttttcaaactgctaatggtacgttcttggtaaaagttttctgaagttgctttaaaaaatcatattaatttattttttattttttttgctaatacttaattaattacgtgttaatctcagccttagtatttgttaacaggttgtagcatgtaggatttaattctttcataattaaataaataatctatcagtttccatttagaatgctggctaattctttaattcttatgtttctcttgatccatgcttcattactactagctattgttatttgggttcatctgttgctcggtcgaggctactctcactggtcagaaatctaagcttcattgaggaagcaccggtggtaagtgtacaactaacccaacacaagtcggttactaattattatattaaccgcctaaatttctcctaaaaaataagcaccattttaaaactctaataaataaacaccttaatttggctatttgcaggaccaaagagaggcatgtcgacgatggtggtgagcgcatacaagggggtgattgactctgttcttgcaaagctcagagagctgatgggaggggacatgtgtgccaacctcataggcgtgtccagcagggacattttgttcctcagggatgagctgcctgccatgagtgctctcctggagaagctggatgatgccgaagaactcgattcggaggcgaaaaattggaggaaccaagtgagggagatgacctacgacatcgaggactgcatcgatgatttcagtaacaacatcacaagcgtagacgctaagacggggttcctctacaaggcttcccaatttctcaagacttgcagggctcatcttg

SEQ ID NO: 1902 - DNA, 3332 bp, Oryza sativa
attaattaattgctcaattatttcctacatactgtacatttgtatatttgaaaaatagttgcatatttaatacaagtattcgcttcaaatataaagatgaatataatgtactcctctccatccaaaaaaaataaggatttctaggttgtttagcaaatattaaagtaaaggataatagagtttagtattcctcttaaatgagggatggattggagtgggagggtgtttgaggttaaagatggtgaaaattgattgagatgattgatgggatacatagtagaatgcttatatttgtagataaatttcaaaatctgggaatttttatatttatggacagaggaaatagaatctagtttccaattgcacgagctttgattttgctaaatctatttaaaagcgagtgtttaattattccttgcaatttaatatgtaccgcacgtgaaatgtttttgtaggtacttcattgtagttgatgatttgtgggatgttccttcatggaatattattacatgtgcttttccacaaaataatcaacatagcagagttataataactacaagacatggggatgtggctaggacatgttccagtgaccatggaagcattaacaatatgaagcccctaagtgcccaaaactcaagagaactattcttcaacagaatatttgggtctaaagattattgtccctcttacttggaagaagtctcatgtaaaatactgaagaagtgtggtggcctaccgcttgcaattgttactgtagctagtattttagcttgccaacccacaagactgaaggaggaatgggagtacattcaaagttctctagccactaacaaatttgcaaggaagtccaccttggaagacatgatgcaaatcttggagctcagctacaagagtctgccacatcatctcaaagcatgctttctttatcttggtgcttacccagaggattgtgtgattagcaaggttgatcttattaaaaggtgggtagcagaaggttttgtgagtcactctcctgggcaagatgcatgggttgttgcagagagctatttcaatgagctggtgaatagaagcatgattcaacttccatatcagggctactacaatgaagtatctcattgcaaggttcatgatatgatgctagacatgattctaatgaggtgcaaggaagataatttcatcagtgtgatacaagatccacgagcggcgatagaagttcaagacaagattcgtcggctcaccattgacttgaatggtgccatgggtgacacaatggatatgaacattactaggaaagtgtcacaagttcgttctcttggtgtatttggaggatcaaagtggatacctcctttgttggagtttaagtttctgcgggtgttattccttgaattctttctacgagagatgataattgacctcactggtatcaaccaactgtcccagctgagatatttaaaggttgaatgcaaggaatgcctaatggatggtgacataccatcacaagtttccatagtgttaccaagtcaaatccgaaggctacaacatttggaaaccttggagttaccctgggtatcaaaatgcagcatcccatcaatatcaggcatcattgatttgccgcgcttgacccatctagtgttgcgacagcataaggggggattaccggatgggattagaaaattgaagtcattgcgcactttgcatggctttaatctaccagtaagctcattggaaaatattgatgccctgggtgagctcactagtctagcagatatgtcactccattgtggcaaacaagacacaaaatctactactccaggatggatgactgctctgagttgttccatcgagaaactcggtaatctcaaaggtctttatgtgaggtctaatagtcctagctgttgcgccgatgcgatgagcagctggttttcacctccatttctcaaccttgagaagcttgatctgctagattggacattctccaaagttcctagatggattggccaactccatagcctccgtgagttggcacttgggggcaagaagatactccaggaagatgttagtatgatcggcacaatgctacccttcctcacccatctaagcctacgtattgttacatgcaatatcgcggtgaaggaaagcaggatcatgatagaaggctccataggattcgctgctctccggtttttctgttttgactctaataggatgtcacacctagagtttggggtaggtgctatgccccagctcaagaggctgctattagcacttgatccatgggaatgggatgaggccacacctgttggacttaaacacctcttgtacctcgaggaaatacgagtattgacagcatcaacagctgttgcttctgcaggatctgaatcaatgaatggcaagtctgcactagtcaagggtgtgttccatgatgccgctaatgctctccagagtcgcccagcatttaccgtgctcccaaggatccgttctctctctgatcacgtaaattgttgtaaaattaatatggaaacagttgcatgtaagtaggatttttagggaatgtatatgtaattgttgtagcaagatttgttcttgttccaactgaacatggttgttaatgttcttacttgtaattgtaagttctaatcttacatcaaaaggatgcttagcctaacacatgatcaccaagataatctaatgtggaatttggtgcactggccggtgtcaattggagccacaagggtatcgtcttcctctgttcttctggctcatgagatgttgatgttcttagctacctgtgtacttgaggtacctcgaacatgatatcgtctgcttgaagcaaagatgttgcaggtgattgtcctccgtggggccgaaggggttgcggttgattgatgtccttcgctactacagatcaatgatgccgaaggcattctagtgatcggtgttcctcccaatgtcactacctacatgggacaagagtctgatcaccatggaatcttcttccacggtttcgtaggattgaatgtttcagggtttatgggagagaacgtgcaagagtgaccactatccatgggaactcacttaaatatcatagtggataactacgggaaactccatttagaaagattttaacacgtttctaatcattccgtgtttgcgaatgtcattgatcatgttcatgttttccagccagttaggcccaattgatgagcatatgtcactaattgcctagcctaccactataccatagtgtcggccatgctcccacccaatcccttccctaagctcactccaaccagtagcgttgtctcgtcctttcctctcctctcctctcc

SEQ ID NO: 1903 - DNA, 6773 bp, Oryza sativa
accacaaccagcaacctacatatgggccaaagtaccaaagctcaactacacgaagcattaaggcctattatggcctgaagttaccgggacaacgaaccaagacctactccgcaaagacttcaagcccacgataaggtaggctcaaccgctacctccatctttccccatgcactagggctagggcaccacattttcttgttggaaataagtctattttgcatcccttaaatatttcccttggtccaatcacatctctcaaccgcaaaaccacaacctccctcattgccccttcatctgtgtcgctggccctccatgtcacatgtcgccgtcggcccttcacgccctgtgacgtgaaacataagcatgcatagtgccactgccgccgtggagcagtgaggagagccactgccgccatggaagagtgagaagagggattcggcaccgacgaagtcagagacgagaagcttctcgagacacgcccgctcctctcggtcgacggctaacgcaagcgcctccgatccaaccgctgcgacatccgcacggggaggaggacgcccacagcaaccactgttgtgttcaccgtaaggtcctgcatcgcaccaccaccaccgagcacacagcacggggatctggtcatgtgtaatgggaatggtgctcgtcgggtagagcgggtgaccggtgcaaccgcgtgacagcgacgaggcacgaccgctcctctcagtcagccgctagcgccaacgcctctgccgcctccacctcctccaccgctggccatgccgacatcgatcggcgtcacggcatcacctccttgaccaacccatctaccatgtcaaacgttgctacttccaccatggacgccgtgccatccacatggggagtatgacgtccccgccacccacaacagccgcggtcccaccgcatctcggactacgagcagtgccgccatgtccaccatgaggttcaccatcaccgatcatgccagatgggaagttggttgttgatatttcttaatgatattactagaatataatttccagtaatggcgcagaaatactcctggtatattatggttacagagttcatccgcaaacatgcagatatatcattgtagcatttcacccaagagtattccaagggtatcgtatttatgtaatcccgtgggaagatcatagtagagagaaccgtactaataatttatatgttacttgtaataatcatagtctaagcaggggttaagataaatcaaagggtacagtgacacacaagcagggagctactcattcacatactaaaacatctaagctaagtggaaagaaaatagaaagagaatctattcctatacttctaatatacatagtatacatacacttatatgattaactagctaataccctctttccgatgccctcctagtacttcgagaagccacccctgactgtcgagtttcttacgacagcccgccatgaccatacaaccagggctaaatacggaggagtaccctcccaggaaactaacttaggactatatacacgtgcggaggaatacccgtactgagctgtcaccatcagcggcccacctctcatccgcagcatataaccccaaataatgatatctcgtaatctagacaccatgcctaaactaccagatactactctaatatcatcgtcatgacatagagtaattgcataagcaaacattatacccgtacctatgcttctcccagataagctaccagtataatcagtataacatgaacataatgtaaagttggcattcatatactcgaaaagtatttcaataccagaaatgtataaagaagagtattctaaacaaagtacaaagcttacaaaagaagaaaggaaagctactagagccatacccgatctcttccgaaggcttccggactccgatttctattctattcctactccactagcataagactactaaactaaacttgagagaatatgagagagctttgcttggagtgtgtggaggaagtgagagtgagagctacttttatagcttgagaatgacagttgtggcggttggaatggtcggaaataccctccaaccgccatagggagtcgatctcagccgtccagaagaaccctggatcgagtggtgccgtggtgggttagaccgaaccatgggttgggccggcctagcccaaaatcggcaggtggccttctctgctgctctcatacgcagacttgtgaattttgccacagttcattgtgtcaattctgagttcttggcccattcatgcataagtctaatcctcgacatcgtccgattgatttatcgtctggtttgatgccgattctcctccactttatggttattctctacaacaggttagtaaacctaatactagtggagtattattatttctaacacaaatatgcattgcaagcataactagttctcctctattttggtaatattgacagtcgaaactgatcgctaacgaccataaacattggtcagcgatgtcatggacagggagctcgttgggcacggtggttgaccgacacagtcgcacgacaacgtcgaggcacgctagctctctcagtcagccaccggcgcatccgtcgcctccacctcctccagcgtcggtcgtgccggcttcggccggcattggcgcatcgcaaacaacgtgccatctgcacgaggaggacgcccacaccgtcctcggcaaccttggtcccgcacaaggccgaggagctgccatcgagggtggccaagtgtgactatgcggcgctcgctgagggcgtcagcgcatgcgggaaaagagggaagacgagagagagggcgtggagaggtgaggatgaaatgtggtgagagtcgttgacacgtgggttgcacctgctaactcagcaagtcaaccacaatcaacctgcctatatcaacagaaaccgcttcctaaaccactaaggagatagtttgcaccagttttcaaaaataggggtggtgttataccgggttttgtagtggaataacttcacccgaggtctctcaactttacgtcgagtctgtttaagatccctaatcctcaataccagaaatgtctacctctcaaatatttaaaaccatgcaaaataggttctatggcagtatataggggtggcaatctaagcccacatatttttcttttttctctattctattatctttcttctcttctctttcagcgagcctggctgcctagggagagcagtgggcggagagcatggcggcggctggggcgcatcgggcacctcgtaacgccgcggttgttcttctcatggcctccgttggtgaagcggggctcatcgccgtcgccaccatcggagttaataccgagggagaaggagggcgcgttgggagcctcgtaacttcatcgttgctcctcccggcggcgctcctcatcgtcgtcattgtccgagtcgatgccgagagagaaggatggtgcatcaggagcctcataacgcttatgttcctcccctccattgccgccgtcggtgaggtgggattcgtcaccgtcgccctcgaaatcgatttcaagagagaaggatgaagtccatccgccagtgacgacgagggaggcatttggtggagaactgagtaggccggcaaaggggggatcagtggtcgacggagcagagcagcggaggccggagtaggccgagagaggggagacgaaggcaggcgacgtcggcaaagggggcggagcggagtggctgcggccgaagtaggccctggccctcccctccttcttcctcgtctcaagctccagctttgcttctcaagcggtagccgccgcacgcttctcaagctccacctccacgagctccggccctcgatctcctccaccaacggtggtgcctccgccacactccgcgactgaccctgctctgcccaccgctaaccccgcaccgagtcgagcgtgcagcatgcgaacggcggcagcggcgcctgatgcaacctccccctccctcccctgccggccgcttcctccctctcccggccgcttctcccaccggccatctgccccactcccaagcttgggaagaaaaaagaaaggaagaagatgatgctgacacgtgggcccacatttttccttctcacttacagatgggcctcacatatttattattttattttttgataactaggatgttacatcaacaaaaccaaatatctatactgtctcgggacttttttttggacagttttacatagtttaggggtacacatttctagtattacgattaggggagcctagacagattctacgtacaattgagggacgtcaggtgaacttattcattttgcagttgagggagactattcagtaaggagcaaaagaggacgggaagtaaagtagacttattcctttcttgtagctatgaattttcatgttttcaactaaccagtccaaagttctaagcattcagagggctaatccatttagtggacctgcagataatatttttttctactgaaaaatttacatgcgtaaatatttgtataaaatttaagctttgcatgacaccagactgaattctagccattcaaagtatagagtagtagactcactcgagagccaactgttatctacctggtgaaagacctgcagcaagcaacactaaggttgccccatgtagttccaatttgcaaagggcttgcaaaatgatattttgaatcaaatccacaaagaggcctggaatgtcaaataatattgaacaggaataaattaaaatttctaaatttaaatactacagcttcaacagcccaagtattctgctgccttttggaagctagcttctgggctgaaattgtaagctggcgatagcagtcacaagaagcagctttctttacggtaataatcacaaagaatacggtaatgaacaagattcacagtttcacataatgattgttacagctaacctgaggtgtattcctcatatatctacctatcgaaaacttttcaggagatgggacgaaggaataggggagctcaaagatcttcccagactgctgccagcttttttatctgatgatcttataggtgtggcacattcgttgaaatccaggattttcccctcggtctgcaaaatatgcattcatattatgatcattgctaataatacagttaaacactggcagtctggaatgggtaatgatgttaatttatgctcaacgtggatgcaaatctatcaaaaccatttacagttgatggattacagaaaaacaactgccaccgttttggactcacaaaccaagatttgccagacagcatgagctacatagctaaataatattaacgcaagaggaactactaaaatgacaaacaataaaaccagggtcctccttttgttacaacgcaagaccttttgtttcaacaacacgggaatatgaaaataagcagttcaatacgcaccttgatttttgcttgcaatttggttgttgctcctggttccttcttggcatctggattctccaggttttccttatcagaatttatgttctcagattggccaccacttgccagcacctcacgggcttctgccaaagcagcagcagtctgcacatttatctgcttcaccaatcctagcgcatcgtaacttccattagctgggctgacgaagtatgaaccctgggaggaacatatggccacaagaagttcagcagagtaaacagcaagcaatatccccagtgcgtgacaacatcagtaattaatgaaaaaaaatactctcaggcacgactcaataatatttatttccatccgcttagatttagccatagtccaccaagttatattcttgttccaaacacttgagctctgcatttcaaatatataaattttacaaagtgctaaatgtacctgaaattgcatatctacaaaccaaggggacttccatgctgaaggagattctagtcctcttttgatgcctggggtatcagccaatctaacaatagcaaggctttagaattcagaattacatattaaaaggaacaaggatcaagtaatctcttcacacttcagtagttggagacaagcggagtttaattccctattgtagtatcttaaatgtattcgtcagtaggattcaagtgttcttcaacattctggatgaaatagcatgtgctaatcccagtaagatggtggctaaaaggcttatgataatacattagataataaaatgtttttcagtttctgactaatgatggaagctcttgaatggatatttcagttacatagataagaatgggtagtaacttaattttgtactggattaagtatctaaatagagacatgaggttgaacatgaaaaccagctaatcacagtttaggtcttcagaagcatgccggactacaaattcaataggttgatgcttgcaatagcaagaaaaggaggaaatgatcattcactagagatcagtttccataaaacttaacgacttaatattcatgtaacctgagaagattactatacaaaagaatctgctgtaaaacaacaaaggaacatgtgaaattagtggtcttacatgttcacatattcataatccacatttatgcatgctgaagatttctccacaataagttccgcaggctttttagcagacactccctccttacagactgacaaagattccatatttgtgttttgcttctgtttcatggtgtttttaccataatctggggaaacaagatcatcaccgttgtgctcaataagaatacctgcaggttgctgcatcaaacaacatataggtaagaacaagatcat

SEQ ID NO: 1904 - DNA, 1307 bp, Oryza sativa
  unsure (1)..(1307): unsure at all n locations
aggaattacagtgtgcagagtattcatttagagggagacacgagacttgggtaagtaaacctgatgacatgtatgagtcgactttcttctttactgaactgttccagtgatttttaattgcattgtccgtcctgataagggaaatagaatgttacaggttcaatcatttcagtagtccaaaaagggcatatttttataataacaagcgttaattgagcagaagtacatatagatcattgtgcattaggtcataaacatttagagaagacaagaatgttaaacatcaatagatgtgtcaaaatggcagtaaaacataaatttcgcatctattttcacttcatagaaaataacagattgattttaaatttcgcttgctgaaaataaaggaacgatattgcagttaagcagtggcatctctatttcacattcggtggaagtatggacccgcgtcctcattctattctcccaaagcaaaaacgatttaagtttcttttttaggttaccatcttccctaaatttatacaacaccatagattccaaatgatgtctgaaaggaaggtggaaagaatgctgagctaaacagtttgggaacttaccacagaaaaaaaaatagaatttggaacaaaaattagaggaaagatttcccccataatagcagtcatcatgacaatatcagatcaaaactagaggtctgcaaacagctcttaggttaaaaataaaaatcattaccttcctggtaaaaattttgtcagctcagcccatttatttccatacattcgatgagcatgtatgagggtaatttcctcttcttgtgtccatgcctccttgtttatgccagggttaagatggttgtgccacctaaatgcagattagatagtccatctttaagacgtagaatccacagtaatgatactcgattaaaaataatggcatgcacattaagaaataaattagcatagtttacaaaatactgcattgtgaaaataaatcttattaacaatctaacacatgttttgccagacatcattgtacaacatatatggtctatgcgaaaactatgtccaaagaaaacctgcattcaccagcagaacaacgggctagaagaaatcagttgttgctagcacaaagaagttgctctgttgagccccacaaaacttcttgttatatcatttttcttcagtgcaagctagatgaaataaaataaaatgaataagtaattttcatagcattaccgttcccgacattgctttcctatacgtccagnnnnnnnnnnnnnnnnnnnnnnnnnnnnnnnnnnnnnnnnnnnn

SEQ ID NO: 1905 - DNA, 1306 bp, Oryza sativa
  unsure (1)..(1306): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcgcatacgacactgcaccatccttcttctcccttacaatcaccctaccagcaacagtaagatcacggtcgaaccatgtgtaccacaagccacctccataagtttggaccccaacctcaagataacctccctttgttacctgcgtggcaagaagcaggatttaatcgccaattcatcgaattgtaccacgccaattaacataaacagaaatcaactacgaagagttcaaactctaaaccttggagacaggcttgagcttcagggatggactgtcagtatgcgcaccgattatgtgaaacccattgccggcagcatacctacaacacatcaacataatccaataataaataatgcactaatcaggacattcatgatccacaaaaccgtatagaattactacagataagtttcttcacaaaaaaaaaatagaaaaagtatgacaaattaaataatcctatagcctcgagcaatccaaggagtgtgaggacaaggtaaaagtggatctagcagaggctcacttggcgccgatggcgaaggcgacgatggtggagtggttgcgcgtgaagaagtacttgcggccgggctggagccccgcccactcctcccgctccgacagctgcgagaaccccgccgccttcagccgccgcttcgcctcatctgagacaacacattcacagtccagtttgcgtcgatcgacaccaaaggaggaagaaggaagggaaataggaatcgggggggaaggggggcgtaccgacggcgtggaaggcggtgggggaggcgttgaggaagtcgacgaggtcggagacgacgggggcgacggcgacggcggcggaggccatgggcggcggcggcagtagtggatcgatgagtcaggtgtagccgccgactttggtatgcagggatcggtgtagggctgtcaaaaaaaaaggtcgaggctcagcgagcagctcgaggtttcgagagccgaacccgagcctgagcaaaagctcgcgagctttaccgagccgagctcgagctttatcaagcctggccgagcttgaccgtgcatagtttatattgcatgtttaccttattaatataataaactaatagataaatatatatattagtatctattt

SEQ ID NO: 1906 - DNA, 3455 bp, Oryza sativa
aaataattatacttatcaagagattattattaaaatatatattatactacttatggccgagctcggtagccgagctcgagcttgaaccgagcttgcctaaaagctcgaaagtgcagtaggctcggctcgagctcggctcgagcctgtgtcgagctcgagcttgggcagacgagcttgctcgagctcggctcattgacagccctagatcggtgaatagttgtgtctatgtattgtacccgtatatactatgttgtgtccggatgccccttttcccatcatctctccctatgtcttttttttaaaaaaaagtttctatacgaaaattgcttaaaaaaataaaattagtccatttcaaaaaaaatagcaaatacttaattaatcacgtgctaatggaccaatccgttttcgtgtttgtgttgggaactgcctcccgtgaagatagcgttcttttcccctctttcccaactcacttgcctcatttttcacgcgcacacttttaaaactactaaacaatatattttttaaaaaaaaattctatatgaaagttactttataaaatcatattaatctatttttaaagttttttattaggctaatacttaattaatttcactataatcgcgtgctttgttttccgtgtcgagaggtgcccaaccttacctcccgaacatagcctaacttgtttatacggggataatgttcctataatttttggaatcagaaaagaaaatcaaatggagtcgaatattatcgaatactgatacataatgaatatgagttagaatacgggcacgaatatttatcggaacataaagaaagacctttttaccattcttacaaagtcaacaaagaaatataggcagttttatccaaaagaaaataaattcgtggtatatataatatgttattctaaattaggctctttggttttctagattttaataaaaaatataattgtaaatatgaagttgtattcaatattcatattagaatctcaattttaaatgtaatttgtttcatttcaaagttattagtaatgaacaaatgtaattgacatggacacttcttactctttttaaaataataaggtattccattaaaaacaaattatttgatatattactataataaataatgtttttattatagataatagtaccgaatatagtgtatgatttgtaactagcaaatatgacatactggatagctgcataccttgtttctaaaataaaattatttaacaaatatgttgggatagagatgtgaacctaaagatggagataaatggttttataaagctatccgaataactatttaaaaattatccatatattttctaaccatttttcgttttcgccatataccaaccttactgtatctttttctgaaaaaaaaaatctaaattcgtttctattgtcaaaactatcaaaaaataatatccggccgacattatttatttccgaaaaagcatcccagtattataactatctgaaccattttcatccattcgtatattaatggttttaacagatggcaccatttacgtattgatacaggttgaaccatttgttttatagaaaagtaaaatgacctcgatatcgcttagagaggaggtgaatagatgatttaaaatgaaatacgaaagctaaagcgaaacatggttggattatgatactaggtcagattgtcggaagtaagaacggaccatctgacctgtagagcagcaatacaaacaggcaacaacattaaagttgatccaatccacaagtaaggaggcgaggtcaaacatcactacattagtgtggtagaaagcaattcaacaagaaaggtaaagggaaagaggatatcaccaaggtttatgtaacagtatatttttcggagttcaaattcttgaggggattctaatctctgttaaggagctcacaaatagtcaagtcttttaatctgggttgatgttaccaactgaaagtaaagatcctccggcattagtctcggtttgtgtttccaatcggtactaaagatgcacttttagtaccggttggtaataccaaccgagacaaaatgttttcagggacttggacttttagaaccagtactaaaacatttttagtaccggttctaaatctagctgagatatttgtgatttttgataccacgatgaaagatcagttgttaagtattggtagcacatgcatgtaatggctgttcatgcaaactgtaaagtcacactatcactgaacaaaaaaaaagtcaaatagccggagagtattgttgagaagaggccatatttcgaatgatggaatatcgaagtgtttggtcggtccggatgctgatgtaattagggatgaaaacggtacgaaaattttctggattccggatctattttcgaaaacagaatctgtcggtcagaattttttcgaaaacgaaaacgaattcggaaatattttcttggaaacggaatcgaatatgataggggcagtttccgtcggaactcggaatcggtcggagacttttcgggaaatttctcggaatttccggaattacaaaggcccataacatagtctataattcctccctagcccaacccaatttagcatcctaattcctatgtcactcaattcagcccaacccaatacacccaattcaaacttgagaattgaacttgacatgattgtgttttgtgatgtaatgttgaaatttgagacttgagaattggatttgacatattttaaagcttagtttgaggggttttttattccgatatattttcgttaccgtatcagcaccggtcagttttcgctccgttttcggttttgacaatatttaattccgttttcgtatctgggtttccgattctgattccgaaaaaatatgaaaacgaaaacaaaaaatatagtttccgccgtttttgtaccgttttcatccctacatgtaatgagttggagcttgatatcttttttttactgatgagtcaaactgattcaaccagtgaagaacatgagcacgggttgttttattgtttggaacatgtattacgagcttaaatgctcatactatgtaaccttgtggttgcatatatcctgcgggatgtagaggccttttttttttctcaaatccattatctaaaaaaataatgactgatccttaaaacatagaagaaccattttagggtgtagcatagagccacggcaaatcataacagttgattatgtgtgcttcatttctaataaaaaaacatatgatctcccttcaccaaatacatgatggttaaaaatgcaaagtatcataagtatctttcctaaattaattatttactaatgaagaatttatgatttaggcaacaaactgaagaggcccacaatttgccaaaacaaggcgcaatgactatgtgtaatttgggcctacatgtcaatgggaggcttagggcaggtgcaatagggaaaatgtacctacta

SEQ ID NO: 1907 - DNA, 5349 bp, Oryza sativa
ctgcagccctatatatatatatatatatatatatatatatatatatatatatatatatatatatatatatatatatatatatatatatataaaccatgcatatatatgtataaatacacatatatatatatatatacatatatatatatatacatatatatatatatatacatatatatatacatatatacatatatacatatatacatatatatatatatatatgaccaaaatatatatttacattaaagaaaatgtgtacatgcatatagaaaaatagacatgtattaattacaatctattatgatgtcttagctagctacgatttcgacgtagtagtagtcgttatctcagaagctaaggacctttgaattgtatttccgtcgtagtagaattcacccttgggatcaaggatttattcgttgatgaatcccattagttgttcttgaaccgccgcgataaattccttgtgtgtgatcaggttatccctcatgcgaataaactatatgaatgtatgaaattaattagtaattaaacaacaaatcgatacgtacgcaatgaaattttgaatttatttgtacgtacatcgagctctcttgtggtgatgatttggtctgcaaggcaatggcaatactcgcacacgtagtagccgcacaagttagttccctgcttttgctttgcgcactataaataaatgataaactgcgagagatctaattaatatacacttgtatgtatttgaattggagattgaatataaatatagagcatgtgtactcacaagaaaattgaacttccgcctaagtctttctcgtcatttgccgtggaccaaatgacggaaccgataccaatcgggactaaagatcccgggagggcctgacagaccctgacagcatttgaaccaagactaaagatgattgggactaaagatcatctttagccccggtttttattgcaaccaggactattgtgaaattcggccgactgacgaaagatggtttctccgcccctggacgaaaagaaaaacaacgatcagaccgggaagggcgtgcatgcaattgttggaacgtggataggcacggtatctatttattggtctttatccatgcatcttggaaggggcagaccggcagctcgaacgtcctgtttaacgcgctagggcgatcgagacgcgcaaaattttctgtgcatgcagcacgcgcgcgtacgtgtacgaacgcgcggtgcccgaaaatcgcattgagtatagcagcagcatcgttcagattgatcgatttccatctcaaaagaaacaggagcctttgctatttcctcggccccgaccaacaaacaaacaaacagcggatgagcggagagtagtcaagccgcgtcgtcgcgcgtggtcgtcgatcgcatcgcgctctctcgcggttgtcgtccaaacgcgttgaaattaaccaccgatcgatcgagatggccgtgcgtgtaaagccctacgagtgatcgccccggccggcgctctctcttccctcgtcatggggagggaggcgtcctcgccaccgcccccgccgccgccgccggcggtggtgcatggagccggctcgtcgttgtccggacagaacaggaatgccgccatggacgatggcagcggcgaggacgacaacgtgccaccatggctgaaactgtctctcggtccggtggcctacggggtcgccacgggcgtcgtcgacgacgactcctcttcttgcgctccggcagtgacgacgtcgatcgaggtgcggccgccggtggccactggtgtggtttccggatcggcggcccaaccatcgattgaacatgttcctgccgatgatgcggtggtcacgccgtcttttgtggcctcggcagccggtgtgctgttcaccggctgcgcgagtggtttgatccccaatggtgcagtctcggtatttccatgctttaattttcttggaccttcaatgtcatcatcaatcctatcgcacctccatcaacaattctcctcgactcgacgtcaaagcaacgcgtccatggcaagatctagccgcacctgtggcggggacgacgacatggcacttagcaacatcgctgcgccgaacgtcacaaacggtggcggcaacaacaacaacgacggtaatgctcttcctgatccaccgtatccttgggctaccaatgaaccggccaaacaccactccctcgccgagctcgctcgccgcgacatcaccaccatccaaggcgacgctcggtgcaggcgctgtgatgcacgcaaggtgatcgtctacaacattgccactaagtttcaagaggtgtccgactacttacgccaaaaccaccaacatatgcatgaccgtgcgcaggcgcggtggatgaaccctgtcgtgccgaactgtgacgactgcggccatgagaaatgcttgcgtccggtgatcgctgccgagaaggagcgcatcaactggttgttcctactgcttggggagacactgggtttgtgcacacttgatcagctcaagtatttctgcgcgcacaccaaccggcatcgcaccggtgccaaggatagggtgctcttctccacctacgaagagctatgcaaccaacttgttcctgggctaatcacaagacgtgaccagttgaggatgcgttagttattaattttttcggttgttaatttagacttttcaagatgcaaccatgcgtgcctacgtggttgttacattaggttcatctagagtctctgtcttggagtctcgtctctataagtctgtgagtgtttgagatagttcgcgatatattatttctctcttttatttgtaagttgtgcaactggatttgaatgtgggtgtgtattgtttgttttaatatactatttatgtcctttcagctttgaatgataggcgcaatttggtgtggtttgggatttgtccttaaatttggagaaatgttgattacggccaaaaatacctataggtctttacactttgttgagaaggtgctttatgttacttggaatatctgggagaaaagaaatggtttaattttttataatatcgctccttctcttttctcttggagagttctctttaagaatggtatctcccttttactccataggcttaatttgtttgatcattggattaatctgttgtaattttctaccttttattttttcaatatattaaactgtaggggcttccttccctcaagaaaaaaaatggcttcttaattcaattggagatttcaatgtgggtccagttttatttgtgtagatagtactagtagtatattgcgaaatttcactgctgcaaacttgtaattactgtatttacactaggttggatttgagatgatagatgctatgtagaagctgagagtacgtaatctatgtcgttagcagcaagtaattcaaaccaatggtttggtaaatgtaatctagctatatattttttttaaaaaaaactgagccagcaagagttggtgttatattgagcagagtaaaaacatttgtgcattgaattttacagccttagagtagagatatgtactgctgtagcactggttacaaactcacaatatgttcatttaactaatgttgcggtgtttataaatgcatttctttagtttgctcaactaatttatgtaagattactatttttttattttgtcaattatacttttccttcgcgttgatctaattcacttagttgctattggacccattttttccccacgatgtagtttcatgccaaactgtataaacaacacattgttgaccttgtctgtggatagattggtgtgttatcacttatcacccaatgtataagcaacccattgttgatgcatctatagtactgtttatatggaattattagttacccaccaatctaattattttttatgaacgcaaaaccttaatagatttatagtttctaaaaatacactgccttttacttatcttacatacatacctaatcggtgaaatgcttgccaagccacatagttctacgaatgcaaatcactaatccgttttagtttactgcacttgctatttatgttagatagcttggattcaggcactaatacatttcattccctttgtccaagtaaatacacttaatacatgatatgatatatcctaatactataaatttggacacatagacacatgcaagtgtttttcggtagtttcagcgtgggcggcgtgaacgatattatggtttgccacaaactagatcatttagtttgcattggtgtttgatttgcaattgtagaatattgtagaatacacagcttgtcaaactaaggtctcaatatgtcctgcacaatttttttttcataaaatcgggttatttagctatgccctgtaatgatgccactgaataatggtcgttacaattttttgtgtacacattgttatttggttatcggattgttgtggctttctattccatcggctttctttgtgtgtttacatgtgtgtgttaccccaacacagcttaatcaggagaaaatgggtacagatattagtaaaaattgttaaaccaactgaatttttgtttttaaaaatacaattccttaaagaagtgttttgtgcagtaactagaggaaataaaaatctcaactataaaaattaactcaaaaggcaacaatgtttgggaacagtcaaatactcaagaagtaactaaatttgttaataagggcctcagttggtgaacaaaagagggcatagtatggtaaatgttggacaatattccatttatattgtggtttgtagcagtggacagtctttaatattgttcagtttgaacttgatcaaaattcctgctaagtcttgttgaaatgttttaatatcttgctgcataatgtaaagggagaacattttaaatgattttcataatgggaagcattggtgcaaaatatgaatagagttggttttagttgcatgaatttgaattggtgggagataagatccgctccaatgctccatgaactcaaggatatataggccacatgaggcgttagaaaaattgaggcgttaggttaacacattacaataattaaataatatgaatagcatgtggaagagtttaggagtaacccacgtagtctccttgctttggcaattgctggacttcgctgtattcccatgaggtaatattgaaattaggccagtcatgttgtaattatgggtgctgatttttttgtcccctgtaatcctctctggatagctaccagctgggaagtgattgtaatgtcaggtttgttaaaacacgacgaactcgatttgaattgtacaagtggatcgaagtgtatcgctcaccacacgccttagatcgggtcgatcttcactgattgggatat

SEQ ID NO: 1908 - DNA, 12381 bp, Oryza sativa
cccattgcatagaatagctaaataaacgttctcatgtcatgtgttaggtacttgcatgccatattttgaatccattgtttatcataggggttgttagatttagcatgcgccctctttcagtagatgtcacaccctgattttagttccagggattaataaaattatttaataaattattcctagaatttatattaaatattcccacatttacaagtgatattaaatgtgggaaataaaacttcctaaataaaaaatggcttgatttatttattattacattctccatgattaattatactctgaaaattctcggatttttcagagctcaattgttaatttgtaagatacaaaagaacatacgagtaattatttaaatacaaattaatcattaaatgatctggttataatttgttttaaatactttgagtgatcaagtattatgaggatttttattggaattattggagcatttgaagcgttttaatggaaaagatcatatgcaatgattaatttaaatggaaaagtaattaaaaaccctctcctaaatctaggccaattctggagaagtctcaacattttagattttcaaaactacttatacttttggagtaggaataacccttatgacatatctccttgaccgggagcatggtgtattcgaatacgtctgcaatgtctgcccagctttacccacacgatgagaacaattcgcgaggttgtaaacaccatagccgttcgagagtcccatttaccactagttactgcacagtggggtcttggttcatcatagtggtcaaactcttgccaggcctaggcaaggtatctatatcgtcacactttcatgaagcccactgttgtgattcatgccacccaaacaccttacgcatgattcaccacaaaacctgctcctaataagccacccaacaatctttcatatagtaggacaatgtactaggctaagtccaattacttggtcgtgtggatgggcgtaactatgtcatttctatggtataaggggataattataatccggttaaaccaccaaaatatctcaacatcccaaaacttccataccaacttcataaatcacacttcaaaaagcccattttaaccggattcctaagtttgtaaagatatttggaatagtgaaccacataaaatgatgactaaagcatcattctataatctcatgcaaaaatgcttgaaagtatttaatatctaaagagtaatatttcatgcataaaatgacagttatattaagttttctatatgatcaaaattttagttatgtcttgccttgcgccttaagatttcccgcggctttagcgtaatcatctgagtccacgtcagctccttggatgtcgatagaatttgctgtacggtctaacgtacgaatacgaaaaagatagcaaatagagcctataagcaaattgctacaaagaaacgataaaccaagaaataaagaaaattggagcaaggcgaaggaaaaaggagttgggtcaaaagaaattttagtttggaaaacaaaagagaggggttttggtttctaaaggttgggtttcaaataaagttgaggaaaaagagagattgggtaggtagggtttatttggtggttttggtttatagtcgatgctagaatagagtagcacaatggctagatatttggagttggtaacccgatgctaaggataagcaacattaccgttaaatatctggcttatttagtcgatgatacaacgcaatgactagagaggttgggaaaaattcgtgtgggtttgcaagatggaaagtgctactctaaagctgtgagtgacagcaaagcggctaggattgcacatagtccaaggactagtgtgctgtggaggtcgggagagtagtgaggcttcaatcactgtacgcgtcgaggcatgcggtgtgaagggcaacactttgaccttggaactaggttatgccgtgttttacgatcaacgattcgacgtcggggtttgtatactacacgaatgtctcatggaagcgtaaagtttgcacgacaactgtttagtggctattggattagcaaaagaaataattgaaggttttagaaataaaaggaaataaatagatcaaaggaaattgaattcaaaatgggtttttaaagaaataaaatttaaaatggtatttgaaatgaataaataaaaggtgtttaaataaattaaaggaaaaatttagttttttaaaaaagggtttttaaataacacagaaatttaaatttaaaggtatttgaataaaatagaataattaaaaaaggttaattaaaataaattttaaattcgaaatgtaaataaataaatgaataaaaagggatttaaatgagaaaatttaaataaaatttaaaaatagaaaatttggtatcaaaataaagagtttgaaattagatgaatttagataaagaatttactagaattggatctatgatttgagaaatatgggtgtctatagagattgaaattgaaacaaaaaggaaagggattagtatgcagtggggcccacttgtcatagccttccttcttcctccttttctcctcctcgtcttcttttcctctgtctcacaggaagccgagagaagagagagagaagcgcgagcaaggtgacggcgctccggtggccgagaggtggcgacgccagcggcgggtggtgttcccgcttgttgctcacccgaagaggaggtcggccagcgagggaagcgagggaggaggccggaatggcgaggataaagattggtccggccaggagagagaaagctccggtggtggctcgatttagggtggaaggaaaggggaaataggaaaaattggttcacctcggcgaggcaagcccggatggcgcaaggatttggccagcggagctccggtgagggagatcggccggtggcgaggtggtggccggcatggcaggaaagagagaaagagagtttagagagctcggctgtggagggggaaagggcgaccgcggaggtcggttcggagaggagaagggatacttggttatggtggcggcagcgtggggaagtggacgacggcgccggcttcgttcttccattggccgaaaagggcggcgcgcacacgcggcggccgtggcagcgttgggcggtggaggtggaggagtacggcacgacgctccagctaggcaaaacagctgcagcggcggcaggaccgtggcgacggcgcgatgccgtgggcggcggcgtgcccatggcgccagtggcggcgcccacaggggaggaagagagaggcggctggttgggccggctcggctgggcttcggctcagttgggccggcagcccaagaaggagtgagtggaagggagagaggaggaaaaggaatgggccgaaaagaagggaatttcggcccgaattgattaggaaggtttaatatttttgtgtggagagttttgaacggaattcaaaggagatgaaagaatgaaagttttgggatttttgaacttgaacatggaatttgaataaaatttaaaggagatgaaaatcaaaggatggatggatggatgtggacctttttggactttggacaaagaaatcaaatagaaatcaagggaaatggaacctaagaaaattttgtatggagggtttttttataaaaaaattaaatgaaaggtttttaaaacaaaaggagtttgaaaatattttaaataaaatcaaggatatttattttgagataaaatttggtggaaaaatttgaaatgggtaaaagtgctccaattttatagaattcaataagaatcaaacataagacttggcacggaagtttttctttaatatttaaaaattaaaaattagaataatcaaaaagggaaggaaaggcaataatttaatttctaactttggataaatttgaaatggtagcaaaaatagatggaggcaaataactaggattttgacctccaagatatggggtatggattcttggtttagtatttgtggctaagggaagttagactttctaaggaaaaaattggaaatagtgttcttagcacaagagcaatcattcaaatattcgtgataatatcgttcttgtgctaagggtgtgatcaagccataggaatcaaattggcggcttgattcataattaaatagaagaatttgaatagttgatcttctagaggagtttgtggtaggtattgtatgaaggataaaatggggatttctaatgataggtctagataggagtttgatccaaaataaattccaataaaaaggaagttatactggtttagccccaaaaataaaaatggttaatgggatataacagagagttgggtcaatcagggaaatattggcccaagctaaatagtagactttgaaatcttgagtggataatttagatgaatgagatttcaaagaggaaatatttattggagtatagaactggattcggaagtatatgtggatgggaatttctacgggaacggaattggtggtagcttgataaactctagaggataggtatattgactcaaagggggattgaaaaggatatttttgtgactctagagatatttaggtggagattcaaaggaaaggtatcaacatttcatgtactctagggaggttagaaaatggcatttcatgtgttctggagatagctgagcgggaatcgaaaggatatttgtgggtgttggagatgttcgggaatgggttcaaaggaaatgtatttagagtcaaagttagagattaaataaaataaatagagagcttttgtaaaatttaaaagatagcgattaactttgcaaataaagtttaagtccaaaataaaagaaaagattaaaagtaagatcactctaatgcaagaatcgagaagagcataacttaaaatatttcgcaaaatattttcctgaaattttgagtccgttacagccttatagtcagcttgctccaatatgggagttggaaaaaaaaagtactctttttccttcaagtaccatacaatgtactagagtgtttccttttcttccctgatttcccaaacttcacctgaaataaacatgtggcagcaatagtaaggtggtaaatccaaattcatatggttagtcatagttctaaaaaaaggttatgccttatagtattatcatgtcacatgcatagtttgattttttttaatttagaagcatcacacaaaaagattcaataataagatggaagcaataacctgttcgaatttctcatactgagaaataatatcatcttctgacaatggttttggagcacttcgcttttccttttggccatcaaaagaagcatcattgttcctccagacatgtcgcctcggcaagaagcggcgatgtcccatataacaatatttgtgcccattaacaagtctgtggtagcaggtttcagtgtggcatgaaggacatgcatatttaccttttgtgctaatgcctgacaagttttcaaatgctggaaaatcattaattgtccaaagcaaagcagcacgtaaattaaaagtctgctttgtggaagcatatggctacaagtatacatcaatgtcattaccaggtgcttttgggccaagaattatcatagacatcaccatatatggatctttcatgcacatccaaggtggcaagttatatataacaagaactacagtccagatgctatatgaagaactcatatttccaaatgggttaaatccatcactagcaagaccaagtcggatgttccgtgcgtccaatgcaaatgaagaaaatttcccatcgaagtccttccattcttttgaattagcaggatgtctcttatatccatcatctactaacttctccttgtgccatcgcatatgtgttgcaagttttgtagacaagtacatccgttttaacctcggtaccaatgggaagtatcgcaataccttctatgggactttcttcactcttctcctccttgatttagagacattattatgcccttcatttttccatcttgaaatgccacaaacaggacaagaatcagccttatcataagcccctctatataggatgcaatcattcaaacaagcatcgatctttgtgtaatccaatccaagatctgtcatagtcttctttgcatcactatatgacttaggcacattactgctactaggaaatgccttgcataacatggaaaatagagcctccattgcatttgcactagatcatagaggtatttgatatttaacatttgtacaataaatgctagtgtcgaaaaggtaccacaccctggatataactcttgctctgcatcttctagaagtctgtagaatttgttagtttcttcgttagttactgtagagttatccatgtcatcattcaaaccaggtgttgagccacccagtgatcccatattcacaaccataggttctccaaaatcattcatcatctgatccataccatagttatcataattttcatccatatcaatattgccactgtcttctgaatctgggacgttttatccatgatagacccataatttgtagtctttctgcactccatggataaagagatgttcctttatattattctgatcaaagaagtgattgtttttgcactttctgtatgggcatcggaggaatttgtctgcattgtaatctttgaaagcaaactgaataaattggtcaactccttgctgatattcaggaagactcctattagataagtccatccagcttttgtccatggccgtagagtctgacattatcctacaaagaaaatattattttctaatcacttattatcattaagttgttaaatagtaagtaacatgctcaatttaaaaccaaacattcagtggtactctatttgatttcagtttcaggatgctagcgatgtttcacaagctgtatctataaacattatttcaattttggtgccgtgatagttttggtgtcgagcaatatttaagtgtgaatgtatttttagtaaaacaaaggctaaatgtacgtctatgaacatacagaaattgttgaacagttcaaacagtggcagatttataagttttattgttcttgtttaggtataacaatgtataataagtgtgcacagatacatgcaaactccgtataacatttaccatggagactaaaatttaggtcaagttttgatttaggagaggaaaacaatctcccaagattacatagatggtcctgtattcttaacagtttagactatgaatcctgaattatcctaaaaggaaaatataatggttcaggttataatcacaatggttgtaagcatttgatttagcttgcatcaaacatggtaattaaatacttatatagtactgttgcatgcgttggtctggtggctaagcacagtaattaagcttaatctaacagtattgccggcactaaacttccaatgacagtatgattgacataaggatcacgtagattaccaaattctatctaatttaatctaatcggctctgtgtcattaacggcaaggtttatgctctaattccagtaataacatagaagttagacactacatacatacatacatacctggaattctggaaatatgaataagtttccttaagtctctccgtaagcgatgctagagagaacaacagtgtggggggaattcctgcagggcaggcgtcagagccagaagagggccgggaggagaccactggaatggaacaggtgcctccttgtgtgctagggctgccgatcagccgcgcatgtgtgagaagatcgatagggaggaatagaagaagtgtttgagatgaagttaggttaaaaaggaagataaaggaaagacaccgtccatatgttttaaaaaaatctgcaacaactttattgctctaataagatgcgcaacaatttattgctcaaataagaacggcaacaactattgctcaagacaaaatccgatacgaatcttcaatcttgaggaatccagaaagaaaatcgatggtaaatcgagtcagaaagatcaaatcgtacacaaactcacgaaaccaatgacgaatataatcggattcaggcattggcagcacttgtgtcttggccgtcgggggtggaggccgacggcggcggtgaaggccggcatgccacacaggaggtctggagggcttttcggctgggaggccgaccactgccctgagtcagccatttcgttggcaactggtgaggacagaaaatgggcctgttcggttcttacatctgcagccatagccaaaaatagctgtacgaaaaagccaaatgatttcactgagtggctgcctaataggtggacgtaccctataataattcaccaactaactgatctttaaggcctgtttggtacagctccaactcctaaatataactccaggagttgagtctaaagtgacgcagctccacaactctagtacattttgtgagagagcttcacccaacttcactcccagttttagtggagctgaaactgtttggctgagctccagctccaggccaaacaagcccttacatcctcattccattgaatcaacgccaccaaacgaggggaggataggcgtggagacggacggggatcggagtcggagatgaggccgagccgacgcagcagcacgcggtggcgctcctcgacggaggtcggctcagagatccagacctcgtaggcggagaacgtcgcggacgtacgacgacacagctgctgcggccgccgccgccggtgctgctggtcagtggtcacgtcgtcatcggaggcggacgtgaacgagcacgacgatccagcgactcgtacaactcctcatcctcctcgccattccagcgacgcatgccaccgacctgtgccaccgaagcgcccgcctcgccgatctcatccacggtcgatcggtacagagtaaatcattttctttattgtaggagattacagatcagtttccatatgttgcctataagcatggaagctctctcatttcacccaagttgttcgtctacaagtatgtcccctgctttggttcttcaattatattgtcacttcattagatgtagtactttggatgacaatgagattggcttaaaataattctgcctttcagtaggcagcacagaacagatttcccctccaatgtattaggggagagattagattttctaagcagaaacgttctgagattcgaccagaaaactgaattgatattttagtaatgtactgtagtttgcttattactttccaagattgctctgtgatatgtaaggacagccttacttactagagattgtgatatttcatatggtggcatgagtgctgatagataattgatatgtgcatacacaagcttttacacattaatttccatgtcattgctaaatatagattgatgtgtgcattccagataggttgatgggaacatattaaggaggtgcttacgattcattgactgcaagttatttatctatctattatatactaaaagtctattaaactttctacaaaagctcttatgctaccacatggcgctctaaatacgatctcaagctgacatgtggcgttaataaaatccatcccttaattttcatttaactcggtgggccctatattctaagccgttgatttggttgagattaaaacaaaccagcgagctgtgcatgaaccaagcgcctctggaaccgctatgacccggattcccgtgcgggcagggtgatcgatcaacatgttgatctctgatcgatcgatcgatcaacctgtacagtggacacccttctcctgctcatcctagcctccttgcaagacatgtggaagccctgatgattaaatcactattcgcttttggtattcacactcctatgcatatgtacatgtggtttttgcatgcatactatacgctgattagtttgcttgccgaatagtaataaatccaacccatctctaacctctgcttcactccccttttctcccttctttgtatgtctagcagtttgagataaaattttatgataataaatttcaaacagccataacttctaaattatatgtttgatttttatctattcatcatctatctattataaactaaaagtacattaaacttcctataaacactcttaagccgtcacgtggactcctaccaacgctcctaaaccgccacatggtgctctaataatttaaagaaaattctaagaaaaatatctaaccgtcaattttcaattttcatttaaagcggtggacctaatactattgaccattggatcaaaactaaatcccccatcacccttctatcccggacccatatgcatgtacgtggacaattacatctggtagctacaacgtttatttatttgattgcttgatttattattgacattaggcaggataattatatatggcctcggtgtgctcgattgatgcatgcatccggttcctgattttttttctaaatacatgatatatatgtacaccataatttatcatcataataattattagatctatttctcatggagactgatttaggtgtgaacgtgcaagcgctagggatttacaataggagtgatcttggtgctgtaaataaacaattattttagacggtctacacgtttaatttaagatacacttgagcagctttagtatttttttcatcaaatcaacaatccaagaccatgttggctatttgctttactattatatcatattatatcttataggtcctcctcatacatatattatacaaccgtgtatttatgatacatcgcatgccaaaaataattattacacaattatatttaaccatccaatcgtattcataataggctatgtggagcctcgcacacactctaaatgaaatgctcacagatggattgtctctcaaactatgcaatcatattacaaacccatgaatgtagtgtagcctcatgttgtacccaatacatctgtcaataaataatgggcgacctaactaacatcagtaatccaattaaaaaaaagcaccttgcttactttatatttaatttggtaggcatgttttctaaacaaaataagtctaccttctatttagatgatgaagaagattataaataattgcttatagaaattatttgaatatgatatggtataaaggtaactaataagttaaaattatataagaaatactaacaaaaaatgtgaatatatcgtacttttaaagtgtggtagattttctccggtgatattctatccttatatgcttctcaaacctaacctacgatgcatgcccgcgcattcgtgttgagttgtataaaacaaaacagaaaatagaaaaataaatgccaatatgaactacattaattgaaataattggtgaaaatcttataacttattttgcttcattcttttttcttagatattaatgatttttcttgcatcgcatcaattttttaattaagtgcttagattattttttttctctatcgtacgccacagtattatgaatttctctacatattattgcaaatataagcaacatactaaggttaccgtacataatcggtttagaagttatatttcttactattaaatttaatttttaagggtcaagttgattaggttttttctttttaagaaatacaatagatcacagatatcatagggaaacaagacctaggatacatgtatatcatctctgtcctattcatatgtaagtaataattaaactgcatcaatataaaccaaataaaagaatcgctagctagatggtacaaataaaacacctttgatagcaattaaagtatttttaagatttgatagaaaaaagttatcccctaaagaaacacctaccttttaaattacatttaatttgtagatatgttttctaaatatactaaatttgtcttattttagatgatgaagaagattatagaaaattgcttaaaggaagattaaatattatatggcataaagctaacaaataggttaaaaatttatctaagcaatacatcctatgatacatgcccgcgcgaatgcgcgggctaccttcctagtttatgtaatttgaggataataaaaggaattgtctaaacatctagacatggtagcatctaatttgcttcaggaattaattgtctaatttgctcgatgctttgttctcttttctgccagcaaatatacaaaccaaaatgttaattcatttctcaaagctttatttggagcaaggttagagtgcacattctgtatattttggtcaatcaacatattatgactgccttttttttatcatcatttatctgaaaggttgaaacatattatgttcaaaacacctggtatttttttacattttttagtacaccaagaaaatcaagttcctcagctttttgtgaaacactttgtcctgaatgatggaggtagcatcagttatggaattggtctttagaaaatgatggtgtaaggtgatc

SEQ ID NO: 1909 - DNA, 4499 bp, Oryza sativa
  unsure (1)..(4499): unsure at all n locations
ctgagcatcaccttcagtatatggaggttcatttgttagtcattcaagcggctcttgcttataacagttgtttatcttcaagttccaatttttttatccctaatgtctcattgttttttagaattattggtaaatcttgtacataaaagttatagtctttggaaaaaatttgtagtaagcaaggctgtttctgatttcctaacagctgttagtgtgcaggaattagagataagctatatatgaagctgcagttgtagaggtacactgaccaaacaaattgttattgaagagaaaaaaaatatctaaggttcccctgaatatttcaaacgaattgtgtgttcttcgcctccataataaactcatgtgagataagagttaaggattttgacctactttttaagcaggggcacttcttggatgtcctaatattatgtttgtttagtgcctttaaggagaacagaagcaatgctaggctcagtgtgctgcgtgtacgttgtagcagatggagattgttcatactacggaaatgataaagcattttaaagatgttttatgtattaatgaaataataaatctaatatttatatattttcctaaattttcggtgccattatttagctttttcgaggaataaactaaacggcatatttgcaaatgaaaaataatttgtgaataaaacttttatatacgtgttcataacgatctaaaagcaaaagctaaaaaataaactacgatgaaaaaaaatcttaaaatcaactccaaatttaagattgaaatttcaaattttgacttatgaacataggtataagcgaaaagatcatgttcttatattctttcaatatataatttataatttataggcaatggtaagtcatgtatgtttcttcatatcactcatctgtcatgtatacttgtacgcacatgtttgatttacgttttaaatatcaccgttgcattagcacaggcatgctactagtaattacaaattgttcaataagcatttgcatttaatacataagaaatacacgcttcgatcattgtatgacctagatattccgacatttgtattacatttataaagtccatgggtccaaaagatcatttttatatcacaaaaatttaatttatgctagtcatatcaccgaatgaacacaacacgcgcacacccattgcctatgagcactcaaatagcacctggtcataactctagtttaagcatcgtcatgactacagcttgctcgctcgtcatctgcatcgcttttctcgcgcactaaacgagttagctaacaaatgagccaagccgagcaacgattttagcagaaaaatagtttttcttcattgattttaaagaaatatacgtgtttacaatgaataggcagaatgatatcgttgtcgcataggagtgatgcgaattcgcggcaagttcacgtggtgagtgcacgacttggcaaacttacgacgagtttnnnnnnnnnnnnnnnnnnnnnnnattgattaattaattaattgaccattatttttaatttagcgtcattagctgtcgattaaaagtgattaaattaatttatgccgcgaagattaatttatgctcgtgtcgtcaatgaggctgagttttttccccaactttcccaactcactttcctcgttttccgcgtgtacgcttttcaaactactaaacagtatatttttttgcaaaaattatctatacgaaagttgctttaaaaattcatattaatccattttttaaaaattagtaaatacttaaataatcataagaaaatatgccgctccattttgcgtgcacgggacctcacctcccgaaccagccttcttctgctaaaaagtaatgtaactcacatcaccttagcaggaactctcttctttgaaggttgtccgtcaacttcacctggatcatctcgtctaatcttgtatcgtagtgcattacagaccgggcatgcttctaggttctcgtactcctcaccacgatagaggatacaatcgttcggacatgcgtgtatcttctgaacctccagtcctagagggcagactatcttcttagcttcgtggcagactatcttcttagcttcgtgtgttgttttggcaacttattttcctccaggagaatattctttactagtttcaataactcgccaaatgccttgtcactgaaacctgaaaccatttcttgtcttccattgcaagaattcaagagtggtacccaaatttttgtgcccctgttcgcaacctgggtacaacggcgtcttgtggtccgctagcatacgttccaatttcttgacctccttttcactttcgcagttttccttgacgtcccgcaacatctgaccaagatcatttgcagcgtcgttatcttcaacagccccgtccacctcgtccgttgtgtttccttcaaatccaccataatgagcccagtccagaatgttctcgtcctctacttcatcttcttctgcttgaacccctagctctccgtgtgaggtccaaacattatagctcggcatgaagcccgtctcaaacaagggaaaatgaatagttcttgatgtagaatactccttctggtttttgcatttagtgcatggacaacgggtaaaacccttatgcttgttagtttcggccaccctcagaaaataatgcacatcgtcgataaactctttcgaccgtcgatccgcgtacatctattgccgatccatctacatgacaagcacaaaaatcgataaaaataatccacgaaagtaaaaccaattaaacaataattttatataattattcatgtaataattataaaataacatcacatattactcatgtttttttatatttaaagttgtaaacaaatattaaattggttgtacttattttaatttcaaattaatttagttttctattattttagactaattttctatctttttactttctcatctcttttatcataagtttttataaatttctaaacaaacctattttctatattttttccctacacaaactttctctctcatcatcttccattcaagtttctagaggcaaaaaaaagtatagaaaactaatctctaaatgtaaatgccaagcaaaaaaaaatagaggaggatagattactaaccttttatacacctcaaagttgtatattatcaccaaaccaaattcacaaaaaaatgggcagcacctcccctctcctcttaaaaaaaatgaagccctgctctggatgaaggaggaagaagaagatataggcatgctaactatagatccaggaactaaagattggaactttagtcccgggactaaagatccctgggggcctgacaacctctgataatcggcgaaccgggactaaaggtcacaagattcctttaaacttattaaccaggacgaaaaatggtttttagtcccgggggttttttttttgaaccgaggctattgcggaatttggccgaccgggcaaagatcacttctctagtagcgaaggatccaccggcgccagtgacgggaggggtggatccggcgccctcttccccttccccgcaggccgcgcggatcccgtcgcctctccgtcaccccacgcgcgcggatcgatctagcgcccgctccccctcccgcgtgtatcccggccgccgcttgtctgcccctcacgcactcggatccggcacccgctccccctcccactgacaatgtgggcccacaagtcagcctggtagttcggtgggaacggataccacggttgttttctttttaatatggcatagatatcgcgtgctttagttatggaaccgccggctatatgtttccctttttgtcggttctgttccctttcggccaaaggaacctcctcaatcctttctaattgctattcatcccccaaaaatattcccacccgtgcattgcatgatcgatctcgattaccaaagggatgataatgcatatagcactgcattcgttcgtaaatataagcattttatttagtgcatcttaatcgattcaatcctacaaaaaatatatatacatataaaccatttatattattaaaatagatatagaatatactatttatatttaattacatataaacttcaataggtggtaggtaggggtgaaaacggtaggaatcagtaacatctcttcggaagcgacgcttgatcggtcgataatcgactatatttatcatttaaactactcagcgccgacattaatacgatgcataaagaaattagaaaaaaacaaaattcataaatacccaaaaacggtacggtaaaaaacggtgccctatatacgaaaacggcgctcggtcgatcggaatttccgtaaccgttttcacccctagttgtaaggatagggttagagtcggctttgtgacccgacaaccctttaaatagagaaaaatatgtcacaatgtaatcataacgactataatattccaataatctaagcttttatcagtatacaatacctccttaattattactaccactcatatggagatggtcgga

SEQ ID NO: 1910 - DNA, 7542 bp, Oryza sativa
  unsure (1)..(7542): unsure at all n locations
ttggaatccaaattcgaatttaaatcgggtatataacttttggaaaaacccttttttaaatttaaaaaaccctttttttttttcctttcctttaaaatttaaaaaanaaacctttttaaaaggaaattaattggggttaaaaancctttttcggggttaattattaaacttaccaaaacagaaaagtaatgtagtgctatataaaaaatatatgaattcaaattcgaatttgaatcgggtatatacccttttgacttataaacattcgctcagatgtgtaaattttaggtgtataaactttagatgtaatataaaattactaaaacagaaaagaatgtggtgtgaaaaaaaaaaggtgggaaggggatccgatcgcccgatcgcggggcaatcgatcgccattagtcttttcgtccctttcccccttttctttcctctcttctcaccggtttcatttgtgccaaagccatagagctctcctccctcctctgcacacaccttccggcggcgcaccaggcggactcgaggacggagtgggagacgggcggcgactccgggcggtcgcgggcggcgactcccggcggcgcggcggcgaccttcccggcggcgagggcggcgactctcctgacggcccaggcggcaaggacctcgggggcaacgagcaacaaatctgggcattccattcctcttccattcctcttcaaatcaaggtatactacaaatctgagcatactacttggattttggggaatgaattgttaaaatttgagtgctatagaagtttctaagcatgtgcatgaatggttgatagtgctatatttgccattttttgatattttgttcaaatctgagtgctatatgttgtatgtctcaatatatgtgtgtatgaatatggtagacctgatttcgtatcaaactttggcattgtagatggacagcagaacaaggtttctgatttatgcggctgcatcgtatatgttgctgccaatgatggctatggttattgagtctagaaaaaagaaaaggaaaagggttccaaggagagaagggattacctatgggccaatagatgaaagggataggaaaagatttgattatcttaatgacaagatttggaaaaatgatatcatctgtgtgaatatgctttggcttaaacgagcaccttattttcgtttttgtagactttttagggatcgtggcttgcttgtggatactatatatatgtctgttgaagagcaagttgctatgttcttacatacaatcgggcacaatgttagaaacaaggtagttggcactaattttgataggtccggtgaaactgttagccgatatttccacgtagtccttcgtgctattggtgacatgagaaaggaattaataaggtcaccatcaacaacgactccatcaaaaattctagggaacccaaggtgggatccttattttaaggtatgatatattatgaagtaacaacttccactggaatgtaaccccaatgtatagtaaactataagctctcaaggtggcatgtaaaacggataaaaataaaaagaaattaggggaacacattcaaaaggtcactaaggacagatcagaataagagctggaatataatgcaagttaacagaaacaaccaaaacaagcaatgaatgcaacaaaaaaatcacaacagtaaactcaaaacataaaacaaatcgctaaatactgtactagtagaatggtagtggaaccaaaattttgtgacacattaagggcctgcttgggagtttagtttttttttaagtaaaacacctgtaaatttggattacccaaaaataacagtgaaaccccctctaggatctacttcatctgtttgtaagaactgaatcctacatggccatagcaatgtgtatggacatttgtgtctaacagaaatttcagttcataggatcaatctggaactacaaaatttgataaacaaatatattcagattgaatctcattgttcatcaaaatttcagaacagaacgtcaagttgatgccttattccaaccattcaaagagtagcgtgagtataaacgaggatctgtcagccaatagctcgattattgccggagtccccaaaattcacacacaaaataaacaactgactcaagctggaaatcctcatattcttcacctaccgagccaccgatgtgtttcgcagctactatgatcaatcgtgtcgtccagatagaggacacgtcggtagtggcggcggcggcagctcagatcgaggaccggtgacggagcttatctatggcgcccctcggcggcgactcataatgaatgaagccgccccaccggcgacagttcagatcaacaactcccctcggcagcgcggtggcgcagactgagggcaaccccggcggtggggagcggaaaaaggtttcggcgacaacggcggaggcgccggggcagtggcttgagggagaggcgcccatgaaggcgatgtgttcgggcagcgcaatgcccaagccgcacgacgacttagcactagctgctgcagcaaagcaaaaccacacccacgacgacgcagcggcggcagcggcggcggcggtggcggaaaccaaacgaccggaaaaaaaaaccaaatggctcgcccgcgatcgccggtgcggctgctcaacctcgacggcggcgcccacctcttcacgtcgccatcaaaccgagcacaggagggaaaaaaaaccgagcgattcgattcgcgagagggcaaagcatcgaagcttacttgcgggggtggagaagccaaaaaaaaagtttcaaatccacaggacgaatccgtcaaccagacgacctcgagacgcactcccctcccaaatggcggcggcgagcgaggctgaggccgacgaacgtaagagacgatgaaccgaccgcgccgcgaagaaatctccgaaatctcgtggattcggtggggggagaaatcgatcaatctgtggagagaatttttttttttagaatccgatggagaaatcgggggggaggggggggaggaaatcatggatgagctgtctccgcggcatgttcgaggtaaaatgtctgctccgctaacatgggcaggtgggcgcgtgagagcgagaccaatgttttcgtcgcgtgtcagtggtggtggggccatggcgtgtggggcctgcttcctgaaccggggatttgctttgctttgtgtgaatgagatggatcgtgcgctgcagtgtatgatttggctggtgtcgaaggaggaggtggtatgctacagctacacgctgtggttaccagtttttttttctctttctctgacacgttgtctccacagattgatcgatttctccccccaccgaatccacgagatttcagagatttcttcgcggcgcggtcggttcatcgtcccttccgttcgttggcctcgctcgccgccgcctacgcctcagccgccgccatttgggaggggaggcttgcgtctcgaggtcgtctggttgagagattcgtcctgtggatttggaacattttttttttggcttcacccccgcaaataagcttcgatgcttttccctcgcgaatcgaatcgctcggttttttttcctcctgtgtgctcggtttgatggcgacgtgaagaggtgggcgtcgccgtcgaggttgagagcagccgcgctggcgatcgcgggcgagccatttgggttttttttttcggtcgtttggtttccgccaccgccgctgccgctaccgccgccgcgtcgtcgtgggtgtggttttgctttgctgcagcagctagtgctgtgtcgtcgtgcggcttgggcattgcggtgcccaaacacatcgccttcgtgggcgcctcttcctcaggccgccaccccggcgcttccgccgttgtcgtcaaaacctttttccactccccaccgccggggctaccggggtgtcctcggtctgcgccaccacgctgccgaggggaattgttgatctgaactatcgccggtggggcggcttcattcattctgagtcaccaccgaggggcgccatagatatgctccatcaccggtccttgatctgtgccgctaccgacgtgtcctctatctggacgacacgattgatcatagtggctgcgaagcacatcggtggctcggtaggtgaagaatatgaggatttccagcttgagtcagttgtttattttgtgtgaattttggggactccgtcaataatcgagctattggctgacaaatcctcgtttatactcacgctactctttgaatggttggaataaggcatcaacttgacgttctgttgtgaaattttgatgaacaatgagattcaatctgaatatatttgtttatcaaattttgtagttccagattgatcctatgaactgaaatttctgttagacacaaatgttcatacacattgctatggccatgtaggattcagttcttacaaacagatgaagcaggtcctagagggggtttcactgttatgtttgggtaatccaaatttacaggtgttttactttacaaaaaaaaactaaactcccaagcaggcccttaatgtttcacaaacttttggttccattaccattctactagtacagtatttagcgatttgttttatgttttgagtttagtgttgtgatctttttgttgcattcattgcttgttttggttgtttctgttaactcagtatattctagctcttattctgatatgtccttagtgaccttttgaatgcgttcccctaatttcttttattttttatccgttttacatgccaccttgagagcttatagttttactatgcattggagttacattccagtggaagttgttacttcataatattggagtaatattatattctcaaactagtgtgtctggtttgtctaagccttgctctttgatatctgctattctgttctacaatcttctggcatgcaattatgagttagcttaacttcctgagttcaattgtgcactgctctgagagagtataaatcaataagttcagaacgtagcaccagctttgacaatcatgcgctgattcttgttaccctgttttctaactttgcaacattttgtactgctttgacaagtatttaatatttgcgagtagtctatcaagttttgagttcagcagagataataatttcgagagtatttgtttgcaggttgtcaaatgagtgactcaataatctagaaaatttatatcatgagaaaaatgtgccattcatgtgaatcggaagatgcaacaatggatggggtcgatgatggccttatctgtagtacttcttgctataatatgtgtggccatgctgacaaatcttcaataattgatggtgagattggttgtccaagcatggaaataagcccttgcaacactccttatggcactcctctttttagccgagaaagttcttgttcaagctttgccagttgcttttcaagcctcggtgagtgttgttgcactgttctcctatagatgaaatgctgtcattgatatcatttgctattttttttgctagcataactaatattttttatgccatttatttcctagatgactacctagttgaaactgactctgaagaggaaattgaggtcttagatactggccaacttcatcccggcatcttattctctgatgaatcgatggagcaaagaacagtgggttctgtacaagtggaagaatgtcaagtcagtcatgctgctgttgttgacgatgattctagtatttccattccgacaaaccagaacatttcatctggtcaacagcagttggagatacatcttgatgctaccaatgaaaattctgttccatccaatgttattatagatgcaaatgtaacggatcctcatcaagatgtcatttccaatggtggacttatagaagcatgttatggtgtaccattggatgatattgatctcaaacaatccaatatcttagatggtgaagagattactagccttcctatggctgacaatgaaatgactccactgaatgatcaaattatggaccaaattgatgatatgaaggaaattagtactatagtttacaacaatacaataagcgctgagcagcatgcaaattcaggttcagagtttgagaaaggaaatgaatccagtgaaaacctttatccgctagtaatgcccagttttgatacagaccctcacatttggttaccaccagacccagtcaataaggacgatgacactgatattgttgctaataacgatgataatagtgacaacaatgatagttgggtacagtcaagtttcaatattagctttgatgcaaagagaaacaagactagttgtgaagaccaattgcagaaagcaatgtcggaagttatgaatgggcaattcaagattcttgttagtcgttttttagctgctgaagggctctctttgtctgatggagaagctgacaagaactggcttgatatcgttgcttcactatcatggcatgctgcattacttgtcaagcctgatgccaatgttggaaatgcaatggatccttgtatgtatgttaaggtgaaatgcatagcttcaggatctattgagcaaaggtaacctaccaacattcttcctcattctgcttttttttctttgcttagtcatgtagacatgccttaactagctcccttttctatcttttttttttgacagtgaagtcatcaacggccttgtttttaagaagagcgctgctcataagcagatgcgtgccaacatgaagaatcctagactgttacttctgcagggtgttgttggccattcttctgcagggctattgtcaatggattcaatgaaacaggtgtgcatgtatgcccttagtagcatatttacattatgtacagagttatgtcatatgatacaagatatgcaaatttcttttcattgtcattgatcaggaaaacgatcacttggagaaaattctcagtgatgtaattaccaaatgcaaacctgatgctatattggtggagaaagcagtctcacgaaatgtaaatgaatatattcataaacaaggagtcactgtagttagtgacatgaatatccgtcggggcctgggaaagaattgctcgttgcactggttctccaattttcttgttgcagaatgttcttgcaacacccaaccttattaaacagtgcgagtctctacattttgaaaagtttattgaggagcataatataactggaggaggaaagagatcagccaaaactttgttatttctagaaggttttcgaaagcctttgggatgcacggtatgttcttttcctatcttgtttttagtttgtaggtcatctgttctctttatgtaggactgatcttctcatggtggtcagagttgttctttctctgatcccttgagctgcatttagtatattctttcagtatattatttacattatatgtgttagccttctatgataaatatttttttctgccattttttttgacaaactggtatatataatgataaaatataatcctgtccatttggaatcaacaaaaatatattaattaattttgaagctaatgaatttccttattccagacttgacatca

SEQ ID NO: 1911 - DNA, 698 bp, Oryza sativa
ggcgatatgtcgttagattttgccaaattggcatcatgtgatgactttgccggttccacctctggagctccttcaaacaatggggttctgcagacgtatggggcggatggcaaagattgtctagaaactattagtgatggaatatctacagggactaggacttctttagattctcagaacatattgatttcgatgtctagccaacatatcagaaaccaagcaatctgtgagcagagtcatctttcccgcataacttactacgggtattttgatacatcacttggtcgttatttgcaagatagtttacttaatgaggtcatacatcttaactgcttgttgatttggcagatgcttattttatcttatgatgtttcaattgacaatatattatttgcagaaacacaactgcttatcttgtggtgaacctccagaagctcacatgtactcttacactcaccacaatggcactctaactgttcttgtgaaaagccttcccttggatgtaactctttctggtaaggatcaacgaagaatttggatgtggactacgtgtttgagatgccatggtcagcccacccacaggttataatctcttcctctgccctaatcttgcatttgggaagttcttggaattcagtttctcaacacattctgctgctaagaagctatcaacatgtgggcatttgttgcatagggac

SEQ ID NO: 1912 - DNA, 574 bp, Oryza sativa
gcatggcccagccgcccttgagcacgcagataaagcagctggagcgggagctgggggtacggctgttcgaccggacgagccggggcgtgaggctcacggaggcgggggagcttctgctggaggaggcacggcggttgttcgtgcagctggatcagacgacccgcctgatccagcgggttgggcacggcgaggtgggtcgtctggcgctggggttcgtgccgtcggccacgaacgaggtgcttccgccgatcctgcgggagttcacgaaccgcttcccgggggtggagctgtttctgcgggagatgcgcccggacatggtggtgcagcggctgcacgagcagcagatcgacgcgggcttcctgttcctgccactggaggacgcggcgctccaggtggagcgcatctcgcgggagccgctggtgctcgcgctcccggagtcgcatcctctggcctcccgccggcaagtgcggctgcaggaggtctccgaagagccgttcatcctccccgcccgctacccgatgcccgggctctacggccaggtgacggaagcgtgccgggcagcgggcttcgagcc

SEQ ID NO: 1913 - DNA, 723 bp, Oryza sativa
gcttccgaatatattccttgttgctcagatatcaatagggcataagcaatcatactagatgcctcgtcctcaacaatggacaagatactaccaccagggccaacaataaactgtaccatgtccatttgggatttaagctgaaccagtgatgaaaaggtggggatgtatttgttgatgagatgaaacttgtccaaagaaccaccctgaagctctttcttgtactccttttccaggtgactaaaactaccccagacccattttctggcatcattacttaagaaatcaaataggttaaggaatatatcaaaacacttgcttggcttggcaacaggatacatttcattacctctggctagttctggcaattcattattcttaactggtaagtcaattaacttttctaaacaaaaactgtcagagatatgtgcatatttgtcgacttcatatgatccaccatcttcacgatgatctggactaacatgtgacccaggctcttggattactgatttctcagttagctgctcattcttcaaaatcataccgccaaatgaactatcaaaagaatgacaagtatcgatacgtgcttcctgcctttccattccaacgttggtaagagatagtgtgtccccatgaacagaagttatttcagaattctttggcttgttctctggtgtttttatctggatagtactatctggagatgcagcgttagctttacagtat

SEQ ID NO: 1914 - DNA, 647 bp, Oryza sativa
agtatggatgaagtgccaagtaattctagttttgcagacaacccaactatctgtagtatagaaaatcatgaaaggtcattggaaccatatgatgtagcaatggagatgcctctctctatgttaccaagtgattctggagctgagcaaaaactacattttatgtcagaggctgacttcaatagtcctaattgtctgaaatctgaactttggcaggatatttccttgcaaagccttctttctggacctgatgcagttgaaactgattctttttcaagatcaaatcatcaatcggatgtatattcctctcaagcagataatgaatttttagcaccaccctacctattacagacatcaaattcttccagtgtgatggaggctacttatggacagagtccacagatgtcagtaccaccatctcttatctgttcaaatgttatgactgatgtaccttctgataatagatcagaaccaaaagaaatgacagtttctcaggcagaaatggtcacacaatcttccagttcttcaggtgacgctgaaatgtctgctaaccctggtagtagtaatggcagtgatattccttcaatgatggaaaggatacctgaatgtgcggaccgacatgttactaatgcggaagaacctgaagccag

SEQ ID NO: 1915 - DNA, 511 bp, Oryza sativa
gattgtggggtatcagacacatcctccatcggcattcaaacatgttttattaatgccactaaagatgatgctgttataactaaatcagttttgcgtattgagcgatctgcttcttctaaacctctggaaaagaaacttgagttctctgatgagaacaaggaaaatttggacaacacaattgaacaggcaaaagatggacagagtgcaggaaattacaaacacattgacgagcaggcaaggggggaacggcgtactgcaacaaatataactactacttatgatgatctgccaggcaatttagtaagtacttccagtttttgatgatatttagccagttagtatgtgtatcatatttcgttgaggataaaaggtagcacctgtatagtttgtgaggtgaaccaatcagagtgggtccagtaacacaattaaatttagcattaggccagtcccattgggtgccacataagcaacaaggtatttaatggatgattgaaatatctcttacaatgca

SEQ ID NO: 1916 - DNA, 663 bp, Oryza sativa
tgaatagtacagttaaaaacatacaaaaaatagatgatctcaatatatgaacaagtaatggaattgcatctaaggttcacatggttttggttgattggcaagcaattgaggaagggcaacttatcatcaacagctaatgaatagtacagttcaaaccatagatgatttcgatatatgaaccagtaatggaattgcatctaaacgttcacatggttttcgttgattggcaagcaattggggaagggcgacttatcgtgctctgaatccaacacatttccacaaccaaatctactttcccccacctaaatccatcattcccggagcacacgcaagcgctactccaaacccttctaaacccatcgaattcttcaaccctatcacagatccaaaactccccaacgtcccccctcaaatcccccatcctcctatcctaaatccggtcttatctgtccctccttcatccgtcccgtccgttagtacagtatccgtaaacgtataaataacatagagacgaatcgctcgcgagctcaccttctcggggtctccgtccttgtctgggtggttcttgatggcggtcttgcggtaccccttcttgaggtcatccttggaacgcatccttgggcaccccaagcacctcgtagtaccgcgtgttgtcgctcttct

SEQ ID NO: 1917 - DNA, 6283 bp, Oryza sativa
  unsure (1)..(6283): unsure at all n locations
attccatcaagttgtgtaataaactaaaaattcttcctgcaaaaaatatgagtaaaattttatcaatgtatgcttgatgctagatctacctcattagaaacgcggtagtatacacttgatgcctccctatactgtcctcttgttttaagcatttctgcccaccaaatgccacatctagtagcatttctcttcccagaagatccaattctctacaaatatgaatagaataaacgagagcaatatcaagaaagaacagagaagcacgaaggatatcaatcattccaaatttaattaacttcaaaagttgaaattacacataagagtagcattaattatttggaatcatcctgcccctttatagcccttaatcgcaaattatgaattcttcaattcttgatatctagtttcacgcattctttattatatgccacaaagcacacccaactatcagctcccaaaaataatgggaataaaggaagtcatctatcctagagatgccaccaatgacaacttggattagaacagtgctaggtgaagcatggcactaattcgggtaagaacagagcacacaggaatttaatgactggggaactccataaaattaactgagtctactgttgatatcatatgaatgactataaaacaatgcaacagactagcatttgcgcagtaagatcaatgacatatgatcactccttgctaagtcaatgttaatatcaatagtcctgaaaatcagatgcaactgtatttaatagacatggaaaactgcttcatacaaaactaaataggaactccttttctctttgtgtatgacatattggacagtacacagaacacaaatttatatcgatggagctagcatgttaggttacaatttagaaagagaaccatttaatttagtctgagaaactagaagtggacatagagatgaataccagatatgtactaaaggcactgtccaggcaatattcagcatccttccttgactggtccaacatgaaatagcacagtccactcatttcctgcaaaagacacagacattatcatgaagtgactacctacttgaatatttggccactgcactcaagcttgattcagtactcaatcaatcatcaaaacaaattcaggaaccatgtgctttaaatttggaagcatacagtatgattctgatatggtgtacaagtaagaaggtctaaactcgtgtttgaggtgaaaagtatgttaggctgttaacgtagctggtcccaggatattccttaagaatcgccaccttgattgctactttatttcaaactcaacaacactacataagtaatgtcatatgtaaatcaaggcaagaagttaaaacaagtataaagcacctgcacaccagcaaagcgcttccaagctttgtcaagcttataatctgttgagagtaatctataattggacaaagcaagctcatagtcccgtaacatgaaagcatagtcacctagaactctaatctgtgactctatggaggtgaacgtatacctgttgaagaaaaaaaaaagtgttacagcaaactacagaatttttatatagggaaaagggcaagatgtaagtaaccacttgcattgggccatttgcagcttctggaacatcatctctttttctccaccacaagttctttatttgattcctaaagcccttccttgttgtggctacctagaaaaatgcttaatattattattattattattattattttcaaaaacagaatggttaatcttgttgagagaggtaaaaaaaaagtaatggaataaagaaaatacctgctgattgaggacacggatcttttgctccatgtagggaattatatgattagaagccaaatcttgcatgaagtcctttatctgaaaaaaaaacggcttatctagctataggtaatccttgctaatgggggctctggcctcttcagcnaaactcaaatacattggcatgctgacactcggatactacagaggaataactaaagttcattgatctaataccatacatctgcgagaaatattcattttgtattcttagcatcgatacccatgaaaaccttgcatacactgagtaaaaactaccaagtaggctactaatcttcccaacaatacctaccagggaacagatgaatcattaggtgctacaaaatgttggacaatggtttcatgacattcaatatgcccaagaagacggataagcagatgacatgatattcatcaaatggggcaatacctcattcaaatcatccgtgttaagccaacaagctccgtcttggttgtgcaaaccatgagatttctgtagtttagtcaagaaaatactgtaactagattgcatatcggctgcactacgtaaacactaatgcaatttaatctgaagtagttctctgtacttacataaggtaaccatgaattctcagcatctgcaccatctgcttctgtagaagaattaatacacaacaatttacaatcattcaaaccaagagtgctcttcatttccgctaaaatgttcatagctcttcaccaaaagaaaaaagaaggtcagcaaaaaagaaggggaaaattgcatacatgacactgtaaaatgttggcatttggcatatgacattatatcattgtttggctagagaacactataaaactgagagaacatgttcattagtaacaggttgctaggctatgcaagaactaatgtaaacataataactgagtgaagaatatacatctcttgtggtccatcttgttgatcatgaagtataagatagtgcttaagaatctggggatccattatgccttcatttaaaagagaaggtaactgatttgtgttgaagagatcaacaaacttgctgattggttcattgtcctttgatgatacaactaacagacctgttaacaatagtcaaagcatgagcaagaacatatccttaaaaaaaacaccaaataagacgaaagttccaaatctcacatgccacagggtggtcgaatgtttcatgctctgaaaatgagagtgtacgcatcagagctctgttgaatttcttaatccacaaagggcacagttcagcttcaggctctggaatcaagagcaaagaaagaaccatatgtaagatgcaccgaacaaacagcaaacaataatactattatttcagtttcatatcaactctaagacatgacgaaggcaaagaaacactatgtttgtaaccacccaaatatcccttgttatttacactcacagccactgagaaacacatcgcatattcacaccatttacaggaactttgagctatccaaaatataatgcacacgctcgtttggtatgatcactttgtaaagatacttccactaccagcgcaaaattataacctaaaattattctgcaaattaaacaatctgaatagaagattattgctgctcatagtaagtcacagtttgcttctaatgtcaaggtgatcggattacgctactttaagtgatccatagaattccaactacggctccataattttgctcaaagtaaatatgcccacaggtgagaacataacaaaatgaagcagtaagggatctcactgctaagtacatcttctagctgtggtgggtctgaaagcagatctggaagagcactctcattggcctcagaaactactggcttgatcctctgatccgccacctgctccaaaacagccaatgtccatcaagagattcataaaccataggcatccatactgaacaagcccacagcacaacccagaagcttccagaaagttcgagaatcacctcgtagtcctgcttccggacgtcggaagcgtagaccatccgaatcttaaacatctgcagcctgtaaggctggtcactcgccgtccgcacgggcactgcatacaggggattccccatgaggtcacagaacccaatcgaatgaaatgcgacaagcgtcatacacacaattatcggaagcggagagcatcggggaggtgaatcaccgtcgatttttttgaagagggagaacggcgagagcatgtcgacgacgctgaggccgctcttgcggcaggcggcctcggcgagcggggtggtgagcaccatcaccaccggggtgatctcctcgaggaggagcctcccgaggtagctcctgagcggatccatcgcgccaaaaacccaagccggtgtggcaggcgcgcgcgcaggcgaagcgtaatcgcaggagcgcgatctagggcgggtatagaggtattcccccaccttcgccggtgcctgcggcgaagggggtcgccggagaggggtcccccggcgacggggcgaggcggcggtggaagcgggcgccggtggtgatctgatctgggaggaggagggcgcccagagacaggggaggagacggcgactagaggcgtaccgtgtagctggctcgactgcgtctgctcgactgtgtggagggggaggggagactgggcttgggtgggcccgtttaatgggctgcaaacttgaagcccaaagtatgaagcccaattaagcctagtttgggtaggcttaaacatggggatgggctgggctatatctgggcatgtatattgggtggaaaattcgtaaggccgagccatatagctttaaattgttggaattttaaggcatgttcactttgttaccaaattttggcaagatttcttatatagctatcaaaatttgataacaaactaaatgtagccacttttttagcaacattaccaaaatttggtaagattgaaaataacatcaaagtgaacaggtccttacataaactttatcagattttcccgaaattcgattcaactttcacagggttcaagaaaaattcctcgtttcaacgatgtttttttttctggcagggccccaaaacagaccctggcataaaatattggctgttcatcactcatcaggaacacatgtatgcatgatgcatggctgatattatcgaaaattcatttttcttgtatacagaaatgttgcgattgctacagcttccaaggagaaaaaggtcggaaaaacaagaggtagacatattcaattactactttacaatgtctctgacaatgaaatgaagacgacgagctttcatgttatgatggcaagcgctgtcaagccaggtaattgtagatctgggggttactcctgtctctctccaggtactccctgtcgattaggctctctattcttttcttgatatccgatggcttgattgggaacttgagctgaaagaaaagaaaacgatatattttaagatatcaaaattgtggagtgcgcaaaatggaatgcatgcgttgaaaacatgtctaacctgctgaaaaagctcagttattagaagcgtgtggctgagggttttacgtgtcttcattattcgaactatggcagcatccacctgcacggaacaagaaaaggaacttgtggcattactctcccgtgattgaattcatcattagatttgcaccaaaaacattccagaataaatttgtttggaatggtgacgttaaacctaaaagatgcagacattaattaagcaagaaaaatagcatgtaagataacaatatgaactaacaataatgtgttgcttcaatgaataaaaagcatgtgagattagaaactagctaccatgtgctgagtgcaaatagagggtaaaacttctacggcgtcacataagaaccagaggaagcataagcacagcatactagtttagctaacatcttataccaaaaatcgaggataactaaacggggacaagtgtaactagaagtcctcaaaggatgttcttgtttgcaagtttagatggttaatgcacctgatactgtctgtcctggaatactctctcagttgtgcttgtgttttcttcaaccgtctccttcatctgaatagcattcacctggaaacacacagcattaccttagttaagcctgatgacacacccaaactcgacgtacccaccccaccccacacaaattagatgacgaatattacctttatgcgatagagaggggcactaaattcttcattaaatacaaattcgtccttatcttctacgtctcgcccttttggcatctgaaaataaaagtgacaactgaacaagctgctactgaaaattagttagacatttggataaaataaagagccacaccttttggagaacccgaactttaccgcatgcaagtgattgcagcgttcttcgcaattctttatcctcaataccagtcgattccttgatatcgaggaagcttagtttttgtgcatcattgaacaacatcaaaaccacactctgaaaa

SEQ ID NO: 1918 - DNA, 2628 bp, Oryza sativa
catgtaaaaatggcaaggcacatgttacctaccctgttgtaagcacgtgaacactcatttcaatgccagatggaagctttgtccttgcttgagatgattgcttgaaagactcatttatttctttggataattcaatgtcctgagaacagcaccaaagtcattttattttacaagagtattaaatccaaataaaagaaattgatgatatcgtgtacgccaccaatggatagaggcatagagcatatataagttagcaacatttgagctaaatatacatagggcaagagttcgcaaaaaggctagtatactagcaaaagtcatttcttctatagcaaattgctaccttgaacattccctccagcttgttggtaaattgacttccacactcagttttgagctgcaaacagaaaaaaaaaaactcaagtatgtcagcaagttggatggcatgtaaaatattattttaaaccatcagcaaataaataattacctttgttatcattgatttttcagcatctatcgatgcactcttccccagcagcaacctcttagccagatccttcttgtagaatgcctcaaatacatcttttccctgaacataattaagaatattaaccttcttcaatcttttatttgttactacgtactagtaaattttatgtgcattagcttctcccagaagcttcatacagaggactataggtctataggactctataagaatgacatattataaccatgtttgtgaaggaccagacctatagcatcatcttcaatgcaatgcttaaaccatccgcccacatgctcatggaaattgtttttctttaatatgatcaccatatagggagttttactattttatacagttgactagttgaaaaaggaggtgtcccacatgtataactgaaattgaaagaacaagatgctgacaaagaagaaacttagtgatataaaataacctagtgacttacttgtataaatcggaacagaaccaaaactttatccaatattccctccagctcttcttcggaggtacctttatttccagctcgaagtttctcatcaagaaacttcgcaatcaattcagcaggtcgattctgttggaaaaaagggcttgagctgatctttcataaaataaaacatagtacaaagaaagaaaatgcaggataaattacacatctacttaagtacaaaaaagcaactagataacaatgaacatcagaaacaaaatgtattggtaccagcatatctcaaatctaagaattgagctttctgtttatcaagtatcacagccaaactggactgcgataggaaaccaacataaagcaatatgtacaaggacagcacagttcttaaacaaatggccaatatcaacatgtcccagcaagtcaaaaatcaaagaatcaaacagtttagcaggctataaaagggaagactgactgtagtaggaaagcaaattacaaaatattgtgatataagatatgaactcagtacacaagaaaggaaaaaaaatattgtcaagcagaatcataaatatggcctacctggcgtaaattgataagatgttcgaatgactcttttattgtattggagaaagcctcatttttggcaaaactttcctccaatattctatcaagcgatgccttaaattccagaagaaagggcaccagttctttgtccttttcttcatccatgataatgccctggcctgtgccccgaatatatgaactaagtgcttgctttagcaactcaatggcatcaaccctctggaagagtgtgtacatcctcgagaggtcttttacacgatttgcttccataagcattgtgaatccctgaacagtaaaacatcatatgccaggtcatgaatgagacagtggctaaactaaattagtggccaacaaatataatatattgataaagtaaacacctcttttctatatattgatctaatgggtcaactagaaaatgcaccatcacattcttattctggccagataacaaatcctacagttgtaagagcagataatcaccttctcaagaattgcagatgtgtgccgctgcaataattgcttttctgtagctgttataagcggcttcctagtgttagcttccaaatatagaatacacctttcatgttcttcttgcaaccttgtctgcataattcatgtgaaataccaccaattgcataagtatacctgaattttgtgtgaacaaaatgcaaggggaaatacaagaggtttatcaatacctccacatgcttgagatagtctggaatatcagactgctgcaaatatttaacaccttcagtagcataaaattcagatgtacactccagaaagggcttttcaaaactctcagaatacattccaagagcagtaaacatcttcagaagatgactaagtaatgtcctgtctattgcttcaccaagcctgataaggaagagatggttaatgaataatcagttacatagaagaatataaaataaattgacccttcaagtccacaattttaataatttaaaatggacccaatacatacactatgatcgccagctacatcacacaaggtaaatgcaatgacaaaacttttctcaagtaaactgattactctttgatatgtaatggagtatac

SEQ ID NO: 1919 - DNA, 3290 bp, Oryza sativa
  unsure (1)..(3290): unsure at all n locations
aatcttgccatgttctttgcaccagagacaaaaatactactaaatctggactttgacccactaatgctgatatttttgccgatatgtgtacttcacattctttctttatgcgttcgtatagatttgcgcctagcttgtgtagacaaaggtcacctgcagcctatagtgaagaaaacaagttctaaataactaaagtgggatcatcaaatagaatagaagcaatataaaaattacctggtaaagtttttcaacatcgcacgaaagtttctgttttagaaatatagctgtaatagcatctttcaaaatagcccatgtatcctcctcaaagtttgttggcaattttggctgacctgatacatgaaaaacagatgggatataatgaacaaaacagaaaagggatgcaacaagagacgaattccggggtgggagtaaatctttagttcttgttcggcaaatgggttatgagaggtgggatcgggaaagggaaatgagtgaagggctacaatgaaatggagtggttagaatggatggctaggatgcagtgttgcattttttatgggtggatattatttcccaatctcatttgccaatcacgccaaagggttgcaaaaaatacatccagaagatcccaggggtctattatctaagaaagaacatatggccttctgaattttcttatacaggttactagttagttatggtgggtactgattagtgaatagtgactggtgcagggattattattatatatgactcagaaatgaatagatattaaaggttagagccactgcaacatccattgcacagaaacggattttcagctttctcctgaagactagagaaggtcacatactggagatgcgaagcaaagcttccaataaataccgacagttacacccaataaagagacaaaagagtgtcaacttttaagcaatctagctagaagccagctcatatggtgcaatacgaccaaatggggagcaggaagtcagaagaaccatacaactatgcccaagctcacttgtcaactgcattaaaaaaggcagaaatccttgatgcatattcacgcccaacaaagcaagccaagataaacaagcaattacaaggaattgaacatacatatatatctcaagagaaactagacggattgttgctgacgaaatcattagttaccctagcaattatcaatttcccccaaaatagtccaagtgtctagccaaattcctctttacaaatagacacgccaattagtaaatagaaaacagaagtgtgtgacgaagcgatccatttgacgaaagggctaacgaacaccacctcaatccctccctattattggaatttaagttaacgacgcaagcgggcaagtgaacacactgagaggaacaatagaattcccctcaatttacccccgaaacccctcgatgatgtattctcacatggaaaacgtgcaattacagtgaaagagagggacctattttgattcggaggggcttgcgggcggcggatggctgggggagtgtggccttcttccggaagaggttggcggcgacccccgccggggccgatgcgctcggagcggcgagctcctcctggtcggcgagcaccatctccgcatcctcctcgccgttggtgcgcccaccggtccgggcggcggcggccgtgggatcgacgtggagcccgttcttctcggtgaccccgggggcggcggcggaggaggaggaggaggaggagccggggaacttggccttcttcatgtgcggctgcgcgggggaggtcggggaggaggcggcggcggaggaggaggagaagtggccggggcgcttgggggcggtggcgtgggggtgagacatgaatcagatgccgaagcgcatggcgcggccgcaccggcggcggcggcgaggcccggggtaggatgggtggtaggtggcggcgcgccggggttttgggggtgaggccgccgcacgccggcgaggaggaggtgggggagtggagactagagagagagagatcgggttgggggaggaagggtttccccttttcttttctttcttttcttttttttcctttcttctttgtctttgctctattctttattaggtgggatttgcgaggccgtagcggcccaaattaagagtgagaatgtgggcctggagttccacgcggcccagtttccttttgttctcattagcccaattctgttgccgccgccttgccctcgccgcctctgccttctgtcgagaactcgagatcgagaattcgagatatccacgcgcagtcagatatggagaactataatcttcatccctttgacgggatcttctttcgtttgttcaaaaaattcatccaaacggttataaaaaaattagcaacacttgtactacatgcctactgtacaacctcacaaaatctcacgtacagactcaactcacgcatcgaaatgttaaaaaaaaaactcaactcacgcatcaaaatgttaaaaaaaaaagacaaattcaggtatgactaatagctattgtttacatctgatcgaatttaaacttaatttttatacccatagacaccgttatgtatgttgttaattccttttagaattttttgtaactatctacattaaatttggaagagagaagagaaagatataaattaagttgtgttcagggattagaatccattcacacgcaaataccctacctgtcttcgtcgtctttctgtctgattcgccggattcgcgatcattgcctcagcctttggtacagggaaggaatgcacccacagaagttacaaaaaggttcaggcagaagaataatacaaaatgaaacccgtccaatttaagcgcacaaaaaaaaaacaattgcattgcatcccatagtcttcacccgtttcctcaccatttctcgctcagcaggcacactgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1920 - DNA, 764 bp, Oryza sativa
agctgaaaccggaaaatgcaagttcgtgactcttgcacgttccagaagtagttcagctaatcgtgactgtacctttgacaaaatagcatcttgttttatttgtgtatttatgaatcgacagcctcttgtagccttgcctctagaagtccagcttttttgcagccaagtacttgtaccaacaaaatgtatcctcgtgttcagctgatgcagtggaagtcctaccaaatgcagagattttttgtcttgtgctgtgttttcgtgtgccaaaattttttgtaagtatatagacacatatttaaagtattaaactgtatactaataataaaataaattatagattccgtatgttaactgtgagatgaatctgttaagcctaattaatctgtcattagcaaatgtttactgtagcaccacattgttaaatcatggcataattaggctcaaaaaattcgtctcgtgatttacatgcaaactgtgcaattgattttttttcgtccatatttaatatttcatgcatgtatctaaacatttgatgtgacggaaaagttgaaagtttgaagaaaaaagtttaaatctaaacatagccatgaatgcaaaatccacccgtacctccattatgcttcacctctgcttgaacaggtaagactccgtgcatttacatcggccatgttgtttttattattactccctccgtttcaaaatatttaacaccgttgattttttaacacatatttgaccgttcgtcttattcaaaaaatttaagt

SEQ ID NO: 1921 - DNA, 2685 bp, Oryza sativa
ttttctaaaacaactttcaactctgtagtagtagttaattttcattcgtttatatcgcaaaaatcatattatccgtcaattttctatatattgttgtgtctgtgcaattcagtgctgccccctgaagtgttccttgcaactctgtacaatctatgagggttggataagagcacccgcaatggtaaagtaaggtgctctctataaaacatgtacatctcagcaatagactagattaatagtaaaccacctcaatagtatgtctacatgggtatctatagctctctcatgtattgtctcgtttttctctatagactatctctagtttagtagatagttttgctctatctcttcatttaatatcttgcaaatagaaaaatatactgacgtggatctcttatagagagtctatagataaccattgcgggtgctttaagtgaaatttgcgcatgcacatgtgcgtcagttgctagaatcctcaacagcatgcaaagctcgtaaagcaaaacaaggagaggtcaacggagagagcacatcaacgcatcactatggtaatcccagagtgagtagtactagcaataataatagtgtcattagtactccctctgctgaagaaagcaacgccttataaaaaattaaaagaagttagtagtacgaaacaaataagacgtcaacgccgtcgacatccaaatgtgttactttctctgttataatatgtaacagcttttaaatttattatatcttagtattataaatctgaacatgtcgtttatattcataattcttatattgaaatggaaaaataaaaggagtattatagtacatgtgaggtggggcaatcaatcaaaaggcgtcacgttcacgtccttgtgatcgattgagacggtcagcgttgccgccttgggttggcctgacccggtttggtttgtagcgtggtaacatagcatagcaagcagaattgcgagggttcatccatgattggcagtttggcatgtgataactgagacatccaacggtggatgacgaccagtaccaactaccaacccagcaagttgtataaacgaagggcccctttaaatcacgggaataaaaaaatgaaggaataaaaaaatataggattctaatagaaatgtaatgtaagtgtaaataaaaaaaatataggattctaacagaaatgtaatgtaagtgtaaaacagaggattgcaaaacacaagaaaaacatagaaatgaccgtttaattggaccacaggaaaaacacaggaatttgaggagagataaagactcgaaggattttttccataaggttctacctcttgttaaaattcctccaaaacttatatgggaagaggcattccataggaattttataggatttcatagggttcattcctttgattcaaagggctttgtaggaaaaattcctataggaatgaaatcctctaaaagaaaattcctatgaatttcctttgaatcaaagggaccgaactctgcaactgatggaattattatgtatataggccgagtttacttccaaactttttcttcaaacttttaactttttcatcacatcaaaacttttctgcacacataaactttcaacttttccatcacatcgtttcaatttcaaccaaacttctaattttagcgtgaactaaacacacccatacttggttttattttcggtcttttgttctctgtcctttttatattgtcgtggtcaagtcaagctgcacacttgcatgcacaggtgcccttgctcgctctggttgatccggtcaaaaacgaccagctgaatgatcgcctacggcttatggctgatcctgatgccatgcatctccattctccagtcttacaaactccagtagcagttttataatactaccagtagcttttttttttttactcttgacaaatttattggcatgatttgaagtttacagttacctgataagctttcataaggccctttttatacggttcgggttccaagatttttcggaaccggtaatttctagttttacaaatttatgatctaataaatcaaccattacattgctaatatttagatatatcattttatttctattttaaattaattttaaaatttaaaccattatgatttaatgtaacgtacaaagttcaaatatgtcgtggatctggagttgtgcaaaacatgacctattttttttcacaaaataaaatgaaatccgtgctccgtttcatagaaagatatttaactatttgtcagtcttataaatggttaattaagggtttgtcaccggatccatataaaaaatcgtgagacgtaaattcttaattatcgcatctttaaagtggtaaaaaaaagttaaatgcaccggcccctctgaggttgcgtggttaggtttgaaacaaagcacaatctggacgcccccggcgcgccaccacacgccaccgcgtgatcaagcgccgcgcgggcagtgcacacgagggaggcctggactgggcggcgctcgcgagtcgcgacgccacccgcccgcgccgcggccatctcatctccctccttcctcccaccttcccaatccctcccccccgcgccacctcacgtcgccatttcaactccatcctcgcgtgaacgagacgagacccctccgaccccttcaactccgcgtctcctcctcctcccccctcttaactcctccctcctcc

SEQ ID NO: 1922 - DNA, 9838 bp, Oryza sativa
gatattgaatcgggcggcggcgtggagatggcgccgccgccgggggcggcggcgggggcgagccttgataggttcttcgaggacgtggagtcgatcaaggacgagctccgcgacctggagcggatccagcggtcgctccacgacgccaacgaggggggcaagtcgctgcacgacgcggcggcggtgcgcgcgctgcgggcgcgcatggacgccgacgtcgccgccgccatcaagaaggccaaggtggtgaagctccgcctcgagtcgctcgaccgcgccaacgccgccaaccgctccgtccccgggtgcggcccgggctcctccaccgaccgcacccgcacctccgtcgtcgccggcctccgcaagaagctccgcgactccatggaatccttctcctccctccgcgcccgcatctcctccgagtaccgggagaccgtggcgcggcggtactacaccgtcaccggcgagcagcccgacgaggcgacgctcgacaacctcgccgagaccggggaaggggagcggttcctgcagcgcgcgatcgccgagcagggccgcggcgaggtgctcggcgtggtcgccgagatccaggagcggcacggcgccgtggcggagctggaacgctcgctgctcgagctccaccaggtgttcaacgacatggccgtgctggtggcggcgcagggggagcagctcgacgacatcgagacccatgtcggccgcgcgcgctccttcgtcgaccgcggccgcgagcagctggtggtggcgcggaagcatcagaagagcacccgcaagtggacctgcatcgccatcatcatcctgctcgtcctcatcctcgtcgtcgtcctccccatcgtgctcaagttcgtcaacaacaacaagagcagcagcagctcgccggcgccggcgacgccgtcgccgccgccgccaacggcatgatggtcgtatgatagtccatgttgagttcatacttcatagtgagagatttctatttttttgtcgggttttttctttcgtgattgtaattacttctgtatgattagttgatcgtcttgattattatacatatctgattcttctaaatatcattgcatttgaaactgcattttatccttttattcgagcattcgactatgtgcgatgcaattcattctccagaaaagcagtaaagtcataggcgaaaatttaaggcgtgttctaaaagaacttatgaaagatatggattatttgtgttatgctcaaacgattttctcagagaaaattctgcatcagcattgcttatacaacttgttctagctatttttttagcattatactaactccgttttatataagagataattttttcgcgaacgcacaaatttataagagataatgttgatgccttttagaataacgtttaacaattcgtcttattcaaaataaatagtataaacatgttaaagtataaaacatacttaaagttctttcataataaaacaaatcacaacaaaataaatgacatttatataattctttttaataaaacaaacggttaaataacatgccaaaagttaacggtgtcatctattaaaaaacgaagggagtactataaaatatttagttcatccttacaagtaattgtagctaagaagtccaatcattccgttagaacacgccctaactgatatatcgtctcatataaaaccaggtacatacacagagagctgatttacaaaatttgtcgtcttttttttctttacaaacagcaaccactggactatatataaatagataacattattaccttaacacgaaactgacatatacaccaagatggccgaagagaaatgcgagctcgaaaaagctagaagaacatgctggagctagaagaagatgctgaactggctggtgagtgagtccttgaggttggagaagagcccaaccagggagtactgccggagcttggacacctcataccacgagttgaggacggcttcgtgcttgtcagtgccggagaaggcgagctgaatcccggggctgcaatccacgctgccgcccttgcccgtgcagttcgccgtgctgatcgcgcagttctgatcgacgcaggtgaaggagggttgcccggagcaagcagagcagccgttggctttccagtacaggttctgaagtgtgcctttgttgaactcaaacacctaagaaacagaattcagttggtcgaatgatcagttggagaaataggtgaagatagaatgttcagaatgcagggtgcgggttatggatcgcaccagggtaaagctggtcacggtgtatgagctgttactgacgaaaaccggaggtgatcttgctgcatatttcctcccagcaaaagctaccatgtagccaccagaagttgcctggcacatagcaaaatagtggccaattagaaacacaagtggcttcattatattgagctaaaaacagttaaaaaaaaggacaatcatatgaagaccaatcacttatgggtaagaaagtaccactacaacaatgctaaatgcttcaaaagatggtgtgtggtttgctggccgaaacagtgaaaaatgtgcgcaacagtttgccattaaccgcaggttaccacagtaatcttctaacagtacaacaaaaaccattcttacgcaatagcactgcttattcttgcaattgagaatttgacatgctatggccaatcaataggagtaactttcgtagtgtaatatgaacaaaactgcgatcaacaaatcaggtagaaaacagaaaatgatggcctccatcgtgatgattagcccttatctaaaatgtcaagcacagctaaaccattttaacacatgttggtaattaaacaatcggtagtactgtagcttctctatgttcaatcaattagaataaaaatttccaaaccatagagcacaacccattgaataatttcatcatcaaagcagataaaccgacacttggcccacagaaaaacagagaagcatgttcatgggaccatttccatctgtgttactagagctcctacaaagagtccaaaaaatggtgctgtatcaatccatatgggacacataatccagctccccccaacttttgtcttcatcctccccaagcaggtcgtgattgccaatgttcatgacaaattgacaattcaccggcaagttcttcgtttctctgtttctcactaggcaattagggtgtttgattctaactaaaacctattgcatgacgaaactgacagcataaattctttattgaaaaggaattgtgtctatataaaattagataaaaaagaagaaactagaggactagttctttatgcgtttatgccaaacttcgggttcctgatatacgcaaccgtgcagtcagttagggttcctcgtgtgtatacaccatctgacataaaaatcgacattaagcatgaaaacacgaagcttctagaggtgaaaagtcgaccagggccttagttaccgggtcgaagccaccggcggcggaggtgttgacggtgaggagcgaaatctcgtcgacctcggggcggaacaccgcgagcttggcgcccttggacgccagcgacagccttccgtcgcagggggagagctgcacgccgccggagaagaagtcgccgcgcgccgcgaaggccacgccgaaggtgaacccgtccccgcgctgcaccgccgcgtccgcgcacggctcgtacacgccgttggtgtcgcccccggctgccaccgacggcgcgatgacgaggaggacgaggagcacggacgccgcctccgcgcacgcgcgcctcgacctcgacgacagcgtcgccaccgccatggccggcgcgaattgggtgcctcgggcgcgacgaggtcgttgacgagaggggctttggctttgctgttgctagttactacagctcacgaagaaacgcgtcgtggggaggcaaggaataaaggctaaaaaggcggttgcttgcttgttgggctcgctgcttcttaggccccgtagtcctcatgggccttgtgtacttctatctgatcggagataaaactaattattagtattagtactactttggggaaaaaaagaattatttttaagggcttggtaaagcttgtatgacccgtttggtaaagctctaactcttaaatttaattttagaagatagatctgtaaagttatggagcagtctaaacctagcttcacatctctagttcattttgtgatagcgctccaaccaactccactcctattttaggtagagttgaaactatttgactggattctagctccagaagaggtacagctggagccatgccaaacagactcttacttcaagattcttgttccatagagttagagctgaatcaaacactttcaagattctggataatataaattgaagttgttcttcctaaaaaaaattatactagatgaagcggtggtagtatatttttgctactagaatatttcaattattagatagagaaaacccttttgtaattgatgttgtaatttgttagagcatctccaacactctctctaaattcgactctccaaatatctatttggccaactctccatctcatttatcaagtcaaatttgttatttactccaacagcttcttcatccatcctctctattttgagtctatgacagcagtacccatgcatcagcctctatacccattcttcctcatctttctccccctcttcctcttcctctctctctccctctatacactcccgagacggctggggacagtggcggcggtcggcgcagacagcggcggcagtcgcggctagggatggcggcggcgggcgcggctggggacagcgcgggcgcgcggcggtaggcgcagacggcggcggcggcggacagcggcggcggggacggcggcagtgggcgcggctggggacagcgcgggcggcggtaggcgcagacggcggcggcgggcgcggctggggacgacgcaggcgacggcggcggccggcgcggttggctccggcgcctcgctcctccatgccgtcgccgtcgtgcggttcctagccgtcgcggacgacggcggcgggcgcggccggcggcggccggtgcggttggctccggcgcctcgctcctccgtgccgtcgtcgtcgtgcggttcccgtcgctgccttcttgcgggtgcgacggggagagagagatggggtgggagggagagtggtggggcccacgaatagccaggcagagtgactcttgactctccaaagttagtgagaggtgcaatttggaggttgttggagggtattttttctccatacttgctaaattttaacttggccagccatttggccattctatgagttgctcttagaacggataacttttcaatggcaaaacaatagaatttctcaaagggagtacctatacatctttcgaaagatttttataatcgtatcacacagatttttaatttttgtattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttaccgtgtaagtttcataaattacactgtaacttacaagaaaatgcactgtaaatttgagtgagaaaatcgagtgagagataagaaaaaatctttcgagtgagatatagcaaaatcgtttctcaaataaaaactgtaccagtagcatggcatggaccaacacgattcataggtacaccaatcaaaaacacaaagttgttactattacatagtcttagttacaccttacaagtactacaacactaaacaaatagtaaaactctatatgtacggttccctcctctcagacacatatttgtacttctaccaactggtctcatctctcatgagatggtcagttgagcctgcatatctatatggccaagaaaagctgcgatgaatgcaaagcaaatttcttgaaatattggatagatcatcacagtccaaggctgccaatatatccatgaacgatatctcaggtgaaaatgttgccaatgactatggatgctctttggataattggattggctgtcaagtctgcagctcaactcttctaggcaactcaattgaactggcaagatgatgtttagtgacctttagggaccggttaaccgcagatttattcgtcatgcgcttgcctgcttcgacacctgagagttagggaaatttggttagaaaattgcaagtgtatgagtttgagccttaagaaacattgtatactagataaggtcagttatgtcacaaggaggagaaaaggcttaacatgaacacatgcagatgatgcgagatttttactcacagctggcaggtaaggagaatctcttatttccttgaggatctaaatgcccagtcctctccttaggattactactcgacctagttccaagtcccgaaggacgagacgaaatttcatcacatccttctctggatgacagtttcagttttgacttagccgatgccgaaccaccagaccggttcgatgaggaaccaccgccctctgagtttggtaggcaggtcttctggttcagtatgtttgaatgaagtgttgaagtttgtcttctaacatgtttcttatgtggagtatagacagcattttcctcgtcttgcattgctccactactaacaggaattccatctgctgcataagagcccaggaatcggctctcccatggacgaacagccatccatctctctagccaattccagccccagctgttcttgtcaggttgaaatgctgtaatggctgcatgttgccttgcttgccactgcgaaaggaggaaaataggttcaggtgtcaagttttttaatgacctccctttaagtcttattttattatcagaaatggaattaagccctcaaaaagtatggaagcacaccaaagaccaacacaaagtgacttgagatgtggccacaactgatgagagatcagttcttacagagtcattgggacagtgtatctgacatcaatgatgggaaggactagaaaaattcttaatctactacctgaaccaatgaaaacttttagagatatgaattcatcttatttctggaaggggttactgcatgaaaaaattatttgacctcaaccacatactggaaaaaggctcccttttcttacttctccaacatacggtgaactgtctaaataatttcatttatcatgattggattctttttctccagaaggagcatgcaaataggtctcatcttagctacatactgaaattacaattaaacgctaaccaacagaagcagaacagtacagaaagtcggaaacaacaagcagcctaattattaggctaacttggagggagagacaacatcatctgttatccatgaaagcaacgtttggaatccagcaatagcaacttagcaagcatgcttgttgttacatgctggagatgacagtgagtcgattactttcatgatatcaagaagctatacttggatgcagaccaatttgattggtgcactacagtatacgctataatccatggttcatatgattaattggataatcatagctgagtattgtcctggtgtaaaatgtttgataaagttacctggtgagttagagcataggccatggctcgttcgcgtttggctgctgcctcctgcctctttaatagttttgcttggatatcttccacagatcctatgctatcacaccaaccatcctgcatttttaaggtaaatagcataagtaaacaactcaagccaaatcactgcactttcatgccagttatttccttgtgaaaattgagaagagcatgcatgcaagcctacctggaaaactactgaaagtgcgactcacctcgatttcccgcacatgtgtctcatttattttctcttgtagaatagcttgctgatccgtctggctttccaaagcaatgcgcactcgccttgctctaacacgggcttgaaccctcaccaaagcttgcatacacctgagtgttatagcagcttgctttctcactatatgaccccttacaagggcttgaagcctaactagtccttttaaagcccgacgggctctcctagcctgaagagaattcaagttaaacttgtagtaaagcctgaagaaccaaacatttgggaatcatgggaaaatccataattccatttcagcaattctatgtttgcatatactttgcattggacttggactagttactaaattggcagagagagaaagagagagagcatcaataccaggaaggctctaaacacagtctgaataactgtagcagcccagatctccttgagttcttcttcagtctgaggcacaggcacgttaggtgaactaaaagcgggttccgagcacgaaagtgcattgctatcaccttctgatggaccattttcatcaggaaactcttctggtgctccaaggttatcatggtcttgaccgtgctgattttggcagtgaaaatggttagcaccgtcccttttctgcaatttcacagttcacaagttattacaaacccagccaaataaaaaaaagttattatatacgaacaatgcaatgctaaattgttaacacgatggtttccatttctttaaaaaaaaaaaagacatagtggtttccatctttcaacatttttgtcagtggcatagaagccaaaaaaaaatgatgcagatattatcatccagatctgcagtaacttcataaatttacacaaggcaaacaagcaatgcaagaagtaccaactgtagtcttaatttagcggagaacgaataccccaggttgatcactacaacaaagaattccccatgacatgatcaagattcacttccccatttcttttcagcaaattgttgtcgaattttaacacgaactaactagtcgaattcccggctacccccatcaaaatcaaccaaaaatgccaagaaaaatagaaggacaaggagcagaacaatggatgagagaacctgtgctactcgcccaccatctccatcctccttgctctgctgctgctgcttctccaccttcctcatcccaaccaacgacttgagccacctcgccgagatgcccatggcgccgcgcccctcaaccgagacaaaaacctaaagccgcaatctttctcatcagcaaccaaccaatccaaacctcaaaaatctctccacaaaaaagaagcaaaacaaaatcacccaaagaacacgcaccaagaacttctaggtgcgtgttcttcttggcaagaagagccgtgcccgcacaccaccagatcgcggcgagacggggccaagaaaacggtggtcgacgctggccacccaatgagcggcgcgccttgcagatcaagggtggtctactctactcctcccggtcccggatcatcacgccacctcgctactactctactctactagtagtggccaccaccaccaacacccgggaacccggccattactgccgcagctgcagctgccaccactgcgtgcgcattattgctgccatcggtgggcttgtgcttgtgtgcgtggcagtgtggcacgctctgctgctgctgctgcagagaggaggatgagattgattagctgattagtagtagtactagtataaaaataagcaagaaagcaccgcgcttttcttgcgtttcactttccgcgccccccgttgtcgggaaagccaagccattgctgttgttctcttttgtttaccctctagtttttcactgcatctttgcctggctttcggacaaagtgatctttatgatctgaaagagaaagaaattctttggtagtatagtactcgcaacaatggaatttcagcaattagcgatgtg

SEQ ID NO: 1923 - DNA, 12134 bp, Oryza sativa
ttcaactctgagtgaagaactattaccattaccgctccatcaattaaacatgtcatggcatttagtatcacttcttttcaataatgtcttttgctacctcataggaagccgagagctgaatcatcaactgctaccactgcttccctacacaggcagaggccgcaggaccacttcagagttcagaaagttcagagattgtgatcttaagctcaatatctctaattaaatccgtttatctgcctcgaattaaagtcacttaaaatgagaagatttcaggttgtttggcaaaatgcgaatttattagaagtagatgggttcagttggcaataaaatgggatatctacatgcgagtcaccaccgaaaactgacatgacaccagtgacagggcgcatgatggttatggatgggatgttcataatgccgtgctgaactctgttttcgggtggtttgcataagtaatcacgtgattaaattggaaatgttggcattagaactcagattaatagccggtgttcagaaatgaacagagattctctagtttctacagaacaaggatcttgattgagtgtcatgttacctgtcctataccatgacaagctattagtttatccaccgaatcttttcctttgtttcttcctcactgaaaaacatactcctaagtttttcctttcagttttttctgagatattctaagataaaatgtacgggagtactttagaatttggattttggagggtgtcaaattcaaatccatgacatgacaaacgggccaactagacacttttaaggcaaaacgagctgattgcgctcggatatcgtacgggactaacaagctttaagaaaaggctatcaacagagggatgtcttttaaccgtgagatgttggggctgtttggttctcagccacactttaccattacttgccaacaaaagttgccacaccttgcctaaggtgaggtgatcaaattgttagccacaacttactaagcctaagggaatcttgccacacttttttgagccattgacatgtgggacccaatttgttggaggggaatcttgccacaactgtaactacaaccaaacacctgtcaaatttgcctaaccttaggcgtggcaaactgtggcaaagtgtggcttgcaaccaaacacacccgttttaagtgacatgaaaagtgtataaaccacagcgccttttgcagaaaaaaaaaactagagctcaatgtcatgtgtcacttttcttgtccaatgcttaggcttttctacgacaattgatctagaggcctggtttagttcctaactttttcttcaaacttctaacttttccatcacatcaaaactttcctacacatataaacttttaacttttccatcacatctttccaatttcaatcaaacttttaattttagcgtgaactaaacacacccagagtaacaaataacactgtaaagtgtggtaacttaaacagtataaactccatattttttccattttgttaatccaatgtgcattgtcccttgaggtataaccgtagaacttcctcttttacacgtggtggaccatagtatatttattttgctagaatgaccatcctgatcgtactccgtctggtttaactatgtactgtactaagttaagagcctcattggttgccttaataagtcaaagccaaaactaaaatttaaatttccaaacttaattttaaaattgattttaagatattttcaacttagtttcttttatagtgttatttaacttttaagtcaataagagcatatatataaaagttttacctaaaaactaatttttattttctaatgagccattttggcttattagtaaatatgggcaaccaataagaacctaaagtatgtggaaagtagctcgaataacaatctgctctttcacttatatgaaataagattgggtaatttttacagtgtgagtcaccttttacccgcaaaaaattcgctttggatcaccctatatttgatctttacacttgagatatgtaatttttcctttcttacactccgaactatcttgaactttcttctcgagcgcatcaatgcctttaagcgtattggcggctacatgtcggtaatttccatgcaagcaaccctttatcatatgagagactatatgcgactcgagaacagagttatggtggtacaaagcgaaacaaatgcgaatttaccaagccaaaagtgaaaatattggatttaaaatgaaaagttgcatttaattgtgtgattagaaaaggttccatttattcagtgaggtcgaatagaaggccagtgactcaaacaggaaaaaaaaattggtggtatgcaagtggggtcgagggaggatgattataatctaaccatcatggtttaaattctcgtgtccatgagtattacacacttatgaacatgtgtttagtggggtgaggcatttgtcgctatctccgtcttctatgtgcaaatgaaaaaaagcgtcacaaatctctcttcaatggagaaaattatctcgtcgcttatgaagcataaagtttcttgtaaagaatttaaaaacagaaaaaacacagccaccatttttgcatgatgcacatataataaccatgaaaaagatacgaagtgagtgtagctctattagtttggttcaagtcctagatttgatatgggtgatcgtatttacggctatctattatttattatttcagtgctaagcaatgttaccgttgacggtgaggcgcatatagtgacttcgtcaatctcaatattttataggtgttcttagagatagagtgtgcgtgtataggggaaattgtgcgcgcgttgtgagtgtccgtgtttattccatgtttctaaaaaaaacatgaaaaaatgaatataaacgtttttcacataatgcacaaataataatcacaaaaaagtgaggaaaaaaaatcctataggagtattcgaaaacaatttaaatccagggaaacttgataaaaataaaaaaacaaaccaaccatattagtagtatactttccttgccttttctcgacagcgcaaggtaagcaagcatcgccaaggcaagaaaaaaggaatctctctgaagagagggaatctccttaccgggttgctcccgtcgcaccggacccgacaaacgcaacccgaaaccggagtcaagtcaacacgcgcggacacacgcgcttcccttccccggaacccgcattgcctctcccccaccctctcgcaggaagaccccggaaggatctggaagctgcaacccccaccgtccgatccagatccgacggccccacgcccgccgcatccgcttcacgcagcttccagagcattcactcctccgccacccgtttcttcctccgctataactacacccctcctctctcctcctcacaaaccgcttccaacccgagaccacgctccccgccggatcgagcagctagggtttcgacctttttttttcccaccaggagggcgacgagatgttcgggcgcgcgccgaagaagagcgacaacacgcggtactacgaggtgcttggggtgcccaaggatgcgtcccaggatgacctcaagaaggcgtaccgcaaggccgccatcaagaaccaccccgacaagggcggagaccccgagaaggtgagctcgcgagcgattcgtctcttgttttttcgtttcgatctgtctgcggcggcggtgaggggcgtagccggtttggatggaggtgggggatttgaggggggcgttggggagttttggatctgtgatagggttgaagaattcgatgggtttaggagggtttggagtagcgcttgcgtgtgctccgggaatgatggatttaggtggggggaagtagatttggttgtggaaatgtgttggattcagagcacgataagtcgcccttccccaattgcttgccaatcaacgaaaaccatgtgaacgtttagatgcaattccattactggttcatatatcgaaatcatctatggtttgaactgtactattcattagctgttgatgataagttgcccttcctcaattgcttgccaatcaaccaaaaccatgtgaaccttagatgcaattccattacttgttcatatattgagatcatctattttttgtatgtttttaactgtactattcattaactattgatatgcacatttaggggctttgctgatgattatgacagattagggtcttggaacattcttgttaattcagctaattgatagccaattctagtgataagtagtattgagaatgatgtgagatattgttcatttggctgatgcaaacattacatcgtcacctgccaagtgccaacctgattttgtattgcgagtttgtgaccatgtgtactatctatcctgcattgtcatagttaggagcctagttactgtggcatacaggctggtgtgttctattatatatattgttttacctcataattatcgctgatatcttatgagtaaactggttaagctttatgagtactgaattgccaatgctttatctggttaagctgtatgatggggacaatagctttcttgatgagatggcaaactaaaattcttgccttcatttcagttcaaggaattggctcaggcttatgaagtcctgagtgaccctgagaagcgtgaaatctatgatcagtacggtgaagatgctctcaaggaggggatgggtcctggtggtgggatgcatgacccatttgacattttttcctcattctttggaggtggctttggaggtacgagacatgagaagcagctcaattcaacctcctggtgattgtggtttgcttagattttgactggctctcattgtggtctgcaggtggtagcagtaggggcaggagacagcgtaggggagaggatgtggttcaccctctgaaggtttctctggaggaattgtacaatggcacatcaaagaagctctccctttctcgcaatgtgctctgctccaagtgcaatgggtatgtcatcagcttccttttgtgggtcctaaatattgcataaactgtttgactattctgatatctcacactgttctgtgctcatcttgcagcaagggctcgaaatctggtgcttccatgaagtgctctggttgtcaaggttctggtatgaaggtccaaattcgccagttggggccaggaatgattcagcaaatgcaacatccctgcaatgagtgcaagggaactggtgagaccatcagcgacaaggatagatgcccaggctgcaagggtgagaaggtggcgcaggagaagaaggttcttgaggtggtggtcgagaagggcatgcagaatggacagaagatcaccttccctggtgaggctgatgaagcggtatgtctgtgttctgactcctcgcattgtacagtacatggttctaaggtgtagtactccatgtgcttgtcaacactgttactgaccaacctgtgctttgtgcagcccgatactgtcactggagacattatcttcgtcctccagcagaaggagcatcccaagttcaagagaaagggagatgacctcttctacgagcacaccctgaacctcactgaggccctttgtggcttccagtttgttctcactcacttggacaacaggcagctgcttatcaagtccaagcccggtgaagttgtcaagcctggtgagtctcccttcaaagaaagatcaccatagagtagcagcattttggaaaccatctgattgtttttttaagcattcattttagaaactattttattgtttactcatatcggccgtcatcttgtcgcagattcattcaaggctgtcaacgacgagggcatgccgatgtaccagcggccattcatgaaggggaagctctacatccacttctccgtggaattccccgactctttgaaccctgaccagtgcaaggccctggagaccgtcctcccgccaaggccggtgtcgcagtacaccgacatggagctcgacgagtgcgaggagaccatgccgtacgacgtgaacatcgaggaggagatgaggaggcggcagcaacagcagcagcaggaggcatacgacgaggacgaggacatgcacggcggcggcgcccagcgcgtgcagtgcgcgcagcagtaagcagcaagcagcgccgtgcatacatatctgcacggctttgacggcggcgacaaattgtttctttccgctctaggggcgataatactatcaagttttccatgttaggcatatgatgatgtgatactacttttggtcttttatactgcgtattaatgacgtacatcaaccggacctactggtccatgaaacaaaatctctactgcttctccttcctgtgtgtgttagtgcgctgcgttcttcccatgtgtaggatttgctgcttcctcgagatgagcagtagcagatggcaccgcgaatggaactgtcaatgcgcaatttgactcggtgcaactcgttgaggctcggtcatgcactgtgtcagggcccccggtgtcgggatctaacaacatggaacatgaaagaagaggctcctgcttagcaatggtaaactaaattgaactacaactgcaaagatagtgagagactacaaatcagacgcccaatttgttcctaaaaggaacaaaatcgtgcgttgtttcatttctagcagaaaaaagtttcaccactaaataaaaaagttccaatctattaaatgttgtgaatcatgatagcagaaaaaagtttcatcactaaataaaacatttgtgaatgatgatagaaacaatccgttgtaacaaacggaacatcgagcttcagctgctaaaacagcaacgaatatgcaagaattgatgaaacaagattcaaactactcagcgaaacattttgattccccaagaaacatcatacttacattggttgaaacattgaaaatcagaaaaatgcactagtctagattgggttccttcctcttctccagtgatcacattttcctttggtctccgctgcagatctagaccgggacatgcgaggctcttctattccgccgaggtgccgtagccgccgctccacggagaccccgaggcttactcaccccgccgttgccggtcccgagccatcttagtcaccctgccgttgctggtcccgagtcatcgtcatcattcggatgaacaaaaactccgcccgccagatagtcgcatggggaggacgcctcgttgctgtcgaatggtgagctatttcgcttgatcccctgcaaggatcatcgagagagaaagaaagatgcatagaacgagcggataaaggagtgagagagtggataaggggggactagaaggctcggtatagttataaagtggaggtgggcctactgctagcatcgcaacatctgatcttttttagttgtatcggacgatagatatggagctttatcacagagataatagctatttttttaagaatgggataacaatcgtttattcttgtaaaatggataaagaaaattatttcaaattaatttcgctgaacatctactgaataaagcactcatgtaccatccagcaaattaaggatccaccataaagcaaaagaaggatcatggaaaagtaatggtaatgtgaacaactattatttggctctcccaaattctcgggagggacaacaccgcagcctcccgtggaacggctcttaggcttgacggtggactttcaacattgaggtggacggcggtgacaacctccctagtccctacaacttaggcttgacggtggactttcaacattgaggtggacggcggtgacaacctcctagtccctacaacttccagcattgaggtggatgacgcggcaacctggttcaaaaggatgcaacaccctccctccgtcttagagatggaaggcggcactagcacctacactaccataacattaaatttcactttgggattacctttattaccggtgttccattttaaatcaccctttaatcaatttcactttaaacatggtatcttcattttaaaaaagatatcttacctttatgagaccatactctaactcttttacccatctacattaaactaatcatctagggctcacgcatgaagtcagtatatattgaggcgaaacagagtgctcggtcatgtctcatcagttcctcgcattggcttgcatgggcatgtcgcatcgggtgatcatgggaaagcttgtcatgctgcggttgtcaggtgcttgcgtatctatcatttggctaggttaggggatagacgacgatgggtcgcgcgatcacttgtattcttgttggatgttgtgtggtccgtgtggagacggaaggggaaggtggaaggccaaacggcatgggcctagccgcctaggtcttgcttgggagcaaatagcatttgatgctggaacattggatttgatcggacggcttcaaaaaaactgatgacgtggaccaacctggagcaagttttataggaattaatgatgtagtgggtaccaactatgtaggaagacggatatagttagaccctaccacgagaagacaaaagtaattgtaacggcgaaagctagcgtggctgtggggattttaaagagacagaggtgaatctttttgctattggttggcctggcttatgtagtgtggggaggtgaggaaagcggaaatagaagcagagtaagacttggtacaaaattagcatataattgtggattgtaaggattttagcatatagccaatggatttagattaacatggaattatctacaactttttatagccaatggacattttttttaatttaaatttgatcctaattaacgataaatgtaagatgtgatcgtagcctagatcaaatttttccaggagaaaatatcgaaatgcaaacagaccctggatgttagctgctccagttttgatgctgcatgcaaagcatttttctaagtgaattctgttgcctcttcatgtccatcggtattgccctgcacgcgaactatgagcatgccaaccgtttgcacacagacagagagagagagagagagagagcgcttaggctcctagacggacactgcacacaccaggtaatcctagaaagttagaatcgatcggcaccatcctctcgccaccgcggctgaaacttctgcagaacaaaggctgctagctcgtgcttgcagctcgggcgacacctcctcgtggataaacttcgtcctctccgatgttcacagggacatatccatgcatcgaactgttaatcattacacttagaagtgtttggcaaatgagaaagagaaatgatttcccacctatctttaaatcctaaccatttattctccatgtttcatttaatcctaactcttcattaatttttcaatcccaatcccaccccccatttctcattatccaaacacatccttaggcacatcagcatctgcgggggaaacggtacggacgggtcaaaggagaacacgagcatgtcgtgaacaacaacgcggtacatcctgtcgagaccggtgtggcggggtgggttgttcgcaactacgtacagaaaacggagtgatctattagcacgttattaataaagtattagtttttttaaaaaaatgaatgaatttaattttgtttaagtaactttcgtatagaaactttttttaaaaaaacatgtcgtttagtagtttgaaaaacgtgcacgcgaaaaacgataggttaggagaaggggtatccgaacacagcctagtcagctgccgatctcgccaatcgccattgacgtcgagccagacggccccgacgcgatcagcacccgtacgtgggccgtgtccagagccgatggacgacaaagaccggcattacacttctcctaatatatgggattaggtgatcgagaaaaatccatcgtgattccaaccaaaactacgatcgcgcgcgtgctggcctgctgacgtggtaacggcacaaacgtgcgtgggagaattctgatctgaatcaaatttgcgatcgtgtgctacaggcagccgattgggaagtggaaacctatctggtttcgctcggacgacgacgcgcgtggaatgcggatgatagacgacgtacgcacgcgtgtgctagactaatggaccaccaaaacatattattcattttattcattggctagcggtggcgaaccaaaataccgacaaaaacctcttcatttctttttatcttaactaattaaaagatttggatttttcctttcgtcacattaatttctcgttcgtatgtccgatcgagcgaggcctgtgttcccacgcgccatgaacacaagcgatattgcacaagtttaaagatcggtacaaaatccaatcggacacagaacacagaggaagagaaaactacaaacaggaagaataataaaaataaaaatcacacagaaaaaaccttgactggctcgaattgagccattttattgagcccgattctcttcattgactcctcaatgccccaatcccccaatacaatgccccagatcctcaaattgaaggtgaaaatattaacaacaaacaataatccccatatccttattttaacatatgaacaacccagatcctcaagattagaaaaaaaagcatgaataaacatcaacaaagcacaagagtaattcattatcatcactgctccttcttctggtgtgggaggaagaacgggacggggtggcgtcaccatcgcatctcccagatccgcctgtctccgacctccacaccgatggatccaccggccaagccaccgagggaaagtagaggagaggaggggcatttgtcgcacctgcaacccgctgtcgccgtcagcccgtcaccatggaggtcggatgcggctaaatctgacggccccagacctccacgccgatggatccgtcggctaggtcgcccgtcatcgcccgttgaggccgtagccggtggcgggacgagtctggaagaccgagtcgccgcagccgtcgcctcgagtcgccgtgccctcatcaggaacggtgagcgcagggagatggaggagaggagcagtagaggagccggcgatgtggccatgcctgcggctggatccagacgaggaggggcgaggctgctccaacccgctcgtcaccgaactgcctctgagcaggaggaggagagccctggcagcggtgcgacgaagcacgggccgagcggcataggcaggaggatgccggagcccggagggacgggcgccggggtagagggagggggctccgccacggttggggagggttggagccggtggtggatatgtgccggcgacatgaagagagacgaagaaagccagggacagagagagtaaagcgatagagataaggctgttctcaccaaaaaaaaaagagaagaagatagagataaggctagctctgtgactgtgaccagggccaccaggcaacaagtcacgaactcacgatattttcccttcttattaaagtaggagcttcaattttttcttaaaaaaaaatacacacacatgctgtcccaaaataagttgattcatgggtttccgtgtacaatctttgacaatccgttttatttaaaatatatatgaaaaaattttaaaaaataagttacgcataaagtattattcatattttatcatttaatctatatctataactaataactaatataaatattcgtatttttcctttcgtcacatctaattttcgtccgtgttttcatctgtatgcaatccgatttggttagcaataacgatggaaaaaaattgcaaaagaaaaaaatggtggccgcagatgccgccgccggaggaagccgccgctgccggatccgcccgcggtcgccgccactgctaacggatccacccgcggacgctgcagacgccatcgtcgccgtcgacgcttgccttagggacggccgtcgccgagggagcgcggatgccgccgttgggagggcaccgtcaccgagaggtagggagggagggatggccgtcgaggccgacagggagaggaagaggaagagggggagggacggccatctccgccgtctccgccgtcgccgcgccacgccgtgagacgggagggagagggggagagggagcggtctgccgtctccgccgcatcctgccatcgccgcgccgtgccggtgagacggggggagaggagagggagcggcgccgctggatgggaggggagggaagcggctcctgtggtgaaag

SEQ ID NO: 1924 - DNA, 7940 bp, Oryza sativa
gggagggttagggttctcatcaatttggaacttatccgagccgtccattaaaacgaacggctcagatcgatcgagcgttgggccaaaccacttgggccgtacgcgggccggtggtccagcaagcgagaggaggagtatggggatattaattagactttggtcgcttgagggctgaagaagaaagtgggctgaaaaaggcccatagagataaagggatttttatttagatttttatttcaataaatgctgaaatgatgtttgtattataaaaatagcaattaagctatgtaaatttcaagaaaatttcaatgagtgtaattaatatagaaaatttaataaaaaataaatccaaccataacattttatttctcacacttactttacttataaattaatttaattatatacctacctacttaaaaaatacccaaatatttcagaaattttgtgtttcatttaattataatttaatatttttctaattcaattttatttttttcttttcgtttcaacgcacgaccaattttgctataatttcaaatagtgtaattaatattgcagaaaatttatatttcattaaattagaatttaatatgttttaattcaattttcttcttttttttcattccgttgcaacgcacgggcatttttgctagtaataatagagatatagataaagatagctagagaagtagaacttggtccgtccgtctacccttattaggatattcatggggattgatttggggagtcaatctcccgcgactttgggaagtcgatcttaaacgactctacatattcgcaaaccctgggaaaatggcgaaacttaagcagagcttcagccttctcttgctcatcgaacccatcgcagtatgggccacaatatattttctcatattttgaagcaccctcgttggatctgtgaagagcctctgcatttttcttgaatatcttgaaccggtgagtcatctcagcaaggtcacgcttcttatcgtaagccttgcaccagcgctcatacatggcccctatggcttcatcagactcaaaatccttgtccgtaaaatcgtcagcagactcatcaaaattcgtcaaaaaggcacctggctcatgaccatcatctatcacaatggaacaacattaatactgtcaagaacagcgagttggcttgcaagtttcaatttggttcctaatttgcgagcataaatgtctactattgtaaacattaaagatgtttttgtcggtactttggtacgttatccgtgtatgagttggattttaagttcgttcacttttggaaatacatatccatatttaagttcggttttaatctcgttcacttttggaaatacaaaatgagtcgtataagaaattctttaaaaaaaagattcgcatgctaacttgatatgattttctagaaaaatatatatctaaacaattctcacggtgaatttcaatgaacaataataagattaaaatagcttcacctgttacaacgcacactttttctagtctaaagaaaactatcctgcctaatatgcccatgccctgatgatggcaatcagaaggcccgtaagagcaggtacaatagcaggctataagccagctataaacatattttaaagagataaacgaagagagagaagagcagcgggctatagatctgtagccagctgcagcacggactccaagacgtaatgtgcgtatgacaggtagaaccgagtattaatagtatagtaagcaactattatatgaattggctattacattagctatagatgatttgtagttagtagttggctatactattaaacttgctctaataagattggggggattagcttacctgatggatcgtaatcgtcgaggtaacataccgcgcgtgcagcgtgacatgcggcgacggcggcttggcgtgctgcgcgacgtgctgcgatggccgccgagtgtggagattatggttaccccatatctacatagcggttatattccagctggatatatggtaccaaatatagatagaatatctttatgaggactcgggttagattctaaacttgtatgtcaagaaaatacccaggattctagtcggttacgattgtattttatctgtaatcccatattccgttaggatatggactgtattttgtattacggatcccttcccctatataaggaggggtccgggttcctctcgggacgatttcttttttctctcaatcatacaatcaataacatactcggcggaatcatccccggataggagtagggtattacttcttgaataagaaggcctgaacctgtataaaattctttttctccaaacccatccactttcctagcttgatagccacccccttttattattgccgaaatcttgttttgacagttggcgcgccaggtaggggttgcgtcaagttctcgccgactaagtgcgatgggtttcgtttctggcatcgacgactgcgccttccttcctgggcaggcgttccggttcggcagcctcaacttcatcaccaacgacttcggcaagatctctctccttgactcggattcaaaccagttggggagagaccaggtcctcgtgccattcggtattccgaactcggccgaggcctactccaagatcatctctcccaagtcggcttcaaaccactcggacgagatccaatctactcttccgcgaccagatcaagacgacgggtcctatccctcaatcctgatgaaacttcctgatgatttggccgctgttttcactgtcaagacatctcccactcgaagatctaggagagctccggcttcggccccgatccaatctagatccagagaggttggcgttatactccaacctcttgggacagtctcgacggaagagttggatggttaccttagctcccccggcgtcagttctcgaccaaccgagatcctcgactacaacgatttcggctaccactatgaccatggcgacctcgacaacttcgatgacagctctgaggataactacacgcccctcttcttcggcgtattcatggctgacaacgaaatggaggaacagcgccaagcccgagaagcggaccaagatcgcgcaaggcaagaagctgaacgtcgccgactggaggaagagcgacagtgacaggagcgagaacgactacagcgttagcaacaagatcgcgaacgggttgcaaaggaggctaaagatcgacggcaacgcgccttggaatctgggcgccgagcgagagagctcattgggcaacaagacgtcgatggaacagcggtctttcgcaccccccagcagaacgcggttgcagcaatcactctcctcgacaccctcctcaaggaagacacactcaaccaagctgatcatgttgtcaacatcttgaatcagacgaagaccatgatcgctgcctcggttccagccaactccgcaagcacccgtaccccgactagtagccgagtccctcacttccgatctcatgattatcatcagccaagcctcagcatcatcggcacaggatctagtcgcaggagcaggggtcacgacgaacgatcttttcactcgcctcccgaacgtcacagggagcgccgagctaaacggcctcactctccacctcaccagcgtcccgtcgaccttcgcgacatgatcaaccagcgccgtgcagcgcgaggtcaccgccattcaccaaatcgctacgacgacgacgtggatggagtagctgccttcactaatgacctgcgtcgagtggattggccagccagctttaagccgactggaattgagaagtatgacggcaccactaatccggagtcttggctcaccgtctacggactcgcaatccgcgcagcaggaggagacagcaaggccatggcaaactatctacctgtggccctagcggactccgcccaatcctggctcaacggactaccccgtggcacgatcggatcatgggcggaacttcgtgatcacttcattgccaacttccagggcacctttgaacgccccggcacacaatttgatctctacaacgttgttcagaagtctggagaatcccttcgagattacatccggcgcttctccgaacaacgcaacaagatctccgacatcaccgacgacgtcatcatcgccgccttcactaaaggcattcgccacgaggacctagtcggcaagttcggatgtaaaccccccaggacggttaagcagatgtttgaaaaagccaacgagtatgccaaagccgaagatgctattaccgcgtccaaacagtcgggcaccacttggaagccaaagaaggacacgccgaccgcaggagggagtggaagtaacaaccacaaggatcgcaagcgtaagcctgaagaacttgtggcgaccacctctccatcatcctgacaacgttcccgcgtcaacaccttcgacaagataaagaactcccaatgtccgcatcatcccaactccaaccacgtggccaaagattgcttcgtctacaaacagttcgcggagcaatacgtcaagaacgcacgtaaaccttcagacggagatcaaggcacatcaaagaacaaagatgatgaagacgatgccccgactggtttccaagatcatcgcaaagaacttaaccacatcttcggcggacccctggcttatgagtctaagagaaaacagaagctaacagaacgggagatcaatgcggttcagcctaacacgccccaatatcttcggtggtcggagatagcaattaagttcgaccgctcggatcatcccgactgagtggtccaccaggggcggtaccccctggtactagacccagtggttcgcaatgtcaagctccgacgaactctcatcgacggtggcaacgcactcaacatccttttcgtaagaccctggacgatatgcagattcctcgcacggagttaaagccgagtaatgcacccttccacggtgttatcccaggactgtcagctacaccactcggccagatcactcttctagttaccttcggcacgggggaaaattttcgcacaaaaaatgtctgtttcgaagttgctgatttcgagacagcatatcatgctatacttggacgaccagctttagctaaatttatggccgtcccacactacacctacatgatgatgaagatgcctggtcctcgaggagtcatatcactacgaagtgacatcaagcaggccgtcacatgcgacaaagaaagttgcgagatcgcccaaacccacgagactattctcgcccgcgaagagatccgactggctgcgaccacgacaagcgagggagaagtgcctgcaaccaagctgacgaagaccgaagaaagcgatgccaagacgaaaaagattcccttagatccctccgatcctgataagactgctgtaataggcgctgagttagattgtaaataggaaagcgcgctcatcacctttcttcaaaataataaagatatttttgcgtggaaaccatccgatatgcctggtatccccagagaggtgattgagcactctttacatgttaaggaagacgccaaacccatcaagcaacgactccgccgttttgcacaggacagaaaggatgcgatcaaggaggaattaaccaagctgttagcagcaggcttcattaaggaagtccttcatcccgactggctggctaacccagtcctggttcggaaaaagacggggcaatggcgtatgtgtgtcgattataccgacctcaacaaatcttgtcccaaagacccttttgggttacctcgcattgaccaggtggttgactcaacagccggctgcgagttactcagcttcttggactgttacttgggatatcattagatccgactaaaagaatccgactgcttgaagacctcgtttattacgccctttggagcctaatgctacatcaccatgccctttggattgaagaacgcaggagcaacctatcaacgcatgattcattgatgtttttcaactcagatcggtcgcaatgttgaagcttatgttgatgatgtagttgtcaagaccaagcagaaggatgacctgatcgcggatttagaagaaacttttacaagcattcgtgctttcaggatgaaactaaacccggaaaagtgcatcttcagagtaccgtcaggaaagttgctcggatttatggtatctcaaagaggcatataggccaacccggagaaaatcaacgccatcctcaacatgaaaccgccaagcttccaaaaagacgtccaaaagctgactggttgcatggcggcgctcagccggttcgtctcacgactcggcgaacgggggatgcccttcttcaagctgctgaaaaagactgacaattttcagtggggacccgaagcataaaaagcctttgaaaagttcaagagacttctcactactccaccagttttggcctcgccgcatccacaagagccgctactgttatatgtgtcggtgacctctcaggttgtgagcacggtcctggttgttgagcgtgaagaggaaggccatattcaaaaagtccaacgaccaatttattttgtcagtgaggttttagccgactccaagacaaggtatcctcaggttcaaaagttattatatggtgtcttaattaccgtcagaaaattatctcactattttcaaagtcactcggtcacggtagtcacatcgtttccactcggagatatacttcacaatcacgaagcaaatggacggattgcgaagtgggccttagagttgatgtctttgaacatatcattcaagccacgaacttcgatcaagtcacaagctttagctgatttccttgccgagtggaccgagtgccaagaaaacatgccagaggaaaagatggaatattggactatgcatttcgatgggtcgaagaggcttacaggcactggagctggggtcgtcttgatttccccgactggagaaagattgagctacgtattgtggatacatttttctgcgtcccataacgtggcggaatacgaggcgctactccatggattaaggattgcaatctctttaggcattcgccgattaatcgtccgtggagactctcagttagttgttaatcaagtcatgaaagagtggtcatgtctagatgataatatgactgcttatcgacaagaggtacgcaagttggaaaataaattcgatggactcgagctcacccatgtcctccgacataacaatgaggcagccgacagactggccaattttggttcaaaacgggaagcagctccttcagatgtgttcgtcgaacatctttataaaccgaccgtgcccagaaaagagacagtcgaagccatggatgctcaaggcgtaagcatgattgaagctgactggagagaaccgtttataaaatttttgagcaaacaagaactccctcaagacaaaaatgaagccgagaggatttccaggcgcagcaggctttacattattcatgagactgagctgtacaagaaaagtccatcaggaatactgcagcgctgtgtgtctttggaagaagggagacagttgttgaaggatattcattctggtatttgtggtaatcatgctgctgcacggaccattgtcggcaaagcttaccggcaaggttttttctggcctacagctgtgtccgatgcggacaagattgtgcggacatgcgaaggttgtcaattctttgccagacaaactcatttgccagcccaagagttacaaaccatcccgttgtcctagccgtttgcggtctgtgggcttgacatggtcggcccgtttaaaagggcagtcggcggttacacgcatctctttgtggctatcgacaaattctccaagtggattgaggctaaaccagtcatcacgatcacagcagataaagctagagattttttcatcaacattgtgcatcggtttggggtacctaatcggatcatcactgataatggcactcaattcactggcggagcatttcaagacttttg

SEQ ID NO: 1925 - DNA, 16984 bp, Oryza sativa
catatggaggataatggcttttgaggtattcattgttgataccttcaacttcctttaaagccaggtctctttgtcttgccagttctgccttgtcactttccagaatttgaatctgcttctccaactgagatatcttggcagcttgcactacattgatcacggttaatcaagattgcaaagataacagtatgagtcagttgagcagagtttgtgcgtaccttttgatgagccactcagttcaaaatttgattcctggagctcagcgatccgatccctcagatcatgttcattcttcctagcaagttctttcacttcgtgcagttgattcctggtggcttcgagggttccgagatgagggactaacctctctaaggttactgttttggcttcgttcctaagatgaatcctctgcaagatagtttaattagcgcgtgaattaaatggcaaacaagatggttgaaatcaggtaccagagggcttacatttacaatgcgggttgcctgaccaagtgccttcttcagtaggcataactcttcgtcctctttttgcttatttatcacgatcccttgaggctgcatgttgtcatcccaccacttgaccagaatcggagggcatgaatcctcagctgcttgtatacgggggatttcttcttcatcaccaatcattggtcctaatgtattcactgacaaaggttagacaatcgatcagagttatttgggtcaacatggtttcagacaaagtgtttacccgtgatgatttctggacgaggacgagcggattcggatgcctttaaaggagatccagatctctggttattgtccgcgttttgtctgcgagggctgtctgcttgggtttcgacttctagaatctcttggcttggccctgcgtccgactggtttccagtcgggggctcctgattaactccggcttcggcttcggccgactggtttccagttgggggttgatcaccgaattctacattatcagttgccggatgattgtcactcgggtgatccccaacagttggcccggtttctttggaagaattcgtgcccatgttagtcgggtcagagtcttttccagacgggtctatatcagatggtttcctgcaaatttgattatcactattattgccgcaatgggtgcgtatcaatacaagagagatcgttatatgagttgcacctagaagacttcctgatctttggcacatggcgactggatgttttcttccttggagtagcttgttttggtagtttcttggtcgtctctcggtcttcaggcctcctggtggtatcatcggcttcgtcgtcacttagaaccaacttcctctttcgataatctgactggccgactggatcagaagcactaggttgagtttcagaccgaattcttggtcctccgctcccttgcccagtttggtggtggggagatcggcgttgagcgattgggggatccgactgcatcaaagcaaattcctggatgtaatatccttcattgttagctgattcaacaagaaaacaagatcatattttgagaaagattgaagtgtatgaatacgtactggtggaggaggattgaatgcattgaacggtacgactggcagcaagtgtgagtagctgacaacgatggcgtttgagaagagcttatacatcctttccttcatgaccttgaagtcaagagaatctggatcttcacggtttgggtcatgcttgccgtcaaattcgaaggctgtgcgagatctttctttgattggagctaaccgacatttgataaagtgccgggtgatctgttctccttgaaggccctgttcttttagctttatcatcctctccatcagttctactgcttgtgcagcttcgtctcccattagcagtgagttccaagtatcccgataaactggaggaagacaggagtactcgggaagaacaggctcggggttttgaacataaaaccagtttgcgtgccagcctttatttgaggtcttgaagggcatggagaagtatttttggcttagtgttcccctgagttggaaaccagcacccccaacgacgcatggtttgctcttatttggctggggcttgaggaagaaaatgcggcggaataaggcgaaatgaggcctaatgcccagaaaagcttcgcaggcatggataaaattggcaatatgcactatggaatttggattcagatgatgcaagctaatcccgtagaagttcagaataccccggaaaaatcttgaggttggaagagaaaatccgccatagaagaaatgagcaaataccacgatttcgtgtgtatcgggggtcgggaatgcctcaccaaatgccggtcgccacccgatgatctcttttgctggaagaacgtcgtgcgccaccatctccttcagattgtcttccgtcacatcggagggcgcccactgactctcgaagctttctctttcttccgccatgaatgagaactgatgatttgatttagttcgagatacggctggaaagggatggggaatcggagcggtggatgcgggaagagatttcgtgaagttttttaagggtggattggagcggattgatgaaccctagtttgcccggcgcaattttgtactgtagcaggaaatggggaaaatggcgagagtctcagcggggaagacgaaacgacgtttggacttcggtgtttttagggtatcgggagtactaatgggccctggcctgtacagtacttcagcccaattatgttttcagcgtggcccgttgtgatccctagggacttaggcgctttttgctttggcaatatgtgctcacaatgatgcggcccgatgctgttgaaatcctttttaacgcgattcaataattctttggaattattatgatgcacatgaaaaggtgcccaacataaaggtattataccatttttgtaagcttttttaggctacgaaagctgttgggttaatttgagatgactggtttgttagtagtcattctcccagcatgttatatgcttattttggttatggtaagggtcacagcctaggctattagactcattaattaccatgattttctatcatgtttgatgggtcattttatgagattcttactcggattcctatcaaacatgtctatttttggacctttgagtgtttatcactcggcccttttcatattttttgtccttgatatattcaagtgagaagcagtcggctgggtattttattgagtaccatgcatgcttcgatataagatcactcggttcttgactatatgtttaatttttcaactaatcacatagtcgggggttacacctaattaggtgcatctactcgatgcaccatgttttattttcgcccttcacagtcttctagcactcggtaagccggagcaagttgaattgaagcactcagattattgttttttgtttcgagaagactattttggtcaactgcgaaggtctcgggggctactgtggagattatggttaccccatatctacatggcggttatattccagctggatatatggtaccaaatatagatagaatatctttatgaggactcgggttagattctaaacttgtatgtcaagaaaatacccaggattctagtcggttacgattgtattttatctgtaatcccatattccgttaggatatggactgtattttgtattacggatcccttcccctatataaggaggggtccgggttcctctcgggacgatttcttttttctcccaatcatacaatcaataacatactcggcggaatcatccccggacaggagtagggtattacttcttgaataagaaggcctaaacctgtataaaattctttttctccaaacccattcactttcctagcttgatagccacccccttttattattgccgaaatcttgtttcgacaccgagcgtgcacaaggactagacgacgcgaccgccgaggagcgcgcggcacgggatgcggcggccgcagctaagcgggcggcggctcgcgcggccgatacgtcgcgggcgagcgacgccaccagcgccgccgttgacatgggcgagggataatcgattgaagaggaacggtaaaccctagttctccccacccgtcccggccgactgatccgattggagtatatatatatatatatcattaatatgcagtagtatcggccgagacggaacagtggatatataacaatctttctgctgctccgattttgtttcatggatactactgcttcatcgaagaggaccagtagatgaacaaaattggagcagtggatatatagcaatctttctgcgccgactggtccatgaaacaaaatctctttctgctcttcctcttatgtggtgatgctgcgttcttgactgccagtgtagtagccatgaatttttttccttgggtaagttcagttcgtaggttcacaacacatgctaaaattttctaacaccaaaaaaccgatacacaagtacaaatttaatataaatgcgataaaaatcaacattcaacaaccacaatttacaaagtgcatactcaatcattctcagattcatgaatcacaaatcgatttatgaagcagccgggagcggagagctggagacgggcaccggtagacgccacgccagacgggagacagcgggcggcggctctgcgacaagacggcaaccggccgacgtcccgcagcaaggcggcgactggcgatacaaggagaagttgtaacgtcgtcggcccccagctcggcgccgcgatggcgcggacggcggacccacgggcgtcggcgctgtggtgtggctcggcactgggctgcgccggcgctaacagcggacgcggcgtggcgccggcgcggacagcggtcagtggcggcgtggaagcgggcatcgggcacgaagggaatagatgctggaggtggaagcgctccaggctccctcaactcaaccctagctgtttgtgggctgttagagatgcctctaacggagtggttatttttgactctctaaatatctatattgccaggctgataaaaatttagagagtcaaatttatcttctattccaacatactattcacattccactctattaaccaatggattccgcctgtcattctcctcctctttcttcttcctcccctctctccaatccttagcccgtgctcctcctcgtgccagcgggtttggcggtggcgaaggcgtcgagcatctcaagttagcatttttctaggagtttgactttcatttcaagttagcatttttttaaaagaaatttcttatacgacttcttttgtatttttagaagtataaacgaacttaaaaactgactcaaacacagaactgtatttccaaaagcaaacgaacttaaaaaccgactcaaatacggatcacgtgccaaaataccgacaaaaacatctttattttttataatagttgagataaagataaagatagagaagtagaacttggtccgtctacccgtattaggatagatttggtgattcatggggattgatttggggagtcaatcttccgcggctttgggaagtcgatcttccactgctctacaaattcgtgaatcccgtgaaaatggccaaacttaagcagaaattcagccctctgttgctcatcgaacccatcgcagtatgggccaaaacatagtttctcttcttctggagcatccttgttggatctatgaacaagctctgcagtttccttgaatatcttgaaccggtgagccatctcagcatggtcacgctccttatcgtaagccttgcaccagcgctcatagaaggcccaaatggcttcatcagattcaaaatccttgtccgtcacactgtcaactagatcagtctcaaaatccttgtccgtctcatcgtcagctggctcaggaccatctatcacaacagcacaacattaatactgtcaagaacagcgaattggcttgcaagtttcaatttggttccttaaagttatcctgcctaatatgcccctaacctgattatggcaatcggatcagaaggcccgtaataagatgggggaggattggcttacatgatggcaatgggctgggaggagcaggagttggctcgtagtcgctgtagtcgtcgaggttataagacgggatgcgtgacaccgcgcgcgcggcgcgagatgcggcggcggcggctgagcgtgccgcgcgacgtgctgcgacgacggccgccgagcgtgcgcaaggactggacgacgcgaccgccgaggagcgcgcggcgcgggatgcggcggccgcggccaagcgggcggcgtctcgcgcggccgatacgtcgcgggcgagccgcgccaccagcgccgccgttgacatgggcgaggcgagtgatgatcgatcgaagaggaacagtaaaaccctagttctccccacccgtcccggccgactagctgctccgattggagtatatatagaacaggaataagttcacttgccaagtctaatttaacgcttttgctattctgatcgcgacaccggggggccaagacgcgatgcttacacggccgagtcaattgcgcattgacagctccattcgtggtgccatctgctacggcatacggctcgtcatctcaaggaagcaacaatgtctcacacagcagtcaagaacgcagcaccaccacacaggaggaagagcagaaagagattttgtttcaacgagtcagggatttccaaggagaagtggatgtagagctagctagcttccccttcatgaatggccgctggtacatcggcacgccctcgatcgtcgttgacagccttgaatgaatctgcaacaagatgacaggcgatatgagtaaacaataaaatggtttctaaaatatgcttaaacaatcatatggtttttgatatatgcggctatgaatctgcaacaagatgacgggcgatatgagtaaacaataaaatggtttctatatataatgctgcttaaacaatcaaatggtttctgatatgctgctgccctatcgtgagttttctttgtagtgtacaagttgggacttgggagacagctaaacatcgtttcaatgcttgaaacaattttgccatagcaaattactcccccatcccaaaatacctattttattgtaaaagcctatccaaccaacattgccacgtcaaaattatctctgcctctctacatacatgaatatctattcggctttttcttcatacgtggatttatagtggtacttatcagccatatcgtctcataaaatgtggttgtgaggtgaaatcgggttagagtcaactaacctaaggacgagcttgagtcaaactaacctcatagctagccatataactatccacactgatatggtccgctgcgaatccatgtcagaagaaatgggttgaatcaaatgtttgtgaaggggatggacttggcagtgctgagtgagtgggcttttgcaacaaaataggttatgtggtggaatatcaaaacaagagcgataattaatttggatggtttacataattttttagtgctattgttcttgtaaaatcgataaataattttaaattaaatttgctgaaaatctactgaggccctgtttagatccctccctaaaatttttcaccctgtcacattgaacatttgaacacatgcatgaagtattaaatactttgcgactaatttacgagacgaatcttttaagcctaattactccatgatttgacaatgtggtactaaagtaaacatttgctaataacagattaattaggcttaataaattcgtctcgcggtttaatgacggattctgtaattagttttttttattagtgcccgaacactctatgcgacaccctatataatacctgatgtgacacgccaaaactttacaaccctagatctaaacaccccccgagtaaagcactcttgtaccatcaagcaaactatccatggaaatgcagtgcctctgtgtcatgactcatgagagagagtgactactattttttttctttttaccttttcatgagtgttctttgcttgatccaaaacacgggggcgcatttagggaaggcatcactggaggcaggctgctcaagtaatgcattatccatattcgattcaacccaaccaaacctaaacccaaaataaaatgatgcctatatacttctggcagttgaccttccatcctgactagccggcggttcaacttatttttcagaatctgcatcgagacagaacagaggagaaagattcagaaaaaagaaaaagaagaaggatgtaacacatctgtctctgagcaaccattgttcggctctcaagtaccagtcggttggtcagatggaataaggttgctgcagtagcagtccatttctcttgatcttgatttgagtaggtgtgaagcaaaacctcgtgtcaatttggatgactttgtatatatgtagctgtcattgaacttcacttctgaaacctgctaaatttgaagtcggtatctttgcccatgtttacgctgtatctgatcaaaaccatttataagcatctgtggtttcactcaacccggcgaaaaagatgttatttagcgatgaatcagatattcagttgtaaagaagtgctcgctatagtattcataagtaaacaaactattttttggacaatacaagaggtgacttctattcttctagaatgcaaaggaagcaacgatttgcaaacaggtcaagcaagaaaatctcttcttttttttttttgctgggccggccaaaggatggccgaccaatttcattaagagaggggaaaaaaataaatagccaattacgaagtttgttacatcgacatgaaggatgtcgagggcgatcaaggccaggccttagatcaaagttgtctctttttttttttctgggccggccaaaggatgattgaccaatttcattaagagaggggaaaaaataaatagccaattacggagtttgttacatcgacgtgaaggatgtcgagggcgatcaaggccaagccttagatcaaagtcgttgtaatgtgaagcaggagtagtaccgttcaccaaaaaaaaaagtgaaaatagtacttcacatgccaccttgagaaattccttgttctcaaggcactgaaaggactactataattgcaactgaaataaaaccttggcttgcaatgcagaaactggactcgaaactcctcaaaatggccggtatgcttcacacgactttggaatataataaaaaccgtaagagaaatacaacctgtcgaagcaaagtcaaatcccaaacacacacatgattgcattgaccattacaaaccaaacaattcgacagatagtaagctacgcaaggacaaacaaagccacagcaaatcacacacaaactcatcttattttaaacatatttgaatctttttttcaaaaataaaaaaaaccatggccatatgcccatatgccattgacctcgaaaccattgcacaacctcatcgtctccttctctctctgtccaagttgtgtgtttgcaacatgcaaaagcgttgacgtcgcactcgcaacctccccctccctcgctttggatccaaacaaaaaccgcaccaaaccatcgagctcagccgcggcgcgcgcgcggcgacaccaccaactcgctggctcggcgtcgatcgccattgcttgatcaagctcgatcgcgatgagcggcggcggcgcgccgcctggggcgccggggatgatgacgccgggcgacggcaactccgtcggcatgttcagctccgaccgcatcggcgggttcggctacggcgtcggcgtgtccgtcgggatcctcctcctcatcaccaccatcacgctcgcgtcctacttctgcacgcgcgcgcccgtcaccgcggccgatgcagcggcggcggcgggatcgtcgcggcggcaccgcggtgggggtgggggcggcggcggcggcggcggcggggccgggcacgaacacgacgacgtcgagctcggcatcgacgaggcgacgctcaaggggtacccggaggtggtgtacggccagccgaggaaggaggcggcgaaggcggcgtcggcggcggcgacgaagaagggcggcgcaaccacgtgcagctgctgctcgatctgcctcgacaactacggcgacggcgacgtgctccggatgctgccggagtgcggccacctgttccaccgggagtgcgtcgacccgtggctccggcagcatccgacctgccccgtctgccggacgtcgccgctgccgagccccttgccgacgccgctcgccgaggtcacgccgctggcaatggcgaggccgtcatgacacgtggaggttctttgcttggttttcattttttaaaatttttttcttattcatataaaactaaacttgaggatgaaatttgtgtattctgcaaaatggaatgcataaaagaattcctcaagatagggactagaaatttcctcttggtaattgggtgtaaatttgggttcagagtagattttcttttctgatataaacaaagtttggcataggattctctttggaattaggattcactttggatttttggagggagattatgtatggattacaaatttggatgaaccttctagagatctaatttttatatcatcaagcttagtgcagaagaacgaagatgagtgtaaacaaagtaagaagtaggaacatatttgcagaatgctttatatatgtaaaattctatcatgaatatctgtaaaattgaagatgcacatttcaaaaggaatagatccttttaattaatgctcttgcatattatctagaaattgaggttgatgaggatatggaatgcagtaaacagattaacctcagttcaaacactcatgcattgtactcttgatgaattaattcaaagatctactaggtgcatatcaaatgatgacatcagcaacctatatacggccgtcccctagatacattgctccttcccccaggtttttgctgggtcaatcagtttacgccaaaatcattactttgtgctttgaagtaacggatataccaatcatgatgcatgctcttcaagaaaagagagcaaaagtgaaaaatgctaatttggcctaaacaaggcaagagtgcaagacgtatctacatcaagcctttttctgctaacaagtgacaacaacagatgtttcttttacaatttctaggaaaagaaaaggagaacttaattaggcaaattaccttcacatctgcagtgtcctgccacagaagctatggaatcattttcagctatgttgcacactgcagagtctttctatgatataaaagactcactgtgccgctctttggtatgatagacaattaggcatgggcaaaaatctggacaccaaactccatgacatcatttgaacagacagatctatttgcaaagatttggtccggaagaccggaatagtcgaatatatattgtgaatatctgaataaattagaatgtgattgtgatcattttcaggttcatctctgatcacatggagaacaagagcttaaaggaatgtctgcacgttgtgatgcagattacaaactaaatctttgcaaacgaaataaattctaaaaaaaaatcgaagcatcaggtggaaatcctgccattccctgtaggaaaaatattgcagcctggttatgtcagacagagtggttcagaatgcataattcatacagctctctgcagaagccatcttatttttgttcatgattcatgaagcacctagtcgctcccctgctgctttgtttttgactgtaaataacttttatttctcttaatacaaaatgcgctccttgcgtattccaaaaaagcacctagtcgcccttacaatcttcgtcggtgtcaattcctgcatcaatggcaccgggctttggttgataatgatcatttagtccctttcaagctttcatgacatgtgagttaagagtaaaacataattaacaaataatctagcacagtagcactagtgcactcgcattgtattattctagtacaggtccatgtgacttcgggatccaattcagcttcaagctggccaatcaagcaagagaagagaaatacaaaactaactccatttactccaaagttccctcacaatgaccaactgatcccaagatctaacatattaaaaaaatagcaatcagtctgaaggaaggaaaatctagttagcccagtgtatacaaaaatacaagtaacatcacattaaacaattgaacgttggtgtacagtcttctcttccattctttatgatcgaactaactcaaacaagaaactaataggaaatattagtaaattaaaatctagctcaggggatttagttttcatccaaggaaaaatgaaagagatcacgaagaattacggacatgtagatacagtttagtaaattccagtgagatcacagattcatcagtggtctccatttcttacatgtgtattgaagacactcacgagtcaccaatataagcatatgtatcttccatgtaatcataaaataaaagagatcaacaagaaactagcagccaagaactaaaacaaaactttttttttgtaagtcgggaacactattttgctatatatattgacaaattttcttccaaatatttatcaaatgtaaatactgttttaatccaattcaggtggggtcttcccccccgatgttccatgaagaaaatgtaaatactgtataattacagtacaattacattcgaacttgtataactataacttatatgttacctttacataatcttgaaccattagtttgattacttcaatttctatgcaagttgggaagaaaaaaaataatagttgcaagttgggaagaaaaaaaatcatagtgcacacacgagtgaggatatttagtcccacggcgtccgctttgcaaattacgaattgtactgcatttacatgcaagttacgatacagttataatatgattgtactgtatttacatctgataaaatttcataagtatatactaggaattaataggcaaggagtagacctgagcaactaggcccattaaaaggcccataggcaggcatgagaaggccgcatccatcagcatttcagcacgcacctgagacctgatgatttgagtcctcgtcgcgtcgcgtcgcgtcgtgtccacctgcgaatcctctagtcctcgcgagtcgcgacacgcggagctttggcacctgcagcgatggcgaccgaccaccgccgcttccccgtcttcctcgccgcggcgctgctcaccctcctcctcctcccggcctccgccgcggccaccgacgtcgagtactgcagtgagtgcttcgaggcccttcccgtccgcagcttcgctcgcctcccgtctcgtgtcaagcttacgtttccgcttttggtggggtggggtttgttgctgcagggcaggggcgggattatcctgtgaaggtgagcggagtggagatcgtccctgaccccgtcgtcagcgggcagccggccaccttcaagatctccgcatccacgggtaagcaccaagcaccgatctgttactgcggcgggttgcagtttagtgcggtcatgcggttgggggatttactgggcatatgcagtagtcggatcgggagtcaaattagtgtgggttttgtagcgctgtccattcactggcattattgaattggtccaatttgcagaacagtacaaccatgcgatggaatttttgttgtaaggaagtaaagaacaaactgctggctgttagaaacttagaacatggaaatattgcgctgcagcctgcaggtgtttctgttaagactgcccttcacaaggcatttttcattgcgatgctacttgcagatggagcacctaatgtttgttggttgcaacttgcaaattgtgacaatgcgtgcatctgtatatgcatgctggatttagtgtagtttgccatagtttcatgcccattccttgtttgttgatgcccgtgtttgagcttactatgactgggtgccctggagttcatcatctgtgcactgttatgacacgtgttcattgtgatcccgcttaaattgctctgatagcaaaggggagagaatttctacaaataaggataagctaactgtttcgattttattcaagaagcatccctttctgtagagtacatttgagctacaagtctaaattcagcaacagaacaagggaatttccgtccacctagtttaattagcttagtttaattagctttatattgtttgtccaacatcctgctcaatacaaatatgatgcggcctctcacttcatactaagtaaaacaaaagtattaacacgtgttttctgtaaacatcataatacttattcatctcattagacatagtgtagcattaaccgttaatattctgggactatttgacacattagaagtttctagttgttattctgtctacttaatttagataacttgtgaggaaagctagaatacctccgtttatagttgaaaaagatcaaccaacaataagtcgataaagttgtgtgcattctttccacttgacatgtcggttacttttgtgtattttactaactttgtttgttgcatgacaagtatcatggcactgctcacttaacactcagtgaagtactgattcatcaaaagttcttggtatggttgtcaagtgtgtgtatggcttaagcatgactacagtacataggcttggatatttgaatgtatgaagctctggcagcacagctgctgtcactgtcttttcccatgtgttgtttctatatttcggtagatgcgtggattctttctttatagggaatatttgagttttgctcatatttcatgacattatgtgccaaacaaaattgaggagttgttgaggctgtattcattcagtaatttgtttgaggaaagcaaacatagcatataatttgaagttaatgatgagtattcaattaatacaaagatacattacaaatatatgcttcctagctcacttttcttatgatgatatttgatttttaaaagctactactataaagttttacgccagtagattcttgcctttgagtactgactggggactttttcatgactgctgccagataaaagcatcactaaggggaagctcgtgatagatgtcaagtacttctttttccatgtccattcagaaagtcacaacctttgtgaggagacctcttgcccagtaactggtgaattcgtgcttgcgcacgaacagactttaccatcaatcaccccaccagtaagcatagctgcagcatgcttttagttctgttggtgaagaagatattcttttgttaatgaatttcctaactacccaagaagaggggatagagaacatgtccttatatgacttctaactttctgtatgacattctaacataatattgtgttgcagggttcttacactctcaccatgaggctactagatgacggcaacaaggaactgacctgcatctcgtttgggttcagcatcgggttcatttcacctcttgctctcatctaaattcagctggagtcacagcaatgtacttgcagaactcccatagtcctaccacaacatgttccactaaagccggtttaatctccctgagttgaacatcttactacttctggtgttatgcaataactatagtcaattgccgcttatgttcagtatacttgattggacattgccctgtcgttgatctgtctctctgctctggctgtggagtccggtcgctttcatggaagaattgaaatgggaccattgcttcatttccttgatggcttgtcagcgtcgatcacctgtcatggttgggactaaacccaatcagctagacaaggttattgcttgctgactagccattatcaccctaatgcacaagcacaaaaccggcagccgtttgatcatggtggatgcggacatgcggttgttgtggagcatgcacttgcccatgcttattagctctaccaagcaaattttaggtagaccgctccgcgtgcgtcgaatggtttttgtttcatgcaactcggcatttacaggtcacctctggatatttgacctgttttttatacatgtaaggacgtcggatataacacagacactatttgtgaatgcgagtgcatacatgcttggaatcttatgagacttatgtgttcttatcagggtttttgcgttatcgcgatacccggtgttatcaatgggcacctataacaaatttcttcaaaaattgtcgataacggttctcaacgcgtaacaataactcctactagctaatagctaataattgtaatcgataaggtaaaaccggttctatttttaaaaatttatcctaaagtacaacaactagccatcttaatctctaaaatttatcttaaaatataacttctccaccagtcttattatcttaaccaattataaccatcttacacgcactttttttaacttgaccaatcaagaccatcttaatcaccataaaaaatacaaaattgtttatattttaggacggatggagtgttacacatgctacaaatatagtgtttttctcgaacatatgaattttacaggattttcgtacataaaatttcttcaaatttctccgtcttaaatgagacgacttaatagtaacacataatttcccgctaaaatcctggtggggcgtaacggctctagcctagccggccccgactcgaactcgaacgttaaccgggggcggcggttagttaagcttgaggaaaccgaaggcgggcgtacgaaatacgtattcgttgtcagcacgcgccccgcgcctacggctagcaccaaaagggaagggctgcgaggtacacgggcctcctcgcgagtcgcgagagccctagccttccacccctcctctctctttcccctctccaacccgcctccctctccgcgccgcgcgcctcctctctctctctcgcttcctcgcctccgcgccgcgccgcgccgcgacaccgcctctgcctccgcggggggatggagccgagcccgtacggaggcgtcggggggaagatccggcgccgcccggcgtcccgcgccgccgcgaccccctacgaacgcc

SEQ ID NO: 1926 - DNA, 5764 bp, Oryza sativa
cgtacccaccgcagggtggtggtggtggtggtgggtgggtgtcgaggctggtggacccggcgtcccgcctcatcgccggtggcgcggcgcggctgttctcgacggtgttccgcaagcgcctcgaccctgcgccggctccggccccgccgaagtccacgcctcccggtgagcctgtggttcctgtacgctcccatctgggaagactcgtgcttgctcccgcggttcgtgctcgttagctttgcgctagggtttcaatcatccagggcgttctagggtttagctcagattagctggttcctacttctagtctgattgattttagctataaaattgctatcctccttgatatggagcagtagactcgtgatgaaaatgacgctgttctacaatggaagtttagtgtggagtttcatcacctcctatttgtgtgttttaactttaaatcataccagagtgtcccattctcttatttaaaaccatagcagtgtactatttgcttgtctgtcccaaagactagaaggatttgatgctccaaggtaaaaacatcaagtgtagtatgatgaatgtatttatgccacttaaaacaatcttaattcagtgtaatatccggtctttttatttttatttaaaaccatatggaaagaatacagtatgatatggtcttattttgtctgcctgtagtattacctattgataattttgtgcttggtgctgcagtacgttactaattttatagtcgcttcatgcatgcaggaagcaataatgagccaaaccaaggcttacctgagtcaacacaaactgtaagttataaccaagtgcttgcaaaaaaaaaaatcggttgtattgtttggcaaattgtgctttatacttttggttaacctattatattccgcttggtgtttttttaccctttattcctttatatttatataacaaaatctgatgcagggttcaaaatccaatcctcgagaaagggaagaaccccactggtgcatcggacaataaggcattgtctgaagtagagcacttgttaatgaggaaaacattcacaagaaaagtattaattacatatataatcttcttgaagtggtacttccatgataactgattttttagttaaccagtgaggtatcaaacaatgttgatttacccccagtgtaatggctatattggttttgtgatgttcaactcttctgttgacaatcgttggaggatcaaacattgttgttctctttccttttttgctggtgtcaactttttgggggtcctcttaaaattctaaacgacagcatctcttctgtcccgtgctttttaagctgccaatgacaatgtgattttgtatcagcagggttgagtttgaccgccttacagacttactgcgtgcaagaactgtggagtctgatttgtctgcaccggcagataaccttgataataagaatgaagcaaggaatacaatggatggtataggaggctccacatcacatgggatggctgcagatcattctattgctgctgatgtaagtagttcttttggtcatgaatattttttattctaaatgctagtccatgaattctggatattggataaatctcctcgagccaacaaagaaaatttaatcatacctggcaaacactgaaagtttatgttgttggtactgaggcatctgtagtctgctggtttggtttgtttctaatgccaactgatatactgtattaccctttttgccatcttcccattatggaagctccttttattgtctgattcttttaatccttttattgtctgattcttttaatgcaaggtaggctgtagttcctaaagtagccttcttgttacttgaactcgtgagtgcaaaaatatttttcgggtgcacacatgttagatgctgcattaattgctgagaaatgctgatttggatttgttggatctgtcattttttttaggcttgattgtgcatcaaagctctttactgaccttttaatatgtttaagtgctagctatataggatatgtgcagctaaacggccctttttgcagtgttggtatgccatatgattgttggattcaattcctacaaattcccatgttacatgcataaaaggcagtggattttacctttcgtttccatgctccatccaactaccatattgcagctttgctacttaggtttttcagtgtttttatttaggaaaaaagcaagcaagtgtgtccttttattcaacttcctttggaactttagtctgtgtttaattttatttctgtttattttgtaggatccggtttgtggtgctagttcacccgcagagctcgcaaagcaatatatgaattcccgttattcgaaagaaaaccgaccaaacagtttgcggagccaagtactcctgaagaacaaggcagaagcaagcaacattgcctatgatagaaggagacctggaggaccatttgtgcaagaactgagtcaatttagcaatgaaaactctgagcttcctgtgaatggctatgtaactccaggattacatgggcggtcagcaatatatagaatgtcctgttccccattctttaaggtattgtgtttactgcacataatgtcaaatcattctcagccatgttttcatgtgttctcaacatgccatactgattactggcgctcgaatttttttcttgttcagtataatgatgctctaacaatgatctcacagggaccaagctcttccaatgatataaatatgtcaccattttcatcatctcagacacgggctaatagtttggtttctggctgcaggcaggtaatttattagcactttatggaaacatatactgcattatatacagtatatattttaaatttgctatacacttagttgaacaagttcatgttactgagaaggtgttacggttgaatatactgtctagctattgaggtttttttctttttcttatatatgtctgtatcgttgcaaatgcaaagcatatatgtggtataaagtgctggtcatcatggccttgatagtgtgttgtgtcgtggcaacatctttagacttgcagggtttgcaccactgagaacattctccatgatatatgatctaaactagacataccagagcttctcttattcctatgtctccctaacaggtcttgaaacgaagaggtgccgaattggagaatgagcttggatctattggtcccatacgcaggattcgccaaaagtcaaatatgatgtctacttttagagatgctcgctcgagcccgcgaggaaactttcttcccagccgtacaattggttcagatttgaccgatggcggttcacccattcgggattcacctagttcgaaaagactattgctggggacgggtcaatctgtggaacctgcagaagcacgtaggaatgatgaagatggtaaaatttcaagtgataatgttcttgctgcgtcacctcaatcaaacaagatggctgaaaagatatttgagcagcttaatataatagtcccatcaccaaaagagaagctgtctcttccacaatttgctgctgggaatgcaagttgctccatgtcaaaacaacctgttaggcaaggcaatgagccaaacgggacgagtgaccctagtagttcccagaaatttcaacctatggatagtgttaagcattcccttgatccagaactgaatggttcaccatcgagtaaagacaagctgagaaaagatggatcatcaaaacttctgtcacattcatttaaggatttaggcaacaaagacattaggtctgataatgttgctctatcttcagttgccgctactacatcaagcaaaccgggctttaaaatggctgtttttgaggtatggggaaagtttactcttggttcctcgaattatattaaacgctcactcatgtcctgagattattctttatcacctttttttgttgcaggatctaccagagtttgatgatgaccaggaggctcctatcccatcgaaaaattcaatgggcaagactgaggtgaagacaactgataaaaaaattgatctgaagaaggagcagaaagttgaaccaattttattcaaacaaaaagttgagtcaaattcagtgcagaaggctgtcagttctccagttagtgaaaagcctatagcatccgcattgaaagatgcccgtccattaggcttattttcacctaatgaccctgaaaacagggctactcatgatgttccttcagacaacaacaatggtttcaaatttccacatgtaccttctggcacccttctggagagttctgtgtcacaattgccacttgcttcaaataaagacgataagctgatcagtgcatcatcttctatatttggtctcaagcagtccagtacaccagattcagaacaaacaaacactgctgatgtaaaaacagaagcaagacttggggagaggtgattttcttggcactccctatttccctttttctccttattaattgtttgcactggtcatcttctggaaggaggaagagtaaaaactataaaacaaagacaacccagtatttgcaaattcgtttttcttcaagtgcttgcaaattcatttgttactaacacataacctactaaaaagaatgttcattctagctattgacttgagaagtcccttatggttttttttctcacaatgacatgacatgtatgtaaaggctgaagatcctgtacagtactcttgtttaactcggtcataatttgtatatacatgttaagagatggtacattttattccaagggttattttagtaggatggatcgtaaatatgtaattgaaatgcatgtacagcctatcaggatattccttttttttttcaatctttgattacttatttgctgtttggaggaattttttggaaaataacataacagggctttaaaataggatatcccttttgtagtgtagaattgctttctatctatggagtaaccgcttatgttttctgctatttatgtttctagtgtcaccaagcccacaacattggacatcactaatttggagggaggtaatgaaagagaaagaacagaagatgtccataaatcatcagataaggtattaccctcggctgctcctttccactttgcatctgctgcatcaactacagcaagcctgagcaatggtttctcactgccatcatcatcaaagttatcaaatgtaacaccaattgataagcctgaagttagcttggctccatccactgtatcgaccacatttgctccatccagtaccagcccacctgtttcatctccaatccctgcaattccgacattcaattttggttcaagcacttcaatggtggcagcaactaaatcagatagtacaaatacagtggcaaagccagctagcagtttattgttcggtactggggatgctatagctgaagccaaatctactgcccaggatacagccaacaaggcatcatcaaatctaagtaccactcctatttcttcaaatatttcaagttctccagtcacatcctcttctgctttctcaagcatagcaacattttcatcttctatggttgcagcttcaaatgatggaattgcctcaactacttctgcctcaacagcaccttttacattttcgagctcaggaaacaacacttttgggttcaattccccagctcaacctgctggtttcagtacatctgttgatggcagtaccacccaaccatctgccaccagcacgatctttggtagcaaactgccacagtcagagggcacaatgtcgcagccatcgaagagttcacctgttcag

SEQ ID NO: 1927 - DNA, 1882 bp, Oryza sativa
ttaggagcttcctcatctggaactggtgctctgttatttggagcgggggcttcctcatctggaactggggctctgcctttcggagcgggagcttcctcatctggaactggggctttatcttttggagcaggagcaggaacctcctcatctgggcctggaactgtgtcttttggagctggaacctcgtctgggcctggaactgtgtcttttggagtgacaacttcctcatccgggtctttgtttggtaattcaccatttggatcaggaactactttctctggccctggaagtggattcgcattttcatctcctagctcttctgctgggtcatctttaactatggccagcacaagtatgttcagcaccagttctacggcttcatcatcccctgctttcagtaacccattcggttcaagttcatcacctcccagcatgtttacatttggccaatcggcttcttcaggaggaggtttttcatttggagcacagtcatctccagctttctcctcacaagctccagttttttcatttacctcagcaagcatgaattcatctactccgcagcctgcttttgggatgacaaatgccaacacatccttcggcatgggatctcctggaaatgatcagatgaatgtcgaagacagcatggcagatgacactaaccaagcagcaccagcaccagcaccgatatttggttcctcaccatttgggcagcctgctagttcacccgctgctccagtatttggtgctccagcagtcccgtccgccggagttttccagttcgggggccaacaaggttccatgcagcagaatgcggcattcccgcctgccggtggtagcctagagtttcagggtgggaacttctctttgggaagtggtggcggaggcggcgacaaatctagcagaagggtgatcaaggtcaaaaggaacccaaagaaaagataagacgctctgttcaaatgtgcatttcatggtgccattttggatctgcctggcaacatgtcgtgatcatcagagcgggactacgaccatggttcgtatggtcatacaaattttccagcgtcagcacagttttcgcagcatcacccggctggcttgtaaaccccaaggtcagtagtgtattaccactcaattattcctttcattggcaaagccggattgcatgttgttgtatgcctgtgctattggagtgtaaaatagaacaaaaaagaagtgtatcccgaggtgtaattttgttctcttttccctgcgcatctgctgtcttatttgcctccgatatatttggctcggagtgtaatgtacactgttgtatttgttctttttgtttacatccgacatgcccagaactccctagtatagaatctccctagtttatcaatcttcgaatcccactgagttttacatcctgcgtgctttacatttcaatgtagtttagttttcttctattgtttagtgtggtattatatgagctgttccgtgatatctaactccacgctgtcttgtctccattagaaacgacttctttttatccaatgtgcctgaccagttctttcagaaaacctatcaacacaaacgttgaatttacaaaccataatcaactagtagaatcagcgttgcatgtcgcaggccgttgtgtgactgggacgttaccggccacctgccgcgtgtgaagtgatgctctctttctctctacctacactgcttcttggatggtggtgatgatgcgatttggacttttgcacatgagcacgacctggtcggccaccatgccacacgcgctttccccttctacgctctcgcatttgccatttcttttttcgcgatcacattcgcgttaggcaagtagttgggcaaggaagaagaaacatggaaacaacacgac

SEQ ID NO: 1928 - DNA, 9652 bp, Oryza sativa
tcttcccgtgccacgtccgagtcaccgcatgataccatggaaatgaaaacctgtctaaatcatttgctccttccttaaccacctctcctactcgtggatttctttttgttcctttctttctcctctcctctcttcgtaccccctgtcacgtagttcttgtttactctttccattaggtgtcacaggtttcttctcctcttatccttcctttccatcggttcttgtacttggtggtatacccctagctgctcgcctttgtgttaatttggttggattgggagtttcttgttctctctttagccttgagcgatcttggtttcttgcaattagcctttgactgcttcttcttcttccacttgccgccggcagctagaagtggtccatcgtaccaaccctttcgtcctcattgaaccattccgcctcgctcccagctccattactagaagcactagagctagcgtgaatgcgtgatccttgatgcgtagttagcagctagctcctgcccccaatctgccatctccgcattgcgattttgagtttttgagattgtaatttgcgaacgatctcggttgtgctgagagcttagcgttgacttcgatgggtgcatcgcgttcgatcgccgattctgatttggtcgcgtgatccgggggtgatcggtgattactccgagcgggaggggagatcgtctcttggcgcggttgcgcttcgccgcgcggagggagagacattcgcggcgtaatccgaaggtgtttgttggatcgaggcgtggtgtccgagaaagattcggagcggcggcaatggggaacacgtgcgtcggccccagcatcagcaagaacggcttcttccagtccgtctccacggtgctctggaaggcgcgccaggacggcgacgacgcgctgcccggcgccaatggcgcccctgacggcggcggccagggccggttgccggcgccgccgccgccgacttccgacgcgccgctcgccgtccaaaacaagccccccgagcacgtcaagatcgtctcgaccacggacaccgcctccgccgagcaggacgcctccaagtcgagcgccggctcggactccggcgaggccgccaggccgcggccgagggtgccgccggtgaagcgcgtctccagcgccgggctgctcgtcggctcggtgctgaagcgcaagacggagagtctcaaggacaagtacagcctgtggcggaagctcgggcaggggcagttcgggacgacgtacctgtgcgtggagcgcgccaccggcaaggagttcgcctgcaagtccatcctgaagcggaagctggtcaccgacgacgacgtcgaggacgtccgccgcgagatccagataatgtaccacctcgccggccaccccaacgtgatctccatcaggggcgcctacgaggacgccgtcgccgtgcacctcgtcatggagctctgcgccggcggcgagctgttcgaccggatcgtccagaaggggcactacaccgagcggaaggcggcggagctcgccagggtcatcgtcggcgtcgtcgaggtgtgccactccatgggcgtgatgcaccgtgatctcaagcccgagaacttcctcttcgccgaccagacggaggaggccgctctcaagaccattgactttggtctctccattttctttcgcccaggtgagcgaatcacattttcttttccttttttcttttccagaatggcgcattgaatttagtatctataactgttataacaaacaagatttccaatccattcaagaaatcacactgcatctatggataagtagagaatgaatatggcctaatctttcatgtactgatttgatctttagtgaatctgaagttcttgagtttcagcatttgtttttgggacaactgcattattgtgcttatgatagtactaatactgctgtgagattttatgcttcagaacttaatttcctttacctacatttcaaagttttcaacaccatttgtttctgcataagttctgcaaaaagtttggctgcatatctttaccattctgcagtctgctaccatatcattcagatgaattcattctccattgggtttctactcatatgccattcttattccaggtcaagtattcactgatgttgttggtagcccttactatgtcgcgccagaagttctgaaaaagaaatatggtcaagaggcagatgtctggagcgctggtgtgataatttacatcttgttgtgtggtgtgccgccattttgggcaggtaagaattttgctgatttttcagtcaatcacaaaacaattatactaactttcgtgacaaaatgtgatgtattttgatccgaactcttgtactaattaagctctccattgttgtgaatcagagaacgagcagggtatatttgaagaggttttgcatggtagacttgactttcagtcagaaccatggcctagcatctctgaaggtgccaaagatctcgtaaggagaatgcttgttagggacccgaagaagagattgacagctcatgaagttttaagtaagttacttgattaattttcatgatatattcctaaatgtatttttctagctattttagtagtgcagggctgcaggccatgaacagtgcagtctgatttacttggcattatcatcttttcagggcatccatgggtccaggttggtggtttggctcctgacaagcccctggattctgctgttctatctcgtatgaagcaattctcagctatgaataagctgaaaaagatggctcttagggtaagtatgacttggacacaaattgttactatatttctgatttctctatgaaatattttcccaatattaggatagcaccatcttgtcgttggccttttgtcctcatgcaccaaaggaaaatctgtttggagtttagctcatgcaagatacagtacataatcattttaaaaaataagtatccaatgttgtattagttggagaatgttgttcatcttgaatggttcaatcatacttacctgcatgtcctgatacctttgttgattccaggtcattgcagagaacctatctgaagacgaaatcgccggcctgaaagaaatgttcaagatgatcgacacagacaacagtggacagatcaccttcgaagaactcaaggttggtctgaaaaaagtcggtgctaacctccaagaatccgagatctacgcactcatgcaagccgtaagttcttaagcaatctaccaattccgtcgagtacttttacggtggtctctactggtcgaaaacatcaaaattgcatttgtatctgaattctgaaatggtattattacaggcagatgtagataacagcggcacgatagattacggtgagttcatcgctgcaactctgcatatgaacaagatcgagcgggaggatcacctgttcgcggcgttccaatacttcgacaaggacggcagcggctacatcacggccgatgagctgcagctcgcctgcgaggagttcggcttgggagacgttcagctcgaggagatgatcagagaagtcgacgaagacaacgtcagtaaaaaaaaaaaagaacctacttttccattccattctgatcgaagctagctaatcacattgcctgaaatgcttgatctgacggaactttcgctgttctttttcgtgccttgtgtttgcaggatggtcgcatagattacaacgagttcgtggcgatgatgcagaagccgacgatggggctcccggcgaagaagtccggcgggctgcagaacagtttcagcatcggcttcagggaggccttgaggatgtcttgagaaacagccactagagtcagtcacacacttgtagaggcgacgacaacgagatcgatatgttgtcttccatagggctggtaatttcgaaacggggaaaaaaatggctggaggagatgtgcgtgtacgtacaggcgtagaggggggtgggtcactcttgggtcattggttcgattgttttcttctgacgttaaaaatacaagagaggtttttcgttcctcgccgccaccgtcgttcatgtgataatccttggccccctcgatcccctgcgcgcgatgccattctggtgcgtgatttcgccgtgtgctaccgtgttttcggcgggcggagcggacgaacgcgctgtaccgtccaaccgcgcggcgtgtgctgcaaagcgcgcaatcgctcgtaataaaacggagctccgatcgcgagggcaaacgccgtgtgggggacaagggcagacacgtgaaatgaagccgttttttgtccttcctgggttattacttccacttctttctcccagcggagcggcacgttggtttcggaggccgtggcactgtcgctttgcccatcaatccgcccgcccacgggcgcagatgcagagatactactggactgctacgactagtacccgttgcgctgcacgtcctgccgggaccaccaccagactctgaccttctgcacgttgtagtagtgtttagcgtttactgtaactctctgaagatgaatctaccactacaaggcgatcacctgatgcagtggtgggcaagttatgcttccttgctagtacagtattatagcaacctgcaacctcatataagttgtagtaggccactactccctccgtccaaaaaaaacaaaacctgagtttccgtgtccaacgtttgtccgtccgttttatttaaaaaattatgaaaaaaattaaaaagacaacacgtataaagtattaaataatgaaaatactaattataaaaaaattccatataagacggacattcaaacattggatacagaaacacagggtttgtctttttcttttgtcaaacattggatacggaaacccagggtttgtctttttcttttggacggagggagtagtagagatgctgtggtaataggacacccgcaatggttatctataggctctgtataagatatatatgtcagcatattttcctacttgaaaaagattaaatgaagagagagagcaaagctatctactaaactggagatagtctatagagaaaaacgaagcaatagattagagagctatagatacccatgtagacatactattgaggtggtttactattaatctagtctattgctgagatgtacatgttttatattttatagagagcaccttactttatcattgcgggtgctcttaggcgaagacgattcacattagctgtcactttatttcattaataacgacgtcgttgcttcttagttggagcatctatagtttatagttcagcaggtacatcgtgtattcatgttctcacgctgattagtccgctgtcccgaacgaataatgcaggcctgtacgtccaaatgacaaatcatagcctaataatcttcagagaataagattcgcataaatgattagatctatagaagatgcagaattgattactactagctttaacaccaaggatgctgtgatgtttaattgtttactcggcattctgtcaaaacagaaaaagaagaaaaaatgacggaaaaaaatataaaaaaaaacgctcctatacacagaagatctcggtcttcaagtatgaacattttcctgcctttttttttttcagacaccaacagccaccagattacattccccacctgatttattattcgtaataataaacaaaaataaaaataaaaaaaaaacaaatggtaatgtggacggctccagcacagtccatcacctcattctagttcgtgtttcggtatcatgagatcaatctttcgccgtctactggcagcttgcgaatcgcaatcgctgaccaaggatgccagccatttggcacgttgcttctaacaacttgcctgcagtattttaaaatgaacaaagcataagattattattatcaatgtgtgattaacacataacgacactggtgttatactgaagggaaaaaaagctagaagaatatgaggctggggagtcagacgattaatgttagattatgtatcattagataccctgtcaattcaacattgggtgcctataaaatttttggcatttttgttgttctcaagatgtggcaatggcttcatgtagcttggactcaaaggatacaagtagtaagcaataagctcaaataatctagaccaggcaatagcaatatctaatgtcgaaatcacaagacaactgaaaatttaggtcatgaatacccaagaaatatactgccatatagttctataatcagcatcacaccacgttgcacacctaaatgaactaatcaacaaaaggaatatcaccaagtgatcaaggttcacaggcaccagggtagtttatcttactcacgaatccacaatccgtggccacccaaccatttctatggagcagtatatatattgctgctcactatcatctaattcttgagattaaaatcaacataagttttcttcagatcatgacaacttatagatgcttggcatactttttgagcacaggtctaggaaaatcgaggggatttagattgatcttaactatctatatatgacctagatcatagaaaaatacatctaagacaaaattttatctttaacatacatatgtaggttttctacttctgtctttgttttcaccaatcatagtccaaaaatagctcgctctaacatcagcagcattcgcatacaaaggcacacagtttagcaattgccatccctcaacccataaccaatccaatcaggctactaccattccaccaaactctagtaacaagatgtggcaaaggcttaagcatgagccttttgatgctttgggggaaagaaaagctgttgctcatgtgtcacgggcagagcacaattcttgcttgcagtcccaggtacagtatcaagagatggtaaagacagtaacccaccagcacacgcacaattctaatgtttcagtacacaatccagtgctaatatcacagaccagccagctatgtgtaatggcctgaataaaatgtataagtgcatagacaccaaagagaatgactgcaactttggtagtattactgaccacatagtagcaagtgcccaaacgggcaccgacaggccatatgccattcagaacggcaataaccctaattgcttctattttatgcctaagccttcgtctttattccgcccagtacacaccacccaccaatcgattaattaattaatccccgccgctacgatcagaacacttaccggtagcacttacctgttcctaccggtgaagagtaaaccctcacactggcaacattactagcatcaacccgcattgacttaagcaattgcataaacaaaatcatctcctaacctccccaatctaggttgtgaactgtaaatttctatggcggatttgcacgattaataattgagtagaaaatgcaagttcagatctgaagagaatggctgacctctccggagtttgttcttcttgcgagtgccggtgacggcgggcgccctcctgaccggcgccgtgtccggcgccgtcttggtgtcatccggcgggaacagcacggcgtcaatgccctgcactgcgatcctgccatccgtgtagatgtccgggtcgaagagatacgccgagccctcgccatggccgaacttgactgagccgtcggcctcgcgcgccaccaccttgtgcggcagccgcagcgtgtcgtagcgcaccttgccgaaccgccgcaccgcgttgtacatgctctcctcggtctggtactccgggatcatgtggtagtacaggatgttctccggcgagccgggctcgctgagctggtcggtggtgaggcgcgccatggcctcgtcgttgggcgcgagcacggtgagcacgtacccctcggagacgagccggcccatctcggtggcgagcgaggtgaggttgacgaggatgtcggcgagctcgttgtagccgccgtacaggaggagggtctggatgaagtccttcacctggctgtggccgtcgaagtggtgcttcccggagcccggtccaggggcaggcgccggcgcgatggatgggccgggggccatggcgtcccagatcggaagcaccgggggcgcgccgggtggcacgggcggcgccggcttcttgaggcggtgcgtcctcgggtcaacctcgggcgcgccagttggcagcacggcggagatgtcggcgaggctgcggcggcggttgaagtcctcctggacagagcgcggcacgaggaggcgctcgatcccgtggatgacaccgtccggcctgagcacggcgtccgggcgggtgacggcggcgtgggcgacgcgcatcgcgccgtcgttggcggcggcggcgagctcaacctcctcgccggagagcgtggggtgggagacggcggaccaggacccggaggggaggcgggcggggaggacgtggaagaggagcagcgactggagcgacttgaggttcctcggctcgagcaggaagcgcttgaactccgggtcgaggtcacgctccagcgcctcgttccgcggcgcgaagatggtgacgttgtgcttgccgacggcgtcctccagcgtctggagcagcagggccttctccaccagctccgccagctccgtgtaatgcgagtccagcagcgccaccagcaccgagttcgagttgattcccgttccagcaccagcgccagatgttgtcccgctactagccgccccatcggcggcggcggagggcaatgtgggttcctccggcgccgtctccgcggccgcgccggcgagaagaagcaagaagacgagggcgccgcgcaccggcgcgcccatcgctgcggcggcttctcctgcccgaatctctccggatgcggctacggctgctgctgctcccaccgctctgctactctgctagctactctccaccactctggtggttcggcgaaggaatgaattgggggaatgggggagaaaggaggagaagagaagtaaactagtaatggaggaggtgggtggtgtgagcttttctcctctttttctcactttcccctccttttttactccaacggaagagagagagagagagagagagagagtgaggtgtgtgtgagcttgcttataagtgaagagagagagagtgagaagggttgtcgaagtggaatagtggatgcgaggccgaggcgagaccgcgagacgaggaaggagaggagaagacgacgcagagtccgtggttggtgggggcagcgtgcagcggcggcacaggctggcgggtggagccgtggagaggggccagcagcaacaagtgtcggtgtgcagctgtgcgtgcgtgcgcgcgcacaaggttcgcctgccgtaagcaaggaaagtgtgggcagtgggggcattcggtcgcccgccgctcgcgccttgtctcgcggctcgcgcgcgcgcgcgcggcgtatgcaacatttcgccgtgccccgcccagacgcccagcagcgcagcgcgaagccgagccgcgaatatttccgcgggtttcgcccgctttctgccgcgcgcgctgccttgcacggagacacagtgcaggcgtgcctggatttttcataatttagtccttttaaaaaacttatttcgtaaatagacctaaaaaaacttaaaatggtcctttttggcgtcagaatggctggcgccgtgatccaactggacagcgccagccactctagcgccgtcctcctgccgacgtggtgggacggtgctaaagtggtggggga

SEQ ID NO: 1929 - DNA, 12358 bp, Oryza sativa
ctatagtgtagagggaagagatgtccaacaatttttttttcacatttagaaacatataagaaccaaccatagaaagaaaaaacttaaatgacgaaatatgtgtgacggagcgtggggctcctcaccgggagaccgcgcaggcccccctttgccggttcagccgggggccctgggtgagattctaagctcctagtctgtggaaagttcgcgagaatggaaaaagcacaagacacgggcgatgtatacaggttcgggccgctgagaagcgtaataccctgctcctgtgttctggtggatctgtgtatgaagaagctaccaagagctggagagccagagagctcttattctaaaaaccctcttctcctttttttttttctcgtgggatctcctctccagatcatccccccttccagcctctcctcttaagtgggcaaggtcctccttttatatctcaaggggataccacatgcaccacttctccctctctctttttgggtgggggcccatcctatctatagtaaaacttggcttgccttctcttggaagctgaaacactacctgtttttgagtgtggccacgcgtcctcgttcgtctgacctcggggatcaccctgtcatcccttcataaatgggcggagatttgcaacggctgctgcccgagtgacccttctgatgggacggcccatacctacctccactccgccggaagcaggtgcaacgtgggaacacggttgtcttccggcgacataaccagtgtcagaccagtcacagaccggtcacctttgtccaccacgtgtcagtttagcaatctgcatgttcgcccttcttcatacaacgtcttgcttataatggttgggataaagcctagcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaatgagcgtgtcatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcatttttcctggagatatggtgatggcgcttcggtcggcgagcgtaattaacgcgcgcacgatatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtcatggcacggggctccgctccgcttgacggtagcgtgctgccgccttcccgcatcgtgagcgagagacaggccgggctgccgcgccgcttcatgccggaatttgccaccggccgggagatagtctcgctgggcgagggatgcccggcaccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccatcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcacaggggccatggtgttcggtgactatcttcgtcgccggatcgcgccactccagcggcgcgcccggggcgcctgggagtacaccgggtccgaggactgtatgaggacccaccggggggtcaaatgggactgggtccccgaagacttcaaggtaatgatccaacgggtgctgaatctcagctccgcggaggcatccctcatcccccaaggagtcctccccctctgcagcgatccagatcgcgccaacatcctgtccatcatgatggcggtcggggcctcagaggaacgagctcctaagggccatgacagtgcgagcgggagccgcaagggagatcaatctaccccaggagggggttgtgcttccggtccccgtgatgggggctcggggggcagccgccctgccgacgcccgagggaagagaaagcaagagggtacttcctccccatctcctccccgagggggcggggcggcacgtgtcagcagcaggcgcccggagggggccgcgccgacgccgcagcccgagggggagcggaagaagaaacggctccgcaagatggggggacagaaccatcccggggaaacctcatttcccctccaaggtggtcgtttaaccgaccccctcgcaggttcgtcccacgcccattgtggctatattcattcttccaacacaagttttcattcacccatcttgtttgtcttctggcttttcttctgcttcagcgagatcccgtcgcgtccttcttgccaattcaagtccggccaatctgaggccgagaatgcggcgaccacggaggctcggaggcgggaatctgaccggcgagaagccgcggatcgcctacgggaagccgaggaggccgcccaggtggccatccgagctcgccaagctgaagaagccgctcgggaggaggccaaacttcgccaggccgaggcggcgacgacttccgaggcagctcgcgacgaggccgcgggcgcatcgcttgggcccactccctcgggcgacgctcaggacaagccaggtccgggggacatccctgagtccggcacgtccatcggcgggccgagccgcgcggcatcctcaccgaggcggctctcccccacgccttctgctgccccactgagcgcagagcctcttctgcaggccttggccgttgctaacaccacggtgttggacgggttaagtgcccagatggaggccttgcaagcagagcgggtggagctcgacgccgcatgggcacgtgtcgaagaggggcgtcgctcggtggaggccatggtggaggtgggccgcaaggcacaccgccggcacgtctcagagctcgaagcccgtcggaagatgctgggggagatcgccagggaggtggaggaggagaggggggctgccctcatcgctactaccgtgatgaacgaggcgcaggacgacctccgccttcaatacgggagctgggaggcggagctagggaagaagctcaatgccgcccggggggtccttgatgctgccgctgcccgagaacggcgggcggcggagaccgaggtggcatcccggcggcgcgaagaaacccttgaggcccgtgccatggcgctggaagagcgtgcctgcgtcgtggagagggacctggcggaccgcgaggccgccgttgctattcgggaggtcacactggcggtgcacgaagctgcctgtgccgaagaagagtccgcactccgcctccgcgaggatacgctcaccgagcgggagcgagccctcgaggaggccgaggccgcagcacagaggctagcggagagcgcgtccctccgcgaagctgcgcaagaggaacaagcgcgtcgcaatctggaaagtgcccgcgccgagagggccgcattgaaccagcgggccgctgaactcgaggcgcaggcaagggagctggatgcaagggcgcgtagcggcggggcggccacgggcgacagcgacttagccgcccgcctcgcagttgccgaacacaccatcgcggatctgcagggcgcgctggattcgtccaccggggaggtcgaggcccttcacctggcaggcgagatagggcccagcatgcttcgcgacgccgtgtcccgtttagaccgcgccgggcggcaggcgggtctctggggcgggcggactgtgaagtacgccgccaaccaggggggcctcgcccagcgcctctcggagatggccgggactctccagcggctccccgaggagctcgaggggacgattaagtcatcctcgagggacctcgcccgaggagcggtggagctcgtactggcgagttaccaggccagggaccccgatttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggcgacccgggtgcatcggagtgagcccccaggcccccgccaatcctcagttttttcttcttttctttctttcaaggccttcgggcctcctttttgtatagattaacttaatctgcaatcaaaataaagaaatttctgtgtcaatttcattttgctatgtgtatgagatgaggatgatctgtgccgtggtccttttatgtcttaacttgattaagggctcgtgcccaggtcccagtcctcaaaaggcgcgggtcggggctagtgcctggggagatccacgtgtcgagactggccaggccgggagcgtggtgaccgagggttatgggtgacccgattgtgggtttttgccgatttccccccggagttcaccacgccccggggcacggctcggttctgggccccttttggcgattttagccgacccgagcccccgagggcaggattgagcacaagtgacatatttcaagtcaagattcttcaaaaggaaacaacagcacaaatacagcctttaggaaatcgaaaatgcttttattgaaatacagatagaagaaaaaatatgcatatgtggtagcccccggccaaccctgcacgcctgaagggggtgcgtggttggcccgagcccgaaacctgacacccgaactccattaggggtagaagcgacgaaggtgttcgatgttccacgggttaggcagctctgtgccgtcgcccgtggccagccgaacggagcccggtcgggggacgccgatcactcgatacggaccctcccacattggtgagagcttgctcaatccagcacgtgtttggacgcggcgtaggacgaggtcgtcgacgcagagtgatcgtgcccggacgtggcgctgatggtagcgccgcaggctctgctggtagcgtgcggctcggagggccgcgcgccgccttcgctcttccaagtagtcgaggtcatctctgcgaagctgatcttgatcagcctcgcagtacatggtggcccgaggggacttcagggtgagctcggatgggagaaccgcctccgcgccgtagacgaggaaaaaaggcgtttccccggttgctcggcttggtgtggttcggtttgcccagagcactactggcaactcctcgatccacgaatcgccgtgcttcttgaggatgttgaaggtcttggttttaaggcctttgaggatttccgcattggcgcgctccacttggccattgcttctggggtgggcgggtgaggcgaagcagagtttaatgcccatgtcttcgcagtagtcaccgaaaagctcactagtgaattgggtgccgttatccgtaataatacggttaggcaccccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaacggccatgaaagtggtatgatctgcagtgcctgggccagctgatggatttgcttggcgtggaactgacacgctctgcatcgccggaccaggtcaaccgcatcattgagagctgttggccaatagaaaccttgacgaaaggctttgccaaccaaggcgcgcgaggcggagtgggctccgcattcgccttcatggatatcagcaagaagctcgacgccttgttcccgaggaatgcacttcaggaggattccgttagccgcgcgccgatagagggtcccttctatcagcacgtagcgtttggagatgcgctggacgcgttcacttccttcgcggtcctcgggtagagtcttatctgtgaggtatgcttggatctcaatgatccaagcaatcaatctaagggagctgggagcgctcccctcgggtcccgaggcctggactccgacgggcctcgggggccggtcaggcgcgtccgtctcccctaaggggtcaggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgccgtacttggcgtacgtaagcatccatctgtgggtcagagcaccggtattccttacagatctggttaaccactagctgggagtcgcctaacaccaggaggcggcggatccccagtccagctgccaccctgagtcccgcaaggagtccctcgtactctgccatattattggtcgcccgaaagtcaaggcgaaccaggtatctgaggacgtctccgctcggtgaggtcaatatgacccccgcaccggcgccctgaagagtcagggagccgtcgaactgcatcacccagtgggcggtgtgaggcagctgcgaggggcccgagctggcctcggggactgagacgggctcgggagccggggtccattctgccacaaaatcggcgagggcctggctcttgatagcgtgacgtggttcaaagtgcaaatcgaactcagaaagttcaattgtccatttcaccacccgtcctgtaccctctcgattatgcaagatttgggcgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggtcgatcctcttcgccaggggccgcatccctgggccgctcttcgtccaagcggcctcgcggggcgcacttgtcttctgtgctgacgacctcggggtcggaggacgacaggtgcggccttcccacagtggcctcagggccgtcctgggggtcgggggctcctggcgtcgtcggacaagcgggcaaagggtcaaccccggtcatcgggagccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggagcctctcctccctgctctctcccgggccaagccaacacagggtggggatgcgcggaatgagggttgtcctcatcgcgctccacaactaacgccgcactaactacctgcggggtcgccgctaagtagagtagcaagggttcacctggctccggggcgaccagaactgggggagagctaagatacgccttcaactgagtgagggcacgttcagcttcctccgtccaggtaaacggcccggagcgtttgaggagcttaaataagggtagcgccttctctcccagcctcgatatgaacagacttagggcggccatgcaaccggtgacgcattgcacatccctaagcttgctggggggggcgcatccgttctatagctcgtatcttctcggggttggcctcaatgcctcgggcagagaccaagaacccgagaagcttgcccgcaggtacaccgaacacgcacttatcggggttcagctttatgcgggtggagcggagactctcgaaagtttccgccagatctgaaagtaaagtttctcggtcgcgggtcttcacaaccaagtcatcgacataagcctcaacattacgtcctatttggctacccaaagaaattcgagtagtacgttgaaaagtaggacctgcattctttaacccgaatggcattgtcgtataacaataagttcctatgggggtaatgaacgcagttttttcctcatcctccctagccatgcgaatctgatggtaaccagagtatgcatctagaaaacacaaaaggtcacaccccgctgtggagtcgacaatctgatctatgcgaggaagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaagcttgacgttccggggcctgccggcgcactttctgccggaccggctttgcgcccggccgcacggcgagacggtgctcaatcacctccctggggaccccgggcatatccgccggtctccatgtgaagacgtcagcgtttgcccgcaggaaggagacgagcgcgtcttcctatttgccatccagaagaccaccgattcgtgtggtcttggacgggccgtcgcccagggcaacctccttgaccgggacctcatcgcacgtgactatccgctgcctcagggcggcggggacggaggtgccaagcctctcgtcgccatcctcgggcttggacgcagcggcgaggtggtccgcgcgctgctccatacaagcgagcgcgactttgaggtcgccatggacagagatggggccaccggggcccggcatcttcatctggaggtaggcgtaatggactgccgccatgaacttcaccaacgcgggcctccctaggaccgcgttgtagggcagactgaggtccgccacatcaaagttcacccgttccgtgcggaagttggcggatccaccgaaggtgaccgggaggtcgatatgacctagcggccaagtgtgccccggcgtcacaccgataatcggctgggacggccggagcaccatccccggggccttgatggcatcaaaggctgcgggggaaaggatgttgagggctgctcccccatcaatgaggacacgccccagcttcacgttgcaaacagtgggggaaaccaccattgcgacctgtcctccccgggcaacgcacgatgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacccaggtcatcatcgccgtcatcgatgtcctcggcgggggccttctgtttggcctctcttcgccgattgccggaaggaaccgccgaggacttgccctctcggcgctcctgcctcctctcctcctcccacttcctcgtccgctcagccaaacttttgactacacggcagtccgcgaggtcgtgaagggaggtgttgtggacggtgcaccacttgccggttgggcgctccctgctgggagcgctggcctcctttttgtcgctcgcaggcctcccctttcgggtggcccgcgaagcaccctcgacggcgaggacatgaccctcgtcgtcggaatgggctgaccttttcttcctcctcctgtcacgccgccctgtccgagcagcggatccgggggcggccgaagctgccacaccggaaccggaggggttccaggtccatgactcctccttacgagccactcggtccgcgagctgaaaaagctctgcggtagtctggggctccttggaggcgatcttttcgagcatgcggttgtgccgcacaccccccctaaacgcgtagatcaccgcgtgtgcagggatgcatggtatggtgttgcggacttgacagaaccgctgaatatatgagcgaagtgactcatcatcccttcactgtactgcgtgcaagtccgcttcctcacctggacgcggatatgtgccttgaaagttcatggtgaactgttggcacaagtcctcccaagagtggacggacgcgggtggcaagttcattagccaaccccgcgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgaggtgacactccggacgaggaggcgccctccgttgcgtgggcagcacgtcggccattacgccggcgctcgatactgatgcgggcatccggccccccacgaagatcttcccgggtcggaggcgctgacgaaggagtgacggccgaatagcgaacagcggccgctgctcgccgcgccctccgtcttgacgacgcggagccggtggtagcagtaccagaggtcttggtggcggaggaccgcccaccagcatctaggcgctgctgcgccgtcatgaccaagttggccatgtcgtccagccaacgttgggctggagactccgggtcagggacaatgggcgggtgacgtaggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctaccaagagctggagagtcagagagctcttattctaaaaaccctcttctccttttcttttttttttctcgtgggatctcctctccagatcatccccccttccagcctctcctcttaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggggatcaccctgtcatcccttcataaatgggcgaaaatttgcaacggctg

SEQ ID NO: 1930 - DNA, 24905 bp, Oryza sativa
  unsure (1)..(24905): unsure at all n locations
tgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgagcccgacccccccccccccgagggggttaggccacgtgggtgatcgtgtctgcctcaagtctctaagtcatgatactcccggtcccatgtcaccgacaatgtgatttgtagaattttctaaatctctaccgaaaataggtgtcatttgtgtgtcatttcttaaaatagacgtaactttctcatacgaactcggaatcaggcaaataatataaccacaaaaatctacagaaaaagttacatccgattctcccccgttttgctgggttcggcgaaattaaaatatccaaatttttcttgcaagattgtgttttcgaggcgataagcttttcgacggagcgttggaaaattctacatgccacatatttcgtccgtttgagtttatttttttagggttcgttcttgtgggttcctaactgtgaaaaaaaatatcaaaaaaataaaagaaaaataaaaaaaaaagttgcacatctctctcctctacactagagaggatagaagagaaaaattctgcaggtcacatattttatctatttgagtttggtttgtatatcgttggttcttgtatgctcctaatcgtggaaaaaaaatcaaaaaataaaagaaaaataaaaaaagttgcatctctagactgtttaagtaacttatggctatcattttcatgtggttatattttgagttagattaagcaatttcatctagtggtagagtgcattatgtttaacatgctgaccgaagggttttgctaaaagagttatggtataatttggtgaaggtccaaaatttggtatgttgtttccagacttttagctaagttgaaggatttattacatattccattcgagtttaatttttttttgtggtttgcatgtatgtatcgtgattctaagtgtaaaaaaatatcaaaaaaataaataaataaaaagggtcaagattggaaacgaggtgttgggggggggagccatggtggcgcctccccctgccacctcagcaccaccccgccacgttggcaggaggacggtgccagagtgcctggcgccgttcagttagaggacggtgccagccactctggtgccctaaaagaaaccatttgtaggataaatttttttagaggtctattttgcgaaataatttttttaaaaggacttaaatgtgaaaaatccaggccggcgtgccggtctggggaccggacagtgatgagttaaagccggtgagatccgcgtgatggattcgtacaatcgtactcgggtgaaatggagtaaatcctgtggtggatacaggagttgagtacagggtacaggcctacagggtgagtccgaaaggagaggttaaggagctcactaatgaaagtggccaagtgcgtcggttaggtccatatgccaccggaaccggatcgtatacggatgcacctaactctaaacggggtgttatcgtgttggagaatggagtttttttttttttaagaacttggagaacggagttaatcttttatttctgaggtcaaacaggagccgccatgtgcgttcgcgatgtaattaagacgcactaacagctccctcgagtgcactcgtgcttaatacttgcaggcttgcatgctgccagtcaatgcagagcatagtgcgttcacagatccaaatgttatactccctcccctttcattttaattaacgctgtgacaataacacgctctacaagatatacctttgaccttattttttattataatatatataataaataaatgcatgtttacttttattatagtgttttgaaagacaaatctatatatgtttttctagtttctttaaactatatatttttaaagttattgatggtcaaaattataaaagtttaacatcaaccttatccaaacgtcaattaatatagaaccatagggattatttatcctgtcaggtgtatcaacaggttaggttatgcataatcaaatggcctcccccggaaaatccattcggagacagctatactagcatctcgtgatcttgcattgtgtttacaaaggactaatgatatacagtatcgatcttcctttttcttttctcctttccaaacatatcttcttcttggcatttttatcgtacaacccaattcatgaaaaagaacactatcatggtgagttggatggtgtattgtcccacggtggtatgaccatgactttcggtgttatgctaacatgtagcttcgcagcattgatcgtgatttaatgatagatcgttggatggtcaccgtcgccaaatcgtgcttcaattcgtcaatgagccaacgccctgaaaaaagtaagacgtacagatatcaccgtacggccgcttcattagctttcacacaatcagatatcattgttgctttaatccacttcttgaaatcatcgtttaattaatacgatcagcctccatttttctcatgtggtagtgtcactttgtatcacaaggtattaggagtacatccagcaatcgattatcggtagtcactcacttttggtcgtttcaatcgtcggattttattgtgttaatgtccgggcaataacacgtaaagtgagccgtccaacttctggtggatttggcctgacgcgtcgcctttttttgtatgacgtgggttagtctccacgctaagctaccggacgatctacagttcaaccctgcagtttttttttttaagataatggaataaaccctccagatttatgacaatgttttttccgatttctgattcctccaatagttcgacgctggtgggctcgtttatcacttgggcggctattctccttcccgtcgttaattaagctgcatccggaagcacagcaccggatgtacgcgccagattgacgtgcatgttccctctacctggcactttcaccggtagcctgtaaccctttttacccctttcgtctacaacggtagctcgtgagccatacacgtatacacatacgaatgccgtggtgtcaatcacctttgaagccaagttttctgtgacatctcgtctcccccggccggtcgctgcaccaccggagatccagtcgtagggttcaccaaaccgttttaagtgtgttactatcactttatagtttggtggttatagtaagattgatatactgtgattttaaaaacttaaaaaaaattactatacatgataaaccagccggtccaaagtactgaccccgccacgagcacggcacgggaaggaattcggaataacggaagaaagaaaggcgccgagtcgtttcgttgcgcggatgcgccagctgccgcgttgatttcgcggggggcgtccgcgtgtggtgcggggtcgcgtcgtcctcgcgcgcgcgcgcgagcgagagacgagagagggtggattcgtcggtgactcggtgtcggtcggtggtttcgtccgctgcggttgccgagacgggagcgagcgaacaccgtgcgtgcgtgcgtgcgcacctggttctcgtgagcaataagctggctacggcctacgggcagcgcacacatgacgcattcttggttttgttggtttttgctagcgagaccaccacctgcgctgcgctgcggacgcacatggagtggagttcactgggttgaggttttgatctggggagatcattgtcatgtgaggggctaatctccgcgaaatgcttgatgccaaagttaaagaatcacgaatcacgcatgggacaattctgaggaactctgatcatcatgaaagcgagggcatttggatggcagatttttcttttcagaatgttcacgtgctagtactgttttttgtattgtggactaccccagcttgtagagaccttaaatatttccagggtgttcaacagtaaaaaaaggagaggggaagaaaatgaaacaagcatgtccagcgcagggaaaaggtaggtagatgcagtacaagggatgcacttctgtgtgattactcacaaacttatgtgtgatcactgcgaacttccgtgaaaatttatgtgtctcatacagaaacgtatcacttatatgcttgtgattactgcgaactcctgtgtacatggcaaatttcctcataggccaaatttgcatataagcttgattactcacaagcataggcaaagcacaacaggggtgataagtgacgaactgatgaatgaccgtacccttgatttatagggataccaacaagaatttcacaatcgacattcgttctgttgtgaatgataacgattacaattcgtaacgtcccgtgatctgaacgcaagagcttccaacgacttttgaagcacacaaagatgatgaaggcatgaagcatcgctggatatctcaggtgctccgaacaagcggcttttctctctggacctgacgaaagtgaaattggcggcggttagagaaacttatgaaggctgagtttagttccaaactttttttttcaaactttcaacttttccatcacatcaaaactttcctacacacaaacttctaacttttccgtcacatcatttcaatttcaaccaaacttccaattttagcgtgaactaaacacacccaaaggaaaaatgtttgtttcatcctctacaggatcgaacactcctctaaaaagaattgactggacgccattacatacatcatctacccgtgtagcattttgccccaattcctgtcttcagtcttcacggccaagaactactgtaggataacgcaacaatcccggacctcccctccttacttcaaagctaagaactactgtgggaaaatacctttcattccatcttgtgcgtactcgttgttttagacctggcattctaatgaatgcccataaaatgcatatattcaatgtgaaggtgctttcaggagttggagattacttcgttgaagctgatagctaacaagatctcaacacgtcagagaaaagctacaaatcagatggtcctactgtatctttattacaggtgtagattggttttcagaggtcctgattaaaatcgacatacaacgacagtaaatctcttgaaaggaaaatcatgtaaacatagtaccataggtagtaggaaatagtacctgttcatgttcattgctctatcaccaattcaccacgtagagatggatcggtagctgtgagcctacaatggccatctcttctaccatgatgggaaattgagggtgcgaagttcagcatggtagaagagataatgcgcaagcggccaactgctgtataatgcgctcgccaagttcagcatcatcagctcctacaggtacctgaaatcagaagggaatgcgtcaatagaactgcatggtacaagggctacctccagggtgcaaacaggccactgcacaaagtcgcaaagattatgaaaatatcaaatggtagcaatataatcgccaaatcaccaactgctggatgatgaaaaattatcaggaggtttgaagcggttagcttgcatattcctctctcttgttcagtctcagtagttcttggctgcatacattaaaaaaaaacaaaacaaaacgagaaccacctaaagggtgtgtttggataatgggaaatggagtgtgagattgagattgggaaatgaatgaagggttaggattaaatgaaagaggaagaatgaatggttaggatttaaagatgtcttttggtgagcgggaaatcatttccatttccaattagccaaacattgccaaaaggtacatcagctcactaaggagatgcagaaaaggtacatcatgtattcatgttctcacaccgattcatccggtgtctctaccaagtaatgcaggcaaagacaatcactagtctttagataagaaaaggcaagcatttaccagaatcttcagagaaaaacttacaaggatttgcaaaattattaaatccataaaagatgcacacacaaatgatgaagcttttaacccatgggatgctgcgatctttactcaagattaagattctgtcagaaacagtagcaagaacaacgaacaaaacaaaccctcctatacacagaagattttggtgttcaagtatgattttttttcctgccgtaagacacacctatacacacctgcttatattgcccacctgatttactactcatttttaaacaaaataaaacaaccatatgtggatggccccagcagagtctatcacctctagaccgtgtttcagtatcatgagatcaatctttcctgtctactggcagcgtgtgaattgcgatcgctggccaaggatgccaaccatttggcatgctgcttctagcaatttgcctgcagtattttaaaaggaacaaagtataagaatactatggaatggttaacaaaatgatttaagaatatgagtctagggagtcagaagattattgtcatattacatttaacagacaccctgtcaaaaagaacagcaacgggtgtcaggaaaatcttggcatttttgttgtagtatgagatacgacaatggcttgaggtaacttaaactcaaatgtaaaaccgtacaagcagtaaaagggtaaagcccaaataatttatctatgccacaaaggcacatcctatgtcacaaaattgcagtcacaactgaaaacataggccataaatatccaaagaacttatataagtttgtaatcagcattgttgcaatcctaaaattgattaatcaagaaaaggaatcaccaagggagcaagattcacaatccatggtcagctaacaattgcacaaggaatactatatgcttgctgctcactatcatccaatcttgtaacgagcactcttgttcgttccctatagattggacagctttgatttacccactactgcactttacttggctattcctagtatccaaatccagcttcatcgccactattcgtagcatcaacatgcatggacttaaacaatttcagaaagaacaaaaaaacatcgactaacctcccgaatctaggatgtgaactgtaaatttctgaggaaatttttgtacgattaggaaattcaagttcagatctaaagacattggctgacctctccggtgtttaatcttgctgacgccggtgatagcgggcgccgtcctgatccgggcggtggccggcttcgtcttcgtcttcgtctcagccggcgggaacagcacggcgtcaatgccctgcactgagatcctgccgtcggcgaagatgtccgggtcgaagagatacgccgagccctcgccatggccaaacttgactgagccgtcggcctcgcgcgccaccaccttgtgcggcagccgcagcgtgtcgtagcgcaccttgccgaaccgccgcaccgcgttgtacatgctctcctcggtctggtactccgggatcatgtggtagtacaggatgttctccggcgagccgggctcgctgagctggtcggcggtgagccgcgccatggcctcgtcgttgggcgcgagcacggtgagcgcgtacccttcggagacgagctgggctaactcggtggcgagcgaggtgaggttgacgaagatgtcggcgagctcgttgtagccgccgtacttgagcagggtctgaatgaagtccttcacctggctgtcgccgtcgtagtggtcactgggctccgacgccagcgcgacggagggatcgggaacagtcgcgtcggagatcgggagcacaggagaatcgccgggtggcgccggcttcttgaggcgatccgtcctcggatccacctcgggcgcggccgtcggcggcatggcggagatgtcggcgaggctgcggcggcggttgaattcgtcctggacggagcgcggcacgaggaggcggtcgatcccgtggatgacgccatccgtcctgaccaccgcgtccgggcgcgagacggcggcgtgggcgacgcgcatgccgccgccgccgtcggccgcggcgagctcaacatcctcgccggcgagcgtcgggtgggtggccgcggcgggccaggaaccggaggggaggcgggcggggaggacgtggaagaggagcagcgactggagcgagttgagattccgcggctcgagcaggaagcgcttgaactccgggtcgatgtcccgctccagcgcctcgttccgcggcgcgaggatggtgacgttgtgctcggcgacggcgtcctccagcgcctggagcagcagggccttctccaccagctccgccatctccgtgtagcgcgagtccagcaacgccaccagcaccgagtttgacacgatccctcctcccacggcgccggcgccggcagctttgcccgcaccagcacgagcgccgttgccattaccgtcgatggcgacgtcggctgagggcaatgtgggacgttccaccggcgccgtctccgcggccgcacgggcaacgaggagaacgaagaagcacacgagtgcgccacaaaccggcgcgcccatcgctgcggcctgcggccacttctctcctgcgcgaattgcttgtgctgctgctaccgcgccctcgtcggcgagggatccttctgcggcactactactccggcgatggactcggggaaggagaagggagtagcaaagtaaatggagtagtggaggtggggttgtcgtgccagcgtcgtgcgcccgcgccgccgcgcagtgcgcacacaaggtcggcacgccgtaagcgaggaaaggcaaggcctcgccgcagggatcgcgggaacgccgccggtttcgttttggcccccgccatgcctgcgttgccagcactccagcacagcaccgactcgactcacactgggggcgcctagtttcccgcaggaagaagacgacgcgttgtttggtttcctgcagaaaaccgtgggccgactctagcaaggccctgagagaggcatgcatagctggctccagcccaagaatgtgggcctcatatgcagcccaatgtttagcttgcaggacagcttatgtgcttagaatattgagctcactattgttaaggattaatccctccgtcccatgatataaggaattttgagtggatataacacatcctagtacaataaatctgaacagacgacctgttcagattcattatattaggatgtgtcacatccatccaaaatcccttgtattatgggatggagtatctactaaattctgagaataaatttagtattttaaaaacaaacttaacaaatatcttagaacaattagtctaaacaatacagtagaaatggaattttgagaaaatgtattttttgaagagtggagcaaataactgaaagttttctgatatcagaaattaccccagcaaagttgtatcagataaactaagggtgagattatgagtgtgaagattgagtactcacaagtcaagcgacgaactgatgactcatgacgcccttggtgcactacatttatagggatatcaacaagaatttcacaaccgacattctttatgttgcaatttacagcgattatgatttcataacaaccttgcatatatattacacaaggtaaaaaaatgtaaaggttcatccgcaagcacaagtcttatgtcccgcgatctggatgcaaatgcttcagcgaacttcctgaagcacacagacctaccaaagatcatgaagcatcgctggatctcaggtggctccgaacaaacggcgtttctctctggacctgatccaagtgaatttgacagcggtttcagaaactactaaaggaaaatgtttcttgtgacattttgccaccccaaaaccttaaaaattttaaagctttctcgtgcacaagaagagcatatatacctgtcttcacagtgtatccaattcttcaacgaacatggagtgggctcattgagagccagatcctgacgcacaagtcgtggaagaagtttcatttacaacagcagcatggttgggggataccgtcctttgattatttgcgtctgaaggagagcaagcactagctgcaggaacagcagatggtccagtatcgtcctttgtttctagccgttccatcatgcgagataccgcagcaatcccagcgttgacctccctccttacttcagtgccaagacctgatatagtgttactccgagaaaaccatctttccttccatccacgcgtactctttgttatagaatctttatacctggcattgtaaagaatgcccacaagtaagacactgatgcatacgttcaatgtgtaaggcattttcaggagtttgagatattacttcatcgaagctgactgtaggcgagatctcagcgtgtcagagaatgactgcaaatcagatggtcctgctgtatcttgattgacaggtgcagattgattttcagatgtcctgattaacatcaagatacaaagagagtaaacctcttgaatttggataggaatagcatgcaaatatataccgtaagttgtaggaaatacctgctcattgctctctcatcatgcagagatggatttgaagcaccctggtcagaatgacccacgtatagctgcgaaccaccactcatatgtccttggtctacagcagcaagagcagcaaaaggatgagcagaacctaagtcagaagattgttcatggtcttcatcttggcctgaacttgcatgcagggagccaccaggaatagcctcattccttgaaaacaccacgatttgtgggcggctatgagatccagatcggctacgatgtccatctcttctaccatgtctgtgtgacctacgcattgcagcagcagcagccaagtgttgtataatgcgctcctcaagttcagcatcatcagctcctacagggacctgaaatcagaaaacggtacatcaatatagttgtatgaattaagcctacctccagggtgcaaagaggaatcatcgcaaatatccaaatgatagcaataaaacgtgctgcacctcaaaatcacccaatactggatggtgaaaaacagcggcagtgttcaaacggttagctcgaatgttcctctcttgctcaacagcctcaagtagttcttggctgcacagttcaaatataaaatgagaaccactaaattggttcactagggagatacacaggatgcaagttctacctcataggatccttcatgctgataggctgccaacacatgggacactgagagcttctctggcacctagatatcaaacagtgagaagcacacatcaaaaattaatattgtcgaggacagtacagtattttgacaaattttcactacatatcgattggatattgactttatatacagcattatccttgatcacatgagctcaccctcaaaatcgttcgtattcataaaaagaaagcatgagaatatattatatcctccatttcagattgatcgcacataaattatttttttgtacatctctagtatctgcaagctcgtatagaataaatatttagaatatgtccccatcagtccataatagacaccagaagggcaacgatagttttatgagcatactgcagaagaactgcacgctcacaactactacgacaaagctatcgttctagactgcttgcacagatgaaggaaatcttccagctgggcagctcagaagccttacaacccctgccccacctgatggaggctggtattgctgaaataatgaaagtctgtggatcatatgctccttaatggcttattgagtctcatatgctggagaatttctgtatggttattcactgcttaaagtgcaggtgatcatcattaaccttcatatacaagtcgatcatggttgaagagcattgcgatgcctaacacatgatctgtttctggaatgtaagatcccattttcgtcttataaatcatgtggtagttccactttactgacagcatttcagcacgacaacaagcatagattcaaatagtgtaagcagataatcaccatcaccttaaaaacaaatattttttgcaaccctagcaaattagatgtagttcccacagcacagttaaattgaaccatcgatgtgtagtcacaattgccagacaaacactaacttcctttatcaccttgcagctaaaagcacggccgtttattttactttatctaggtggaaaagaagatacagaaacaaaacaaacaatcagggattgcatcatataaaactgaggtacacaagcaaactagtcatggtgatatcggatagtttgctttgtggaaacaagagcaaccttaaatttagaataaattatgcaatatgcatgattcaattaccgtaatttacatctatatcgattgcaatgcatcaccagctccacaaagaagtacagaaaaagaaaaataccacacaacaatatcgttccaataggccagaaaggaaacattaccattcaagaatgcactgcagatggtactcatgcttgcaactcgtcacctgcaagagaaaacgccaacatccacaccaagaaaacaaatgagcgactcgatcacaatcatatcgaatccaaaattttcgcctcggcggatgcagaccgtggaggggtcgttgtcgcagaaggcctcgaggcagatgctgcaggcgtcgtcgcaggcgtcctgcacacctccctccacgaacgccgccgcggaggacagcttgctctccatcttcaccttctcatccatctccgtacagcccaaccgattcgattagcccttcccgcgcaagattcctacgcctgatgaccaaagaaaaaacgaattctatgagcaaaaaattccacggattaagccaaaccaagccaatcaacgatcgaaacaggagtctcttgctcaataatccccccatccacgatacgaaatccaccgaaatgaccataaacacaccacgaaatcgccccgcccccatgtccccaatccaaccaaaacgatacggataaatcaaaagaaaaacaccaaaaaaaactatccagaaaggaaaggcggatggattgcgaggctaccttatcccgattgctcaaggggaatttcaggattcggccggattaatcagcgaactccccgcggaattgttccgcctcggcggcgaaggcgagacgacgacgacgacgacgacgaggggaggaggagacggagtcgggaaggctttctcttaataaaaaaaaatacagataaaagaaaatcctaaataaaaatcccccctcccgctctctcccttcccctcacgccaatgacgggtggggccggagagcggtgggtcccccttatctagtgaggctattgcgggggtgtgggggcattggcgcgttgctaaaatcgaccggcgcgcgtagggggagggggagtgggtgcgcacgaaacgtcccactgcggcgtgggccccactcgcgatttcgggggcccacctgcgagtgagacgtgcatttcggggcccctcccctcgcctcgggttccgagatattatttttagacccgcatttcggtcaagggtgcgataaatgcgtgtgtaagagcaagttcaataatatagtcaattactagctccaatttatctatagtcaatctaatagcttattcatacaatatttacatactacactattaatatttggtcccacatgtcataaacatattgtgtcttagagtctatgctacagctggctacaaatctgtagcccgctgctcttctctctccttatttatctccttaaaatatgtttacagctggcttatagcctactattgtacctgctctatgggcctccaatggctgatcgtctcgtctcaaagaaagtacggtgtcgtccaaacgtctgaccaagaattggcgttcaagatcaaacaggggttgatgagcagagtggttggaaaactttgcgataagttttacttttccggttcgatccgttcatgtacacaaagtggcccacgtctataattgtattttaaattaataaaaaatagtgagaattgtgagatcattaatatatcattgttgtttttctttcatttaagcgtgtgttaagaaaagtattcaagtgatacatgtgtgatattgtgtacttcttccgtccaaaaaaaatgaatgatatgacattgtaatgcaacgtatctgaacaaaggtacgtccaaattcgtagtattagaatatgtcaaatccagtattatattgattttttatgggactgagagagaaaatatgcccatcttcagtttgataaaagaaaacgatgatggctagagctcttaaaaaatactactaccaaaacatgattgggtacgagtaaatgtggtgagcatgatttaatctatgacatactactaattgttgattaaaatatactctctctttttttagttagtgttacatgtcacatgttatactggatttatttattcgagaatagagagagtgagtgttatttatgacgagaacaatatttgtgttttatttttacggagtagcgtatctactacttcaaagacttagtacagttagtacaattatgtgatacatctactttgcatcaacacttatataaagttacagacaatagtcataaattgtggttagtgcctctaatcacaaaaggttaaatgtagtgcgtatttgtcgacggaagctgaaatcactataaagtgcgaactcatttttacgatgttatgcctaccagacacaaatgccttcgtacaacaaacacatgcttcatccaattgatttggaaagcttgagcgccgggagaatgtaagtcctatacatgactaatcatctagaatagggtcttgaacctcggactgcctgacgacgagagggtggcaaaacaatatacattgtcctctctgacgtaaagaaaacgaaacaaccctctatctcctggtgggaagctatagaaaatgtacaagcttggtggaaaaaccttacaaacatgacatgtgtgccaaagtagggattgcgctccctaatccttctcgtcgtctgggagatacagaagaagtggaaccaacgaatttttgagcacaacgagagcatgacaatcaccctcctagcaaaaattaaggaagaagccaaaatttaaccctaggaggagctaaaccacagttaattcctaagagcgtataatctgtaaagacgggcttttcccttctttttttttttcgttaccaggggtgtatttttttcctctctatctaacgaaagataaagcacaatctcacgctgtctccttttaaaaaacactttctttacgctgttcattggctgtagcgggtagaattcgcaaggaatatgaattaaatttggttataaatgaacgtacttttgtaatcacaacaaagggtccatagctcagtggtagagcaattgactgcagatcaataggtcaccggttcgaacccggttgggcccttatttatttatttttttaaaaaactgaattgggttgctatttaagaccgaatataatttatttgaattggataactgtttttgaagaccgaattattcatttcattttaaaaaaactgaattggattactgtttttgaagactgaattatttatttcatttttaaaactgaaatggattattgtttttgaagaccgaattggattaatactgctacataatttcacatttttaaaatttgttggaaaaacaactgaattggattattgtttttgaagaccgaaatggattagtactcctacattatttcacattttttaaaaacatttgaaaattgaattggatcaatactcctgctttaattttaccaatgcttttgagttgactcctacaatcatttatcggtgacccttttgagtggtcaggaaacatcttttgagttttgatacatgatcctgaaaaggatgcctcttgattttatttttttttgacgtaaaggtaaaaagcctttgagttttcacttttcatacataaaatatgatcctaaaaaataattttgttttttcttccttttgcacaattgcctttatttatctttaaaatagcgagatatgtaacgaaaggaatcacataaccttccaacagaaggagctttcagctacctcccttttatccaagatcaaggaagaggccaaaacttgggccttagcaggaggcgagaagtgttaatagctggctttttttagttagctcggaccaaaggtcctagctattttttttcctttcgctttataaagttctcattctctattcaatgaaattggcgctcgtcgattcattaaaaaaaaatagcgagacaaaactgtaagaaggtatcagcgctacgcaccatccaccaaatccaccactcggtttcaccacacaaatagtctttttggatgcttggttgcttttaacttccctgtcaatgtcgtgaaaaattcagcaccagccggcggcggcggtggcagcaacagtaaacggccggcacgccgccggcacaagacgcagccggcaacatgaaacttcaaacaatcgtcatcatcaagatcaattaatttggtctcttccattcttcttacatacaccaatagaccggacaaaattaacggagaagattcgtttcattggtcagacctatagtacaaagcctattcttacacgcatgacaacagctaaaactgctaaccaattaaacaagaagaataaaatgtaacaaattaactggaattctactcaggaacgctgatgccttcctgtcgctgtggtcttcagacttcaggttgggaaaggagcagcaagaaacgaaccttgcctgctctcatgtgctttccctacttacaaatgcatatacaaagaagatgagctacagcgtattttgccaatgaagatgggctacaaagatggactccatacttaatggaggcaagtcaaaaattgctgcattgttcggtctattgacagttaactgtgagattgaagcctaggaaatgttgatgctcaggcatgtggtagctttgcttgagagatccaaaacttagcttgcggtgcgatggtagtttgacatcgtgatattctgatgttgggttatagccattgtctgaaatggcaacttcacttagcagcacctgtaaagaaaccagaacaaccagtgagtttacactatcttaatgagcgtgttcaatcagttaccctgatgagaatgaccaaagttctaacagaagatcgtggtgatttttctcattcagagcatgcatgatccaaatcaggagttactttaaactgcattacataagtactgcaaatgtttttttttttactagctactacaaatgttttagtttagaagaagcgcaaaagtttgttttcaggcctatttcacaaaatttgaagttttgggctactgcagatggtactctatagaggaaattcttattttaaattcacaattaccgtcataagtagttcgttgcccaatttttatcataagataaatgattatagactgaaacaaataatcctggttccaagtaaggcaaccgaaatcatacacttttgaaagaatatctaatattgtcaaaggataggaaagaaaaggtagagaaaacaacaattaccttttaccgaagttttagcgcttccccgaggccaaagtttccggtactatgctgacccattttacccattgcattatttcccttctgcatcatttcgacaaactcattgtagtcgatccgtccatcctgcacaaatgatagtcaaatgagacaaaattgttgtttgtcaatttatcatgaaatacttagcattttctactcacattgtcctgatcaatgtctccaataatatcctcaatacgggtatcacctataccgaattcctcacatgccttttgaagctcatcttgagtaatgtaaccgctgccatctttatcaaagtatgagaaagctgcaaacagcttatcctccttctctactttgtttatatgcaaagttgcagcaatgaattctccataatcaattgttccgctgttgtcaatatctgcctgacatattcaagaaaaggagcttcatttgagaaacaatccaaaagtccagtggatattcatcataaatgtaaagcgacactgatatccaaacttcccagaatgttccgcatttaggaaacagttaatcctcctcactacaagctattttcactcaacaaaattaccatatattacaaatgctgataaaaattcaacatgaagcaagctcacgtttcaaaaaagaagtgtatgccagtactttcgtggtcaacactttacaaccaagaaaaggagccggtgggtacttgtaaaaattgattaaaaaaacttaataaaatggaaatttgtttgcaagatacaattacagatcagaacaaaatcttgtttactaatttcagtataaatgatgaatagatgcgcagaaaccttcttagaatacttactgcctccattagagcatcaatttccgagtccatcaaattagcaccaactctctgcaagcctgtttttagttcttccagtgtaatatgaccgctgttgtcagtgtctagcattttgaacatctcttttaatcctgcaatttcttcttctgataaactctcagcaataacctgcagtcacataccagttcatattaaaacatcaacatgaaagcagcctatatattactaattagaaaaatatgctgctcaccctaagcgccattttctttagtttgttcattgcagaaaattgttttaaccgactcaagacagcggaatcaagaggcttgtcaggagcaactccatcaacacagacccaaggatgacctagaaaataattggataaatttggttggaagtaaaactagatgactagcaacaaattatttacaaatcattgcatacttccaaactactcacatagggcttcatgggcagtcaatctcttttttggatcacgaataagcatttttctgaccaaatcctttgcgctctctgagatattaggccaaggctcagatgagaagtccagatcacctttcaaaacttgttcaaatatcccttgctcactttctgctccagaagccaatttatcaattgcattagtattgcaaatattacaaggaaaatatatttcactaaaatacatatgatctcaccatcccaaaatggaggaaccccactcaacaaaatgtagattatcacaccagcactccagacgtcaacctcacgaccataatgtttcataagaacctcaggtgcaacatagtacgggcttccaacaacatccgtaaatgtctcacctgtcaaagcatttttttttccaattaatatgacacatgaagaatggtatttataattacatgtgcggcatatacaggattatgtcaaacacatagtacctcccatgcttggttgtctatagctactttaagactgtcattttgggccaacatatagacggttctgtttcatattttatatagctaggagtttgtgtaagcggagctagaaatataaacctgtggggtcaattactaatagcttgtatttaagagatgtcaattttctaacttttttggatttatacatgaaaatcaggggtattttttaaaaagctgtgaggtcagctgtccccacagcttgtacatacatccgccagttcacatatagctgtggagaaaatttgacttaaatatccaggtgtaagctctcaacttcacgtatatatgctcatgagtattagttggcacctaaaaaattaagttctggagcaatttttatgagcaaaccacaatgacatggtctacctacaatcaacgtcaacaatcagtaagatatactctaattggcaccagattgtttaggacttagcatcgagactataacaaatgtgtgcaatgaggtgcacaacaagattaacccatggaaatggaactaatccccacagccatctcaaagtataaatacattttttaaaaaatcttctgattagattaatcatagcaccaatgctaatgctatcatcacatatacagtctcccattttgcagtcaccacaaatgctcacattattattaaagtctgaaactaaagtatatatttttgcagaaaattgcattgttaagagtcccagaagggggagggcgccatacctggcttgaagaagatggagaggccgaaatcgatggccttgagaggcgaatcctccttctggtggatgaagaggaaattctccggcttgagatccctgtgcatcacgccgagggagtggcacgcctcgatgacgccgacgatcacccgcgcgagctgcgccgcggccttctcggagtaatgccccctctggatgatcctgtcgaacagctccccgccggcgcagagctccatgacgagctgcaccgcgacggcgtcctcgtaggccccgacgatggagacgacgttggcgtggcccgcgaggtggtgcatgatctggatctcgcggcgcacgtcctcgacgtcctcctgcgtgagcagcttcctcttggcgatggacttgcaggcgaactcccgacctgtggccttctcgacgcagaggtaggtggtgccgaactgcccctgccctagcttcttcccgatcgtgtatagatccttgaggcgggcggtgttgacgtcgcgcttgaggacggaatcggcgagcagcccggcgctctggacgcgcttgaccttgggcgccgccttgttcgccggctgctccgcggcggaggtgggggtcgacgggtcggtggagcgggaggagtggtgggaggagtgctccgatggggggattgtgacgggctcgggcgcctggtcggacggcgcggaggagggcggcgggagggcggggggagccgcgtcggcgggcctgggtcgccagagggcgacgttggcgaagaacccgttctggccggcggcgctggggccgacgcagttgttgcccatcgccggcgggatgcccctaccctacgcggacgacggcggcggcggctgcggctgcggcggcggtggcattggagacgggcggtggaggggcggcgcgcgacgaggccggcgggcgcttggttggttgggtggatcggaggaagacagagaggagagcgaggaaggaccttcctgggaccaaatgaggtgggccccctggaacggaccctctatcactgacgtgtgggccatcctcccgtgtggggcaacttgtcagtgggtgatgagggatagcggtgaggcgacggcgcgggatgcggatcgggtttctgcgcgccaaatcggacggtctggatcgcccggtttacttgtgcaggcccgaatttggaatgcctttgtgtattactttgggctttggcccatttacataggacttccatagttcccttccattggagcatgagattgtttggtttcaatgcaaaactttatcgattttgttatatctcactcgaaagatttcttcttatctctcacttgattttctcactcaaatttacagtgtgttttcttgtaaattatagtgtaatttatgaaatttacagtgtaacttttgtaagttacagtgtaatttttgaatctttgcatgtaagttttgaaatatatattagatttggtttttttcttgaagatatggtaatttagtgtccattatggtgttttttagttgcttttttgcattttactgtgcccattagattttaatctaaagattaaaaatctgtgtgatatgatcataaaaatctttcgaaagatgcataggtactcccaaactttattactagatttttttattacgcagaaaatatatgcgcacacatatgtttgtgtccaccactccacccccctaacacaaccgaagagtgaagtaccttgatgtcactagattcctatgaagtatcgtgtgtgcacaatatttatgggcttttctgttagaggaacttttgggttgcgttttctcctttgaatccaaagctccataaacttttttttttcagattatgagaagttgtgattgtagaataaaaaataaactaggaaagaaaaattggtttttacaacttctccatattctcaccagttgaattcctacccatgtttctcgtaatctaaagctcctccaaacaaaaatcatgcactcacaactccactctctacattaacattctggatgagattattgggcctgtttggcaattggcacaggagctccagctccacctcttctgtaactgaagctcagccaaacagtttcatctctacctaaaataagagcggagttaggtagagtgctcttacaaaataaactaaagagttgaagctgaatttagactttagacagttccgcaactccactctagactcaactcctgaaactaaatttagaagttggagctctaccacaaacatgctaggagtagtgttgctctaccatgcatgtttcttcacagccgacgagtgtagcaatcctacgcggtacacaaagcctttcacgagaaaccgtagtgacacgcaaaattcttgtgttcaaaacggtggttgcattgcagggtcaaaggctcatgcgtcatggcgaccacgatgcctgcttaaacaaatccgtgaatcgtcaacttagttttaaccccgagtagaattcaactgctttgattttgattttgacggtgcaatcagatcccgagtactgtactactgtatgcatccctcgtttataggggcgccgtatttcatttggccgcgtaatcaatgcgtttcctactctgaaagtctgaatttctcaaggactgaaaacgaacagaggcatttctactcgtcagttgacctgctccttcaacttcaaacaggcctggtaaaatggtactagtagtacatggtgttctcgatcttccagttaattaattaagaaacatcaaaattcatgttacatgatgtcactaattaagaaacttaaacggtcttactggtacatatatatggatatcggatgtcatgatcttctcgacctcccgattaattaagagacgatacgtcgacggtggactcaactgtgccgtggaaatatatgcagtcccatagtcgaattctgctcggattgaagtcgtacgtaattaagcccttgaattttgtcaaattgagtggttagttaggacaagcagctagccaaatcgatcaacaggacgcctttttcagcttcatatcccaagtgggattgcaattggggttctaggttaaatttccaagtaaacgatcaatcaaaggacgtgcagagaattcagagtcttagctagggattcttgtggtcggcttgggttctttctgaagaactgtcagagattgaagataaaattaaaccagagctatatctgaacactcgattaaaagttcattcttgtcccgttcaaacaatggagaaaagttcattcttgtcgctgcaaacttgcaaccccacagcttgagattaccacattacgcatcagacaaaagtgtttgacatcgtagtaaagtatagctaggtaggtttggcgtttgaacgccttgactgatcaactgtggacgcgagctgataatccataccgatttggtcaacgttgggctgcagccgaaagtaatactagttatcatcaagccaataagtgaaaactatcgctaaccacttctaacctaccttggcttgccttccaaatggaagtgtgtaacgcgtctgactttttcgctagctaactaataatcgtaatcgatcgaaaaaaaaagtcagcagtcatgaatctgccgtacttgaccgacgacttttgacattgtattgctactatatccatgtctttgctactagtagcatgtgaaagtgtttgctactctctatctataaaagcattgtgcaaagtgcaatccattatagttgtcaaagcattgcaactttacaagaagctactctttactcgtagcgagttgagcaaggagagctaggtagctgccatgaccatgacagtggccatgccgtcgtcgtcgtcgtcgaggagaggtgggctgcgagggccgaggccgctgccgctgaaggtgtcgtcgtcgtcgtcgagggggtcgtcgccgtcgtcgtcggcgtcaaagggggcatccaagaagtcggcggcggcgccggtgatcgtgtacgagcacacgcccaaggtggtgcacgcgcggccgcaggagttcatgaccgtcgtgcagcggctgacgggcaagccaccggcggcgccgccggtgatgatgccggcgtacgacgcgccggcgatggtcgagcagggcgcggcggcagcatgcggcgccggcggcgacccgctgctcctcaccctcggccagcgccaggccgcggcgtcggcgccggcgcagcctccggcggtgccgtcgccgatgatggccgccggcatgctgctgtcgccgggcttcgtcttctccccgaacaccatgcagtccatccaggagctcagccccttgttctaaatcaaaccgtgagttcacgtagaattcatctagaatgtacgatggtataattgtatagtgcacagctcacagcagattaaactgaagggagagtgtaagccagttaattatccgtgctgttcgtgcaaaattttgcaagcgaaattgaaattttgcacgcacagcggtttgcatggtggtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1931 - DNA, 753 bp, Oryza sativa
tgttgagcctaaaacccgcaaaagttgttaaaaaactttcagtcctcattgactaagccaagaaatcaaacagggcaatgatacatcaagtaagcaaattgaattgataaaaatcacactccattattattatagtagccccctgactgaaaacttcaaggaaaaacttgaagttagcagtcaaagaggagagatacaaacgaaatgcctaagcgtaaaatcgacgaaggtgttcaatattccaagaattgttgataagagtaccgtcttcgcgcttgagtcgataggaacccggccgagtgacttcagcaattatgaacggtccttcccataagggagataatttatgccgatcctgtattgtttgaattttcctcataaccaggtcaccgactaaaaaggctcgcgatcgaacattccgattatgataacggcgcaacccttgcaaatatcgagtcgactgaattaaagctgcttctcgggcttcttctagtcgattgatgtcgtctactcggccctcttcatagccctcctcgttgaagttccgaaatcgtagcgattcaaattccacttcactcggcaacattgcttctgcaccgtaaaccaaaaagaacggcgactggccggtagcccgactaggagtagtgcgtaaagaccagagtacggacgacagctgatctacccacttaccagcatagggacgtagccggtcaaaaactcgtgctttgatcccttgaagtatcatgccgttag

SEQ ID NO: 1932 - DNA, 634 bp, Oryza sativa
ggatcccccatgattgtaaagagttgacacttaattcaataataataaggtgttgtgttcaaaagtccaaattttgataacaatagatgtgttaatttataaaaaccaattgattcatccttcctccgctttctggaatcacgtctcttcttgtttctatcttcctttagctcttttgtcaataatgggtacctctctctagcacacttcctttttagttcagccgtactgggattagtaacatcttcatgcatgttgggtgtaccgtacgacagttcagctttgtctgtgcatggtagccgcacatgcctaatgacagaagcgttattttcatagcctgcaccgcaaaatcagaatgctgatgttagcctaaaacaaatatctcatatattaaaaaaataaagccaatataagtatgataccaaatccaatagttgaggttctctgaatcttatatgtagagttcttgttgatctgttgacagttctcacggtcttttggaacattgatttcacttgggataaccgcgcggcacgcttgtttgtcaacttggcattaatcacattagttatattcacaaaaggacctaaaggaagagtgtatgtaaaactaggaagcaaaaatatatcaattg

SEQ ID NO: 1933 - DNA, 688 bp, Oryza sativa
tggaatgcgggcgctgggggatgggggatggggaggaaggaggatgaaggcggcggcgtctggacgatggatcggtgaccgctgttgatacggagggtatcgaggaggaagaaggatcaaaggcaccgctcgggagagaggggaacgcgtgcgcgtctgcactcggcaggatcagagcattgcggaagcgatctgagccattggatttcacgatcctacgtttagtattacgcgtgtctatcaggattggagtcaccgctaccactacggaatttttaagtagcagagattacgaatctcaactctaattgcgattgccactaaatattaggggtataaacggagcggatattatccgatccgctccgaatccgtccgatgtaaggatatggtaagggtttttagtatccggccggatacggatgcggattttgtcatgcggatatggtatcaatgatatccgatggatgcggattatccgatattttaatcggattatccgatgtactgtttggcggataattcacaactttcaggccacacaacaactttcagacccatctagcccatctattataaccctaacctaattcactcctcccccagatccctctctctctctgccgtcagccctcagccgtcacgaggtcgaggagtctgagagtggcggcgcgacgggacccagcat

SEQ ID NO: 1934 - DNA, 667 bp, Oryza sativa
gatctaggaaattaaagcagtctaattctaacttgtataagttgccttcaataacaggttaatgttagtgaaagcatttggcaggagctggaggaagaaataatcccatcatcatctattgttagaactaactggcttgaaaaatctcctgacttgagaaaatacaaggattcctgtgtttgtgttgtgggaggtaatacatcttcaatatccataaatctgctcctaagtggatcaacttaacttcatctgaattttcctggagttaagctgctttcagctggaaaccagcaaaatggcaaagtaaatccaacattattagcaatggactcatggggcatatctagcgcagcttgagtgtaattgtggaagctttccacgtggaccactcgatgagatgaacagactagtttgggtgactcgtatcccctttgtcggttggaaatattaattccaagcatccatgcccatgcatttcgactttcgagagatacaaatatatatgctatatgatgtagagttaaaacaagcaataatattgattaaaactaaaaattagatacactatttcataaggcacaatcaattacatatgcacatgtgcaaagaatgtaatgtttcctaagaaatggatattgcaaagaacacttatgtctacatttatgca

SEQ ID NO: 1935 - DNA, 618 bp, Oryza sativa
atgcaaactgttgatagcccaacaacaggatacttctgctctcctcccacaagttcaaaactttgagttgttcagaccgtttgtcagctttggaggagtagaagtcatacaaaggaatatcatcaacttgccaatgaagaaattcggttctccatgttgatagaattccctttgggagaataatcaatggccttccagcagggtatttggctaggaagctgtggacaaaactaattatcaaaaaagtcttcccagaacctggtgcatgtgccagaatacagccaccagggttgttctcatctgccaagttcttgaccaggaaattgaaaccttccacttggtgaggtttcatatgctgtgaatgttgagggtggaggcatagagcatcagggaccacttcgagaatagctcctgaagttttgtcaattgcatctgcatcactagaatttctgtgttctgagggacgtgctctgtacgattgcttccgctgacacatgtaacagataatgagaaatatttttgaacaaaaagaaggaatgtagaaggaacataatgtagaaggaggctaggcaaggagctattagtttaagagtagcaaaatgatttccatgtgcattt

SEQ ID NO: 1936 - DNA, 6863 bp, Oryza sativa
ttggtcgcacggctggaggtccctttatcaccacgagctatgattatgatgctccacttgatgaatatggtgagttacaaggaatatgcttagagacgttttctgtattgagcatgatttataagtgcccttatcaatattatcatcttctgctgctgttatttctctacactatgagcatatttgcagcttttcaagcattaagagtggatcttttttaaaaaaataaaattcagctacaccactatattcttcttactcaatccttttcttgtggggctaatacacaggacttgcaagggaaccaaagtttgggcaccttaaagaactccatagagctgttaagttatgtgagcagcctttggtttctgccgatccaactgtgactacccttggaagtatgcaagaggtctgttgtgattaccctttcctctcagtgaagtatatatatcttaaccagcttgatgtttcatttacatattgaatttatacttcaggcccatgtgttccgatcttcctctggctgtgcagctttccttgcaaactacaattctaactcgtatgccaaagttatcttcaacaatgaaaattacagccttccaccttggtcaatcagcatccttcctgattgcaaaaatgttgtttttaacactgcaacagtaagtttggcatatgcttatcccattatagcatggtttcaattctgtatcccttttacctggatcaagtatatgatgactttgcttacctgattcaaactgttgtaatctccacaggttggtgttcagacaaatcaaatgcaaatgtgggcagacggggcttcttcaatgatgtgggagaagtatgatgaggaggttgattcattggcagctgctccattgctcacgtcaactggtctacttgagcagcttaatgtcacaagagacaccagtgattacctctggtacattacgaggtaatgccagtcgataagttgcactttgcacgtaaaaattgcaatgtacataacgatgaatctgggaaatggtgactattagaaccccttgttcgctgaactttgcattgattttctgattatggcaattgagaaggtgtcctttgttctaaattttagttttcacagaagtaacgattttctaaaattatttcatcaccattgacagtgtggaggtagacccatctgagaagtttctacaaggtggcacgcctctgtcactcactgtgcagtctgctggccatgcgctgcatgtcttcatcaatgggcaactccaaggtttctacttgaaaatgctccccagtctatagagtattaatgtagtaaaaacttagtgaacaaaataacccgcaaaagaagtaatgaataaaatgattataattcccttttgtaggttctgcctatggaaccagggaagatcggaaaatctcatatagtggcaatgctaaccttcgtgctggtacaaacaaagttgcactgttgagtgttgcttgtggactgccggttcgtgctctcatctctgcatgaatttgtacatgtttacagcaaatgatcaattgtatgagttggatttttcttgtcctgctatatagaatgtcggagtgcattatgagacgtggaacactggtgttgttggtcctgttgtgattcacgggttggacgaaggttcaagagatctgacttggcagacttggtcctatcaggtatattcagcatactggtagcctggtgcgagttaacgtaagaatgaataaacatgtgacttcttccattccaggttggcctgaaaggtgaacagatgaatctaaactccttagaaggctcaggctcagttgaatggatgcaaggatcattggtagcacaaaaccaacaaccgttggcatggtatagggtatggacaattaaccttgccataatcatttgatgattacttgcctcccattcttacgatagtttgtttttgtaggcatactttgatactcccagtggtgacgagccactggctctggatatgggcagcatgggtaagggtcaaatatggataaatgggcaaagcattggacggtactggacagcatatgcggaaggtgactgcaaaggttgccattacactgggtcatacagggcacccaagtgtcaggcaggttgtggtcagcctacacagcgctggtaagaacattcacaacaatatttgaattttctggcacctcttgccttctcttttgctgtacacaaaaccatcatgtactacttgatatttggttccttttcccttgtccattaaaactggagtgctccatcacatccctttttggttctattgtctagtcagtggagtactatattaacaataaaaattgaactcttgcattcaggtatcatgtgccaagatcctggttgcaaccaactagaaatctgctagtggtttttgaggaacttggcggtgattcttcaaagattgcccttgcgaagcggacagtctcaggtgtctgtgctgatgtatctgaatatcatccaaatatcaagaactggcagatcgagagctatggggaaccagagttccacacggcaaaggtgcatttaaaatgtgcacctgggcagaccatttctgcaatcaaatttgctagctttgggacacctcttggaacttgcggaacattccagcaaggggagtgccattcaattaactcaaactctgttcttgaaaaggtgagaacgctgtttggtcattttggtctacctgaaatttttttcttaaaataatgtggactacctgcacctggacagaaagacccttcgcagcaaattaaccctgttcaaaccacttgaattttttatcattttgcaaagaaactataatcactgcaattagtccatgaacttaccacacatatcactgattttttctggtgcttatttgaatagaaatgcattggactacaaagatgtgtcgtcgcaatctctcccagcaactttggtggagatccctgcccggaggtgatgaaaagggtggcggttgaggcggtatgctctaccgctgcatagggcaatttctttgccgagacgaatttagagatggcaccaaacaggtgggcttgtgcttgatcaaagcacacagaaagcgatgcagagtagagttcaactgtaaagtatcgacgccacatagctgtggctggaggattagagatcgattctagcattcactcagtcgaatttcagattagaggattctaactctactgcatctccatgaattgttcagagtgaccaactgctaattgaagttggtcctgggatggagtgcagggagagtaaaggcaaaagattggtgcattcttttgctcgcgttagtgtgcgtgttgtgttgtttcatctttcttgaaaggaagaaagatgccgatgaattgtgcatgtatcccatatgaggaatcgttgattgtgcagtgagcatgatatgctgcagaacaattgctcgtgtcatattctgaagttcagaaaagaggttgtcaatttatcttcttcagataaaccatataattcttgtgatgaggcctgagggagatttatgccacagacatatgccgcactagaaaacaatttaatcgttttaaggtaggaaagataccattgttgttttttcctccccaaagtattttttgtctgaaagtatgaaatgtggatgatgtattcagatagcatagggtaccttgtcaccaactgagctcaataattgaacttgcatttctggcaatgaaaatgggggagttttccctttcacaacagtaaaaaaaacggagaacaattgagctcaatctggccggcagcgtgctaggcatgatgcttgcggctcaatgactgacaaaacattatcctgaatgaaattgtggaccttgccccttccggaactgatgaccacatgaattattaacagttgagaacataggggcatgaatgcagcaatagctcccaacagtaatgaaacaagtagtaataattttgcatctcatatatgggacaccccccggtgcacattcagaaacgaacaaatgattgtgctaaagaaatactgccacagccaaaccgacattcacgcggccaaaaaaaagagagaagaagatgcagagtaaccacaagacattcattcagctctgaacaacaatatattagtgctaaaatggaagagcaaacaaatgcagcgtaaacaacaatcagcaagcaactgtctctctctgattaactgatctgataaaggtctagaaccataaactaggggtttagaaaacgtatcctgtcagtcagaaaagcagatgtcgcgcgtcccgttgcgcgcagcaaatctgcagcgcaggggcaatccaataataaaaggagcttcctttttgacgatgtgctccccctacccttcgacctcgcctgtcggctgactgggatgcggctaccgacgcccgcccgatctcctgaatgttttttcgaggttatttcgtcatgaatttgctctccaatctgagtgatatggtatccaaaatcagtgcagaatggcatggcaaatccacggcttcgacgacgccagcgaatgttgcatgttattgatgcataagggcattagggcagcacatttggcatctggaactggtcgaccgagctagattgaaatgtcgttgtttgtgcagtgagcatagcatcggttcgttggattgcatactgcaagtctgcgatgacggtgcatttcaacggccaatgtcagctgcgataggattcaacggctgcttgcatccatctcagatggtttcgatagagaagcactgtatcgtctcgaatttgagtgatggtacccaaaaaaacgatgaagaaaatcttatgtggtaatctttgttgctgctctacctccatgttgccacgacaagtcgaaaacaagcgagaaaacaagggggacggagaattgaactccgaccccctaccgtcgcgaatcatgtgctgcctttcctttcgtcttcgcgcgtctgttttgggccgtttcacggacaacggcatgtcaaatccacggcctttctcgtgctcgtgccaaggcctccaggcgttacacgctcgtcatcggcccaagcagcaagccaccggcccaccgctcctctttccctacttcgccgagcccaagcgccgccgtcttcgacgacgccaacaaacgccgcagaaaacgagatttggggcctgttcactttgttgcaaaaaaaaaaaaaaccttaccaaattttaacaatgtcaaaattttgacaggatttcttatatagttatcaaaatttaacagcaaactaaatgtagctacttttttgataactttaccaaaatttggtaaggttgaaaatgacatcaaaatgaaaagggccttgaagtgagagatgtacctccaaacaatttttaatagaaaattgtgagtgtgtttaggattgatcacgggatcttggagttgaaagatcatgggcagcacagcacagtatcggttcattggattgcacactgcaaacctgtgatgagtgcgcatcatcaatggccaatgaccaggatgactggtgtagtagtaccacgtcttgcatctcagatatgtctgatgtctctaattcgctcgaaacaaatgtagaaatcttaggtgcacaatggtgatgattcctgttgcagctagccagcgatcttaccgttgccttgaaaaataacgataatattgagaaaacagggggttcggagaactaaactccgaacaccacccgcgccgtgtatttgggccgtctcacgaagatgtcattgcaaaatggaataagttcacttttactcctttaaaagttgtcttaatctaatccatgatcctaactgtaaaaccggatatctccacccccgaactactgaaaccggtgcaatttaactcccttggtggttttaaatggcggtttcgctgatgtggcgtctatgtgatagtgttgacctagtctgtggcattgacgtggagtttaggtggcattagagttaaaaacatatatgtgggacccatttatcattcacacaaacaaaattatagggcccactgacatgtggaccctacatgtcatcctctctctcttcttcctccctctctttcccttctctctctccacttcggccttctgcaagaggcgatggcggcagcggcagcgacggcggcggtggcgcgagggtaggcgctggaggcactggagcggtggcggcgacggacggggaccggagtggcggcggcgcttcgggctagagttggcgtggatggaggcggaggcggcgacagaggagatggcaggcggtcgagggccggagcgacggcgggtcggcggagagcctggcggccggtggtggctagcggggagagagctagtggcgaaggccgcccccatcttcctccctcctcgccgggctccgcacgcacctgccccgatcggtggagcggattacgcggttgggtccgtaccacgggctgccaaaggcggacggcttgggcttcgcggcggacttacggatggtgatgcgggcctcgccgaagagggatgtggacgccgcgcgaccattactgcggaggagagcgccgtggcgagtgagtgagcatctgagttgctccacggctctggggtctacgccggcggctgtggtggcacggcggcgggtggccatggcgagttgttcgggccttgcctgcctgccgccgctcccgcccgccgatgcacggctttccgtcggggcccagctcccttgacccttgatgccgtcgcctgttgccgcccgccgctgtgcgcccttcgttgccatcgagccgctaccctcgtctctgtcggatgaaggtgaatagaaaggggag

SEQ ID NO: 1937 - DNA, 2537 bp, Oryza sativa
aggaaaccaccctccaaaatcacccggagagtcaaattgcaccggttttaacactttagggtcaagatttttggttttgtgattcaggatcacggattagattttagttacttttaaggaaatccaagtgaacttctccttgcaaaatccacggccttccgctcggtcgggtccatgcgcacacccgcgcgtcgtcgtcggcccaaccaaacaccccaaaaaaccaccgaaatctcacgaggcggcaacgcatcaaccccagtgcccgtgtgcggccgtgccccgcgcccgcgcggctgtgccgtggcgggctcgcggcacggcacggtgacgcgcgaccgtacgtgcagccactcgctcgacacggctgcctgcctgcccacctccaagtacatttaacgtcacctccatcctcacacatggactgtcctcccacctgtctcccgccatcgtctcgccgccgcttctccctctccctctctctctactcatcatgtgtgcggatgcgtcgcccatgcatccatcgccaaaattattggtcacctgatgaccgattctctcctgtgatttcagtgcagtttcagcgagatcgatctacctttccgggacgcctccatgcctgtggcttggttgacgatcaaagcgtgtgcgtgccgacgctttatggaaagtacgagatcttgatagcaaagcgcagagagagaaaaaagttgggaaaaaaaagggggaagaggacgatgctggatgacggaataaagatgcaattctcgattagattagatggatagagtgatagatagatagatagattgatagatactattgttttttgtctctctctcggacactcttggcctacctacctcctgttcatcatcagtcgggagaggcaaaagctacgaaagccatctgtccccagctaagctctgcttttgcaaactgcaattgcaatcgcagtgtagtgtggagtgtgtgctctgcctgtcttgtagccataggcacacaagaatgtggttgttgatctggatcgcaaggcctgatcgtatcggagtaacggaatgtgacatcaaaaggcgacgacgcatagaaaaatatctcgccgtctgattttttttttactttacctttgcatcttctcttctctgtcccatcctgctcatatttcaccacctcgtgcagactggaactgaattctgtatagatcctgcatgataaagagttcagtttgtatatgctgctcatgaactaagccgtacctgtacgtacgcaaccggatcaatcatagaatttaagttccaagtgatcacaatatcagttgctacctcgggatgcagtcttgcaggctccattggtactttatgctactatatagatagatgcctagatggtcaatgtttatctgccaattctaccaccatctgaatgtatatatatacaatcagccagaataaatagttgtggcacatgaacaaacaatcattggcaactgatgtgaacgatgatgatccacagatcgaacagctgctggaacccggttggctatctccactagtagcaacttccacaaggctgcttcggcgaaaaagaaaagaagaagtcagaaaaagacgacaagagaaacaacccaactgcaaggtgatgaccatctagacagacagggttaggtagtgcgcttgctcagcagctaaaatgttaatggcatcatcacccgtgcgcgtttcacgtgacttgacatggaaaattcttctttatcccccgttcggtagagaaccattttctgaacgcatttcctttttgttcttgtcctcatttaaagattacaacgtgcagtttttaatttcaatatcaattaaattgttaataagaggtgcatatgctccttgttaatcccaatccgtccttaacaatgttgatctgggttagttgcatcgtgattacctccgtaattttcctaaaattattggaccttttgtctgaactcagctgtcgttcatctagcgtgaaactgccacttgttcgtcaggtagctcctctcttctcttcttcctatcctatctttccgtttgattttgacagccttgtgttcgcatgcagcgatgattggccacattcagactcttgccaattgtcctgaacagcgttctcttctatggactggtcttgaacagtctctgaaagtagcagaagtttattctctattatcctacagtatctcagatgaaaaataatcattagaaacttctgttggttataggacaccacaccgttctaacagtgtagcagaagagattggcgaatcatgtatcgacacggcgaattaagatagtcccaatcacctaattccagtgacgatccaacagaattgaggtcagcttgataaagaaaagtaaagtggacaaggtgagtgtaatcacagaaacgtaagtacatgaggaccctgatgcaattgcgttgggtggcacaggccgatcgatctgaatgagtctgaaacttcttcggtcctttttcttttgagggaaacaggagaggagacccct

SEQ ID NO: 1938 - DNA, 4989 bp, Oryza sativa
  unsure (1)..(4989): unsure at all n locations
ggcgaatggaacaacataagcactggtgtgtcaacagattgctggagcgtagcaaccacagccttgaacctttggttcaggccttcctgcttagactgtcaaagacaatcaaaacaaagtctttccagcagctatacgcaaaaccagttgatatgacagaggagggaatcggcatgatgctgctgtttgacggctgcttcattctgcatttcttgctgaggcatgacccgaacaaaggtgcggagcatgaatactggacaaagctggatgctgggcttctcgatcatgagtacgagacactccagtgggagagaccctgggaatggagcctggtcgccatcgacatgctcctgctagagaaccaaatacctttcgtcgctgtcaggatcctgtttgacattctgaagacggagcatgacaaagctgttgacctgacggcatgcgcgaggaacatgttcaacaagtacctgccagctggaatgtgcacatcaacacgcccaatccgctgccaggacgtgcgctgccttctgcagctgctctaccggtcactccttccaaatccaaagctacacagtgatctgatgaagacaccaccaaagccaccaagaaccggcattgatcctgccaagaagcttgacaccgatggggttcgcatcaccaggaggcagcaatggtattggtggccgttgagccatttccaggagcccttcaccttccttgacatcgtcttcagccatggcaaggtgcggatccctcagctggaggtcagcgatgccagcatccagctgctgcagaacctgatcgcgttcgagaaatgctaccagggcaccacgtcccatgtggccaactacgctgccttcatggacgctctgaattcggatcaccatgacacggaattgctgcgtaagaggagtatcttcgacgtccagttcacccctgcccagcctgagctctccctgagaaggcggtgcaagcaggacgtcgatccgtcgtcggagaactacctcagccggatgatggtggacgtagtcctgtacaaggaggcgagggccagcaggaagaagacgcagacgccgatatcggacaccgcgttcttcgcggtgctggctgtgacggcgtatgttttgctggccttctgttggtacatcgtttcttgatgatactatgaaagtggatggtggttttctaacttttgctgttgttacgttctgttggctgttaagcgggtcctttgctccttcacgaaacaagatagtaccaatgttgtgcgaaattgtggattgtcacgcatctgttgaagaggacttgattggaggtggagggacagagaatctgcacagtttcgctgtgttatctttgtaaacagaaagaggatgtttcagagatttcagtatggtgtagcctttgccaatctgactccacaatgggtcatttgggatcagtaaggtcctttggggaaagcaccagtggtgtatgatggatggtgtatgactccaaccattaaaatatttaaccttggtttctatagatattacatacatgtaaacatgctttcaataaaaaaaaaatagcaagtttaaggtgtgcgtctgctgtgtaatggaaaaaaagttttttcttgcgggtaaaaaaatggttatttgggatcagtaattgagaaaatgagctgtttagatactccataggaatttgcaggattttaaaaggagagatgactgaaacatggcggcttgcttccaatcaaataattaaggcaaaccaacagtgttcctaaaatctccatattcaaacaagtgctcaaagaccctatttagaggaggttaagattctgagaaacagtttgtgagaagcttctagtttattttctagattctacatctacagcttctcagaatctgagtgaaaatccttactgtttgggaagcttctagcagtaacagcttataagtgaaaatctttactgtttaggaagcttctagcagtagcagctaataggagaatttccagcagcagaacctccgcaaacaggcccaaagcctcaaactattcaccatcgtccggaatgacgccttcagtcatacaggctttacagctccactcttcgaatacgtaaagtggcaaatacgccttcgatcggaaaaaggaatcaaacaagctcatcgtctccactctccacacatcatcgccttcgcttctcctctctccgccccacactgtcggaagtcggaagcaaagcggcggcaccgcgcgagagaggcatggcgacgaccgcgaccctccccttctcctgctcctccaccctccaaaccctaacccgcaccatccccctccgcctccgcctccaccgccgccgcttcctccaccacctcccctccctcgctgccctcccgaggctcccgctcccgcgacctccccttctcccccacgcgcgccgncacgttttggcgtccgcggcgcccaacggcgcgtcctccgagggggagtacgactacgacctcttcaccatcggcgccgggagcgcggggttcgggcctcgcgcttcgcttccacgctctacggcgcccgcgccgccgtctgcgagatgcctttcgccaccgtcgcctcggacgacctcggtggagtcggcggcacgtaagtggacgcttctcttgctactatatagactagtctattagttcatcacattttccccttgattcgtaggaaggttagcaacttagcatcgttggcttttggctttacttttttgcatgcaccgtaattggagcgcttccttgtgatttgtgaatgactagccaggaatcatttccaattttgtcgcgggttccatctttgctgatgttttgttctgtgatgtttttgtgataggaatggcttcgctaactcatttttgttactacattctagagaatttttgtggttgggtacattgttactcactatcatatactgcatttgaacggggtacttttgagtgagaacatcctcacgggctgttatctcagtggtgtttgctcattttaggggttagaggcacaaatctggtggggaatgtgtgtttccagtgatatgcacttgtttgttattattagtacttttaagtaatttacatttgcaccatttgttgcctttaccgctctcaccaagtttcaaggttttatatggtttcttattcagtattattgaagaaattgtttgaatgtatacaacgcaatgactccaatgcacgatttgcgctgctataccggcataatgtggcttatttcagtatttactgggatttacaatttgaatcattatgaataccagagctaaacccatgcgttttaatgaccctgtacaatataagccaatagatttccaataatatgtaagcagtttggcataacataccagcatatgaagcataaaagatgggcatgcttttaatagctaccaccttgctgtaataccagtgcctagaaggatatgcatatgcataagaactgttatttgtttttgtcacagatgtgtgcttcgtgggtgtgttccaaagaaattattagtgtatggatccaagtactctcatgagtttgaagagtctcatggctttgggtgggtgtatgaaactgatccaaagcatgactggaacactctgattgccaacaaaaatacagagctgcagcgccttgttggcatttacaagaatattttaaacaactcaggagttactctaattgaaggccgtggaaaggttgggtgatgttcgtaaatcaagttaaactttgaatagactgtttccctaaacaaatactatggtaaggtgcagctgttgatgtaactttgtttacttagtacagatagttgatccacatactgtaagtgtagatggaaagctctacactgctaggaacatacttatagctgttggtgggcgaccatcgatgccaaatatcccaggaatagagcatgttatagattctgatgctgcactggatctaccttcaaaacctgagaaaattgcaatagtgggaggtggatatattgctctggagtttgctggaattttcaatggcttaaaaagtgaggtacatgtgtttattcggcagaagaaagttttaagagggtttgatgaagaggtgagcaaatattgggaacaacaaaatcatattcacagtagatgaagtgatctgttcactggagttatttttgtcggttgtggatttgcaggtcagagatttcatcgctgaacagatgtctctaaggggcatcacatttcatactgaacagagtcctcaagctataaccaaatcaaatgatggtttgctatctctgaagacaaacaaagaaactattggtgggttctcacatgttatgttcgcaacaggtcgtaaaccaaacacaaaggtctgcaccatatgcgccttttgttttcactttgttagatcttgcatctccatttgttgatgcatccatcctttgttgctgatgttgttctttaacttgtagaaccttggactagaggaggttggggtgaaattggacaagaacggagcaataatggtaggttaagcaatcaatcaagtgatacttgacttcgagtttctcagctttgcgactctttaacatgttgagcttctgcactgtatttatgtttgctaggttgatgagtattctcgaacctcagttgattcaatttgggcagtgggagatgttactgatagggtcaacctgacaccagttgcacttatggaaggtggtgcatttgcaaaaacagtgtttggtgatgaacctaccaaaccagattacaggtatgtaggatatccctatcaagaatacctcagttacatcgcatgtttgagggaatgtttgttgttgctgtacagtgtacacttgagctgcatatttttgacagtgaacgggtatctctgttgcatttcattagagaactttgttacttggtcacatcctaatgtataatttgcaggagatgggcttgaatagcttgat

SEQ ID NO: 1939 - DNA, 12442 bp, Oryza sativa
ccctgtttatattgtgcttacatgttatcccttctgcattccaggtagaatctaaagataaggttgttactcagaactagtacagataggaggtaagtacagtccatttacactggcacttgctcttggtctttgcaatgcacatttgatcgtggagcaatgatagtattgtccataacttgtttacttcacaataatatcttgttcccactgcccagtatagttcaaatgtagtgttgatttatggttgtttcacatgccaagatgtagcaaaattcagtcaagtgacatctttgactaattgaatggcttctatcccctctctccccctctttttgctggaattctatctacttgtttgaatactgaatattttgttgttaatgtgggaggatatttcggacctatatttatttgctttgttaggcagaatcacataagttcaaatctgtattcagatatctttcattgtaagcatccacggaatgtgcattggttcagcgtcatcataatctcttatctagcttatgttgcaggcattctcagagggacttctctacttccgagcagctgatttacactgggcggacaatttttttttgtagcggtatccacggaaaggaaacccatgacaggaagccagcaaacttgtatcatagcgctgactggcattctctgatcccctttttgcatctattgtagcttgaacacggtgatacactattagctgctgttttccttctcttggttgaaataagtgctgcaccatgtgagtaccacagcctggaaattttgtaagaaaaaaaagaaatattattttggtagtacaactcagcctaatctgaattttacatcatatctgtgctagcatttcctaatatgttgaaattttgcagcaaaagatgcatatttctttttgagttattttctgtctgtatgatgatatgcccgtttgctggaagttactggcgattaggggtgcgagtccaccagcttgtgccgtcccctttttactcgatggggcaattaggggggcaattatgcctggtttttttttgaatggataaaaaccgattggaggtggggaccccccagggggaccccaaaccaaattcaatgactcaagccttccggggggggtgaagccaacctgtttcattttttaactaaataaagtagagatagagatgcagatttagggggcttttaactatttgccactcttacgagtggtgcttaacgatttgccactagacctacatgtcatagacacatgagggcccacatgtcataaacacggtgtggcaaatcgttaattgccatgtcacaagagtggcaaatagttaaatttcctcagatttagagcaagtacaatagctgattataacttagctataaacatatatcgagaagataaaagaatagagagaagagcaacgggctacatatttatagccatctgcagcacgaactgcaagacgcaatgtgtgtatgacaggtgagaccagatatcaatagtgtagtatatgtttatacgtaactattggctattaaattgactataaatgatttggagctagtatttggctacactattaaacttgctcttataaagtagcatggattcagagttccagacacgctagggtaccagtataaaacattatcaaggtctctacatccagaatgccacaggattctcaagcatttcactactaactccttgaggaatgtttttgtactctcgaaattggcggctattgccagtcgtaagttctccattcttaccatacatcatagaaaatgtcaccaattgaataaacggcaccgagactgagtgatccaggcagcactccacgacgcagaatttgcttccaccacccatgctaacgagggtgacacccgtgaccaactcatgatcagacacagtagtagctagttcctccctggtgtatttcaccgcctggccattctcgcaatcgtcagatatcacatccattgagcatatgcgccaactggtggtggtgccaggttttctgctgagcccaacccaggcgtccaactcagcgatgaagtaagcacgaccggagaacggcagctgccactggccatggttcttccacatacaaccattcctcacagactccgctgtgtcaaagctaaaggtggcagaggactcaccgccaatgctgacaaagatagttcgcccatccctgtgcacagcgtaggaggtgacatgctcatgctggaatggaggattaggaagagcgtgccacccccatacaaagtcctcctcctcctcttgatcatcagactcgtcatctggcggcgggtagagcagctgaaatgaaccgacagagagagcaaagagccttccaccaacagggatgtagatggggtcaactggatccggcctttgccgagggccaaccaccaggctccgcatgcgaacgtcatagatagggataccagccatgggattgaagctgaactggggatccacgggctgcattgccaaaatcttggagtcaaaggcaccagcaaagtacttgggaccagcacggggtgcctcgaaactgaatatggccggtggcatgctgtgctccccatcaccgtcattgccaaccgacaaatcgatcttgcgaatgctgtatccccgtgaccagtcatcaagtacaagataaaggtgtcgccgcttttcgttggggaagtagtttcccttccaccccaacataatgctccaaccaccctgaaattcgaaaccaagtcacaaaaagattcaattcctctttcatggtccaacttaaaccggaaaaagcatacgatgagcggtaaaataaggattaatccatctccaatcctacctctaccttaaatcggaaaagcataatacccgacaaaactaattgcggaaaaagaaccaatccaccacaatcccacgcctacaacttatagccaaatccattcccaatagcatgtatgcacctacatgaacttaaatcatcctagtattgtgtagtggtgctatatttttagaatcggtagccaaggggtttttattctattttggatgaggtagtacctactgtatgacgtgctagaatctactagtagtctatgattttgggatgtttttagttaaacttgtttaaagggagctgggggttttatcccatcactttacggctttattttcaagtactaaaatttattggttgtgtgtcttatagcagagatcggagatgtaaattatttttattatctaaaaaatatgagcttagatcgacaagtcttcatatgagaatcagaatcaggggcaataaaagaaaaaggagcaaagcaaatcacatgtatgcacctcgagcagatgaacgttgagagagacgcgacgagcaagtaaaaggcggcggagacgaaggaggtgggatcgagacagagggatcggtgggcattaatatgggccgttgggttcttacagtttctcgatttaacttgcactaggagactactaggaatcggagtaggatgataaaattacccttcctacgccacgccttatgcaaagaaatatccggagaatcacagccgtcccaacttggatttgtggctgagatttaatctaacgctcaactgcggtaaatcctagagaggcacgccgacgccgagtttaccagcagacgacgagccggagcgctcgggggagcggcggcggcatccggtgcgctcggagatctgaggaagcgccggccgcgggcggcggcggcggcaggtggcgtgttttggtccagcgagcgcgatgtgccgcgggcgagcgaggagcagcggcgccatggtttgggtcctcacgcctgcgaccgcagaggagcggcgccccggcgagtgggcgcgagccccagggtagtccggtgagcagcggcgacctcaccctcacccatggatggtggaacggatggggatggcggttttttgagatccgcgtcatcagctagataggtggcgacatcacaggttagtcaaaaaaaaaaaaaaaactgcatctgacaacgttatttaggctgtgttcgtttgtgtgagatagggtgagaaaacacgttttccgcgcacactccccaaactactaaacgatgcgtttttttaaaaattttctatagtaaaatatatgcgctaatggcttatctcattttgcgtatcttcccaatcttctcaatcccctatctctcaaactcacccttagttcctgctattaaggagtcaagatctgccgcggagagaggcacggctaactcactatttttgtattccatttcatgcatgcagagcgagagagagagagagagagagccacagccaatttcataggatagctctctgttcttgcattggttttgcttccctctgcgccttgggtgataacaaggatctctttctattgccctgtgattctttctttcatcgtcgtttgatattccccacaccactcttttctctctgttcttttctgtttgggtttgatcgcttgctcgttgagaacctctgcacgattcccgtgtcacaagcaggtaatttgtaatccctcctgtcttctcttgttaattcgaacctatataatctgaataaatcaagttacgttcaatttcgaagatgatacttcatggttactttgatatgcggtgtcatttcaattgattggtggtgttgagtgtatggtattttcttaattggtatggggattgaccattgatgatagtgacaatgatttacatgctgtcatgttacagtaatagcaataatggtttaaattagccatgcataatcacattgagtttagttttagtcccacccctctccagattctctattcatctccctgtatattctgtttgtacaatgtcctctcttccatacttttgggaagtgattttttaaattcaattcttgcgtttctctatgaaattctcctgttgcatccattttcgttgccaattagttgcagcgccatgatggagatctttccaaaatttcctggggcaatgttaaggtgccaagctccttactgccaaatgccaaggaagggaggatgcacgaaattagtgctgatccgtatctatttctgtaatgtggactgtacatattatgtactcatatttaggatttcatatgacaagaatatcaccatctgtaggacgacctccatactagtttagtgactgtatagtgatcttcatgcttgtttagttcaaagtaatgctgaactcaacatgatctgtctgcgtgatgagcatgacaatgttaaccttaaaaaaaaaagcatgacaatgttgttaaaagaaggaagtaacaaataggctcttctgctggcctgaccgttgctttattttgtctgaacatgctacacattataattgatagtacttatcatatgacctttaatttccaacctctactgaactttattacctatgttgctttcattttacagttgaatcatgactgctcagccaaagaagaggagtgtaatagaaagtggagatggaggtcttggtcttggccttgctttatttatctcaaatggtgaagatttgggccctatcattcggcatggatttgattctggtaaacctgaagctctcatgcaaaacctcaggagtattgtaaagaaaaaggaagttgagatcgaagagctttgtagacttcattacgaggatttcatcctggccgtcgatgaactacgtggtgtgttggttgatgctgatgagctaaagggcatgctaactggtgagaacatacacctgcaaaaggtttctagtgccacattgttgaatcttgatgagctttttgagttatattcgattaagaaaaacataggagaagccataacaacgttgaagatatgtgtgaaagtcatcagtttatgcatggcatgcaatggttatattgcagaagctaagtttcatcctgcgcttaagactctcgacacgatcgagaagggctacttgaaaaatattcctttgaaacttctgaagaaggtagttgcaaaacatataccattgataaagatgcacattgagaagaaagtttgcagtgagtttaatgattggcttgttcatatcagaaggatggctaagcagattggacaggtctcaataagtcaggcctctatggctcgacaaaaagatgaggaaatgcgtgcccggaagagagaggctgaagcacatagtgatgctagatctgatgagcatgtgtacaccttggatgtggagaatacagatgaggaatcaacactaaattttgatctcacgccagtgtaccgggcacatcacatgcacatatgccttggtattggggagaagtttcgagattattactacaagaataggctaatgcagctcaacttggacatgcaaatctccacctctcaacccttccttgagtcccatcaacccttacttgctcaggtagctggatttttcattgtagaacaacgtgtacttcgaagtgctgatggtttgttgtctgaaagccaagttgaatcaacatgggagactgctattgctaagatcacatctatactggaggatcaatttgctcgcatgagtatagccagccacctcctcctcgttaaagattatgtcactttgttaggcacaactgttagtaagtatggctatcaaatcgcacaattgattcaagtcattgcgaaatacaaagacaaataccaccagttgcttcttattgagagtcgaaagcagatagatgatatccttgctaatgactcatatgagcagatgattataaagaaggaatatgagtataacatgaatgtcacggcattccattttgaacctgatgatgtagtcccggagtttccatatgtggctccattttcctctggtgttccagatatttgtcgtatcgtccggtccttcattggggattctgtcagctatttttcttacagtgctcgcacaaacatctatgaaattgtgaagggttacctagacaggctattgattgaggtgttaaatgatagtcttctgaacatggtttatgctcgctcgttagccatgtcacagatgatgcaacttgcaggaaatatttctgttcttgagcaatcctgcgatatgttcctcttgtattctgctcaactgtgtggcattccaaagcgtattgcgcagagatctcattccggtttgactgcaaaagctgtcttaaaagcctcccagaatgcagcatataactctttgataaatttggccaatttcaagattgatgaatttatggtgctcttggacgatgtcaactggatagtggaggaagccccagataatccaaatgaatatatgaatgaggtccttatctatcttgaaacgctagtatcaacagcgcaggagattttaccgctagaagctctatacaagatggtttctggtgcaatgagccacatctcggactctatcatgacaacacttcttaacgaaggcgtgaaaaggttcactgtcaatgcagttatgggccttgacattgacttgaaattactggaggcattcgcggaagagaaattttataggaccggtttggtggatttgggtaaggaaacaacattcgccgattgtttggttgaaataaggcagctagtcaatctcctccttagcagccagccagagaatttcatgaatccagtgataagggggaggaactatgggtcattagactacaagaaggttgccatcgtttgtgacaagtacaaggattttgcagatgggttgtttggaagcctttcaaaccgcaacaagcaggatgctcgcaagaggtccatggatgttctgaagagaaggctgaaggattttagctgattaaggttaggaatgtttgcctttgtaaataaattgtcattgcgctgctgaaaatgtcctttggaaactgccagtgtcagaccttccacctcaatttctaaacagacatatgaataggtcaagtttttaatcttcagtcttgattagtactatagtttgaattgctattttccagtcgtgttcttcttctggtcgaacacctacagcacaggtgtcaataacaggttttatatgccaccgtcaatctttttaaatttgataacctgacttgatattttcttctttttttttcttttgtctcaaatgcatcttccaaagtgacataaagatcatgttactagtatttctgtgctgcttaacgtaaaagcctgctaacctgcatcaagaacatgggattccatagaattctaatcatgctgtaacaaagtgttgacatctgcaaaatctcctggagtcctggtaagcggccaacgtgctgttggtgttggacgtctgaatggaccgctgaaacaaatacgccgtggtggatctgccaggtgtactccaaatttcagcctctcctttcaagtttcaaccctgcgaccttgatcgtttcggttttcaggtcccttggccattcgttgcactatactcttccatcccacaaagaaacgtttatatgcattgcaccgtttgactgaccaccttattttaaaaaatatggaaaaattgaagaagataaatcaaacattttcatgttttatcatttaataataataaaaatactaatcataaaaattttcaaataagacagtgtcaaaacattatatactacatctgtcccaaaataagtgcaaccatagatattcgtgcccaacgtttgaccgcccgtcttatttgaaatttttgtgaaaaaattaaaaatatttagtcacacataaagtactattcatattttatcatctaatagcaataaaaatactaatcatagaaaaaaaaattaaataggacgaacggtcaaacgttgtatgtgaatagtgcaaaactgcatttattttattttaggacggaggagggagtaaaaactaaaaaaaaagtatttttcttaatgggacagagcgagcaggagtagtggtcgtgccgtgccgtgcgtacttgcgatctgctactcctcgaaccaaattaatcaacacacgagcacccgtttgttccaagaacgtagccgaaacacgtcgctttgcaatcatcccggctaattccggtgaagctgcggtgcttgatgcccatcttctccgcacgtatgtcgcctcagaattggcagagtttggtttgaacttttgaagtcgtttcgttttgtctctcgttccgttcttgccggtgaggaactatagggagcacaagtagaggtagaagcagtcgtgccctgctcgataggccaccgcgattcaaaatttcaattcacgcagcggcagtgactcgtcgtacgtgtagagtgcatcgatcaccaacaaacaccaaaaacctgtgactactcaagcctgtgctactgcttctacacggtagtcatgcattcgtactctcgcgagtctcgactgcagccatactttacaatttcatgcgaacgaaccaagctaattttactttgacttgatcagaacacttgaaaattatttctctatttttttttaaccaagcgatatactagtacatagtaaataatcaaaatgtagggattaatgatcaggtgcgtgtattagaaactgtatagtgtatagcataaatatccaaaaggtactactgtatacacaattttggaacggatgcagtatcacaatttacaaaccttagtacagtagtcagttcactcagttgcaggggtgaaaatagtacggaaactttccggattccagacctattttcgaaaacggaatctgacggttggtttttttttcagaaacggaaattaatttggaaatattttctcggaaaatgaatcgaaaatgataagggcagtttctgtcggaactcggaatcggtcggaaactttccagaaatttcctcggaatttccgaaaattttgtgactgaaataccctggattctttttttaagtactgaatagtgaataccatggtgtttggcttttattttttttaaaaaaatatttgttcaatgcaaatatgaagttgcataagaattttttttctgcattaggatttatcaacaacattactctcttaaatatagataatttatttcatagattgtgttttgtgatgtactgtttgagacttaacaattaaacttatatgattatgttttatgatgaattgttgaccgttgagacttgagaattggatttatcagtttgaggggttttttatttcgataaattttagtcaccgtattcgcgccgattcatttttgcttcgttttcggtttcgataatatttgattccgttttcgtatccggggttttcgattctgattccgaaaaaaatatgaaaacgaaaacgataaagatggtttcacttcgtttccgtaccgttttcatcccagttgtgcttcaatggtctgctgcctgcagccgtcaaattttaccgaaaggattagtaggcatgccaagactctgccaccatcaactatcatgtactgcttcaatttccaagcataaggttgctttgtgtgcctagctagctaggatttgtaatgacttggattaggtccattaaattttcacctgactgcaagtacttctcttgatcacggtcatttgtttgacacatctctcaatcatcactagatgaaaaatgaacaaatagtgtagtagtacttacatactggccggtcactgtttttgtctgaatttagattcctcaacgtaagtacagagtacgtagtaggagtatgtgaatagtcggtctaattccaaagactgcatattgaatctttcaaatcaaagtttattttattttattcaaagcatgtacgtctgaagtcaattctttcctggtctgaacattttggctcggctggagagtcaaaatgcctgaccagccaaattaattaacaagcctacggggcaacgggtgaaatagacatatgactcgcaaaaagatcgatgtacaatctttaattttatacattgatctttttctcattatgtttattcattattttagataataaaaattgtttacatctccggccacagccattagacacacaactattgagttctgataaaaaaatagagacataagtgatgggagaaaccccttaactccctctagaaaagtttcaactgaaaaaaaaaatccaaaatcacatacatttaagcacgacattggttgttactacgtcatctaaaagtgaaataaaagaattggctaacgatgattgagagataattggctaacgatgattgggcaacggtactgtatcgttacccaattcttttaatgtgaagaagttttacggtatggttttacagtacgatcgagtacttatgtgcgggataatctgctgtgaattaagggtgcgttgtttatagcttatggattatggattgttgaatgtatggttccgatactcctgaaataatacaattttattaaaaaaattcttgtgcggaatttcttattttttgtcaggttaattcgtcaaatttctaataatgaattaattcatttatataatgtgccgtactgaaacaattcaaattatataatgcattctgtggccacggctcgtatatgctgacctttttgatattgatgatcaagtccaacgtcaagccattacgtaacataaagactagacggccagcttgctggctgcgtgatatttgcatgttagatgcacacggataaactaataggttaactagttttgattaatattttctattataattacacagtacaacgcagacacttacaacacatgcacactcacccctataaacgcacgcatgcaaattctacccctatgagcatcttcaaagattgggacggcaaatcctggagattgacgaagttatcataggcgcctcgctgtcgacgggtatgtcgcctaccacgtcaactagttttgattaatatatcacaccgtacaattaataatccacatatatataaatttttggggtgagaattatagaatggcacaatagcaatagaatgataatatcaaaacgattatattatattgaaattatttaagttcatccaacattttatgataaaaaatgagtaaatttcacaaaacaatatattttgatcaacagtaaagatacattcttaataactgaattataaatttattaatacaaaatttatgacgaaattacatagatttagaatagagtatcgcaaaactatagttttatgatagatttagtgctaaatatgtaattttgggatagtatgtcttaaatctatagtttcgtgataagctcaataaatttatctgtagcttttcaatagtttagtcatactatttgtagttttgtaaagcatctcggatgtcgtacgtgatggacttgtgatgcgagtgtatggctccattcaccaagtttctaattttttatgcctacgttcacgcgcaggg

SEQ ID NO: 1940 - DNA, 25195 bp, Oryza sativa
  unsure (1)..(25195): unsure at all n locations
tttaaggaataattaataaaatacaaatgggtaggtaaggtggcacgatgagggtatttgcaaaaaataaattcgtgaccttagtaaacactcttttataagaagatattgatagtggcagtaaatctgcgtgggtgtacgtgtatgcagtggagtacataatagtgcgttgtttttcttctgatttaaaaaaagagaaaattgtgtgttgaaggagtgagaatcaaggagtaaaccatgcataaaagggaattgcgctgttgtattaagaatcaacaggaaaggtaaaatatataggagtagcatcttgtttcattgtgactccatgatcgatctatacgtacgtacaagtatatatcaagcatccaacatgactaattacagatttttaggacctagaggtagctagctagtagctgtcaggatcaccttaattattccaaatcaatcctaaactgactaaactactccatttctacatggatgaacagctagctttgcgaggctttccagcatttttgcatggatgaagctctctcacagataaaagaagaagaagaaaaagaataaatttaaccaataatgaacagttgatcaatgtctatgaagatctccaatcttcatgtctacatgttaacagctcgcacggcagctgcagctagcgatcgagcaaaaccggccgcgatccacccatggacgggacgatgcgcgttggccggccggcggcgcgccggcgcggctagttacggttggtggcagctggctccggagccgcctccgggaccttggtgacaaccattgccttccgaatccgacgtgcccttgtcaaggacctgcaagatgagctcgccggtggcgacgccgccctgcaggccctgcagccagctgctgccaaacaagtcaccttccagcagcctcgccgccatgatcgcgttgcagcattgcatcagcagcacggccaccaccaccaccctcaccatcgccgacgacgacgccatgatcgaattcagctgcagttactactgtactaagttactaactagatttgtttcagagatggcagacaagaattcaagctggctgcctacgtacgtgaaaatggatgaagaaattaatattgaagcttagctagctaggtttgttggaagagagacaggacgggggttggttatatatagagtttggtggtaaaaaggcggtgtgcaacaaaagtgaccgggtctattcttcatttcttcggcgccatgtaaaacaacgaactaatactactattattaagcttttgatttggcagtttcgcctcgcggaacaaaaagaaaaacgcggtttttttgagctagcgtgcgagcgggccgcggtctcgtttaattcaatttcctacgtttgacattgactacaagtactgtacgtatggccatttcaagggattttgagatacgatcaaccaacaaagccaggttacagtacgttgttcgtttgctaactacattctcatgaaggagtagttagttaaaatagtatcatcatgaactcgattgtttaacctccttgcctgcgtcagctcccgttcgttgtcggaccaaccgaccggcgtacgttcgacccgtacttcccgacttgcatgtactccctccgtttcaaaatatttaacaccggtgacttttagcacaaaattggccggttatcctaatccaaaacttacctttggtgaaaatattaaattataagcccaccttaaaatatactttaccatggatccaatgattaggaaaaaatttatatattgccttaatttttttgatataagccaagcgtgtcaaacatgtgttaaaaagtcaacggcgtcaaacatttcgaaacggagggagtaactaactacacgttttggctgatcgagacgatttcaatcgatcgatgagcaagagaggggggtattcaacgagagctatagtcagccgaactggactgactgatctagctagctgttgtatacgacgaagttaaataattacgcacacaatctcatcactgatcatccaatcgatatagagttagctggctagctgctacatatacttgaattatattgtgagctagagttagctagaactgtacttcaggttagttcatgcctgccgttgccggtctgtctgctcactactggagaaaccattattaaaaaccgggactaaaaataatttttaaatccaaatttataagagcaacatcactatttaattattagtgccgattggtaacaccaaccgggactaaagatgatcatctttagtcccggttcacacgttatcagggtttgtcagcaccccccccccttccccattgcagtgcgtttggccaaccgccaacctacatgaagcgcctataggtcgttaatttataactttcgagaaattgataaatgtttttaataaaaagaaattattagatgagattgatattgatattatcctcaatgatttccatcatatcaggaaatgttcgaagaaatttttaagataatgcttatgagttttggatataaatattacttttgattgcaaattaaatctgttcatctgtaatatggcataaatgcatacattggtaattatattgatagtggcagtaaatctgcctgggtgtatgcatgtggagtagtagtgtgttggagaccaacaggaaagataaaatacaaaggagtagcatctcttgtttaaaaaaacacgaatattagagaataatctaatatcagataaataaaagagatgaggctttaaatccaggttagctagcccaccatcttgtgaagctagctggaaaacccggccgtggacgtttctcaaagtatagcatctcttgtttcattgtgacttcatgacctatacaagtatcaagcattaaacatgactaattacatactttcaggacctagatgtcaggatcaccttaattattccaaatcaatcctaaattgactaattaaactactcatttctacatggatgaacagcagctagctttgcgaggctttccagcatttttgcatggatgaagctctcatagaagaaaaaaaaagaattaaaggaattcaaccaaatgaacagttgatcaatctctacgcagatctccaatcttcatcactactacatgttaacggctcgcacgccagctgcagctagcgatcgagcaaaaccggccgcgatccacccatggatgcgacagatgcgcgttggccggccggcgaggctagttacggttggtagcagttgcctccggagccgcctccgggaccttggtgacaaccattgcctcccggcggcgaccctcccttgagcacctgcaagatgagctcgccggcgacgccgccctgaccctgcagccagctgcccagatcaccttccagcagcctcgccgccatgatcgcgttgcagcactgcatcagcagcacggacaccaacaccaccctcaccattgccgacgacgacgccatgaatataattcagatgcagttactacaatactgtactaactagatttgtttcagagatggcagacaagaattcaagctggctgctgcctacgtgaattaaaatggctgaagaattgaagctagtagtaaggttgttggaagagagacaggattgggttggttatatatatagagtttggtggctgtgtatacatacgtacgttgaaagtaaaaaggtatgtgcaacaaaagtgaccggatctattcttcggcgccatgtaaaacaaccaactaattataatactactattaagcttttgatttgtcagtctcgatcgcctcgcggaacaaaaagaaaaacgcggtttcaattttttgagctagcgtgcgagcgggccgcggtctcgtttaattcaatttcctacgtttgacattgacaagaactgtagtagtagctcgtgccatttcaagggattttgagatacagtacgttgttcacttgcctactacattcccatgaaggagtagttcaaatatcatcacgaattcacgataatcaactcgatcgttgtttgacctccttttctgcgtcagctcatgtacgttgtcggaccaaccgaccggcgtacttcacggcttgcatgtaatcaactacacgttttggctgatcgagacggtttcaatcgacagatgagcaagagggcgtcgtattcaacgagctagctagtcacttagtcagccgccaatcgatatgatcgatcggaccgactggactggctccaaaaaaaaaacagtaaaggtctgaataaactaagataaatctatagctttctttcatatgtatatacaaaatttgtagtgaaaacttcatgaagaattccatggtgttattgtgagtagtgaatgctcgagtccccattgtactcatgctcttgatccgcctctgatctagttgttgtatatgcatgaattgtgagctagagttagagcaagtataatagagagctataagaaggctgaatactgaggtggatgagagaggagaggagagagatgagaagcggactataagtttacagccggcttaggcacaggaaccaagaaaatctgtgagacagacaggtggaccatatgtttacagtgaagagttaaccactatatgagtgagctgatagataggctataagtaagcagctggctatattattacccttgctcttagcaaacttcaggtgttgctctctgactgccgttgccggcccggccgctgcattggccaacctacctgaaacctaggtcgtttataataactttccgagaaagtgacggcgactttgatcgatcgatatcgtctgtgaaattcatatgttcattcgatcaaatcgatcacaccgtctacggccggacgtgcagtgcgtgcgtatagtaccggcaggtttaattagtttacgcgcatgcatcagtcacctgctgacttcaatccacatcaccaattcaccaccagactcacccatcgatctcaaattgaattagggcctcatcgtacgcttcaactgatgctaaattttaaactttaaactttaattatagagttcattttaggatatattttttaagatcgtcttttaagttgttaacaacatataaaagctttagccataatcttttccttgataagtcgctttgatatataattggttcttagccaaccgataaaggctgtgtttagatttaggggtgaaaagttttagcgtgtcacatcggatatatggatacatatttgaagtattaaatatagactaataacaaaacaaattacagattccgccgataaactgtgagacgaacttattaagcctaattaatccgtcattagcaaatatttattgtagcaccacattgtcagatcatggagcaattaggattaaaatatttgtctcgcaatttacacgtgatctgtgtaattagtttttttcctatgtttaatacttcatgcatgtgtctaaacattcaatgtgacatgctaaaaatttttacccgggaatctaaacatgcccaaagctattgttcattgcacagacttttaatatgacacatgccatagtagtgcttattagctcctaaatcttttgtattttaagacaaataaagtcaatagtaagggtagtgtgtgtgtgtgtgtgtgttttatatgtgtggtatggaagttttccgacagtaccgataccatattccgaaaaactaataatatttttatcgacggttaccattttcaaattttatttttcccaatttctataagcgtggcattgaagttgacactaaatagttcaattcataaatataaaaattttccaatcatttttgccagtttccgaaaaataataaaataatgatatcatactaaccatttccgactaacgtaacttccaacaatatgcctgcggtgcagccatatataataccataaaatttacccttcactacaacatcatgacagcattaatttcttccaacaataccgcaaacttcacaaatataaaagcgaatcacgctattgtattaaagggaaaaccaaaaggaaagtaaatttcttctaatgtgtcggacagtatccatgcacatgatcctcagattacacactttcaggacccagctagctatatatgtccctgacttaccttgttccaaatcagtacgcctaaattgactagactaaactacaagtctactgtctacaactatgaacagctttgcaaagctccacttttacatggaagctcttacagttaacatgggaaaaannaaaagaaaaatgccaagaaaaccttnggaananttcccaaggnnaattgggggcacaatctcacntatgcaggagctgagtatatatatatgtcgaacttaattagatcttcatgtacatgttaattaacgtcccgcgcgcctgcagcgaacgagcaaaaccggtccgggaatccatccatggcggccgaccggcgcgcacataagctgccgctcgccgaccgaccgccggcgcggcgaggctagttacggcgtccagcattttccggatccggagccgcctggattgggaccttggtggcaatcattgcctcccggcggcgaccctccattgtcaaggacctgcaagatgagctcgccggcggcgccgacctggccctgcagccagctgctgctaccaaataagtcaccttccagcagcctcgccgccatgatcgcgttgcagcactgcatcagcagcacggccaccaccaccaccctcaccgtcgccgacgacgacgacgaccacgccatgtatatatattcagctgcagtacgtacgtactactgtactagtagtagcaacctaactagagcttgattaattcggctgttgattcgatcaatcggctagattgtttaaattaattaattcggagtggcagacaagaatccaagctggctgcgtacgtacgtacgagaaaatggctgaagaactgaaactatagttgtttgtgtggttgtggggaggcaggatcgattggctggttatatatagagttttggtggctgtgtatatacgtgcaacagaagtgactgtccaggtcggtctattcttcagcgccatgtaaaacaacgaactagtgctacttttaggctttaatttgattgatatttgtctcagctcgcgcgcggaaaaacgcggtttgtttgagcgagcgggccgcggtcacgtacgcttaattaattcaatttcctacgtttgacattgacaagtctagtaagtattcaagatcattgatacgatcaaccaaagccaggctcgtacgcacatacgttgttgcttgttagctacgtaccgtgcccagctacattcccatcaaccaaatatatgacctccggactccggtccttgcctgcgatagctcccgttactggactaccgaccggcgtcttcacggtttgcatataactacgtgtaattatagcatttttgaccatttagctagttgcaaaaacttattataacaagaatagatcatgccaaaatatatcttcaaccaaaaacacgcgacattggtttcatcgagtatggcgcaggtccaaccagggttcccccaaaccgtttttgcggtggttaccgccaccccacggtttggccgtggttaccgccaccccacggtttggccgttactggccacggtaaacgtgcggttaccgtaagatgtaccgtggtttcaaaaactgagaagattactgcacgtgataatcgtgtggtaaccatacggttttgtaaaccttgggtccaacatgttagcgccacgttctttggtgcataggttttgccatgctagatctaggaattgagttcaacatccaccaggccgtgctcgcctgtctttccttgccctctcattttctatcacgagtcagccgactcaacttgccctcttttcctgtcccacccaactcatctcctctcctatgtcttcaagcttcggttctctcttgtagggagggaactctttgccaccttgttgccttataaactatttggaacaacggtagcaatgctactatacaatcacctctcatttatttttcaactaatcttacgccttttctcaatccatcctcatttaagattaaacttcggtgatattataaaaaattcacaggtatcaaataataccacaaagtttccatatataccttcccttagtaccatgtcaagatagcatttcttccaacaataccacaatatatatatatatatatatatatatatatatatatatatatatatatatattgtgttaaaagggaaaaccaaaaggaaagtaaggtacattccagcttataagcagcaacacaaatttgaatttgaaaacttaattttggagttgattaaagggttcttttattatagtttattttttagcctttgcttctaaattgcttaagaacacatatacaaaagtttttattgacaaattgttttttgggttgttgatgagtaatttgcagcttatatagtttatttataaattaatcagcatgtgtgaaacgatcactgtgtaaatctcttcttgtattgacaagtgtgtatgattcatatatacattgaggatcaacctagctagctatatgtcacggactagtacgctattacacaaatcaatacgcctaaattgactaacctaactacaactatgaacagctttgcaaagctccattttctgcatatgcatggaagctaactagctctacgtgtgcaggcgtatatatagaacaaataaatcgtatcaaatgaacagttgatcgatcgatctactctacgagcaaaaccgggccacgatccatatcgtccatggcggcgccggccggtgcgccggtggccggcgcggctacttaggcggctggtagcactggcctccggagccggcgccaccttggtggcaatcattgcctggtggtcccgatggcactaccttgagcacctgcaagatgagctcgccggcggcgacgccgtcctcgccctgcagccagctgctgccaaacaagtcgccttccagcagcctcgccgccatgatcgcgttgcagcattgcatcagcagcacgcccaccaccaccaccctcaccaccatcgccgacgacgacgccatgatcgaattcagctgcagttaattactactgtgtactaactactagatttaatttgtttcagagatatggcagacaagaattaaatcctcttaattttgctgcgtatatattactacgtgaaaatggatgaattggagaaggtagtagctagtgtatagtgcggtttgttggaagagagacaggatgggctggctatatatagagagcgagggaagagagtttggtgtgcaacgtaacgtacaaaagggaccgggtctattcgtcggcgctatgtaaaaggcgctacttttaagcctttttttattgtcatcctcgcctcgcggaaaaacgcggtttttttgagctagcgagcgagccgcggtcacgtttaattcaatcgtcgtatgtttgacattgacaagtacaaataccattcattcaagataatattcatacgtacgatcaaaataaaaccatgtgtgtccatgttcgtacgcatgtatacgtacgtactcgttagtaatctttttttttaattgtgtgcatctcagttatatgtagaacaaatatatcatctagatgtaatttaatgagtttaataaaatagtaactttgcctgcgcgagctatagctctcgttgttggaccaatccaccgatcgaccccggccgtatacttcccggcttgcatataacttacgtcgatctcgtaactacacacaattttgccgagacgacacgtacgatcgatcgatgaagagatgaactagttagctactagtcgtattcgacgagctagtctaccgtggatatcgcgatataatatgaccaaataactgactgactgattactacgtagtactttacataatctacagtattaattactagctatgtacgcagttacgagcgaacttacttggtgcatgcatatgcatgactatatgaatggtgaagcaagctagcccggccgctgtcgtcagtccatgttgctctatcagacttgctggctgccttgccgagcaagtttaataatatagtctactgctcgctccaaatcatctatagccaatgtaatagccaatttatacaatagttgcttactatactattaatacttggtcccacctgtcatatacatattacgttttggagtccatgctgcagctagctatagatctgtagcccacttctcttctctcttcctttatctttttaaaatatgtttataaatagcttagagcctgctattgtatctgctctaaattagtccttatgacttccgagaaagtggcggtgattttgattatattagtattggtttggtttcatgggcaggtttattttacgcgcatcgatcgatcgatgagtcacctgctgcagactcatcaccaattcaccaccgactcaattgatcgatcgatctaaaaaaactgaattagctagcctgctacgttgcacatatcgagatcttaatcaaacgcagagagagtggattttaaactctctacgttgcacatatcgagatcttaatctaacgcagagagagtggattttaaactctctggaagatgtcctttcgttgttttattgtactcaaatagttataaaaaaatagtagaaaaatagaagaagtgttaacatgttatcactctacaacatacaagttaaaatttaacttttgcaagttataaaaagataaattaaactatatctggttaagtcaaatatatttttttcattgcaacatgttgaagttactgtgcaggttgcaaagtgatctatcatatattaatctattttattaaaaaaattaactatttaagtgatatgtaaataacatggggacgtcccttgagagtttagaaaatttttcccatttgacgcatgctatagttgcttgtttagttactacctagctcgatctcgtctcacatgtcctgacggtcaaatgctatgtcttgagtacatatatatgttgacctttatatatttcaatgttgaccaagtctaactatagttaagtcaaattgtgtaagatgtagcaggcatgttttgctatatgtaagaacaattaatatatattatatatgcatgcacgttacatgccagacaacctcatgttgtattgttttcatctcataagaggatatattatatagatctcaccatcccctcgttttatgtatgtcacttaaatagttataaaaaattataaaaattaataaaataggttaatataaaatatatcacttcacaaacataaaagttaaaattcaaactactacaagtttaataaagataacaaatataaccgtgaatgaatgataactttcagttttttttttgcaacttgtaaaagttgaatttggtttcgcatgtttgtagagtgatgtatattatatttaatctatgttgttaactttttttttatttttttataactatttagatgacatgtaagaggatatcctcttgagagatgaaaatccatatccttttgttcttctccttgctgttacattctgtttgcaatcactttgtaaattgttttttaaataaatatataaatacgtatcaaagtatatatatatatatatatatatatatatatatatatatatatatatatattacgtcctacacaatacatatatgtactttcattcattgtagtctaacaatttaataattattagtgttcaaagttgaaacggtcaactaatataaatgcatatatagatcatcatcaaataccaaaattaattgaattaatccaaataaaactatatatctttatcatctggcgaaaactactttacacaatttaattacaattgtctgactattttctctcctatatactccctccgttttttaatatatgatccgttaattttttaagatagattgatcatttgttttattaaaaaattatgtaattattatttattttatcgtgatttgatttatcatccgatgttctttatatttgtacaaaattattaaataagatgaatagttaagtgtatatcaagaagccaatggagtcttatatttaaaaacagagatactacttgcatgcatgatatgctctaattattgactactacactgattatgaataatatgaactatatatacatcattcgacttcttccaacgtacactccatctttacatatatggaagctcctaattactgcatatatcattaaaaaccaaataatgaatgaaacaatctctacagatcatctagtatatatttacatgcatacatgtcgacatctacatacaactaaacagagaagcagccggtgtcagatcgccgcatgcagcagatggcgatcgagtagtataattaagctagctagccgctgccgtggcatggtgcgccgttgccgccggtctcgccttgtttgcacccattgcctaccggcgtggttggggtgctggtcttcagtatctgcatgacgaacatctcgccgccaccgcctccgccaccgccggcggcggcgacgacgtcgcccttcaacggcctcgccgcgaggagcacgccgcagcactgcagcaacacggccgccaccatcaccgccctcaccatcgtcttcgccgacgctgacgccattaattatatgatttcttgatgaattcttaattaagctagctagctaggtgctcggcaatggtgtaaagctcagtgagacgacgagtgaattgaatatagcagacagaaagtgcgtttgctgtacgtcgaatgggtagctagcttgattaaagaaaagagtaatagcttgtttaatttgttggaggaaatcagacaacctggcttccttttatagtagtacagttcatatatgttcgtgacttgaccacacgttgaactgcatgtactagtaaaaatcttaacagatgaacgggtctaatcgtacgagtttaccagtagtactactaattaattaacaacataacatgccactgtacgcggttttcagcgcagtccatgtccaaggttgaacacgaatagctagttaggttcaagaagacgtgcagcagcagttgtagtgctgctacgcgtgagtattactatggaagctaaggggatgtttggttgatgcctaactttgccataactaagtttaggctagttgtggcatagtggcacaaatatggcttagaaatagttggccacaagtgtggcatgcttagctctaaatttgagagcatgacacgtgggtcccaaagtgtggcataacataattgcggcagcgaaccaaacacatgcctaaaaaactatggtatgactaaagtgtggcgtgacaaaatatggcaacgaaccaaacagctcctaaggcaaagttaatcagtcatgtatatacagttacactcctacaaagacctagtagcccctccgtcccaaaattaatgtagttttacattatttatattcaacgtttgactgttcgtcttatctgaaaaaaaaagtttatgattagtacttttatttttattaggtgataaaatatgaatattactttatgtgtgactaaattttttaaataagacagatagtcaaccgttggacatgaatctccacggttgcatttattttgagatagaggtagtgtgtgtatgatactccttccgtttcaagttataagatattttgactttggtcaaagtcaaattattttaagtttaactgagtttctagataaatatagtaatatttataatactaaattagttgcatcgaatcaataattgaatatatttcataataaatttgtcttaagttaaaaatgttactactacttttctctacaaacttgatcagagttaaagcagtttaattttgatcaaagttaaaacatacgaagtactagtcatgtgcctatgtaggaccgtacggacgttctgattaatccgtgtgtaactcgaccttgaccccgatcgatcgagcgtccatgcccttgaattgacacattcgtttggaccgaccgaccagtgaatcttcctcgatcgtaacggccgggttcgaccagttaattaattagttccctctgaaacaagcaacttaactcgatcgatcagtagctactactagtaagctcgtacatacacacgcacacgcacgtactatacgcctcgccgaaagaccggaccgttacttacacacatacgagtatacgacgagttgtgtagacgttttcatgatacgattgcgtgggtttcaagaaaagaatgatatacgagttgtgtacatacgcacggctcggtatcgcccatcgatcgatcgaacgcgatttggtcggctctgttcagctacgtactaccttcgtacacataaaaaaatcgtttaggacaacgtttaagtcaaaccttaggaatataaatcatgaataactctcaagttgttgagtttgaaaatataaaaattatatgaatagatttgtcttgaaaaataatacatatatcactttttaataaatatttttatagaaaaaagaagtcaaatttatgttttgaagaccgtgtcgctattctaaacgtctttctttacgagtatgagggattactaattcagcggtttaattaagttgatgcctgccgctagctagtcgcggcgcgtggacgactggttgaattcatgtgtaaatgctgcagttttcgccgaattctgcgtgcgtgcgcgcgcgcgcgcgtggtgcagggatcagactgatgctgcgcatgcgttagagcaggccgtggcacaaggctctgcgtctgctcggccaggccggtcgtccagtgcggatagggaactgggctgagaatttggggccgcggctgggggatttttttaagggaaaattgaaaccatctcattataatttaaattaccctttttttttaaggacgaggagatgggggcatgaggggcagatccagcacgaaggcgacagggtttcgagcctccactattaggtgaaaacgcccccacgaagactttactaaaattttttaccatatgtaaatgggagggggaacggtaactctatctagtttgctcagactctagtgctatttctttctggatccgccactgaacacatgactggtttcttttcataggtacctgcctaaaatctagactttttaaatatgtgtatacctagctctttaattgatttaggtagtcaaactagttgatcaatccaatacggttatgaaacatctccaaaatgataaagaatgtgttagctttctccccctcatccttttctcctcgctttctccctctgctaggggacggcgttcccgcacagtgtcgctttgcaagggagacggtgacagcaggagacaacagcgacaacatatccggatgtgcgaggcggactcatgcacgcgacaatggatccgtgagggcaaggcgaatggcgggtcccctcctattggcctcatcgtcctcaacaaccgtgtgcacaaggcaggctcgactgacaagccatcgagccttcctccctcactcctctctcgccgtcgagccgccctagcaatggcgccctccctcccttggatgtagagagggcggggatagagagaagggaaatgagcatctatgacgtggggcccatgattagccaatttggccaatgaggggagaactttggcaggtggattatcttggtcatctggatggagaggtgttagaggaggattttttttttctaaaattattaaaatttggtttacaaaatcaattgaaaagactgttaaaaacgctcgaactcgtatattagccacgttcaactgcatgcattggaaactaaaaaaaattaaggaacaagtctattttctattccattcgtaagcaggcactactagtaaataatttgtttttttcccccggtccagccgtgtaagtacacggtccatgtccttgaacgatttattaggttatttagcccactccgaaagttaatgggctggctgtgaacctccgcaaggcaagtcacgtctcacgtgtaagctggactgttggatatggttaaaacatttcggcctaccaacgatggtaaacatttaaatcaatgagccgtaagcccttgctacataggagtactccgtaacatggtgattaacaaattgtatttgaaaaatgcattcttattctctctagagtgatagtctcagtgttttttttttatttcaagacaatatataccaatacatactcactccgtcccataaaaaactaacatctattcatatttgtgataatagaatatgtcatatccattaccaatatcgttaattacatgcactactgattaatactaagcagcaaagacagaaattttattgtattaactgaaaaaaaaaatctacgtacggaaaacaattaaaaaccggccggaatcagcttgatcgatcgaggtcgtcgtgttcgcgacaaagaaaattaattaaaactaagtaacaagctaagctagctagctaccggcggccgggagtactgccgatgcatggtgggctggggctgctgggaggggtcgggccttccttgcacgtattgcccgtaggcgtcgttgtggcgccaccgccggtggtcttcaggatctccggcgtgacgacgaacatctcctccccgccgccgccgccggctgcggccaacggcctcgccgcgaggagcacgccgcagcactgcatcagcacggccgccaccaccaacgccctcaccaacttcgccgacgccgacgatgccatgtttgtgagatctctgatcttgaactttagctagctagctatattaagctgtaagatcgatcaagctgattgttatgaaactattaggaatatagagatccacaattaatctcaggcctatacaatgtaatcagctagagtattcctaatagagtactagtgccgatcgatcgatgagtaagtgatgatctgaatgtagcagccaattaattaagtacgtggacgtactgtcttaattgaacgacatgggacaggatgggtttccttttatagataactcgatcgtacaggtatacgtacgttggccacacgttcaactgcatatggagtatgcagaaaaatcagaaaaacaaacaaaggaccgggtctattgtctattcgtaagtatttactatgactaatgagagtttttactgtccttgaaagggggcggtaccaaatctgaaccgtcgatctagcttcatcggacggctgagattggatggtaccgcgtggtaccgcacgcgcagattggggcggtaccgctggggtaaaaccgtattttcgcgtaacgaggtaggggtccgtgatttcctgccgggatcagaccggggcttctcttccctttctctctgagcgccatctctttccttttctccctgttttgttctgattctcgacgatttcttggcccacgcatagggatttccccctctagaaccagcgcaggggaaggaaagatgggtccggtcgatcggcgcatgcgtcgtgcctttgctgccgccggcgcaggggatggggggatggcgctcagatctggaacgagcgcgcctccatccgctcgtccggtcgatcggcgcgtgccgttgtttccgccggcgcaatgatccccttggagcaatggaggtggtaggcggagggaaggatgggtgtggtgttcagaaccaagcaccggcggggagatgcggctgcataaggtgctgcgggtgtcgtggcgtaggaaaacggagaagaaccggaagatcaatgtgctacactgcgaagagttgagtccctgcgaaggtagaggtgttgcgggcgtatttcctttcgcgcagatggaaaaagctaagccgggtaaggtaacatcaagcacttgttcttcctttcagtttgaaagaaatgttgcaattgactggagcttggaaaatagagatagtagttttgaatacatggctgataattgattggaaataacctagatggaaaaacagtgttgcataatataaaagtttagatagatacacttagatggaaatacagtgtttcaaagatgccactaattggcttcaaagcttcattgtaacttcagatgtggacgaattttctgaatgtagacgtctgatgtcgtcgtggacagcaagcactatatttagagtagtgttgattaggttggcggcgacctttagtctgaaaacttcattcggttcctgaagtcaagagggagtgaaaaatatgtgtaagagatgtgtaacactaataaaatgtgagtcatagtagcttagtacttttcggagcagtaccatatttaagaagtcgctcgttaattcctttccatcccaggtctccatgaacttcaaagcatttaacccacatgaccaactaaccatagaaattgagaatgtcagttagcaataattgttagttaaaagcgtattgatgatatttcacctgtctttctgttgaggtacactctttgggcacagtggccattttgcaacatttgtgtcagtccaggatgttggaacaggacgttctttcaccgtgtaatcaatatacttggccacgccattgatctgttatgtgttaaaattacttagaacatatgttattatagcatataggaactgttattgcgatggagcttactaggtttttaatatcttcgcttgcattgtaccattgtggctgcatctgcattgagtcaagaatttgaatttcttggcatcttgcattaataacaattacgtaccaatgcgatttgtccctatttattggtaggaagaccttcaggaaatagcataagttaaagtagtttttggaaaggcataaaaataaatgatgacctgatttagtaccatatcatggaccatgtatctttgggcaaacgttgatctggattcaatgtatcttttacttggctttcctcttgtcttaccaacggcacaccaaacctggacttgcgtttctttctcaattagagcagaaccgtactgcctggtgtggccttgttgattgtcgtttatgagttctgtgtaagcttcaatgacctgttgcaaaataaaaaaaaatatagaaatgtatgggaaaggtagaaattattataacagataaaaataatcttaacgaggtgttcaaccattttgattttgatgaactatcaagcggcgttacaagtggcagtagatgtgcacgtgatagctctatgtcttgtatactggcaagaaccttagttttttctgactggaggatgtaattgattgttattttatctttcaatgtcaaaccaaggttcgctgatcctgaattggatatttgaattttgggctcgaatgtttttttgttatgtttgtagaatatgaaatcactttgagtttgatatgatggcttgactgtccttccgaactgacctcttagtctttctgcaatggttttgttattgtcatctgtctcagttgcttcatccccagtgattatgaacggagcttcctctgttccattaccatcaatctctttggctaaatttgtctcatcctagagaagaagacataaaaaattgaatgctcgaacaatagttttgtaaattagttcagtacaactcaccgtattatcttcatgcatctcttcagtatggtaggcatcctttcattgcctaaatcgaatgttcgattatcctcgactttgttgacatcagcttcttgtttgggtctaaatgcatcggcttgtatagggactgacttcctttttttggacagggtgtttttgatgtcctgtaagagttgcagttcatttagctatatattatgaacaaaagctatatattatgcagttcatttagccagtgctgctttatgcttacctcgatggctagtgtgtttttccggcatatttgttccacggaaagtaacttgtttgtcaatttgttctccatgaactgaatggacctttctaactgttggagcatgtcaacaagtactttgatgtgacctgaatgctacaagaaagaagcagttggttatgacattatgtgtaggaagtaattttttgttgataatgtgcactcaaaaaaactgagctaagaatgtattacctctacggctgcaatttttgctggagatttgattttcgtttcatggtcatcctcacactgatttagctctctgtcatcatctttttccttctcattgtcagtaccgtacggcatgtgatcattagcatatgcaaaagattgttgtgcatctatttcttcgttgtcagaaagtatgggatagtcattttctagttcctcaaaggcagtgtcttcctcaattctctgttcattgatataaaagtcactttctctgtcttcaaagccatgcgtgtcatgctcatacctctgttcatcattcaaaaagtctggatgttctatctgttcaataatctgtataacatatggcagcaattagcatatgatctactactgcaactagtatttctgtatgtgcagtaacttaccaatccccccccttcagctgttctgcagtcatatttgtttctcaacctgacattggctgcattccagaatgaaatcaggggaatctgacgtccattgtaattgatgttgcagaactcagagtttactgccttcacatgttcccaataccaacactgaatgcaatgtaaaaaataagcattttgagtacaataagaaaataaattcagcatgtgataggtttgtatagtacctgcagtaatggaagattgccttcaatattttttagtcctcccttgaattccttcaagcaatcgcagagatgttcccttgttaagcttgcccaattgatagtgtgaatttttgttacatctctcagtaaaggtagatagctggagctgacatgggcctttgtagtaggacaaaggatgtacccaatggtgaaaaacatcatccttctaatgaaatcttcctcgttgatttcagattgtttcgattcttctaaaattgcttcttgcaatgatatgagtgaaatattcttgctctcgccatccttgtgcctagaataaatcttgtaatcctccgtgatcaatggcggcagtttggaaatcaccggtccttcggctggaatatccaatatacactggacatcccaaagtgtgatcggtaaactcttgtcttggatcaatattgtttggcttttgacgtcgtaccgatcagctaaccaaatacaaattacccggttgatgttaatctctggcattgctaacaagcctccaaatccaattttttccatggccgctgtctggagtggattcaaacttctcaccattgttacaaatttatgtggggagctagcaatggtcagttcccttggtttctaagaatgagaaaagtgcatgcaagtaaatcaccgtacaagaagtgaagagcaaaaagtatgttgagaagaagcaaataaattttaaaataacatacataccacggagagaataggtagtttcctaccatgacgccctcttttgccagggttgcggcgacgagcagtggaagtgttgttgtctgccatagaaatgtttagaacagatatgtgcgtaggaaatttgaactgaaactctctacttatatgtgtgtagcaaaaaaacgagttaatgacaccggaataatcttgtattgaacttaagtacaggttttgtgtcgtttgatttttaaatgtacacatctcactgtgcatcggcatatattatacgtcaatccactgtgtcaggtgcatgcagccgtgtagcaatcaatgccattatagtctattctgtttccaaagcgaatatgggctgcttttgttgcatggcctcctcggtacaccacacataaaactgatatacatgcgtgcattccactcggtataataaagcagtcaagaacggcactgcagtcaagtatgaaagcagtcaacaaaactatgcatttacacggtttaagtatgaatgcagttccgtcgaaaaattaacattagggtgtgtaggataattttgatggaaaagttggaagtttaaagaaaatattacatccaatgtaatcacttgttgtacatgagatcactaattttcactaacataatgacaattactacaaacgatcccattaaccacgcacgagtatcgtcgagctcttttttctttttcattaattttttttatacgccaattctagttcagagatatggtcagccgtatctaactctaacttcattttttcttcctcggcctttgtattccgaacgaaacaacaccagtcatattgtttcgaaccggttagcttggtagcacgttccactgcatgccacatctgctcaagtgtcttctgaactcttgggtgccatggttcgtcgacccaaaaaaatttatcgcactgatcctcttcctgaaacgaataacagttcgtaaaaaccaaccgaatgaattttcttttgttttcaaggacttttgagctcacctccagcggacaacctaagaaccttcttcctgtgtcaggtccttcccaagctgtcctccgtttcggcgtgaggccatgcctgcaagttagtctggtgccaagctcctctccacaatactccgaatcttcaatgtacatcgggacatccatgcacagaccatggcgatattcctacaaacacgagatcggtgaagaaaaaaaaattgaaaaatcgttgaaaggtacttgtattttcatttaccttaacagcgccgtccgccattgcagcttcgttgttctgtaccttcttgcttgttaccatggctgttatctgtggagtgaggatgaggttgatggatgcactagtgtgaccagcaactagctacaaccgaagcagcatatatggacgagtactaaatgaggtagttggttggttcgctagtccaaccatcaatacaagaatttactactatccgacctggcattataaaaaaatgaaattataattaacggaattgacaaaaaaatcatataaaatgaaattataattaactagagacgtcgagactaggagcggtggttcggaccatgccgggtgtcctatgcgcaacacatagagactctgcaggtgttttcctaagtctattacttgtcatcggactataaaatcaactgttcagtactggtacacgaaagttacgcgttactatacgtgtcgagatgtacaaaagtgtgtataacatgcccagatgtacaagatttgtgtcacgttactaaattgagacagcagtacttaattcctgcatgcgcacacggttaccaatacgcacttacacagtccaccaaacaattactaatacttatccatccacccactcccctgtgcattaaccatggaaggtgagcagccaactcagttcgtccccttatttcttcaaccattctcctcctactgcttcctctttcttcttcttcttctgctctttcttcttcctttggcactggaggcggccaggctgtcctcggcactgcaggcgctgcggccggttgcacggctgcaggcgagctcgcggtgggacggccagctccgagcagtgcagtgtgccgactagagtcgccgaggtgagctgtggtaagagccgatttcggagacgacaccatatatcaggttctgcttcctcccattatattccatttttgatgcgtatcgtgatgcctatcttgtcacttagagtgaaacacaagtagcaatgggggacggaaatgaggtcattgacatttcatcagatagtgacgatggtgatgcctatcttccgattttatccttttttcgtagcattacacctactaacaagtttggattaaacacgagcagaacaagtacaaattgagataaacaagatttatcaaagcgtgcgccgttcaactattacaacaggtgtttattaattctcattaatttcagttttagctttcaatgattacaaaagtcatatgaacttgtgtatgtgaactctaaaaaacaggacaatatggacctcgtactttctctggattcgacaagtactgctggtatggaaatgatgtcacattaacaaaaagtatgcatcttcaaattgctcacgttgccgcagtaaatttgccgctgtcaagagaacccttatgaccaatgcgaaaatggtatgtaaaatgactttgttgcttcatgtagtttgtactatggctaatcaacttttcttgcagacctttgcagtccagtttagcgagcggtacataaacaagtacattgggagtccaattgatgatctgatggtgtctatggctggaacaacacagtcatatcaaatgaggctgaagaggtccaaggacagtagggcaatgctgaccactggatggaaccaactgattgatgcaaaagcattcgatgagggtgatgtttgtcttttccatttcaaggaggttgacgacgttcttgttctgaaggttcatgttctcaagtagtgtggtggatgaaaatcaccattttgtctggcaatatgtaatgccatccaaattcgtatgatgtaaagctagttaagaccttattatgtggttgacctttccagtacaatcttattatgtgctagttaagacttgattatgtgggtcaactatctgttaatggatgcttgtcaagatggaggaactatctatgtgttgttgtgtcagtcactggatgcttcgatgttattcttcagattactcaattgcgacacttcttcggtatgcactacaattatccaaagtactgagtaacagtagcacatccactaaacctggagacatgatgctatcaatatcagcatccactcgacttgaagccaacatgcaacctttccaagtactgagtaacatcatcagcagtttgactcaattgcaaaacatattaagatgctaatcatccaacccaaatataaaaaagtacttcaggtccattacaattttggaacatgttcaaacaatataaactgtacgcacacaacatcaatatacttcatgttggaccatacaaacatccatgttcaccacagccatcctgtactccaccctctgggacagcaaaatcacacatcttcgttcactttcctgtaaaaaaactgggctgcag

SEQ ID NO: 1941 - DNA, 19111 bp, Oryza sativa
aaacaacgcaacagccgatagcgttccatttggtctgaccaagtgtaaattgaaccatacctatcagaaggaaatgcattctttgctttcatagtccatctacgtgctatgcagaaggtcggaatggtgtctaactttaaataatttcagaactgcaaataaatgattgcatggaatgtattccactccatttttctacaagggcagcagatgctaaccaacaatgcttcctcaaacatgccggtcaaaatgacaacaccatccttgccaatcatttgcaatacatacctgacacaattgtcctcctctatagtatctattacctcccaattcatgcccatgtataactccaccttaaccttcttgaaaattttaggtgtaaaaacacgagctgcatccttctctattagagtagagtcattgcttgtaaatggtactgactgagatgcttttgcatccaactctgcctcttgatgacgcatacgtgacaagcaatgttcatagtgctcaatcaaaatgacaaggctcatttttctgtccaacaacctatgcagttttgagttaagactttcacttctttgattgctcttcatgccaagaaaaaccctccctttagtgtatgctgctgcccactttttccttagattatacatcctattcaaccacctgttctcatctgatactttatgcttaaccttgaactcaacccattttctctcaaactcatcttcttcaagtggagcatgcacaaggaccctaaaatctgaaagcatagttggactaaggttacgtgccatattctgctcaatatgccatgtgcacaaccgatggtcagaatttggaaacacaagtaagaatagctctacccattgcattggctccatctgggataacagacttgggatgtttctgacacatgcaacttaaaaactgcttaagtacccattcataagtaccaaccctctcatcggaaactacagcacaaccaaaaatcacagtcgacccatggtggttcaccccaacaaaaggaatgaaagggagattgtatttgttcactcgataggtgctgtcaaacacgacaacatcaccaaatgcatcataatctattcttgattgtggatctgcccaaaataacctcttcaagcatcctgcttcgtcggtctcatactcataatagaaatccatatcatctttctgacgagcttgcatgtacttaataacacggtcagcatctccaccatcaatccgtttcttcttcattttcacaaaaaaattgtacaaatcccttgtaacaaatcctgcaccttcaaaaccaccatggtctctctctattacatccatcacttggtgctgatgtaaacctaaatctctcaattccaccaattttgcctgttgtgctggagtaattctacgatgtgaacggagaaatgccacttcatcagctttacacaaaggatgattatgatctgccacaaaccttgttacataccaatggccttttatctcatcgagtttaatctcaaaatgagcattgcatccacaatgagttagtgctctgggttccctagttctgccagaataatccatatacacctccttcctaaatccttcccttgagcatgtgaagcgcttatgaaatatcaatccactaaaacgatcacgcctactataatccttccttacactaaaacctttctctttcgcatactggttatagaaagcaaaaccttcatcctcactactgaatttcatagccataaacttacaatactcatcctgatcctcaaatcttgaaccatcaccaatcattttttatatcaagaacaacctgtcaaacacatatcaagaataaaaataattatgcacgttcatactgtatcggcctaattgctaaaacaaaactaaaaaaatcttctcatcgatatacgactggtgcgggctaaatgctataatgcgagtcgggtcagggacttacggcgacacaggcgagggcgtggcgacggatcgaagaaaggcggtggtggacggcggtgggcagcggtaggggattgcgcttctctgcctggggcggtgggcggcggtcgtctgcggtggtcgccggtgctcggcggcggcctcctgcgctgctctgcctgcggcggtgggcggctatggaagcaggcggcctcctgcgctgctctgccggcggctattgggcgggtgtggtcggcggcggcctccaccgtagctctaccagcggcggcctccaccgatgatctgccggcgggggagggcgcaggaattacttcccaccacgcatgggcgacggcggcggaactggcggagagaaatcgaattttgcggatgagtcgcccttgtcagattgcctcgctattggctgcttgggcggcgccgaccggaaggcccaattagtctcttaccaatttctttccgatcgtacccctgcaaaatcaatggctagatttgattgttaccttatagtacctggtacctcattacacctcatagtaccttattaaagatgagaaaagagctcatgactaatagctaattagtatgcgattttcagcgcggtccatgcatatcctcattgtacagatggatgtatatatgaaagccgcatatatacatgtgccatgtagaaattaaacctcgtatatatgttcatactcatatgtgtcaacaataataatgaccaagctttactgactgcgtgcgtatgactatctgattagtccatgtatgtgcaactcgatcttgactccgacagtcgaccgtgcagctagctagccttgaaatcttgaattgacacattcgtttcgatcgatcggccgatgaattcctcgattcgcaaacggctgggacttgaccaatttactagtagttccctctgaaactggcaaggcacacttgtgcaataatatgtttagctcaccgctgaaaacctcgatctttccattttcagcgtaaggggccctcgatgttttcttattcttttttgagctccagttttgcacagtaacatttttttttcttaaggctgtgtttttttaacactttcccaagtttcattcactcattttctactcgtacgcttcctaaattgttaaacggtgtgtcttttttaaaaaaaatctataaaaagttattttgaaaaattatattaattcatttcaatttttaagactaatacttaattaatcatgtgcctctccgtttcacgtattaggaggaaagattcacaaccttagctaacgaacacagactaaatgtagtagattctcatatacccgcgcgtgcacgctcatgcatctcctataaacatcttctaaagactagtcaacatatcttgagatgtctcactgtcaacgagcacatcgtcggggacctgaattcgggtggatatgtatcacacaaagaacctaactatgattagcctacgcactgttgtataacaaatataggccagtacaaacaaaatggtgtgaaagatgtttggtgtatagattgcatattatcaggaagtagatttttttttaaaaaaaatgagaacatagacgcgcgcgtttttgtttttatatatatgacacaaacaatggataaaggcatacagcaacacagaaaccgcaatacgatttttaaattttagtcaaatggaacttatgtcaattattttagagaaaattcaagaaatgacattgacaaacactcaaatccaaaaaatgccatcgacgaatacaagttacatgaaatgttatcgtacaagtgattttgtcccagaaacgccatcgccattagggttacgttagcaaccttccgttaagttctataggatgcatgaacggtgtatttaacggctgtcccagaaacgcaatcgccattagggttacgttagcaaccttccgttaagttctataggatgcatgaacggtgtatttaacggcgtaggatgaacggaccataactgtgatgacattttttgaacaaaatcgtttgtatgatggtattttagaaaacttgcattcgccaatggtatttcttgaatttaggtacttgtaatgatatttcttggatttttctctttattttacctgcagcggcactgcgacagggataaaccatatttttgggaccatattgcacaggccagaacagcctagtagctaattaattaaacaattttcacttgcttacaacattacaacttacaataccccatgcattacgacatgcactgattatagactacttctagctaactttgatcagctatacattcatcttccggcactccaattttgcacggaattaatattagaagctcgatcatcctaactgcagatcatgaaaacgaccaaaccaaaataataacgaataaatcgaagtacaatctccagacacacacgcatgccaacatctacgcaattaagtaaaaccggtctcgatcggaacccagcttgatcaaggacgaccgtgttcgcgagaaaggagattgattaatactactccctccgtttcaaaatatttgacaccattgactttttagtacgtgtttaaccattcgtcttatttaaaaaatttaaataattatttactcttttcatatcatttgattcattgttaaatatactttcatgtacacatgtagttttagatatttcagaaaattttttttgataagatgaacggtcaaacatgtgctaaaaagtcaacggtgtcaaatattttgaaacggatggaatattatataagcagtaattagttaattaattaagctaccggcggctgccgaagcatggtgcgccgggagggctgggggcttgcttgcacccgttccccggctgtattgggacagcttgtaggatctgcatgaccggcatctttccgccgccgccgccggcggtctgcattggccgccacccgccgcctccggcgacgtccccttccaacggcctcgccgcgaggagcacgccgcagcactgcatcagcacggccgccgccaccaacgccatgaccaacttcgccgacgccatgtatgtgagagatctctagctcttcaactttagctagctagctagctaatttaagctcgatcgatgagtacgtacgtgagctgaatgcagcagacaattaattaagtacgtggaatgatcttaattaaaggaaggatattggtttgtgttgggggtgatgggacatgaagggcttccttttataccaactcgttgtatatactcacgttggccaacacgtacgttcaactgcgtatgtatggagtagaaatcagaaaagcaaattattaaggaccgggtctattgtctattcgttagtgtttactacgattaactaattcgtggggttttttttttccggttcagcgttaagtacgtactcctacgtactagtactacgcggttttcagctcggtcgatccatgcatcctaattaaggttgaatgattataattaattagttaggtgcagtagcagtgtaagtacagacattgccagtcatgcggcctatatatcactatatgagcttactgactgcgtccatcgtgtgtgtgaaactctgattagtccatgtagcaactcgatcttgactccgaccgtgcggccttgaaatcttgaattgatatacgtacctatacgttcgttcgttcgtttcgatcaaatcgaccacatgaattcattcctcgatcgtaacggctgcgactacttcgacagttcgaccaatttactagtactctgaaaccgttatcgtgtatacttgtgcaataacaatgagtcgtatctgttctcacacgagcgcatgacgtgacgctggtgtttgcgaatttggtcggtctcgttctgcccatcgatttggtcgcgtggactggtcgatttgatcgaattctgcgtgtgactccggcgttgctgggcaaagcccaggaggtaattgggcttgtgtgctgatgcctttcggtggctgggccgcgtgtcccggaggcttccccgttgttgtggggaaaaagtacaccgaaggtctctcaacttgtcatcggatacaaaaacatcctcgaaccacaaaactagatatgcgaggtcccttaactatacaaaaccggtcacctgaaatcctttggcggttttgactccggttttggtctacgtggcagctgactcagcgtgggacccacgtgggccccacatgtcagtttgtccacatcatctctccttcccatttctctcccttcgtcctctctgtccagtctgggcagctagctggtgggcgcgaggcgggagaggatgaggtcggcggcggcgacgcgggagaaggggaggcggaggaggaggttggtgtggatgccataggtaagcgccggcgggtagagggcgaagaggcgtgcgacgtcagcggtcgttgcgtccgaggccgtcttcgcgtcgcggacgtctccaccgtggatggcgccatgccgcaccgggctcccccgcgactcatgtagaggagcacatcgcggtcgggcgccgccatggacttccttgtctgctcacccaaagggtctacagcggcgagcacggcgtccacgacgcggcgtgcactgtcgaagtccccccagtcgacgaggcagcgaggagggagttggtcggccaacgcactgtcgccgccgccccagccgccgttgtccttcttgcccttgctcatccgcgagggacatccccaacgagccgcttgacggtgtgggggcttgacggctgcgagcggtgtcgtcctagcctccggtcgcattcggccacatccagccgccgcgccatgagctcggccgcgccagcgcgaacctccatgccagctaccatggaaagcggcggcatcggggagagaaacaagccaaaaataaaagagaaaaaaaggggaacggggaaagacagcgtcgatggcgccacctatcccccgccggccaccgcagagcaacgccgccgcaaggccgcgccccgcatcgtcgcagggagagaagagagaaggaacgaagagaagaaggaaaagagatgggtgatgacgtggacagattgacgtgtggggcccacgtgggtcccacgccgagtcagctgccacgtcggtcaaaaccgtcgagggacctagtttgcactggttttgtaagttggaggatgcgttgtatccgttttcgtggttcaaggatgattttgtatctcgatgacaagttgagggaccttcggtgtactttttccttgttgtggaaggccatgatggcccatgggccttctttgatgcttccccaccaccaaatcgtctgatttgcaccgtggagtcagatcagatgccatccattctctcacaaaaaggaggatttgaacctgtcattgagaccttgagtttgagtgcgattcctcccttctttcggtcactgcttttagcaagagcacagttttacttttgacgacttgtagcaaaatacttccaaatcctaaccacaaacttcaaaaagttcccaacatattccaaatctcgtggaataaaataataataaaccctcctttttcttctctaatcgaatctattccgagaaataatgataaaattatattattatgcaaacccatctcgaattcgcgatccatccattctctctcgctcgctctcccatggcgctccaaaccctaaacccgcggcacgtgctgccgctgccgctgcctcggcggcgcgcgccgcggccccgcgtgctccaccgcccgccgcctccgcgacggaggctcgagggggcggcgcggccgcgggccgtggcggtggctgtcaacgaggcgaggaggcggtggccgccggcggaggggggaggggaggaggggaaggagacggacctcgccacgctcgggaacctctgcgtcgacgtcgtgctcagcgtgccccagctcccgccggcgccgcgcgaggagcgggaggcttacatggagcgcctcgccgcgtcgccgcctgaccaggtaaggggccgagagctttcgcctgttgggattggaaatctaggggctcggttattcatcaggtgaattcagcattagatgccgcaaagccggatttattttgggagatttatagctctagtcactttggtttggttcaaaatgcttgtgttgtgataggaaggattcaagcgagcgtatcgtaattgtatctactgataaatttggggattggaagaaatgtggaggctttcgatgagtaacggaaggttttagatgtacacatctcatgaatgtttgcatttgttctgtttgtgttgaaaatgagaatgtttttatgacaatttagttatttagtattacttattctgctgcactttatctgcttgggaagatggagaacccagaaaagaaacccagttataaattgaacaacattatgatcaatcaatcagtggttattagctattctgaacattttatctttcgtcacttggaacagaaattttgggaggctggtggaaactgcaacttggcctttgctgcagctaggcttgggcttcgctgttccacactggggcatgtaggagaggaaatttatgggaagtttcttcttgatgtgcttgaggaggagggcattagtgttgttgggatgcttgataactctgattctggtgcatgccgaaatgcctatgagacccttctttgctgggttcttgtagacccatttcagagacatggattttgcaggttagaacttcatgttctcatgcatgccttactgctcttattattttcatcatgaatattgtcaacttcagcttcaaattctcatgagctaatattcttgttgtgctttgcattgcaattttcatctacgccagccgagcagactttagtgatgagccagctttcagttggatacgtaaactcccagctgaaaccaagacagctattcatcactccaaaatattgttctgtaatggctatgcttttgatgaacttttccctgatgtgatctcgtccgctattgattgcgcaattgatgcgggaacagcagtattttttgatcctggtcctcgaggaaaatctctcttacatgggacccttgatgaacagagggcacttgagcattctctgaggctcagtgatgttctgcttttaacatcagacgaggttagatgccttacagttttatttttgctttgtgagcttcaattgtaattagtaaaagccaagcgaaccataaatggcatgtttttttataatgatatttgagctggctgatcttgacttcacatctgcagctttgccttttctccaaacttaacaattcaaccataaaccatttatgccaaaataagattaaagggtacagcctaacactaatatgcttttgtaaaaaaaacctgtttgctgaatctggcctgtttagagaacagtgaacccaatgtggtgtatttagtgttgtattcttgcttcatttcactcataaatctgtttattggtttgacaggctgagtccctgacgaacatcagaaacccaatccaggcagggcaagagttgctgaagagggggattcgcacaaagtgggttgtcataaaaatgggctcaaagggatcaatcatggttacgaagagtgctgtctccagtgcaccttcatttaaggtatgtttattctgctgataaaggatctttgtgtaattactgcatttgtcaatattcactgtgctgtactttcattagattgacgttgtggacaccgttggatgtggagatagctttactgctgctatagcttttgggttcctccacaacttgccagcagttagcacactgacactagcaaatgcagtgggtgctgcaactgccactggctgtggggcaggtcggaatgttgctcacctggataaagtattacaactcttgagagaatccaatatcaatgaggacgatacgccgtggagcgagttgattgaagcaagttcattctgttctgaagtttcagtgctgtctaagacagcagttaatagtttcagtgaccgccttgtgcatgttcctacttgcaatgtggtttccaacctcctttctatgcttgaggcagtgtcggagcgaagcacagttcaggcttaatcccatcttgaatggtatatgggggcccttttttgccattaaatcattcatatagattcttcttttgccagaccgtcacactgatttcatgtgacgagtgatagttggaggctggccaccagggaaagctatttgttggaaagatgttttggaagctattagtaaatgtgcagtagtggtctcgcctagaaacatcgtattttaccctaacttttgcactatttgttggaacatggtgtccctttaactaaccaagttatcttcgactgatcatctgtttgcgccaatgatattttgcccctttctggagccatctgttctggttcttgaaccaaacttgtttttgttctgaagtatcaacgagtttattatgataacggaaaattttgccgatgttgactgtagccaagacaacactttgcaaggtttactttcgtgtgtagttttgaacccttgctcgttactgcaaaattgtgctgatcaatggcaagtgtctgtacacgtccgagtctccgagcatcagaggtaacctgtgaccagcactcctgcaaccgctagactttaaaaattttcaagttcatctaggctatagcctatagattgtctccagaagtggttggataaattcaagacggtatgaacttatctgacatgaacagtagctggcttactaagtgaattccttcctcatctcggcagaagccggaaactataattacagcgaagagctttactcctaaatcctaataacaaccgtttcaatttgtacaagaaagatctcatccaacaagatcggtgtgtatataatctgtgttctcccatgttatgttcagggagatcaggtcacaaatgaccctgtcaaatctccgagcgagatgccaccatgaaggcatcatggtgctgtaacaatcagtggcagcaacttcagatctgcaaaagagaccgaatcaggatctcttgattacaaaaggtgatataagtgaacaaagaacaaggcctaacatttcataactagcgtgattctatgcatacaaggaaaagtatttctctaaaagaaggggaaatatgaagattaaataatactaagtcaatgaagttgatagagtagctagcgctgaaaatgcagattcaaaagacactttagtgtccttttagttaaccatgcattctaaggaattttgacgaaagtagaggatcgtcaataaaaactctgatggcacagttcaaagcagatatttgcaatatactccctccatcccataaaaaaccaacctagtattcaatgaaatgtttcctaacgaatctagacaggagtttgtaccaggaaaaacctattcaataataggttagctttttgtgggacggagggagtataagagtaacctattgcatgtacatcatggaagcaatgttcatattaactactactatggtctattgttaccttcagagattaattatgagatcataaaactgccctctctctttgctcagtcatgattcttcgcaactctctcaaatgtgcagttatctcttgaacacattgtacgccatcatcactacattttagagagcttaatatctgtttgagaaacttttgatctgtttcaagtgccgtgaatctagtatttagaagtgaaatctcatgtttaacgctcgtcatagaactgattctgccatcatctaggtgagaacatgagccggaatcaacactttgattttcatcaatttgttgagaagaaaccggctcaccgctccagtgttccggatgcaatactgacatgttctgtagactatcatatgtgccaccaaaattatgcctatctgtggaagacatgcccagtgtttcctccaatttgctcaaggatttcaaaatatttgccttttcattctcaaaatcaaacatggtatccctcatgaaatctgagctatccaagactccagatgccatatctccatcagtaaaatcaaacttgcaaccaatggttcatgaagcctccgataattgtcaagttcagcttccaggtcaagcatttctttctccctttctgtaagcaagtcatttagcctttcaattgcttcttggtcatgatcagcctgctcttccatcatcctgaggtactgaagtgcctccatgtgcattgaagccttttcttcctgcaatctattgatcatagccattgcttcactcgcagccaccgctgaagcactccgctctgcctcaaactccttataaaggatactcatttttttcttgccaagctcaaccttctgcttcaggccttcgagtgaggtatcaccttcatcttcactagtagcatggacatcaaatggttccatatttgagtagttagtctcaagaaattgtctgctcccagtggcatcatattgtttatcatcaatctgtgtgattctaggactagcggccacctcactccaaggaccatcaaagcctcgcgcagaagacatctgggacaggaatgtcttgacttcttggttagttcttgaactgttatccttagcagagattatttcagaccatcgaggagattgaaggttgcttctacgacgagaagcactcttcatactgtttttgcggttgatacaggcatctaaaactgaactcattcctgcatttgcagaagcaacaaaacccttagcaacttcctcgtcagggcttcctgaaatacccgctgaatcgtcaacttcctcaataccaaccagaaaagctacagaacaaatttgacatactcagataaattcaaattatataaggattgcagcattttggataaagatacatacttttctctttcggaagctctgcgcaaacttgttcaggcacaatcttcggttgcacgtcatgattgtttccacttacattgacattgctcaagctaatttcccttgaaccttgcgcaatatgctctgaagatttcgctgcactaacaaggttggtgccagtggccacattgtcagtttttgctgcagtactcactggcacaggagcggtattcatcggctctgcaagaacaacattctcagaaggatgcatggacaagctgttggtgtcactgatcataggttgtagttgcgaatcatgaaataagaagtctctgcttctctgcgtagctttgtgaatcattgaattaccatcttcatcttcatcatcatccgagatgcggttctcagactctgaatcatggcggacattcagcttactgtagcctccataagacaagtcctcagaaccttcatctgaagaatgccctacactagtcatgtctatgcttctctccttcactgtgctcacatcatctggaactatgccatttgcaagctcaggtagcttgtgtgtatgccgtgtcttcttaaacgtctctgaacaacaagagcataaatgtgtatgcctggacctcggttgagaattcaccttgtccttatttctcatgctcttcagtttattgggcttaccatccaaaccagcacatgaaagtaggcacctttcacacagatcatcagagtgtgcgagcttgttgtgactctggcaatactccaattgcgagatttccaacttgtgtgcagcacagatcagatcttcagagaaccaggtgtttccatgcaggaggcgatccaaccttgagcacaggatgcacggtggtcgtaggctccagatgcgtgcaaaccttgtggccgtgaatgacaccacggcggtcacaaagagcattatgatcaggctgcattcgctgaaggcatggcacagcacaggccagaattgccgtgcaaagtccggcgaccttgcacgagccttcgctgccatcgaagatcaatgcaccgctgatttgcatgtaggttgattaaaaatcaaatcctttccacaaaattcctattaatgtggcacaaagataatcagatcaaaccacattgttgaggaggaagcgcttgtaaaatcatggtcacccataccaacgtgtggttccagaagatgaggcctttcacctagaaaagttcacaatgctacaatgcagcagtaccttcagctgcgctaagccaagaacgggacattttttcttcatatgccaatgatcatacggatagatcgcaataacctaatctttttaccaattggagcaaggatccaatcttccctgcaaataattgcacagatgaacatgcagggtgtcatgtacaaacaaaattgttcagaataaaagagtatatctggaacgtaccaatgcagcagatcttcaaccaagaagctgcgattcccataatcaccaaatctggagcatattggagaggaacagaacaaatccgtgtagtaaagatcaaccaaaaggcccagaaatgaaaaaaaaaaatccccaaatgaaatttggaaaaaaaatggttcttggttgcacaggaggcaaaacgattctcccctcacactgtacgattggagaggagagagaagaggggaacagatgtcctccatctcttcccaaaacacaatcctttgcatgtgatgtgaggctgagagatttaagcatagcctcacgttatggtaaagaaaaccatcaaagctgataaggagccagaagaactgaactactgaagaaataatgactggttcattttattttcaaataattccctgaaaatttgaggcaatgaaccaaagacactaaagtttgataatcagattctgcaattctgaaaatgtaagagctacaggtgctattattttagaaaagaaaatccttaaataatagaactagtaatcaggcatggagaccagtgttccaggacctccaccttgtgtggtccggttagttgcaaaccaatcagcttattcttcgcagacataggtatgcgacagatcaccgtgcccataaggaatatagcatatgtaacatgttcctctctacaatcttccaatagaaattcctaccctacatcaatcaagaaactctcccatgagcctctgtcataaaaagagccagccaaactgccagaacctggcattactattccatgattcacacggccatctttgaccttcatgatgagctaagagaaaaaaggattagtagttcagtacgggttacacctgcacaatcccaattaactattggattcagtcacctgggtcttttttcacaatctccccatcaaatccatttgctcaagctagatctctttcacatccccacataaaaagttctctttgttgttgcagagctgcaggttgcccggggtggacagtttcttaagtgctaagattggaatcaaaacaacttggctatgcaacacggtacatgcaaagcaaaagaaatcctttgcttgcgaataaaatcatgtactacgcatgcaaatgtcacagcaacagctgtgcgttgtgaattaatttcaacagcttagcttatatattcatgtatgcattgcatccacttggttaatcataatactcatatagcttgctgaatgctgatctcttgtctgagatgatcctgtgaatctagatgactaattcagtggctgcccttagctgctagcaagtggtcatgagctcatgatttgctgacgtgttcatgttggaatagatggctatgtcacgtcttgcaagtttgacttggattacatagcattgtcagactgagtgcactagccagtggttaagactaagtagccagtacagtttaggttggatgaaccgttgttcatccaagctgtaaatgtgaaagcaacaaggtgccaaaagaagcatgtggacttgtatgacataaagctgctcaaagcagagtcatatgccgtgagctaacaagctgcccctccatatatatacaagctcgtagcttatacatgaaaatctctctatatatatctctctggcttcctcttattcattcatttttattggaattgaagggaatggtggcttgtcccaaaacttaccaccggccgaattgccgaattcacttgcagctaagcaagctaggtggggggtttcggaccaggcttcattccccccaactcaactgtttagttcttcggcttcggcacaaatcggcgggcgacactgccagcgtgaagcttctgcaggtaggacgatgtttggccgtgcagccagccgtccgtgctccatccaccatcaccatgcatcgatatatatcttccatctcgctcactggtaagtgctctccatttcctataactctatcccagactcggttggatgtgtacatatgcaccgagaccaagcgatcaacttatgtgtagtgccagttgatgttgttccatggttgtgtttgagtaccagtgaattgtctcatggccttccgtcatcttcgtcttggtagactaatttctggtggttaagttcttggttgcttggagtttgaaaaaggttcagaaactcagcgtattggtgttcccagtgtatatacattaattgggaagttgttcacccgttaaggaattaatgaagcttcactagatagtctatccgatccctcattatttgctaattaagcctctatgtggatagagggaagagaggctggagagggaagagagattaactaggacatgataagcaacttaaagccccttttggcacctataatcatagcagctgatagtagtagcaaacaaagttacggccagtgcagcagcatatatgctatcagctgctaggtgggcgtgtgggcaatgatggtaaacaaagggcttgatcggttcgtgtcgtcctcgttacgaatctttccgatcatggaaagatcgcttccaagattttcagtagactactagagtaactagactacatgcatgtgtgacaactgaagcatctctgcaaagccatgccgttgccgacaccgttaggtggagccgaagcaccaaagcatgcaaagcccctcacgtatgcaatcattcctcttttatgctctcttctctctaattagctagctaaagaaaatacttagttttaagagcaaaggttgaaaaaaaggaggcttagttgattattcaaggagttcaaactgagattggtcacaccagaaagattcaacacaaaagaaaaaagatatgctaatcaattaccttgatctaaccgttcaaccagcatctgaacgatctcatcaacccagtgctttttttagcattggctttattcctgcgagtgatgcttcatgcttgtacgtgtgatctgagaaaaaagagggccgtgttatgacaacgatgtgacctacagtaacaaagagttgataaacatatcatttagagaaacaactcgtcatatatcaagaaagtgacaagacgaaacaaacagcgggttgatggtaatagggcaaggaaaagagtgacggcatgatccattttttccgctgaacttttgactaaaaagttttggtgagtgacgaaatttctcaggagcaatgaggggattgggtactgcttggaaagactttacaaggctgcgtacgtgcatcgcagcccaccgtgggtacatttcgaagataccatcatttgatcatctcatacagcttttggtttgcagcatttttcaactttgaagcgtgggcaagtgcctttccctctcgcatcacgtgtttgcaagtctaggtacaggtcctggttgacattgccttctgccattgtggctatgtgccctgtatagccacatgacagttccgagcagtaccttcacatatgttctgaatcggcggcagtataaatactcaattttttttcccaatttccagaaaaccattaacaagtttaccataaactagtcatcatgattattactaatgcataagagggggggggggtcaacttaccgtgccaacgccgttacgctgccaatctgtacgggcatcgcggaccaattggcctgagatctatctcccgaggttggggcagacattagcgaagtgggtagggtcgccgcagatgaagcagctgccgtaaacgggctcgcccgtcgccgcaacgaacatcatgccatcagcattccgtcctctgcccctcctgcctcgcccttgggtgccgcctctccgccctgcagatgcagatgcagatgattgcctgctgctactgcgcccgccccgcccacgcccgccacggcccctcggcgcagagttctccacatcgtcttcccatctgcgttgcacacagagacatcaggcaacgcaatgcatagatagctaaaacaaacccctataattgacagcttctcttttcgcatcatattccttattatgtttttagctatttaacttgatagagattagagcaaaatatcacaccagggggaaagctaagataaatctgtttattgcctagttcggaataggagtatgtgcacataagatttatgaaaaacataactgagatagctgcataactagtgatactctgcatgcttagatagtttcaagtggatagatcagatgcaaatgcaccctgcagatcaatatcgtgtgataaaataacactgttactaaaaggattcacatacgcgaaaaagccgcatgcaagattctggcatttatagaacttcctccccctgttagcctctgtattagcagttcgcaatacgcagggttctcgacatgatgtgcactgtacttgacctgcgtgtgaaaatagctcaagatcaattcatgagcttgcattacctcttctttttcgttgccaggccagctgaagattggcttgcataacaatttgtagacattactgagtagtacagtcacctgatgcatttcctgagctttgggtatgggttgaacgaaaaccttgaggattcacaacaggtgtttgtccgttagtaaattgcacggctggatgaaagctagtatgtaaatcttgccttgaagacccctgccttacaccacttgcagtctggctctgatttcttgctgtgaaacaacaaatatgatcataaaatatacatgttttttaacaaatgacaacaaggcctactttcgatatactacctcccttttttaataaatgacgccgttgatttttt

SEQ ID NO: 1942 - DNA, 2337 bp, Oryza sativa
aagtagtaagcaacacatgggagacaaaataaggtgaatccacaaaacaagcctgttttagattatatatattttgagtcgcaataagcataagattgcgattacccctaatgaatctaattctctacaacttgacttgtagcggttaaaaagatgaactcaacattttgcgaatacctggtgttgcagtctggctatgacttccaaatctacttaattccatgagctctttgagtatgtcatcacatccaccaatacaacttataacagcatgaaatatgtccgaatcaccttagtatgtaaccaaacaaaagatgtgtacgtgttgagaggaaagaaggatttgttttttggtcatataagttttaactgaaaaactaaagtgagtatggaacttcaattgaaataggagagtataccgaggtgatcgacatcaaaatttggtggaatatcccttcgccgaaacttaaattgaatcttataaaccggacctgtaaatttaacagattatcaatattcaaaggagaatcagcaaaggaacagtccatcagtgaaaatcattgatcatactagtggtacaatttcaataattggggaactaaattattcacctggagcacaggtaggacaaacttgatcagtcacagcagcccctgaaagagatcgtgggagccaaactacatttctacactgaaagttcaggaagactattaatatcaaaattttcgtcggagttcaattattttggctgcattattagttccatatgctcttttctggcaagattaatgaattgtttcttatttccttttttactaacaagaggtctggtaactaagcaaagcacacatgttactcacttgagggaagccccgacacccaaccataaattcgccagtctgaggaaagaaaagcaaagctcaagcatggacatagtgcgacacttccaatatgcctaagcttcagaaccatttcaagaaagaaaagatgtatgggaagataattttaccggcctttgcttcagaaacatttcagattcattgcatgcagcacatggtctcacagtttctatggagttctgtgtctcattgaccggtctacttgacctagatcaaaagtcaaagtgaagctagaaatttgtagcaatgaaagaagaaagccaaatggatccaatcaaaccttgcaaagaatgttcccattgcatcaaagagtttcaccttgtttgcccttgcctgcattataccaatgataagtggttaactactagatataaactcagaggtcagagcaattcaatagatgatgaacagtttctatgcttcacttcctgcgccatattgttacttttatacatacataaaaaagaacttacatcaagaaaacaagccttcatttgctgcaaacaattctcaagtacttctgatttactctttgtaccaatgctaactgatttcatatcagcttccatcattgatcttaaataaggtttccaaagctcatacctaaaatgacttaaattatttcaagaaaccaaacatattacatgggttcagtaagtgaggtttaagaatcaacttaccccatttcatcgtaacccatcaccaatgcctcgccctgcatttagagaaaaaagaaacaaaagacacgtgtgaaattagcagatgagcttcattttcagtacaatggagaaaaagtatctcatggacaagtactatctgcactggagaaaaaatatattacagagaacagtatttcctgtgaaccagataaatatattttacaacccactaaacttttagcgcatttgacactttggtgctgctggtctgttggatgatttggaaggagagaaacacgcgagtattccagaatcagagccgaacagcggggttcctttttggcgcaattaaagacgaagcagcgatctggaaagaagctggggttttcaatgttttaggagagtaacaaccttctgtaacttgtattttttctttttaggaagttgccgctgtggcaacatcctttcacttcgacagcttcttgtcgaagtctgaaacttgtatgtgtgtaaatactccttttcttaagtaaatttggtcagcctatcttaggccggcctggctaaaaaacccactaaacttttgccgggtcagcacaaacccctaaactgtcttatcaggactagtccaatagaaatcacagaaggtatatgtaacggaaataaatagaatatgtcattagaagtaatactttcagctattttgtccaaaagtgtggatgcattacgtatgactataagcatgaaaaatgttgatgaatctgacattcaaaagaaaa

SEQ ID NO: 1943 - DNA, 7668 bp, Oryza sativa
  unsure (1)..(7668): unsure at all n locations
agtattaaggtaaagacactgcattcctgaactccggggcgcagcatttccacctggaccagcaaaaggtccatttcctaaatatgctacctaaatacctggcaatgtaaacagctaagcatattggcttgtaattcactttctatttaaatgctcctcctttctttcccttccaataaatatcaaagcagttaaagtacatccaaattggccacagttaaatttttcatgagtcctcctaacattccattcttgtttactgactaaacatattatcatcctttatgtttcccttcccaataaatattaattgcaacgcaccacaactggcacagataattgttttatgatttttttttcagaacaatgctattaaagaaccaattaatgtaaactaaaggaggaatggcaacccaagactcacattgaagcttcaacacaaagaagacgcttctcagagcttaaaagttaagactatgtcacctctgtacataagatcaagttgtttctattactgattgaaatacactttctcctactcttgtttaccagatttattagtggagcaaagtgtttaaagaactaaagaacaagcagaattagaggtataggatatgtaacatatttacatgtcctgtatggatactgcctatttacacgtttgcaacacctatgaaacaatagacgattccagcaaggtttgaggatgctcacagcaagaacaacgcgccctgatgcattgaactgttcaccagcaatgtcaatttccacagttgtttcagctccaactgcaggttgggagcaacaagcaaggaaatggcgaacaacaagctcatacaatttctggacacaagaagacaaatatgaagagttttattacacacttgtagaacataagaaatactgcctttaaaaaatattaaaaatgctatagtatctgctatataggaaagacacatactttgtgattatcagtccaatttgtttccccagctgaaaattttgttggatgaataggaggatgtgccttgtcatcgtgaccaccattgctggggtttctccaaagtcttgcttcaggatccaaaagacgctgagcatatgttccccaatttggatgagccacttgttcatgtacgatggactacatcaaaagtacccaaacatgtcggaaaaaatagatatattctttttgaaaaaacaaacaaacaagggaaggttaaaatggtataaccatcgcaggtatttatcagagtgtagaaaacgcttttaatattttctagtggcatttcatgaatgacatatgattagaattttataaatcaaatatttaaacgtgacggggatcatcatgtgttagcatatccacacaaaatgaaaaggggaaccaattaccaaaaaaaaaagtaccaaaccaattactctctctgttcccagatataagtgtttataggttgattagaaaagattaagggtttaggcgaaactcaaatgcccttgcttggattccctcccaatcatctgactggctgaaattgcttacattcccctactttgaaaactgtgtccaagataatgcttatatttgtgtacaaagtttgaattgctataaatgcttatatttaggaacagagggagtatttgactttgagaacatattctttatcatgtaaattatgtaaaaatgaaagttataggtgcaaatattcaataacatgtaatccgaatcatcaaaccatgaaataagaatggacaagaggaactagtaaatttgaaaacatacatgtaggtcagtgtttggagagaagttatcagtctctgtcctgggataactaataaatccagcttgataaagttcctcagccacctgatatagacaggacaagagagcactcagcaaaacaatcagttcagtgatatgtggccataattggctaccaaaactgttctaggtatacaaggttaccaaaatagaattatttttaacaccttcattgtgtgctcggaactcattctgaagtacctagaggcacgtttctgaagctctatggtacttagtggatatggggggtattttagtttctcttgattccttacattttgcacctgcagggaaaaaatacaactaaactggtacttttgttctgtcatcaaagatacttatcgttattatttcgtgaacattggcgttgaaataaaagatgtcaagggctcactgacgacattggttcttcaacacacatttcatagatcacaacagcagatgagtaatcaaacaaatgaccacgtctgccaaacaagaaataatctcagatgacgtttgtaatgaaagaatcagtacaacatgtcgagtgcatcttacatccaaccaaaagatgcagtgccttcatctgaagtgtgggaacaatntattgtccagaactcttcaggttcatgagcttgaatctcccagaaacgctcaacaataaatcctagggttggaaactgcaatgcaaagaacatgttacaccaagatgaaagtaggcatcatttagtatcttctgttcatactctatagtgaagtacctggcaaggaccataactcaaaattatattcctatcatcaccagtgtcatcaagaacaaatgcatctttcagcagcattgtctggaaccttgtgaaggaggcaccgatgcgaaggtcaatttcctgtacaaaattcttaataatcatcggagatcttcaagacactaagaaggtgcaagaaaatgcttttcatttgagaagaataatataagaaggagaaaatataccgtcgtcccattccattcctataccagtacaaaagctataatattatagtcagaacatgtggcagaggctcttcgaggaccttagtttgctagagttgctgtagtacttctcagtagatgtgatgcaagagaatgcaacatcaacaaaggttggaatgataatttaattacctgtcttgcatcaacagcatcagcaaagagcttgttgggtctgtcaagatgttgcacagcttcatggatttccctgcagtttcatttctttaagacattaacaggagatttgggatgagtgtgggactgtgggtcgggtttatccagtcaacttgaacaccatagttcatctccatacaactaactcaaagtaacaccaatcgggccggatgtgaagtgaatggggatacccgtgcgatgcaggagatggatatgccatctttgcaatcaagaagagaaagtcatcagtagcaacaaatacctgtcaatcaaagctgagaaacgagctctccaaatgttgaggcggctgttggcacctgcgcatatatcaatcacttcatatgcgatattctcaccctctctatcacaatcaagccaaagcacaagccactgacacttcctggcttcctcttccaatgttctttttatgtcttgcttatcctgcaattaattaaaaaaatgaatatacctcagctgaaaaaaaaagaaactggagcagtaattataacttcattaccatcagaccataccactagcatcaaaacacaaaaacagatcacgtgtttgggcaaatagacaaatgagcatggtcattctcagcaatttaaggcatgcctgcatgttacccaataaatccatctaagataggagattctaaaaagacaaaaggaaaagatacataggcaatctatcagatcaatgatgactatggagaaaacatactgctacaccaaatcacatacaacaagcaagctccagcatggttgtggcagtgcaaccgacaaaaagagtagcatcttgttctcctgatgctggaagaacggaagaatgagaggaaacttgtatatctgtttaacttctgcctctagtttactaatttttctgcaagataaatgatgttgtaggataaactttaatttcagaacaaaagcccgacttcctgaggcctgagaatagtatctgccagggtgttcatataatcatactaggtcggccagcccggcatacaactaccctcttataccagcaatagcaagtatagccttcagtttttcaaaataaccaaataggacagtttatgcattactgtatccctcttcctatcacaataacaataacttaatgtatcacatgtatagtacaacacacagacgtatatgactggaaccagattgctgctgcgcaacagtgcaaatgaccagcagcactagtggttcccaattcaaaaacgagtagcaatcatgcgatgtcccccgatcaagctcctgaagaaccctagaatagagttccttaagtgcagtaccctaaacaaaatcagcagacgcatccattgatagtacaaatcaggtactcattattagaccctcaggcccccacgaactggaatccaggtacagtacaccaccaaacgcacgaacataaactagtcaacgaaatttcagtgccgcacatttcaccgtgagttaaacacagccaactccatggacgcaagacactaagagaccacaccatgcaaaaaacgacacgtgactggtgagggcacaattcacaggacaccgcgcgttgcgcaccaactgttcggagaaatgggtagcaggaaacagagagccgtacctggggtacggacttgcgaacgggggcgtggaagagatcagcggggtcgcacgagtgccagcggcggaaccggtcgtcgaactcgagctccatgaggtgccccgtgacggaggtgacgagcatgtggcaggcgcggccgccgatggagtaatcgaactcgaagacgcggttgtaccgtgaccgcccctcccgcgaccgcatcccgcccgacggccgcgacaggatctccgcgacggacttcgccaccgacggcttctccgccacattcagcacgcggatcgcgccgccgccgccgccgtggtgcatcgcgagaggaggcgcaggctacgctctgggagggggagaaaccggagggaggaggcggcgatttcggccttaccttttcgaaatttttggttctgagcgcgccctcgagagctaggtcggttaagcttttcacgagagagagctgggctttcgagctcaattgttcaaagacccatgaataaaatggatatgggctacatttggcccattcaattttcgccagcgtattacgcggattcgacttcgagtcatcctgaacttttttggggtggagccgtcaattgtgaattcgaccattcaagctgcatcctctttaacatgaagaaaacgagagatttagcattccttactgagccttggagagtacggaatagtattgaatgatcatgcacttaaaactctggaatgttgaaactgtgaaagggatttcgtatgaattctacacgaagactctcttatgccaaaggtcaagctctcttatgcgaaggtcaaggtttacaattacatgaaaaccacgtgatgaatggttttgcaagtcgtagctgaccgcgacaacgcgtcgagccctcgggtaggcacatcgaagcttgacacacaaggaaccaaacgcgctcaagagcattataaatttatacaacatatgaacatatacgtgttgacacagtctttatattcaccccagtttttcagccttcgtaactcgccttccacaagaattcagaacataccaggaggtcagctgctcaactatgccgatcagaagacagcaagttctgcctctagctctcattttcatgctgatcttcagcaccacaatcaccatcagtcatgcatccagattgctgggagcgagatcgcagccacgacagggaagcacggtgttcttaacttcagcaaagccaggtgcatctggatgcaccaatgatcctaacaatcctggaagaagatgccaaacaccatgagagctttgaaacatgtacatgtacaatattcattttttttttctttcttttctgttcttttcctgttcttctagaggttattcttaaggagcccttttaaccctccacagccaattcatttgttctttttgtacagaagttttgattgccctgatttgtgcagagttgttttcaatatgacatcttttttataattgttttgaatgttaccttttcctgaactcacttgccgtttccttctgatcaatcacgttctgttgattgtgactccttagcaagcagtactcgtctgtctgtatcatggcatgactaaaagaaacatctttgacgtaaggaagatccagtaatagcaaataacctcgcagatcattatggaatctgtatgttatatgtagatatctcagacatcacgatgctttgtgtactaatatctctcaccaactaggattttccagtgatcttccaaacttctggttccctgaacaggaacaaacaactgaagtgaagataagtaattaatacaagtgagaataaactgtacagtcattgccaaattgaatccttttcctgatctcaaacggtggttcagatcactgtgggactacacaatgtactaccactacacaatgtcttgacaaaacatagaagggaggaagcacagttttttttttttggtgtgtgtgtgtgtgtgtgagagagagagagagacgagtttggtttgaagagtacctgaaaatttaaaggtgtacttgatttctccagtgccccgaaaacaaaagcacaaccccggatagcaaattcctgggtcttggcgaagaagtatatggaacatgttacctgatgggagagacttccacaaaattaaccagcagcctatggaaattacagtcacgccctgtttagattccaacttttttcttcaaacttccaacttttccgtcacatcgaacttttctacacacacaaacttccaacttttccatcacatcgctccaatttcttcaaacttccaattttagcatggaactaaacacagcctcagtgtgatggtaccaaatctcaaacaaaattattgagggatggaatgcaaaaaaaaagaaaaggaaaaaagtaactcaaccaagcaccactgttgtcaagagaaaaataatactcagtagatgtttagcttcttgctggtcagaaaatggatagcattacatcttaccaagtcatactcaaaatagtaacttggtatcatttatcatggttggttccactaggtcaataagtagaagagtggcatgaagagactagaagatgttatagtgccaactgcagaatattaaaatttctcaccttcaaatccataggcatttgtttcagactttcagcagaattctgaatattcacaaactgcacagtgcctgcagccctgcgtttctctttcctaaattatccaatggctctacggaatccaataaagaagaaaatgaggaccctcagaatttatcgtcaggagcaaaccctctttgaagcatctcatcatgaagctggaatgcctccttcgagttgccagctgtgacatgaccatttatcatagacatgtatgtatatctatctggttcaattcctttagcacacattttctcaaaaatccaaccagcttcttgcacattaccatgtacagaaaacccatttatgagcatattatatgtgacaacatctggttgaaccttttccttctccatcatgttaagcaacttaaaagcatcgtgcatcttatcttctttgatataaccatggat

SEQ ID NO: 1944 - DNA, 7424 bp, Oryza sativa
ttaaatcaggtgacaccttgttgaccatcatcttttgcaagaacttctgcccctttgaaacatttccagaccggcaatagcccttaatgatgatttatatgtcatgatgtttggcaaaatgcccttatttatcatttcatccaaaaaaccaaatgcatcttccacttgtcccttctcacagtgactgtcgattaggatactgtacgtaacatgattggggaagatttcacgagaatgcatatcatcccatagatcattggctttgtcaagatcaccttgtctgcacattccgtcgatcaaagtattatatgttactatgtctggcctcaaacgctggttcaacattgtgtcaaacagttgcagcgccttgtctagtttaccctctatgcaatacccgtgaatcaaagttgtgaaggtacataaatctggtggaacccctctctccctcatctcattcaaaagcccttctgcatctaacaacctgcgctctttacagagcccattcaacaaagtattgtaagttaccacatctggcaaacatccacagccaaccatctcatccctaactctcagagcatctgacattaacccagccctacaaaatccgcctattaccattgtgtaaatcacaccatcgggtaccaatccaaagcacctcatctccctcaagtacgccatcgcatggtccatcttccccctccttgcaaacaatccaattaagcaactaaagctcaccaaatctggtttaataccacggtgccgcatctccttgtaaatcttcaacgcctcctcaatctccccaactctacaaaatcccccaatcaaaatggtaaaactccgaacatcaggcgcaacaccaaaatcatccatttctttgaacacttcccatgctttatcccacatcccactcctacataaccctttcagaaccgaattatacgtcacaatcccaggctttagccctttactaaccattgagtcaaccaacgccattgctgcctccgcgtccccagcgcgaaatctagcatcaaccatcacattatgtgtaaccacatcaggaaagacacatctcttctccatctcggagatgacagcgtcaaccttgtcgaactccagggctttgcagtagttgtggaccattatgttaagcgtgtacgtgtttacctcggagttggaggagaagacaaggcggtaggcgtccgcggcgagatggggccatccggcgcgggagagggcggcgagcagggcgttggaggcggcggcggggatggggacgcggtggtcgaggatgaggcggaatgcctcgaaggcctcgcggggcttgcgggactgggtgtaggtgcggattaggaggtcaaacacccgcggctgcggggtgggggaggagccgaggagggaggagacgatctcgcgacggcaggcgccgcggcggcgcgacatgcggaggaggagggactggcattcggaggcgcgaccggcggccgccgcggccgtcgcggcagcggccaggtcggctgttgcgggcttccctccgcttccaccgagggcggcggcgagacctgccgccgagcgtttggtggtttcggcggccgcggcggcggcgaggcgacggggaatcgccattggtgactcgaggagtcgaggtgttcgtcccaattggtgagtgttactaactaaagccgtgttcaaacaaggaatacgtattccgtagaaatcaaaatagagccaccctaaacgtaatcacaaaatacgctttcgttcgcggcttccgtgtgccaagctggaatccgactcggagcatagcgagatcaactcggtttcgacatggcttcggtttaagtcgccaacacggcctcgacgtttcgtgacacaacacgtatccttccttccacttcaccacgatcacggaggcgaacatggcggcgctctctgctcccggcgccggtgctccaacggccgcgaagcctccaccgctttcctcccaagcgcacaacgcgccgccgatgaccggcgcggcgcggccggcgagccttggcgctgctacggccgcgacgccttccccgcccgtgcagaacgcgccacagatgaccgccgtgccgcgcccggcgagctttggcgccgcggccgcgagggtttcatctccttccccttccacgcagaacgcgccacagatgaccggcgggccgcggccggtgaaccttggggctcccgttgctcgtggtacggccgcaagggctccctcgccttctccgacaatgcagaggcagaacgcgacaccgatgaccggcgtgccgcggccggcgagctttggagcttccggcgctgccgctaccaccgctaggggtccttcgccatcactgcccgtgcagaacgctccgtcgatgagaggcgctatcagggctccctgggcggcgccaccaatgcagggagcttcgccggctgggatggtgccggcaggtcagagctcccacatagctgtgaccggcatcccggccgcaccgttgcaacacaagcggatgcggggagcgcgagctgcaatggcgcaggccatggttccgaggagctctcatacagcagtactgtccaccgtgaggccccacgcgccattgtcgaacgctcagggagctccgtcaatggcaatgtcgccgggcgttccgaccatcccgactccgaccgggaatcctcacgtgtcgcagcaacagagagcagcaatggcgaggtaccccgctccgacgagctctcgtgcaatcggagcccccatccagcccacggagcctcacgcgccactgccgaacaccgggggagaaggagcaccaccaccagcacgcaccatgccaccgccatcctctcaggccgcgacctccactcctcccgccgccgcgacgccactgcagcggccgccggcgcaagccaccgctcagccgtcgacacagagatactacgtcggcgtgcagcgagacaagggcacgggcaaatgggcggcatgcgtggtcgacccgtccaacccgaccaagcaccgcctcgtgggcgccttcccggacgagcacgcggcggcgctggcgcacgaccgcctcgacctcgcgttccgcggcggcggccaccgcggcgccggcgacaacttccgcccggcgttccacgccgtggagctggagttcctcaggctgtgcgcggccacctcgtcgccgggctcccactgcggcctcgtcgccggcggcgacaagtacgacgagaagtactccgaattcctgcgcaaaatctaccacggggtgatggacaactccccctcctacaagaaattcttcgacgtgatcctggatttcttcatcgctcgggcgagagagatcgggcgggaggccctcgaggacggcggggatatgctggtggagaggttcgtcgcgatgcacaagaacaaggccgtgacgccgaggtggcgtgcgtggtaccggaggtaggtggaggaggcgcatgcgaaacaggtggacgcgcagcagcggctacggcagcaggccatggaggaggcgcaggcgaaacaggtggccgcgcagcaggagctgcagcagcaggaggccatggcgaacaaacgtaaggtggccgaggcccaagacgaccgagaacacaagaggcaggaacttgaccaccacgaacacaatactttcacgcgcatgaagttgaaaacaaaattgttatgcatacgtcccaacagttggactcacgtacaattgaatttgatcgacgattataaacagtcgcagtgcattatacatgttctctaaattgatttatagttgtatatttatttgagttgtacaactggatcatatgtagtatctccgtttcacaacgtaagtcattatagcatttatcacatttatctagattcattaatatcaatataaatatgtgaaatgttataatgactttcattgtgaaacagagtgagtatataagtatgtattggcttattgaatgagatttgagatgtgagaagattgagggcacatctgtacatgaccttagctttccgtacacaaaaatgagaaatgtgaagattttgaaggccgcgttgcttgccgcatattgcttctatgccatctgaaccggcgagacgctcgagaagcttttcacgcgactccgccggagagtgcctggctctctcgccggcgcggccggcatcggcggtgtctcctgccgacgaggagtcggagagagaggcggcgaagttggaccaccagccggtcgccatatcctctcgaaagcaccctggaaggtgaaccgttcggatcctcccaaatgtcagggaaaacccatgtcaattcctctatgacatgcatggcccactcacgtgggtcccagctgcacagtctaagaaagttcagtgtatatgtactggagcctggagtactacttcacattttggaagttcagtggtgtgtttcacaagaatcataacgaagagcacagcacatcatgcgttccaacttccagtgctcacatgaagttttggtgaattgatttcttccccctcatagcgattctcgcaaggttcttcagattcctctgtccctccgagggggaggaggagagatcgatcactcaacccagaaggaagctaggtgagtttcttccgcatttctcactgtgttattcagttcttgttttccctaattcctaaatagaagttctttctttctctcatcatgtttttccttgccctctcccatttgcatgcacgtctgttgtttcagttatctggttaggcatttttgcggtcagattgggcatttcctttctatccctagctttgtgcgtttcttgggttttggggttttttccccaaggtttatggtcctggcaaactaattgcaagttgggtccaattgaactgtctagactctacacatggggattgtgaaacaagcatcgaataaccgagttctgattgcaaattttttttcccgtgaagtcgattttttttagggtcccttgtggactgtggtattggtcactgcaagcggctgtctgggagttgcgagcaagctcagattagaatagatggatttgattcagacagaaagatgggtttttgttggtagtaaatccatgatcgaagtattgctttgtttttcttcaattttcagaacaaccgcatgttttatttgcatcagtgatagttctgttcatgatgatacattatcttttttgttattgcaatgtagtaacattttattattgcaatcatccatgcacaaatgcacaatgcaccttttaaaacactaacaagtcttcctttgtgttctaggatggattctgatagctgcaaaaggcggaagcatgaaagcggtcacgatagctcttcacgggtccagtcccagtcaagcatccttagtcgtaacagaattttgtgtcatcagttgcttgaacaatgcgatgacttgaagtatgggagctccacgaatgatttcaaggcaatcagtatgaagcggcttgaatttatcagcatcgtacaaaagctgcaagaagtacctatccagttgccatatgccagtccactcaagtcatcagaaacaaatcgccttgtgcaagatggaagaaactctagttgtcgtaatataattgacttggattcagacaatgatgaagattatacttttgctaatgtggacaatattggtgctaacacaacagttgttttagttgattctgatgacggggacagtgttgcatcctttgtagatgaaaaatcatctgattccaagcaaaatgcgaattatattgaagaaagcgttctgcctgagcagcatgcccaacaacaggaaatctccatgctggataatgaaaacatcagttctgaagcacaagcagttaagaaaggaaaggatagtatggacatcgtcgatgttatttccaacaaggtgtgctcaattattcctgaaattttattctactaatgtgtatacaagaattaagcagttttatgcatattacgggtaaacggaatctcatactaccccctgaaccctgatccaaaattagtcgtcctggagtgtgggcaatcaaagtttgaaacctttgagaataaatagttgttgcatgaaattttatcagtagttatgtcactaaaattactttcaaaaagctatagacgatctacaagaaacacaaaagcaaatctctgttttttttcgttctccaaaactgtccaggttccttaagctgattgtaatggctgtgcaaggaaaactagtagttttgtgtggctgtctccttcaagtttggagcatccagttagcaggctcccagtagattttttttgttttccgttcccctgatgacattttggcttgtaatgagcttgttatcgtttctattagcagaacgggagagggcatccctctctcctcttcaaaaagaaatattctataaattttgcaaacagagagctataaaaagtaatggccaaatgtgtgtggatcggagatcgtaacaatacccagaataacttatatcttcaactacagggagtaacttataagagaggtggaaactaatcatccttagtttccatgaccagcgtatagcatataccagccttaaaattatgatgtttgtctaaacttatgctagtatgacaaaatgtgttgtttcaacatttaagtttatactattgaatggctgaaaattatttatttgatgtcactcttgcatttcaacagagtggtcatgaggagataggggaagaggaagcacaagctgaaaatgtccagataaaagggaacttaaagaaagagatcatctctgttgcttctgatgaactagcttgtgaagttatgcgcagtcagtcaccaaccaatggaaattttgatcaatatgacaacagcagcccagttgatgagctggaaggactttggatggacatgtaccttgcaatggcatgttcaaaggtataccattggctttttctttattttttgggaatacgcataagatttgcacaccattgactattgactctctttatattccgattgtctctgtgtttgttgtttgatagatcaggatataacgtacagtttctatgagagaaattacctcactgcctagatcccttaattgtctgatagttatttctggaaggttttataacagttttcatgctcactctgaggaagttgttctcacttggcctaatcaactaccgcagccatgcaagtgcatacaactccctgtagcggctgactgaaatgcaaacaaggcagccgatcaggccaactgtatgaaattcatacgagtaattgttaatgcacaggcctttatttagtatcattctgctgttttgcttgaccgtcaataaaaagttctgtttgttttatctcacttctcaattccttgccattcagaacatgtaaattgtaaatgttttatct

SEQ ID NO: 1945 - DNA, 731 bp, Oryza sativa
  unsure (1)..(731): unsure at all n locations
cctgcagcccatggatattcatggcgccattggtgaggattagattgagatcgatcgatcgacatggatgacggcggaggtggttcttacgggtggaggaagtgctcgaagagccaggcgcggaggacggagacggcggactccgggaggccgcgctgggggcgccacgcgtgctgcggctgctgcatcatgccgaactgctgcatggcgcgctgctgccgcagctgctggtcgatgtagcgcagccgggagaggccgccgccgccctgcgccgacgcgtcctgctcgccgaggccccgccgcgccgcctgcgcctgcgcgccgatcgcgtcccgcagcgaccggaagtggcgggagatcgtctgcagcgccagcgccgtgtacggcctcgccgcgccgccgccggccaccgcgtcgaacgacgacnnnnnnnnnnnnnnnnnnnnnnnnnngtgcctgtacctccgatcaacctgccgcgcgcgccacaacgcaacaaaacctccattgacgagcacgttcttcttgttcggaagtgacatggagtcatggagatcgaggcattacctgatcgagcatggccatgagcgcggtgaccttgttctggagatcctgcctctccgacggcgagagctcgggggctgaattgctctcctgctcctgcgggttcgagccggccttgtcgtcaccggcggcgtcaccgcccttgcactcgccggaaaacttgccct

SEQ ID NO: 1946 - DNA, 6904 bp, Oryza sativa
  unsure (1)..(6904): unsure at all n locations
ggaattgtggactttacagtttttctcaatatgagtagcaaacaggaacatattattaagggcttggatggaataaataaatttgcgaaacgctcgagatgcaatgccgtttctcttcatccatgcttgaagaatgccaataaagctgatgcagatgatggaaatgtcaccaataggaagatcggttccatcatatccggaattgatatcaacgacggggtgaaggccaagtttgtacacaatctgttgtctctttcagaagccacgggagggaaggtactcgtgttcagccagtatgtgcgctctttgattttcttggaaaagctggtcagtagaatgaaaggatggaaatcagaggtacatattttcagggttactggtggctcaactcaggatcagcgtgagcaagcagtccatagattcaacaactcaccagatgctagagtcttctttggctccatcaaggcatgtggcgagggcatctccctcgttggcgcgtctcgtatagtgatcttggatgtccatgagaacccttcagtgatgcgccaggcgattggccgtgcctataggccaggacagtctaaaatggtgtattgctaccgcctcgtcgctgctgattcgcctgaggaggatgatcaccacaccgccttcaagaaagaacgagtgtcgaagctgtggttcgagtggaatgagctctgcagcagtgatgattttgagctcgcaacggtggatgtttcacatagcgaggacaggttccttgaaagctctgcattgaaacaagatatcaaagccctattaaaaaggtatatctcaatgattagtatgattctgaagtctgattagatcataatctgatctccgtccttcacattttttttgtaggtgaataccaccattgaatgctgaccagtgaccaacatgtgacgaagaactagggggaggaattaaaaacaacctgagcaagttttctgtgatcttttgaagtgtttggcagatggtatgcagcatgctaagttgaatactaatgcaaaatggggcacactacatatactagttatcaagtgtaagaattaagatgcttttgattgacctttcgcattataagttcctggacataatgagattctcttgtattcaagtactgccagtttgatatatgaccattaaaatgactattgcacttatatttgcttctgagtttcttctgaaatttttcatggtgtgtgcttggttcaatctgtctcatgcatcttcagaagttcagatcatgaacttgcagtaaaaaaaagtgttacaaaactcatacacccccccccccccccctcctatctgcattgctttataacatctggtacaaaacatgaaacatttgtagctgcaattcacagtaatccattgaacatctggtccaatctgacccaacacatcaccacatatatatatatgaatgatccatgcatcaatcagtagagaaatctgcaagctagcaaaaataccaatctatctttacagcaagctacacccccttctcatatacagttttacaattacacccctgatcacccctacttcgatcactttacttacccccccaacacaacacacgagtgtacgtgtatattgcttgtatacctgtataccctcgccgacggcgccggccggccggcccaggcttctgacgccgtcttgcgttattccccgccgccgccgccgccgccgcagacgatgcatccatcgcgcgccgtgctttgatcacgcgacgaaatcgtgcagcagctgcgacgccgggccgaaccgctgccggtcgtcggagccgttgatgtagtcgaagtcgccggcgctgccgtagagcaggccctgctgctcggccgggacggggccggcgttgttgcagtgctgcaggcccagcgtcagcgacacgctgccgccgtcgtagccgccgccgccgccgaggtcggccatgtcgccgtaggagacgaacctggcgtcgccgccgccgccgtggtggtggtggtgcagcgcgtcgtgcagtaggctggtgccgccggcgccggggtggtgcacgtggtggttcaggttgaggccggtggcgtacgtgcccatggcgccgccgaggcagctggacaggccgacgacgccgacgccgacgtccagggcggcgccgcccatcgcctccgacttgaacgggttgttgagctggcccgcgacgccggcgtgcctcgccgcggcggcgctcgacgggctctggaactcgtcgcggtcctccgacgagatcgcctcgtccttgcccttgccgccgccgccgccgccgttctccgacgacgagttggagtccatctccgcgccgaactcctccttgtacatcttctcgatcattggcttccacagccgcacgcgcgcgttgatgaaccagttcgatacctacgtaaaaaaagaaaaaaaaaaccatggaattctcttcttgatttgaatccatcagctttgcatgagagcgtcgagttcatggagctcaatctcacctgccccctggacaatcccgtctgcctcgcaagcatcagcttctcggaatctttcggatacctatggatattcatggcgccattggtgaggattagattgagatcgatcgatcgacatggatgacggcggaggtggttcttacgggtggaggaagtgctcgaagagccaggcgcggaggacggagacggcggactccgggaggccgcgctgggggcgccacgcgtgctgcggctgctgcatcatgccgaactgctgcatggcgcgctgctgccgcagctgctggtcgatgtagcgcagccgggagaggccgccgccgccctgcgccgacgcgtcctgctcgccgaggccccgccgcgccgcctgcgcctgcgcgccgatcgcgtcccgcagcgaccggaagtggcgggagatcgtctgcagcgccagcgccgtgtacggcctcgccgcgccgccgccggccaccgcgtcgaacgacgacnnnnnnnnnnnnnnnnnnnnnnnnnngtgcctgtacctccgatcaacctgccgcgcgcgccacaacgcaacaaaacctccattgacgagcacgttcttcttgttcggaagtgacatggagtcatggagatcgaggcattacctgatcgagcatggccatgagcgcggtgaccttgttctggagatcctgcctctccgacggcgagagctcgggggctgaattgctctcctgctcctgcgggttcgagccggccttgtcgtcgccggcggcgtcaccgcccttgcactcgccggaatccttgccctggttcttgtcacccttccgcttgatcgcgtcgcggacattgacaacctcgtcgagcagctcgcgcgccgccctgagaaacctcgagttctgcacgtagatgctgttctgcgcgctcctccccgccatcggcgacgactggctcgggctgagcagcgaggcggccgccatgcccgccggcctgtactggtagagagacaccggcacctgcgtgccgaggctaagcgatagcccgccctggtgtccccgcgccgccgcgccgtgcgccatgagcagctgcgtctgcaggcccatctcgccgccgtccgccgtcgccgcttccctgaacgccgccggctcgtcgccgccgccgtgcgcaatgtggctatgcgacacgatgctcgccgggagcgggatcaggccgccggccgacgagtccgagtaagggttagacggcggtgggtagtgctggaacgacatgtcgcctccgtcgccgccgccgccggtgaggtctctctgattggtggaagaggagaagaatgtggccatcgtcttcagaagcagaagaagagacagactgaagaagaatcatcacgtagatgacgagacaaactgattaactctgtcatcacaagggtatttgatattatcaaaccctgatgaaagattcagtctttggcttcagctgcaaactggctgcaaaagagaacaaaaaaaacgagtgaggattcaaaactagtagtaccaattcgtctttgagatgatttcaggtagtaaattcagactgctggattgctgcaatctgattttaggttgttgctttctagtaacattcatacttgagtcagacgtttcagagaaaaaaccacagaagatttaataggagcaaaaacatctcgtgcatcaacatggtgtactgagttttgtcagagacgtgacgatgagtccagtagtaaacagtagccacaaattcagacagcaactacaaacgaagttcagaattcctagtacaactgaagtaattccgattcttgaaagaagagaggaaaaactggaatatgtcaggaagacgaggaagtgaatccaacatagctcaagtgctaaactgcttatgtcagctgtctaccttggacagtaagcttcagattgctgcgctttctgcaatactattcccaaagctttcgcagtacctgcaatttgataaattcagcatctaatgcgaacaaaatagcagttcaaaccagtacttgtgaaatcatgaaaaggaaaaaaaggagtctgaatttctcagcaagctacaaaaacgaatgcatccagaaatagttggtttcagagaaattcagctcaatttcaacaaaaactcaccgctgcttgagaaattcagaaaacaatctcaacaataatctacgtaacaagaagcaatcttttcagttggcacaccaaccaaccacaaaggagctaacaagaaacggaaagttcaacaagcaagaaggcagaagacaataccaagaattcatatgaacaccaatcaagcccaaaaagataattccttttggttttctcagatcaaactcaaagacaaactgatgcaaccaaagaacaacgttaaacctgataggataaggctatatacctgtgcagaaatcgactttcagaccaagcaaagagctagaacaagacagttcctggagtatgacagaaaccacccagaacggggacagagatgatcccaaggattctaaaaagaaattgcaacaagagagaagattagaataataagaactaaaactgcatctactcctttttgttattttttttccttctctcttttggtttcactctgtaggctacactagagttgttctaactcctcactctttccttgagcaataatatacggctgccaccaataaggcgctgcctaacactatctccctacaaatcctaaagaaaccccaccaccattttgtctgtttcctttcgattattcttctctatctctttccccgctccctcattttctcacttaggtttcaactcgtggattcactggaattttcatcggctgtagcagtcgaacatgcagcaggaaattgaacggacgagattgactgaatgcaactattgcagtatccctggatcatccaacgctcaatctgaacttgcaatttggtttgtagtctgtacatggagctagccgcaaattctagtggattctttcactttcaatttttttgactgaacaatcaagtagtaatgatttttccaatgaattaactcagttcatccactgacagtagcacaaaaaggagtcagtctaaaaactctcagtttttactcttcttgagtttgcgcttacagcaaacagtacttgttgagcagttcagttagttcactctgtgcattcaaatagagtaggtgcaattcagttatcacttgcttggtgtgtttttacctgaattctaacccagcttgccatatttaggtggttcttgattgctaggaggccgatcactcggagtaggtgacggcatctgttaagacgtattagtctgctaacaaccagttggtagacctaaaccctcttttcccttctgaaccttccaatctctccaactgatcatgagatgctccttagcaatttgcatagggggaggatgcagacatctcacaggacgaagtgcaaaaaaatgtactgcatatatacatttgcattgcccaaaatctctcatttcttttcatttctagttaaaagtgcaacaggaggcccccaaggccacaaaactaatgctcaactttatttcagtttggtggcacacacttgctttagaaattgggcatgaggtagtgatgtgcaaggacaagtgtcttcatggtcccctccaataatgaatttgacctcccaactccttgcctttgctttgcaggtgcctctcgctgacatgtgggccaacttcgaagagacgagattcggcgaaaaaatgcgattattataggtgagtataattgacaaccaacgcattttttttaaagaaaaagaggattatttctagcctctataccgaataaggatgcacaaaaccatatttgtagacattgggatttgaaccataatagggtagagtcatgcagtcggacaaggaatgcgtattgttgtctctgtgactgttcacaattttcatggaatgtattctaaggcatatgattctcagaaaaattataaataatttagtaatttcagtttcatcatgaggtttgttttgttcaagctattaggaaatcgttgagaatgtcattagcatgtctttactatcaagaaacacaggtcacatctcatttactttttttacacagtatctgaatgtgttacctaaaaagtttggtactggacaaagaaaacgaaatagttttcaatggactacaaatttattcaataatgccatgacagggatcttcatagatttgggcgaatttaattccacatttacaattgtagtttgaaatttacaacctcacttttttttcgcgaacccacaaccttacagttccaaagaggagaagatacacatattatccatttgcgactatattcaagacagagagtagtactccatgggctgcagg

SEQ ID NO: 1947 - DNA, 173 bp, Oryza sativa
atattagcactagtagacaccgggtgtacaaaaatattattcatgacaaatatttcataagatgtccttaaatagttcacacaattgacgacattaaggcagaagtttccacagacatgtctggaataaagaaaattcataatcagctagcttataatattgaggtttacatt

SEQ ID NO: 1948 - DNA, 487 bp, Oryza sativa
tatgattaataacttaatgagtgtttgaatctgcacaacacccatttctgctagtagtagtttaattcgggatacactagatcattatactgttttagcatgtgtttgtacaaaagtagcagcagatttactgggtagccctctacttgaacatctaagcttacatacatgattcacataccactagtatatatacttgtcatgattcagtacgaacgagccaagatcaaaacgaattcacgcattcaaagatcaaagtatacttgatggatcagtcgccccccttcttgatcctcccaatccagctggccaccaccggcgtcagcgccaccgtcggcgggaacctgatcggcgacgccgccttgtgcgccgcgtaggccagcgcgaacgtccccaccttccctcccgtctcccccgtcgcgatcccaacctgcggcaaaaagcaggggagccacgtgagccaccgccgccggccggtgagccgccg

SEQ ID NO: 1949 - DNA, 7451 bp, Oryza sativa
  unsure (1)..(7451): unsure at all n locations
acatctactagtatagattttctttttttttatctctattttcaaaaatccggcagggaacagtgactgttcagaatgaaagtgaggttcagaaagtgatttgatcagtttccaattaaaaaaaaaagagaggatactgcgagcaaaattcggaagagatataaatgtaagtgctccaataagaaacggagtgcaatccaaaaataaacaatgaacccaatgtgcattagacttatgataacaacactgcaccagcacagtgcacagctattagatttgatgctgttttcttttcaagtatttgcttatagcacaaagccagaaacagctatcagataaaatatcagaaagtggctttgcaagacataaaaaataatcaggaaagctgttgatccagccagagagcaaggaacatgatgagcataccacaatcctcgcagcagacatggctatctaaaaaatgtcagttgttaataagctttcctccaaggacttctaaattttaaaatcttcttatataactgaagattaaattgcaacgttaggtggaagccatgcttttggangttatagcatacaaatgttgcggtggttcacaggttgttagcaccaaactctaattttcttctgtttaaggttatgatacagtattacagtgcataacagtatgcaaactttgaacagagacggcatatgtgttgttttctgaactcgattttgtttctttcataaatggacactgcagataataaatatttaacattcatagataagatttagttcaatttacggaactttgaccatcaacgacttcccaaatgcttaatttgaaaaaaaaaaggtatacgtatatttgaaatgtacgactatcataatgacaaaaattctttatattttgtacactcaatataataaattattagattttgtaaacctattataacaaaagtagtgattacagtttttaaagttttgaattttatcctaaatatccgagaggagtacctaaaacgcctattttattttcaacggcaattaatggaatgaggggtatgtttctagatcaaaatcttgtttcaaaaaccattagttcaaggtgttctgatctcttttttttttagcagcggccacaaaattcctaacttatatcccaatgatgtgtacgtagttaatactcctttcgtctacaaatataaggaattatggattcaattttatctgcaaatcctatatttctataaagttcatcctcaccaagtgtagttaatgctatttttttctcattgagccacatcatcttaattatttctaacccttgaatgattgatctatggttcaaattatgtccctcctttccttcttctaggaaatcatatcatctttcttttgtctttggatgattattctatatcatttcccttcttttcattccgtcattgaggtatatcaccttagttttgcttttgaataatctatttatatatgatttacattgttataaaccatatcattttaattggttataactttttttcttccatggttgatcacagatgaaaattatataaagtatataaagtgatgtcgtgtagctatatgcatgttatttatactattatcatatataactcccacagcaactcgcggggtttcattttgaagtggagtactattttcccatttcatccaaccattgcatttattgctactaggcatgacctttccattcaattaaactcacatggaaattacttcgaaagtaatttcacctcaacacttaactttgctaaccaatctagagtctactccttatatttgtagatggaaggagtatcatcagtgatgatgagtagaaacactcctttcaagtaaatattacagtactattttttagccttttaatggtcatgataataccattttttttctactctctctatccacaaaagttacacatattacttttgacaccaagaccaataagaaattaaatcacattggatgttaatcaaagagcgaatataaacatgcaactaataagtatttagatgactccttgagttttaatgaagcatgtaatttatctcttcatttaaatcttgaatatataaagactataaataggaacaatttatttagaaaaacttaaatgtaaaatatgtgtaacttttatggatggagaaagtaactttcacagaaggtgcagtaagcaggtacagggaccatcactcctcagtcaaataaaaaagaactaaaattgatgctgagaaaatgaagcaaatagtggatgggggagtgaaaggccaagtttagttccaaaatttttcttcaaactttcaactttttcatcgtatccaaacttttctacacacacaaacttttaacttttctgtcacatcgttttaatttcaactaaacttctaattttaacgtgaactaaacacacccaaagacacaccacatcaaatcttgtgctagtcattggccaatagaccattcaatggcggtattcaattcctctactgaaaccctctccaaccctctcgtaaatgtgctgcaacctcctctttctcttctccctctctataaaacacaagcgaaaataaacgccacgccactccaccgcccgttaaacacggcggcgcaatgcctcccctgaaccctccccacctcactttggaaagctcaagaagcgggcgcgcgccttggccgccagcggcggacgccagccggctgctgccatggccaagaaggggctcgttggtatcctgtacaagctccgcgacgtgcaccatcgcgcgccgccgacgccgacgtcgccctcgtcgtcgtcgtccccgcactgccacggccggcatcagctcttgctacccgccggcgccgtcgtcgtggcactggccgtcgtgccggcacccgcgcaccagctcgttcaggtgacgacggcgccgcaacaagggcaggcggacgacgacgccgcccccggccgcggctccgtgtaccgcaccgtgaacactgtctacgacacgtcgtcgctggagcacttcaacccgcggcgctcctccctggacgaggcgtcgtcctgcattgctgaccggagcttcttcgccgtgaagtcggaggtgaaggtggaggaggagaagcagaaggagaaggagctgcagctgcgtgagacgaccgtcgtgcgcggcgtccgctcgagcggctctttttcgagcccgccggcgcggagttcttgcccaagcaggtaatgcggcgcacgtcgcgcactacgattaagacgcgcgacgacgcgagagcaatcgatcttgttataacacgagagaggatttcaggaaatggcgcgaggcaagaacgacgacgaggcgacagccatggacgtcgtcgctcgcaagacgcgacgaagtcgacgaggcgacgccgatgaccacgctgcagaccggcaagaacgaagcggaagaggcggaggttcccgcgtgaaaggtggcgcggtggtgctgatggtgaagtcggaggacccatacggagacttcaggtcgtcgatggaggacatggtggcggcgcacgggctgcgggactgggagggcctggagaagctcctggcgtggtacctcaagctgaacgccaagggcgtccatggcgtcatcgtgggggccttcatcgacatgctcgtgagcctcgcgtcctcgccgatcccgtcgcagtcgccctcgtcgtcgtgcatcaccttcgaggactactcgtcggcgaccatggaggaggagagctaattaagctgttctcgaggaagacgacgaccacgttttgtttttctttagcctcatcaagagatgacaatctctttttctctttttttgggtgctaattcttttgtgtttccacgaaggaatggcaagtgagggaattattgtacagttgctaaaaactaattgatgctgatcattagtgtagattaattaattaattaatgctgagatggctaattgatcactttgctctgctgtgatctctcttcctagcgtagtgtgggtcaagatgtcaaattttcaatggctgacaatttttatcacaattttgtgaagattttgatgacaagattcagaggaatgatgggtcaaaccctgttccttggtctgcaggtccatgaaggcaatgcaggttatctgggatatattaatgagtcaccaacagctcataaatatgtggccttcatgccattggtttctttggagtaatgcggtaccagatgattttaatccaagagattgcaatgttatcaagctgtcacgtactctaccctgcggcaagtattagtaattattttggtcacattgacagggggctgtgtgtttagttcttttcaaacttccaaaaattctgttacatcaaatgtttatgtctttggacacatgcatagaacattaaatgcaaacgaaaaaaaccaattacacagtttatatgtaaattgcgagacgaatcttttgagtctaattacgccataatttgacaatgtgatgttacagtaaatatttgctaatgacgaattaattaggcttaataaatttgtctcgcagtttacagacggaatctgtaatttattttgttattagtctacgtttaatacttcaaatgtgtgtctatatattttaaaaaaatttggacagggaactaaacacggctagggtcaagaaggcactatttgaccactaattcccattttctacataataacataatatgttgataaatatcagattttaaaaaacgcacactacataattttataacgaatgtaggaatgctattgtcgtgcagccaagctagacacggtttatatactatggtcaaacctaaaaagctgttaaaccacatttaattttcgagatgttttacaatggtttttaatgaaagtagaattaagttagaccgtttattttttttctaattcaacagatcatatatatttatactaccatctctatgtagaattttttttactgctactagaactcatatatcaacgactgagataattttattggtgattatactggtagtaaaatgctatagtagaaaccgcttcaaagattctggtattttggctgaaattattggtgtttagttggaagttccttccaaataccagttgatgaaagttggatttctgttcagtttgagtaaaaacatgttgaaatttgcctcgaaattctacaagaaaatgtctgtttcatgagaaatgtttggccttggattcttatctaggatatccacacatttatccacgcacatattgcaagcatgatacttccattttcgcgagcatagtcagtacaaacactactaggactgtttaagttttgtccatgaataagccttacccacagtcctccacgatcataagtccctttcagtgttttcgacttgaatgcgtcgagtaataacacagtgggtccatgaatttatcagtgcttatcatgaagcttaactcttacggaacaggacagactagtaatatcagctaggccccggcagagtccttttaaatctactactaaatgactacttactctaatcaagcctcatgttcagcagtcttcaggagttaccaggacagtctaatcaagggacaagagtttttcactggctggagtagagactgcaaatttggtcggtaaagtttatgtaaaatggagtagtaactgggttatgaaccttgcagaattcagaagccatttgtgccatttgtaggttagatcaagcagaaacatagtggaactgagtgccatatcttatcttagcttagacaacactcgtagtagtagctcctaaggctagcttaagctttgtccctaaccaccttgtgaaacttaatttatgatgcttaaaggttcaagcattccaagttgttcttttaccctgcaacactgcaagtttgcagcttctagactgctcgctgagacatgttcgttcaatcccaataaactgtaggctcacaacgagcgatctttgcgtctctattcttatgtcagattgacatncaacgctggatcatgcaacgcatggataccaccaaacaggaacacattgtgcaatgcagagcacttgatcgatgagacgtactacttcagagtccagacagatttaagatcgaacagggtattaattacttctgcatttctgcatcctgttcactgctactcctacgtccggggacagcgatcgatcgatcgatcatgcatgcggctgatgcatcacatctcgccaacatgcagatgcaaacacatcaggcgtagcccaaccaaccggcaactacaagcatcgcatgcatgccaatccatctgatcactgatgatttacatggttcgcgtatctttgggatcacaggcttcgactgttttttcgcagcatcttcagtgggtgccgttttttctgtagttcagagatgataagcccagtaaacaggatgtgccgtgttcctgttcaagagatccgggcatgttttgcgctagtggagtggatgatgattgtgatgcacaacatctttgactatgaaaagcagatttgcaggttggtgatgcgtgatgtacatacatgtggttgtggcgggcataaattggaacttctctgttgtggatttgtatgatcagtcttgtcttgtggaatcatatgctttgtgttttgtttgacagttgtgttgttattggaaagttgatctccctggtatttctcttttagattttgtttaagagagtcagagtgaaagaaagttaagactcaccgttttctttctttctttctttctttccttttgtttgactgaagacaaaccttcttttttaactgaagactcaccggtttgttctttcttggtttgcctatagtgcgatcttcaacactgaaaataaatcatttcttcactagctggagagataaaatgaacttgctccttcttctctatccatagtaaaattcaatccttaaatatgaagtgctaatagtaaatatacagatggagctgaaacatgtagtgcatttctgacggaggtttctgaagatcgctctaaggagtaaggagtgcatcatcgatttcaggccaaattgccaaggcatgctcgttccaacaatgttttgaccgtttttattttcagatcaacgaaaattgtgccggatttgtcacgttgttcattagcctcgcttctcacgaacctgacggaagtttcagtgacagggggcaattatctaagcctcccgagcccagcgccgagatcaaattgactaactagttaatttcccctgcttccttagcagagacggtcagacttgccaaacccaatgcacaatgcaagctgcaatattgcaacacacgagtcacaagatgttacagcatagttgaaactctcatcaggatttttagagctaaaagatatctagtggttcctgctgcaactttgaca

SEQ ID NO: 1950 - DNA, 12460 bp, Oryza sativa
  unsure (1)..(12460): unsure at all n locations
tatctatggataagagaatttaacgccatgtgccgctttatcatattcattaatatgttatttataaattttatgctatgaaatgtataggtaactagatatgctaaatttttaaattttaagtgaattttgacactagtattaatatataatctaaatgtatagtaatttttaaaattccgctattggaacttagcgcctagaaggctacaatagcaccctttatcagcaaccatctactcatacattaatccgtgaccatttgctattctatatttattaccttaggtgtaagcatatttatatttgtgtatattagtttatgcatcttctatttaaataaaatatcctatgctagctttttttttcctttggaaacttattccgatactagtattttgttgaatccaagctaggtagaattattgagatgcacaaccaacaagccaaaacagaggacattcggagtatcagcccaataattatcatctcaccgtcaccttttagcaggtttagtgtcacatctcctcccagataaaaccaaactaaccctaaattattgatcctaacaaagctcacttttttttaggctttattgctactagtatattcgcaaatcgcttgctcgatccagttcatcacgagtccttaattcggtgggccccactcgtcattgaccatcaaacgcaaccggacaagggcaaagccgtaattaccccctcccaaaaccgccacgcgagatacctaccgccagagagcggcggagaagcagccgagcatagcagtctgaaccctccaccgaagatgatgtctatggcattagctatattgtcacttttaacttatttggcactatattaattaagagagagagtgaaggaaggaagaaactgggtctcatgcaagacacagcttcaacacgagaatatatgcactagacactatcaatttttgtattagaagagaatagtgtcttcataatagatgaagaataaatatgattggtagagaagagaaatgatgtatttattaatggtccactttaagaaaccatgggttgtagagtgtagtttctattgtgatgtcttattgacatggcaccatagacactacttatatatactatgggttgggattgcctaaccacctgatttgccttgtcctcagctaaccaccttgggcaagtaagcgagcaagtcagaaagccaccgaacagagcaaggtcacttcacgccattaccttcttctctccaagaactcgagtagattgggcaggagattaagatcctggccagcttcgtctccaagaattcgacgctctggncaggaagtcggtggaattcttgacgaaagcgctcacgtgagtgtgccccccctcttcccgctcgccaattctcccaattctggtggggatttccggtgccgcctcgccggcgccatggcccatgtgctatggagattattgattcatctgcttgattgttgggtgggtgcagggcgctgttcgggtatgctatgccggcgttggagtgcttcaaggcgatcgagcagcggcctggtcggacggaccatctccggttttggtgccaatattggtactgactactgactcagaaaccccttagcttggagtaattagttcatttggtgtgttcaatttgatctctgggtgataggctgatgcttagaattcgtcgtaattgagtgaattgggtaaaccatacggggattaatttctgctatctgggtacagttagctggattagagcattagaattggtgctaatatgttactgcattgctgtggaattcagtaccaaatcctcactttcacctttctgaagtgctttgaatattggggatctgaaacaccgtatctactgtttggagatctgaaacaccttgcaagagttgaccaatttcagcaaatcttgcaggatcatactagtaatcctcgtcatattcgatgatatcgctggtgtcctcacctccaagtaagtaataatcacacaaccacaactcatcagctgttcctgtaatctgctccctgtaacctggcaatccccttcattgaatgacaggataccaatgtactctgaactcagactcgccttcctcgtctacctgtggtacccccagacaagggtatgtaatgctatgtctgcaacgcttggtccagcaacaaagctgcagctaactgcatgtcctgatcattgtctgaactaaacaagatttgccacaaaactgcagctgcacataactgcatctcctaatcatatctgaatttctgaactaaaaacgagatttaatctaatttgcaacactgagtccagcaacaaatctgcagctgcacaaaaagtgcatctcctgaccacgtctgaattaaataagattttgctttgtcactctgaaccagggaactgacatcgtgtacgacaccttcctgcggccgctggtgatgcagtaccagcccaacatcgaggagcggctgcgctacctgcgtgccaatgccggcgacattctcatcttctacctcaagaacttcaccgataggggctacgatctcttcctccgggggatggagtacatccggtcccagacgtcacgaggctcaagaacgagggtatgttaccagttactctccgtcccatatcgtaaggtgttttagttttgttctaagttaaaattctctaactttgatcaaatctataagaaaatatattaacatctactctaccaaagaacactatcaagacatatttcatagtgtattttaatgaaactaatatgatattgtagatgttagcactttttcttttacaatcttggtaaagttagaaaagtttacctagcacaaaagtaaaacaccttacaatatgaaaacagaggaagtagtagtacacatgttgggaaccatggtcatcacaggattccggaaatgtaacagtgcagtcaaagaattcaggatatgtaacagtgcaggtgtgtaactatgttggcaatggtttgtttctgctgtgcagcggtggttctcgttcggaggcgaccgggcagagaggtcgagctacgttgatgattatgtcgccggcggtggcgatcggaggagcacggcgaggcaccggcgaccccgcgacgattactaacgggctggaccggcgccatagggattcagtagagagaggtgcacaggattggaaactagttgattaggagtgacaaaatttaaaaggcccaaagcaaaacttctcaaaaacatgatgtgtatatatatatagacaggtgatcactgatccatactctggtatatatagctcctcacaatttggcgttgcaggttggctagtttgttggttttcctgttgtgatttgtgcacccgtcttcgatagactacatgattcattttttgaaacctaaggcgaaactttgttccacttttatatttagaagaagagaattaacccagtttataaggaaaaccgggcccaaaaaccacacaattgcacggttaattataggaaaaccggctgaaacccaccgctacacaactgacaacgacggcggagcccaaaagcaggatgtcaccgccaagctaaacacaaaagcgatataacagctcccacatcgcagaagaggtgttatcgttgccgagctagccgcccaagcgacccaacagcgccgacttcacaactgcagcgacactgaagacacgaaagtcgccaaagcgaaaagcagctccgacatccaacaatagacatcagccaagccatcgagaagccactttcttcacgcggccagcaccccaccagaaggaacgaagtggacccaagaagacaaaggcctcgccgagcacaaggtatgaaagcttttgaaccgaaaaagaccatcaacggtcgtcgatgcattggaacttctccgaagcgacgcccccaaggaggacacgacgtgtaacgccgccgtcgctcgtctgaaagccggaacaaggttttcatctggagattgtgggggatatgaaagaatgccatgacaatgcctccaagaagggaaatgacgcccacgagcgccgccgtcgtcgaaccggccaaaggcacggcaaggctttcgccagcatcttcacatcacccacacaagcacccccacattgacggccacagaatagtccatgacgtctcacaagcacccatacctcaaccgtaaccaacggcaaagacggacccttggccaccaactcctacagcaagccgaagcctccgccctccccctagcgttccccacgaccagaacaaggtccggccaaaaagggagggaaaccgaaatgagggagaagactcggtcgtcaacgaggaagtcgccaccgcggacgtcaagcccaattcctgcttcacgccagcataagccatcgtcccgccaactccacatccgcacatcgccgcccatccgacgcggaggggacggatccagccgcggacggccagatccagctaggacagcgcaagccggctcgacgtaagcgccgccgcagcaccgttgtcgttgcgaccaccacgccgccacagcctttgcctgcgcagcgctagcgccgtggccccgcgcggacgacgccgaggccaacgccgcgacaggcgcgagcgagccgccgctgcccgcccaccgcgacgccgcccctgcctgtcgccatctcgagccccgtcgccgacttctccctgccgccagccgccacctcaccagtgttgtcctccgctgctcctcgttgcgctgcaccgctctccgccgtcgccggctgcccctcgcgcgcgagccagcctccgccgtcgccggccacacctccgggaacgcggcctcccccgctgccagccgtgcctccgcgagcgctggcctccaccgccgcggccgcgcctctgcgagcgccggcgtccacagccgccggcccgccctccgcgctccttgcgcgcgccgcatccgctcctctcccctccgactgccgtctccggccggatccggcgggggcagcgccggatccgccgcctccacgccgggatgagtcgccgccgccgcgtcctagccgaagacgacgcgccgccccatcgccaccgtcgccaccacctccctcccgcggccatcctccaccgccgcctatgcatcggccgcgtcccctcgccggatccgcttccaggggcgtcggatccgccgcgcccttgccgtcgccggccgccggagccccccaccgtcgcgcgccgctctgtcctcccgcgctgaggaagagctttgccagttctcttggccccgccgccgccttcccgactggccgcacggctttccggcggcgagctccggtggcggcgaggtggttagggtgggcgggggtggcggcgcgggcggctagggttttgcccccgagccgcacgcgcgagagcgacgcggaggaccccactaacaaactagactacatgattcatgcgatgcaacccccactaacaaaccttttgatcattgtgatgaatacataatggaaacaaaccaaagaatattatactgttgatgatggataaaaaaatcaataccatacttgacgatggataaaaaaaggggatttttttttcatgagactccacacaagtggcaagccatccaataagactctccacgagtgacaggtcatacaactagttggagcaaccagctgctatttatagatttcgcatgcaaatctattcatcaagaatacgcatgcaaatctatttgaaagaattatgggaataatagatttcgcatgcaaatctattcaagaattatgagaatcagtaactaactagtgctatttatagatttcgcatgcgaatctatgcaagaactcataggaatatttgactaactaattaataagttaacgctggatattcctcctcgacctgatcaacctgtttcacgccgatgatgccggccacgaaccctaggcaagggcagacgtacctcttgacgaagcggtataccgcgccgccgcgccgggtcccgagcggccccggcgatcgccggcggtggagcgcggggtggggcctcgcgtacagccgcgacgtcgcgcgcaggagcgggtcgctgatgccggccttcggcggccggcgggagctctcctcgaactcctgcgagccgatcacgtcctcgaagctcacgtagccgggcgtcgtgtggcaccgcttgaagtaggcgtcgtgcgcggcggcggcggcggcgtgcaccaggtcgtcgtaggagtgcagccgccgcgagatgggcggcaaccgcgcctccgcccccgccggcgcggccccggaggaggagaagttgtcgctgccattgctgtcgctggtggcggcggcgctggtggagtggtgggagaggaggggctgcgagtaggatgcgcgcatggagaaaactggggcgacgtacgagacttacgagtagccgatcgagggagagattataagaaagaaagtggttaaaagatggagggcggtattagggtttgattatgagagagcatcacacccaactcgtattcggtgaagggggcgtagaaacgtattcggtaaaggggccgtagaaatagtgtatacagttatacgcacccggtttgccgcgcgccgtccagagaagattgaaactcaaaatcgattgaactcactcaactcaacccaaaagatgattgtaaatagatgtcaaatcgaaatagctaggtttcaccaatcatccgcggacggtttgaggaagcatcgatctccatcgaggactcgtgcggagctcgccgccgtcgagccgtccaggtgctcagtttgctgctgccgcggttgacgaggtcgcgctaggattgggagtttgagaggctggctggagagcccggatggccggatctaactaatgaattgttatgggctttggggctgagagatacatgggctgcaggccgaaccaacctgtgggctgagcagctagcggaggcgcttccgcttcggttcgtttgcggcctggaaaccgcgccgaacaggctactgggcgaagtggccaacacctaaaactggatttaaaagaaaaataaagccaagcataacaatactagtatttagattcggtgtaatggatcaatttacggtgaattttggatttttactctgttcggtagaaactggtagtaatataccttaggatttaatttgtcaaatacttttacttatgttatggtgggtttacactcgtcccttgctaatatcttccatagttggcttggtggtttacaacgtagaataaatgttaactttttataggtgccgtagctttgtgttggacggtaagactttgtagtaatgatataatcttcaatggcttaagtactaactcccctctttgtaggtaattttcaggtgaacccactgcgctagtggtcattgttgcttaacgaggagaatagcgatgtggttaaacacatgcacaagttaccggaggctagagtttgggatttcttttccagatttgcgtggaacttgagtaagcggttggagacctagtatccacttttgtcatcttttgttagttggcttctattcacgagacgacttcgttgtgaggtgttgtagtctaagtacccttgttttatttggtcggtggtgttgttcttatgcaaggtgtgatgctaagtactattgacaatgtatgtttggctatgtacgtatagtttggatgtagaggataggtttttaatcatttttttaaaaataaattgacattttctccctctacatgtttatctatgttttgttagtattgttgtattgctctcactaagcctagatgctcgctagatataatgtatttttgcttacttgtactcccctccgtacgttcaaattttttttatgagatagaacacaacctatatacaataggatgtgttccatccaatcgaacaattatattttgaaacggagaaattgtaagaattacaagttgtcctagcatatctgcactcttccatccatcccaaaataaataaaagaaaacttttgcaaaaccataaacagagtaaaacggaccgagacgagaataagccagcggagcacacgcgcaacaagacaatttttttgtttggcattcctatcaaaatattcccaacatagcatagcttctagtggaaactgtgaaccactgaaccaccaccatagacgatagcgtttgtagcttgcttgcaacggacaaaccaattaaataccccctccgtaaccgcgagattctaagttttcaacgaaggctgtatttagttccatgtcaaaattaaaagtttgaaaaaattagaacgatgtgacagaaaagttggaagtttgtgtgtagaaaagttcgatgtgacgaaaaagttaaaaattcgaagaaaaaagttagaatctaaatagggccaaagcgagaaagcttccttgcaaatcctggctgtgtgcatatgtatcagtacttccttcgtctcagtaagttaatttttttttattttttttatttattccaaaataaatttattttaaaagtaataattgtatcaaaattgatgaaagtagaaaataattatattgaaaatagataaatgagaaatagttgcattgacattgataaaacaaaggtattttagttttttattgatgatatgtgaaagaagatactttctccgttaaaaaaataaatctaaaacgggatgtgacacattctgtacaataaatatgaacaaagatatatatttagatttatactagcacactggacacgacacacacaccagcaacgggggcacacgacacacacacaccagcaacggggattagaagttgacacgactgtctatctggaatcctagctgtgctgcggtagcaactgtcctcagatgctgatactccctgatagccatagccacgacgcgatggggtccccatccatcctcccctcctgctcggttgttttcgcttcaggttcagtgcagtcacgagcgcggacgcccccaaaaaactcgccacgctgtgtgcgcgcgcgcccaccgcgatccccctgatcccattaacgtttcacccgcgcgcgcccacctgccgctgcaatatatttcgccgcgccccgcgccacgccacgccacgccaccttgcgcgcgcgcgcgcacacacaccccagcagcagagatgagggggatgggcgacgacgggatggggccgatggcgatggcgccgccgcgttccggccacgccacggcggcggcaccgccgccgccgcagcacaagatggcgatgatgatgcacatgaccttcttctggagcgaccgcgcggtggtcctgatccggggctggcccggggagcgcggcgccgggatgtacgccctctgcctcctcttcgtgctcgcgctcgccgcgctcaccgaggggctctccgtgctctcgcccgcctcgcccgccacgacggcggcgccgcctcctcggatggcggccgcccggcgccggagccggcgtcgtccgcggcgctgctgacctcggtgcacccggccaggatgggaatggcgtacctggtgatgatggccgtcatgtcgttcaacgtcggggtgctcctcgccgctgtcgccggccacgcccttgggttcctcctcgcgccgaaccagggtccgcccgtccgcccgttacgtcgacggcggcgtggcctgtgagcacggtggcctccctcccgcggatggatccaagacttagtccccatcgattccgttaaacgagtatgtccaagcgccttagccagtagacactatgcactgtatcggatccaatgtgaaaatttaccttggatatctcgctaaaataattgtattttgtcgacttgcttgatatctgttcccgtgcagtcttctctagtcgtttttcgtttgtactcctatgtttcaagatggaatgatactactactagctagtattgatgtgagttctctactatgctaactttagatgaaccaatgatttgttagtactctccttccaaaaatatcctttttttaaatggaatccttccaaaaatattagatttatttcatattttgaattagctacatttgtagttttcatgtatttaaaacttaaatgaatagataaattaaatgattaatcggaacccgatgagtcatcttaatattcattggctgcgtacatgcatacactaattgatctttgttacaccttatctccacttaaattattattatttaaatccttcacccttaagatttctaattgtattgggtgcatatattgtatttattagagtgataaagatgataataattgtttttgttctttcgattaaatgtagctgtgtcttatattcgtttcatatgttgatgaaaccaaccctctagtatatgtttcatgctcatggtaacatatactagggtattctttttaaattcctattttgtgatagtgttgtcatcaatcaccaaaaagggggagattgaaagatctatgcactagaattgccttgtaaggggagattggaatatctatgatcctaagagcgcggtgattgttttggtgattaatgacaacccattgttggaactaactatttccatgagttggtgagattaggttaagtttcagcatcaagttaaaagattgaagctagaagatggacattataccttgatgaggagcaagtgaaggcattgatgatgcggggtatgaaatggctatctatggcaaaccggtgaagagaaagcaaggctcggctagaagatggacattataccttgatgaggagcaagtgaagacattgatgatgcggggtatgaagtggctatttatggcaaaacggtgaagggcaagcaaggctcggctacaatggaccatgtggggggtgaagggcaagcaagaggcttggcgccgatggactgaatccggtggtgaagggcgagtgaaggctttgtcatgatggtcatgatggaccgtacgaggccatttgaagctatgagtaatccgtatcaattataagaagaccgcaagatggaatgccgatgatcaagaggatgtggttcttcgatgaacatcaagtcaaaatccaaagtgggcattgatcaaggcaaaggtataattgatttgggactaatatgcttaatgagtgtaggtgagaatagtcccaatagtgaaatggtgttgacatagacaaccctcaaggtgaagcaagaagatgttcctagtggtgtattagtcccaggttgcttaggagtgggctaggatgcttggagatcccccaaaacatcaaaatcaaagtggcgagaagactcggagccgagttagactagtttactttttcgctttgagtttaggaaaaaccgtactattaaaaggggttccaagtatggttctaagataacacaagtgctcttagtggtgtccaagtgttgaaatatttttaggagctgtttttgaaaatgactctactcgggacagagagtcccacccggaggttctgtccggaacttcctggcgccgaggtgaggttgaaaattttcctaagtgttgcccggaagttcctggcacccaggtccggaacctcctggcaaccctccagttcaaatatgtgagtaacggctagatgacgtcacctaaccgttatatatagccaactcgaccccagctcattctttggccattccactttagttcttgtgttccctagcttgttctagcctctcccaatgtgattttgcttcctccacccaaatcttgtgcacttattgagtgagagagtgaatttgagggtggtggtgaggattggagaaggttttgaaggctaggatgacttgagcacttggtgtatctcgttgggctatcacttgaagcttgttactcttggagggtgacctcctagacggttaggtgtcgcccgcaagtttccaacaaggttgtggattgacccgggcaagtttgtgagagcgttattccacctccgaaagaaaacagaggtgaggtttaggaggtcgtcttggtagagcaagcctcacttgtggtgttcttttggtgtttaagttggggatcttagtggtcacttgaaaccaaagagaagtacctaggggtgttggcttgaagaccggagacctcttcctaggccttttcttggcgaggcaaggtgttaatcaagacccggctctttggagctcctcaacagagacataggattctcggtggagaatccgaacttcgggaaacaaatcatttgtctcctctcactctctttatctttgtgattgtgatgcttatctccttatttgcctagttgtgctatcatgtctcccattgtatgatcacttgtgatatcttgtgtattttcatgtgtattactcttgtttgagacatgttgtacctctctatggtttaggcttccttgtgatttaatttacttgttgtgaggtgcttgaaatagcaattcaca

SEQ ID NO: 1951 - DNA, 3779 bp, Oryza sativa
atcattgcatcaatcaagcaagaggcgaaccggtaacaagcaagtcaagaagcaagataaaagcaaaactcaactttcctacaattgccgggtaaagagacatattggtaaaaattgtcccattggtaacattcctaagccaaacctctcatttcatcacaatttgcttaggaaggccaaaaatggcacttgtgccactagggtgattagttcgctacatgctagcacaaaggccatttgggtgccgaaatctcttgtgactaacttccatggacccaacattatttggtgaggcaaggtgttaatcaagacccggctctttggagctcctcaacggagatataggattctcggtggagaatccgaacttcgggaaacaaatcgtttgtctcctctcactctctttatctttgtgattgtgatgcttatctctttatttgcctagttgttctatcatgtctcccattgtatgatcacttgtgctatcttgtgtatcttcatgtgtattactcttgtttgagacatgttgtacctctctatagtttaggcttccttgtgatttaatttacttgttgtgaggtgtttgaaatagcaatttacaactgcccggaagttcctaggaagaaccccggaagttccgggcagctttctctgcttgtgagaaaaagctgccaggaagttccggaccttttgccaagaagttctgggccctgattttaaccgctacgatttgaagtaaattttaggtgcgcctattcacctcccctctaggcgacatcaaggccctttcggtaagcaactattgtatgattggctattagagcaaggttaatagtatagccaactactagctcaaattcatctatagccaatctaatagctaatttatacaatagttgcttactatactattagtatatggtcctacttgtcatacacacattgcgtcttggagtccgtgctgcagctggctacatctctctcatcttttatctcattaaaatatgtttgtagctggctaatagtttgttattgtacctgctcttatattgactatatatgatttggagttagtagtgtgctatactattaaacttgctcaaattgtttttcgggtcagaaaagaagcttcggatcattaatctttcatgtaaaaatcatgtaaagaaataccgctaaggtctattcaaccgggcatcaaccatgtggaggtctgaaaatatgaaaacgaccttgcagggtggcaccgtggcatgtgtggaggtagcactgtggcagcggcaactacctgtgctgtgcatctctctgactctgtgtggtggcgaagatttggaaaggcagcaggaagaatcttgcaagatcattgggtcccgttcttttctctaagcaaaagttgaaaagattttcgtggcacgctttttatatgaaagttaaaccgtatacttcgtacaaaaattttatatatgaaagttgttttaaaatatcatataaatctagttttcaagtttgtaataattaaaactcaatcatacgttaataccaccttattttgcatataaaacctaatttttatttttatttttatcttcagaagaaaaaaaacaccatctaaaaatcgagcgtccagaacctcttattaaaaaaaggggacgaaacagagggttaaaaaaaaaagcttatcaggcctattagcagtggcagcagggatgaaaaagggatgcttacaagaaacagtagcatctttcatctcttctgaaacgacggattgtcaggaccatatttatcaatttagctatttagtaaaaatagcaatatgatgttaaatagaaaattaaaaatttataaataggtagaaccagaaacggtaaaaaataataccactcatatggaaatggtgctcggtcgacccggaatttccgtgactgttttcatccccagtggcaaaaagggaacaagaaaaaaaattaatttgatttttttcatatagtttgtagattagcaattgaaaaaaaaaatactacagttttagttgaactgagcagattattggctatgtattggtcgcaaacttgcttctcatttaccattcttaagagccccaccgaccgctcccttctccatctctgatgagtatgtcgctattgatgcatcttctccaattgtctccaagtacgacacaatcccccttctccttcgtctccgatggttcatgccattgccgcctgcttcctaacaacatgaccttctttgtttccgcggttgatcctatgcactactctcgttcatccctaagcctctggtgctaacgcttctgtctttccctcaccggcccaccgtctctgccactcattgctattcctccatccctctaaacctgctctcatcgaagtcctcgccatctccctcattgacgcctccacctcttggcaggccatggattttgatccaatgacatccattagtggattcagaatagcaaagcataaaattaaaaccgtttatcatgttgtctattcgtaaacttatgcgtgaagattgatgaactgaaccaaatgtgaaaaccccatatacaagactacaaattacagcactattttttttttttgaaaatccctgatatgactatgcctatagaaaatcctatgacgtaaatatgaggtggctttgcagtattgagactctgaacagaacctctctcaaagaaagaactaaaatacgtacttcaagagaactcgattgaatcatggcccaaggcccaaagcccagtcgacgcacataaaatccaatctctcccggttgacggaccgatccccagtggaaaaagtctttgactgcttccactatcgcccgagtatgatttatttcctccaaccacaaaaccggtatatcgacttctctaactattaaaaccggtgcaaacaatatccctcggtagttttggaggtgggtttggctgatgtggtggtattgactaagtctttctcctacgtggcgcttacgtggcattaaaataaaaacaaaaataaaaaatatgtgggatccatatgtcattaaaaaacaattataggacccactgatatgtgggacccacctgtcatcctccctcttcttccctcttcctgcccctctctcccttgtctctctctcctccccggcctttctctcctcgggaagacgacggtgtggagaggcggtggggagcggcggcgaacgagggcggcgcgggagaggaggtggacgaggaggtagtaggcgcggagggagtgggggatcgacgacgacggcgacgaggaggcggcccagtagaagaaggtgagcgcattcctagcaacgagctccggggaggaggaggagtggcggtgcttggcaagggagaggaggacgacgtcgacttggtcggcagtggggaaggcggtggagagcgcctcccatgtcgctctcggatggtgcgcgaggtaatgggagatgcgctgaggcgtcgtggcggcggcgacaacgatagcgcacgggggaggaactcaccggccgtccgcgcgcgggggagtggctcgccggccgtccgcgcgcaggggaggtgctctccggccgttgcgcatggggaaggcgctcgctggccgtccgcgcatggggaggggctcgccaaccgtccacgcacgggagataggctcgcccgccgtccacgaactggggagaggctcgccagccatccgcgcgtgggggagaggctcgccgggcgtctgtgcgcaggggaggggttggagctcgccggtggtagggag

SEQ ID NO: 1952 - DNA, 7665 bp, Oryza sativa
gccgccactccccaccgccgctccggccggggtgaagagaaacgctgggggagagagggaaggagggaggaggaagaagggaagccgggaaggagctagagggaggatgacatgtgggtctcacatatcaatggatcccacaatataattttttgtgtgagtgacatgtgggtcctaccttttttttatttttattctaatgccacataagcgccacgtagaacaaagacttggtcaataccgccacgtaggcgccacgtcagctaaaatcaccgagggatataatttgcaccggttttgatagttggaggagtcaatttacctggttttgtggttaaaggatatgaatcatactcggagctatagttgagggagtcaaagtatatttttccatcccaattgtcccacccacctgatactaccatcacgcgacgcgacgccccacggccggcggcggcgcgaatcgcctaccgcccgctgcacaggggcactagacacacatgggctgatgggcacatgacttagcccagcattctcgcttacatatcttatgttgttttttttattaagacgtggattttaccaaggattttattagtatgttttctaaaccgctaaacaatatgtttttcaaaaaattatataaaaataattttaaaatatcaaataaatttatttttaagtttgtaacaattaaaacttaattaatcatgtgactttttcattttacgtatgctaacttaatctatatccaactctattttaattatatgttaatggcttttttattttaggtagactatcttaatcttcgtccaactctattttttaatttttaagtttgtaataatactgcccaacacggccaggatgaagcgtcgatctgaatttctttttcaattttgagggcactctccttctagagacactcccttatgaacggagcatcgaatttgggattgtggcaaatggcaatgcaccgttgctgtgcacaggtgccggccgggcgcgcttacacggctacacctaacacgcctacactcttttttctcatcagtcatcagaatacttacacgtttacatttgtgcttttgacaatcctagtaggttataattagtactaagtgcttagccgatgaacgaaatgatgaccaacaccaccgacacaccaccaaaactcttgtatggatgtttttctgttgtttgcatatcatttaaatagttacaaataaattaataaaaactagaagatatattaatatgtgatatatcacttcataaacacgtaacttaacatttaatttctacttgtaagtttaatttattttttgttgtcatatacagaagttaaattttaagttgtatgtttgtagagtgatatatcacatgttaatatattttttaaaagctttttataactatttgagtagtatgcaagtaaggagtggaagtaaggagtggacgttcaaaactagtactcgctaaactagtcgagatctctttttctctaccgctgcgcaacaacatttgattgaaccatcttacgatgctttttctcaggctcatgcagccatgcttggatgcttgcgttgttgagacttgagagcacggcacgtatgcgaacttgatcaggtaggtcgtcacaaacgcggcgcgcgtcgacgagaggccgagacaaccacccacccactagcgcgcgcaccgagcgagctatctctccgctcggtctcggtcgatcgccgcgcgcgcgcgtggccgagcttgcacggcgccattggccgacgcgagccggtgaggcgatagtgctcgctccaccactctccccgaccatcatgggggtgtcacctcacctgctacgcctgtatatatataaagcaccagcagccatgaagcccatcaacgaaaaactacgtgacagcgtgacacagggggtagttaattactagttattcgcagtgcgtgcgtgtgtgtgtgtgagcgatcgattgatcgagatcgacatggcggtgatcaggggtgtcgtggtggtggtgctcgcgctggtggtggtggcggcggcggcggcggacggtgcaggggagtgcggggcgacgccgccggacaagatggcgctgaagctggcgccgtgcgcgtcggcggccaaggaccccaagtcgacgccgtcgagcgggtgctgcacggcggtgcacaccatcgggaagcagagccccaagtgcctctgcgccgtcatgctgtccagcacgaccaggaacgccgggatcaagcccgaggtcgccatcaccatccccaagcgctgcaacatcgccgaccgccccgtcggctacaagtgcggaggtaagctgagatcgggagcagcaaagaaaacggtgttagtcattaacgcatggtaattaagtattaattaaaaaaacttaaaaaatagtaacagtttttataaaaaatcacatcatttaataatttgaaaaggaggaatagagttgaaaaaaaaaagggaagaagacagcctaatcaacatgtcaaactgtcaactcttgccacgaacaatctatgattatttcatcattttcagttggttggcgctaacaatctaacatgatcgattccttctcaattctctttcacagattacactctgccatgagcaacaaagagtactgcatgcagtgccggtgccgtgtctgtcatccgcttaatttatcgagtttatgtcgtgttacttactaaagctgtatgctgttgtgcgttcgtgcagtttagtgtcagtgtcaaacaccaaataaaagggttccatcttccgtgggacttcgtgatttcagtccgtagagttgtttctccaagtccaggatagtgtgtacttgatcatattatctcggagggatgcagagacgctcccctgaattctctgaataatagtacaacttggtttgttcatcgattcacacttttagttcaaaaaacttgctatacatttttacatcttgtatgctcgcttatgccttatgcccgcagaggagaaacagaggaaacatgcaactagtaacagtgaagaaattcagaggttgtgtgctctgcttaaacgaaaccaaatcctctcacattagtgtacagcgcgcacatggtcactgatatatgagactcatcatttatggacccatatatcagccaccatgcctctctgatttaacgtcagaagatctctccatagacccacatgtaagaggcgcactctcacatgtaagaggcgcacttctctctctgactatattagaggagcatcatcgacggttgtgcatgctgctcgcctgcaggctgatactagtgcttgcaagcttagcaaggggcgcagccacggtactagcctactaggtacgttcacacgtgtgatccttgttatgagccaacgatcgctccaattgacaacgtcggatgtgcgccacatgcacaatgagccaatgattttacccgaatcacaatattgaacatacacaacatcggatgtgcgttagacgcatccatgtgagccaacgattttcactctattagagcacgagaaattgagtgtttcttatcaaaaatcgtttttttttcaaaggtttttatcggagccgagagtgcctacctccgagccgagagtgcccgccctttctgtcaagtaggctactttttccggaacgcacacttttttttaggtttcataaaagcatatttaggtccacacgtgaaagaacctcatgaatatcgaagactgctactgagttgacaccattccaagaattgaattcattccgcaaaccaggacctatatcattaccaactccagacagtcttgcagaaactattaggggatttcaactaatcctcacaatatcggttgtgccccacgcgcccatatgatatcgatataggagatcgttttaaatctaatcggagccacaacttaataagattgactagtcttttaggtaagttatattctactttctccgtttttaatagatgacaccgttaaattttgaacatgaccactcgttttattcaaaaatttatacaaatatataagatatatatcatacttaaaatactttgagtgataaaacaactcacaacaaaataaagtataattacgtaatttttttaataagatgaacgatcaaacgtgtgataaaaaattaacaatgttatctattaaaaaaacagatataatatttttaagttgtgctctccataataagacatcttttgcttgatgtattacaatgacgatgttgctacacgtggacactggtgcaccatcttctagtagatgtatcgttcatcgcagagggcacaaatttctctatcacatataggaggtgcagagcaaaatgatggatccaccaggccccgcgtttgctgcttccgctgaaaaacaccgtgaaaacaaactaaaatggggcgcattgttcacaaaatttcgctgctttggcttcaaacgaaatatagggcgatactcctacaaaatcgcaaacttgttgtgtggtgtacgtataccactcttagaccttgttcggtttagagaggtttaaagaggattggagggggaataatttcaaatcccctcaaattctttcctcatagggattaaccgaataggccttatgattattcttttccccaattccggaggccattttgtactaacattgctaactaatatctccgtaccttatatgtggttaaattatgagaacgttcgactcgcatgcaacaaagtatcatgtgcattagccatttggcctgcaggtcatcacataaggcatacttgttagggtgcacagtacacacgctactaattaagcgaaggtgtgtcacaccctcacacgttccttgtgttaaacatagcacacgccacgacctgccacacttattttgtgcacataaatggcttgtcctaattttaagtcaaattaatgttgtgtttactgttaaactctcgagtattagggactgaactaaaaaacgtgtgattagacgaattgtgaaagctaaaacacaaaatataataaagtttgatttttgaagttcacaaatcctagtgacaaaaaaatagacagtagataatatgtgggaggataaatgacacaatcactaacaagtcggataggagtgctatgactttagagaatatggagactagagtagggagcccctaaatttagggatcttagataggagtttcttgaaacagtgttttagtaactttacatagtgggatagcgagacaattcgtgtaaccattctatccactaaaccaaacatgttataatcgtaagcacatctgacactatgcagagagtatcatctattgtcaggttgagtttgcagaatgacttctgagataatatatttacacatcgttttaagaatcatctctatacatgtatcgtcctgatatttctgcacgtacgtagtgctactttgctagcctattccattaattgaccgggattgccaagtgtccccggtatccatatatgttcatctcgtttttgtgtcataaccgtcataacgtttccgctcctgatcgatcggcttcacgcacgcccagcactatataaccagctcccaagcgagccgggagtagtagccaacgagcttatagaacacaagtacaagaagctatcagaaatcagaaacgctagctagcagtaggaacaaacaatgaggtcgtccccgatcatcttcctgctcctggccgccgccgccgccatcgccgctccgtggcaggttgcgcacgccgcgggcaagtgcggcaagacgccggcggagaaggtggcgctgaagctggcgccgtgcgcgaaggcggcgcaggaccccggggcccggccgccggccgcgtgctgcgcggccgtgcgcgacatcggcacgcaccagagccacgcgtgcctgtgcgccgtgctgctgtccagcaccgtgaggcgctccggcgtcaagccggaggtggccatcaccatccccaagcgctgcaaactcgccaaccgccccgtcggctacaagtgcggcggtacgtacgtattgcgtgcgaagagctttggttagcttcatattataccgtttcatattacaagtcagactttttaaaagtttgattaaatttatagaaagattacaattatatcattaaattagttttattaaatctaatattgaatatgttttgataatttattcattttatattaaaaatattactatattttttataaactcgatcgaagctaaataaatttgatttttaaaaaaatcaaagtgataacagatgtagtatataatatctctgtcgtagaatataaacatttttgcgtatttttcgaaacatatttggacatctatatatccggatacagttcaagaaacacatagaaatgattatattttaaaaccaagtatatgacaagtgtgatggttctctgccttttgtagcttacacgctgcccagcctgcagggctgatgacgacgtacgacggccttgtttaggctctggcgccactaaaagctacctacagatcgcttacagcatactactcctataatactgttgcttaagtgtgctagctataccctgcactgctgatgaataagtatgatcgagctagcaaagcaactctacatggttgggacgtcaacactggttaatctcgtgcgctgcaaatggtctgctagtgtaatcctgtccgcatatgctgcttgaggttgtaatgagaatggacaaagtttactatccgcccgactgatacgtataccgaacatttacgtagcaatgagcgtatgcagatacgccacacaaaactatagactggcatggcatggcatgttgtctgtgttgttgtcacactgttgcgtgtgtcagatgcaggaaaatacatagtgaaaacctaaaaattactaattgaaaactaaaagtccaagatttattacgtcaccatagagtgaaattttctctcaataaaagttttactcatgagtaaatctacgagtgaaattcttactcgtgatgatgtgtacgaatctcaaacattcatttttcaattcaacggtagttctctagtttctgccgtatattttcccatcagacgccggtgctccctgctccgtggcgccgcaacgggctacttgtcacgtgctcccgcctcacgtttgccacctcatgggctgggcttcctcccgcaaccaagcccagaaactcaccaacgccgtggcaaacgctcaatctcagccgtccatcacgagcatatcgcccgtgaataccaccaccaccagcaaaccaggcggctcgatctccctatcccctgattcccctccagcctctgcgtccccattcacctctcctcctcctcttcttctacctcgcgctcgctcgcttccctcgtaaaccatccgcgcgcgtggtccttccatggcggccggggctctcctcctcgccaaccccgccgcgcccacggcgaggcaccagcaccggttgctgcagcagcggaggcagccgcggctcctcgcctcctctcggcctccccggtggcggctctccgccgtgcaggagaccaaggagggggaggcccagacggccgaggagatcaccgagaagtacggcctcgagttcggcctctggaaagtaagcacgcggcgca

SEQ ID NO: 1953 - DNA, 9715 bp, Oryza sativa
atcaccattggaacaggagggtaatcaaatcataagtggagtgataagcaaatatgttttcagatccataccgccaattcagaaaaaaatggctatctgactatctcagtatgtacatcttcacgttgcgcctgcacttcctgttctctgggaaaggatgcagactcccatggaaaccaccggaggaattaagtcataccgaataacctcaatcgacaccagtagatctggtctagcagtaaaccttactggttatccatggttgaagcccacgcctgtaggttcactggctgcagcagacggctggttgagtgcacatggggtgtcacttatttcttcagctaagaagtcgttggtgtcaatctgatcccactgcatttctgctggttatcatgttaaagtacttcaaagttcaatgcacagtgcaacttgtaagctcttatagtatatgagaaaaaaaaaacccaatgactatatttcatcaaggatacatgctgttgtccacatatgagtaatgctgatatcatcatcggtgagaagccagtaatcagcatcagtctgcaaaggtgtagaaggatatcatgggttagagtctaccacataagtaatttgtctattattgagtgctatagcagtgtaagataactgaactataagaatgagcttgtaattttttgttattggttccagaaatttagctgtttattattttaaacaagaattatgtcaagcacatgatcagcaatttaagatatttttgcacttctgctatactaaatcgtccatatgtgaagttctgtaacattgagctttcaactaaagctgctgactaaaaatcaagatactaggggagttcaaaattatgcagctagtgcagcatcaaaattttcaaatgtgtgaattgggatgctgtttttagctcaatgacatgatcatgagttctgccaccctgcacaggaatttatttttataaaacgcaaaatccatataattctaatttaaattgcataaaaatgttttagaacataacttacatcaacatctgaaggagtaatcttcttcatccttccaaaagcacgtgaagcattaagctccggagtttcctggatatcctgctgaacattcaacggcatggtctgcttgctgctatgtccagcttctgttgctatggagggaggctctacaacacttgcatgccttggaggtgttgcagtttcacctagctcctccattttcttatattgactgataatatagtaagggtgttcatcagataatttcttttgaggcaaaagcttcaagagaagaatgaagtgttacctaaccaagtaaatatctattgggcccattgtactccttaataatattctatatctccgttggagataatcaccagcctgcttatggaaagaaaaaaaatgaaataattaatactccctccatttcatattataagtcactttgagtttatcctaacttacgcaaacttgaaaatgtttgacttaggacaaacccaaagtgacttacaatatgaaatggagggagtagcagttgatcatcaagtattgtttatatggagaagtcatttagtgtttattacctcgtcaggatctggaacttcaactgtagtaccacgaggtccttttattgcgattaatgcttcattctgcagaatgagaaaagccaaataagttacatcaaaattttaattcagcacagcccccataattttatgttaaacaaaattagatcaataacaatattgccttccttaataacatagacaaacctgaaagcagggcagtcccttgatgtcatcttcagtaacaaatagccacctaaaaacaggaacaaaaaatatagctcagtacatgattgcacagtataagcatattacaatttgcaacaggtaaattgtcacgagtttaactttccaccaggctttgccaatacttccattttgcaccggttctagagaagatatgttgcagaaaacaccagctttgacgctgcagttttgatgaatggtggaaatttgtgcatgataagtctatgatgtcagatggttgactggtggttgatctagatcaagtagaagcaagcagggaggatgatggttgtaaggtgtaatgggatatggtgaaaggattcacaaaacccagtgcaaagtgaaacttgggtcaattcactcggtgcaaagtgaaattattaaaaaaaaatggcatgctagcatgcccaacaaacaggaacatcactacctatgggtgctttcgtcttcagttaactcctctcatcttttccgggatttcactggaacacaaatatctcggaaccatataaaaaattactgtcgattattttcaaaatttggacctctccaaagacttcaccacctcttatccttcttttctaaaagctggcttcctggtatgtaaagggttttcaacttcggtctgcaagaacactgaaggcagcttatactcagaacttcttttacaaacattcagataaatttgccatgagtatatagattttaacatgattgcgtaaatgagaaaagtagaccggcaggtaccttgagacatgaaatatcactatcaaggttagttcctgagtcatccgaacccctgtgatgccatgaggttagcatctcacaccataaatacaagcatacaagggaaacagaagataaagattacctccaacggattctgttcttaagcttcttttctatcaaacctgttccttccagtacatttgttatgtcatatatgcgccgtttccgaacctgtttttgttggaaaccatatataaacctgtagcaaaactaacgaaaagaaatgactgttaaaatgagagagagggggggggggtttacccatacatctaatatctttgcagcatcattcaaatctagaatgccatcttgagtctgcttgagcaaattaatgaattttctggtcaatagtcctgaacaaacatcacatgaatagctgtcagttaaaaagagagtaaactgtatcaaatgagatgatgtgactacatttataaagcaccaaaaattcataatggtacatttaacatttagatttccacaattgaaagttctaggtgagggactgctatgatcacctaatgaattgtcatagcgagaactggcaggagtggatggatttccaggtgaacctgcagatacaaatgtgtgtgcattgcattagtcacaggaaacaagtataaagaaaacagaacaaagctgtgataaacaaatactgttaacttaattaatgtcactgatgaggaagtttctacttgccagcattggatataggcgtctgaggtccagctttattgaatttagccattgatttggttgtcctagaagtttttccagaaactggggtcataagtgggctgccaactccttcagtaaacccagggctagtcatcatacgttcacttgactcagcagcctcactttctccacatggagtttttcttttcagctatgcacataaagggggatcatgcattcgtaaaatgggcaatagtattatgtagtggtcaactcaagcgaattgaaaacttaacaagttaacacatgaatcataataagctagataaaaataaatagcaacacctacattacaatctcatgatccaagaaaacacttgcaagggtacaagcaatggcaggcataggtgtataactgctttggtgaaatgattggtggtcattgaatttggaagataactatcagcaatatccatttcataatcctgtgaaatgatatgtgtttctgcaccagcacacctgtttgccgctacaaccgccttgtgcatttccacatggaggagagtatttccccaatgtgatccatgaggacccccaataactaacatactctcaatcacgagtaaataaaactgcttcctagcaaatgcactgaagatgactagatgaacacaacttctagcagaatacgcatttcagacgtcattcagatacattgtcctccaatttagaatcatgacagaagcatctttccgaattgctgacattatcttccaagctgctagcgactaaggtaaaacagcagtggacacatctacatgtcctagaaagtaccaaatcctattatagtaccatcatactatccaagccgacggaatgcaattttcaagtttcaagtgggtggcttggataagtgaagagctattacccagtaacccaaaacaaaaatataccagaagacagacatttcacaaagccttccactttggcgtcaataccacatgactgaatagatagattcatagacagtagtaattctaatcttcccccaaagtatttggcgactgtaacaagccgcccacgaattcacccaaatccacatgttaatctacaccaacacccccaaataaaataactggaaatgccgtttaattgaaccgccatgtcaccttgtaccgccaaatagctgccgcacaaaacctcagaaacccgcacagaaaccatccccgagaaggaaaaaaaacaaaaactagccaatcaattggtgcacacagtaaaaaaacctcttcggaataagctcaaaaacggcaactcacgggtgtcctcctgatgacaatcccctcctcgatctcgccgccccgggacgccgccgcgaagcggtggtaatcgccgggggccgccgcgaagggcgcccgcgccagcggcggcggcagcggcacgaaccgctgccgcaccgaccgcacgatgtgctgcgccgccggcggacggcctcctcccgacgacatgcctccgatccgcgagaagcgcccaatcgggcgggcgcgccgcgatcaccacccccggacgcgtccgacggagctagggtcccggcaaggcgggcggcgaccgaggcggggaggtggggggagtggggcggcggggttaaggcgaaaagcgcgaggttgtgcgagcgagaatgcgaggaggaaacgagggtggggggaagggagggaaatttttagccgcgttcgcgagtcgagtcgcggacgtgtaggggggaagatgtggatggatgtggatgtggactgtaagaccggaactggaagggaaggcagcggggaggggcgcgggtttgagacacggcttcttcatggaggggctgcgtgcaaatatcgcgggcgtggtagttggtgttatcctacgcccgcggctttgttgttggcggtctaggctgcgttaggaggaaatttcaccatcccccatgtaaaataaaacgattccgtataaacatacacacgcacatctaagtgctgttttgggagcttaaacatgtactccatctgtttcactaagtcattctagtattcccataaaaaaattcattaacatcaatataaatatgaaaaatactaaaatgacttgcattatgaaacggaggaaatatttggttctagaattagatgtatttggttctaaaactagatgggatgggatgatttttcacacgtatgtttggttcataggataggatcattctttgtttggttgaaaagatgagggagtgatgggatggacgctatttgtggctaccgtcaacccacgtccgatcccaataggcgcggcctagcaactcggcgagcgagcaagcggagtagggacggcgcggccgacgactcgacaagcgaacgagcgagcaggcagaaggaggagcagcggcgaccaacaggcggacagacgagcgagaaggcggcggaggcgaggcggcagccgcttctcgcggagcagaggtggtggcggatcgcggaggacgccagccgctcgtggaggagaggcggtgggtcgcagaggggtggtcgccgcacgtggaggagaccgatgaggcacagctgcggccgctgctcgcgaaggagatggagaagccgaggctgcggtcgccgctcacggaggagaggcagctgctgctcacagaggagaggcgacggaggcgaggttgcggctgtcgctcgcagaggagaggcggtagccgctcgcgtaggagacggaggagcggcaacgggtcgtggaggtggcggcgtctggtcatggcggagtgccggcggtcgcggaggtggcagcaggtgtgaacaacgatggcggatgcagaggcaagttgacgccgtgtgctacatccaagtgggatgagttcgtccggccgattttgccggatggcttggtcccaaatttgagaggaatattcatctatatggatcaacccaacccactcgaacctcaaccaaacactcctaaaaagtgggttcatcacatcccgtccttgcaaccaaacaccatcgattataagaagcggctggtatgtagtcagcttttgagaatctgaaaaagtcaggcttcccagcttctggcctctagtttattttggattctacaactacatcttctcagaatttgtaccaaaagttgtattgtttagggggcttctgattttgggagaaactgcaacagctagaagcttccccaaataggtccttagtatctttggaaaaattggccaggtatattttgagattagtgaagtcattagaaaactagaccgacatatcttgaaattgatgaagtcatcacaagcatctcgctatcgacggatacgtatatacctatcatataagcactcgtataaaatctataatttgaacccgtgtgaattatttcaaccacaagaaacctaactaattgagctacgttcacttcgccacaaaaataattattttgtgtatatattagtgtcacagcaaattattgtacaatttcaataattataaaaaaggtgactgcaaatatcaaatttatgtgcaattctgcataatagtgcaaacaaaagatgatctctataggttcatcattttatcatgcatgatgccgatcacgcatccacagttccacactacacaccactgttcactaagctgtaagtgggttccaacgtctcgtagatggcaccttgaattcctaaattagattcatccaggattgatttctgtttagacttgtagtattaggccatttccaacccaatgactaggatgatgtccatagcattaaataagctgtcacataggatgaaaaatgatgtggtaagtaaataaatgaggaaagagaaggaaactatgtcttgcatgagacatggtttttacacaaacatccaagacattatgtgagataagtagcattaaatttaagtatgaaatagtggtgtttgcattggaagagtagtgtctagtactaatttcttaatgatgtggagtttatgaaaactacgtctagtattttgggttgagaatagccttaatatatatcatataccgttgtagatttgtttttttacgtgacaatgagtaccggacagacatgcgacaattagttgatacaatcgatctggtcaaacaacagaatcgagcatcccgtagagtccccaacagaggttgggggggggggggggtttaaacaccgcctccggtttataggacaccagtgcgccaccgcccgtaggtgacgtgcataggacgctccgaccgctgcctccaattaaacttgtttcaccgactcatcgctgcccccgctaggttcagcattcagagaacacccatcttcgtcttcgtcgagggcacctaggagtctaggaccaggcgaagcaaagatatcgatggcgccgccaccggcgttagagagagcaatccggattccggccgacggcgagcgtcaagtcctgcccgaaccaattccccgactccatcggccgtacatgcaaggaggacttgaatgggccgcatttacgccgcagcacagctccggctgacatcaatcaaatgaggaataagttcactatcgtccctcaactttacattgagtgtgtatgatgtctctaatctccaataccagaaatgtctaacccctcatctgttcaaaatcatactaagtaagtctctcgacagtatggatgtctggttttgttgacgcggcatcctagtcagaaaaaaagtttaaaaataagtgggggccacatgtcagccctatcatccttattctcttttttttctagcctgggagagaggggaaggcagcccgaccccggtgggggaagaggcggccggcgtgggaatggaagggggcgccgggaccggccgacgggagaggggggagaggcggccggcctcgtcagtgggagcagccaccgtcccaccggccatggccatcaccggcggcgggagggttgctgctcggcttgcggtgctcgttagaggagtcggcaagatatgcggtagtattgagtcaaggcgacaccgcaatgacaagcgcccgccgcgatagggagatgctaccgttggtcgcgcacgccgtctcggtcaatcagtccttgtaggtggggcgccgtggcggcttttggtcgcctatttcactttcttttgcctctcccccctctccccccagtcatgttggccacctcttctcccgccggcgttgggctacctccccctatctcctaggttggggaaaaaaagagaagaaggatgatggggctgacatgtaggcctaacgtatttcttttaatttttgttgctaaataggatgccacgtcaactaaatcaggcattcgtactgtcgagggatttactttgcatggtattgaacagttgaggggttaacatatctagtattggggattggggatgtagcctcgatgtaaagttgagggatgacaagtgaacttattcctatcatttatcctcacgtcctataaaatgcaacctaggttgagcttctgttggggccaagaagtagtaggatccaaacctctcgaatccatggatcgtcaaagcatcagaatccccaacaaaaaaaagccgagctggaccgaaccacccaatccacgtggcactggctgtggccactgagagggcggcacgtcacccgtttaaacatcttcctccatttcgcaaacgttaccagatcctctgacgtagaatggttctacgtcagaggaaagtctgagactagattcccgttcgtcttgcatcctaaggcagcatctgttccagccttcgttgtttgatctggaggtgatgtctaacccgctccattcggcccattagtataccaaggagaaaaacaacaccgcaatagctaatcgactctgtcgtcggcgatgcgagaatgaacaaaaagagcagaggtcagaaaaaagcatgaggaactgcagtggaggaggggacggaatcaataacgttcagatggatatccaacctacgctacggttccacccgctcccgccatcccgcgcctggggagatgacgagagcggcgtgcggtcaggtcgatggccatggccgacgagcgacagcgtttctcttccaccttcactcgagtagctagttcccaactccctccaccctgatttccacacgcacgctttcctaaactgttaaacggtgtgtttttttcacaaggtttatatacaaaagctacttaaattagtaaatattaaattaatcataagaaaatgtttcactctatttttcgtgcggagggaacataatgcctcgctctattttccgtgcggagaaaatatgttccgtactcaagagaacaaacgcagtcttctgcaaatgggctgaaaggagcagtctggacctcgtctctaagccgaacgacgagggctgaaacagattgcgg

SEQ ID NO: 1954 - DNA, 3026 bp, Oryza sativa
  unsure (1)..(3026): unsure at all n locations
cgccgccgcctagagatcggctagggcccgcagcttcgtcgcccgggccggaggcgaggttcggcgcgatttgatgtttgatttttttggggtggtattggtgcctctgtgagagttgggattgacgcgcggccgcgtgtgtgcgtgcgcagggggacctgccgttggtcgggaacaaggcgccggacttcgaggcggaggccatgttcgaccaggggttcatcaaggtatggcggtaatccggtaaccacatgcacagctacattgcgccacgcacgcacgcgcggcagtgttattcgacataggggattaattggcccaggaaaaaatggggcctatttgattggcagtgtaattcaccgtgagatttgataatttaacactcttttcaatgggtttcgataaattgacatcctagcccactttcattcactcatatggtcccacatgtcatcctcacaaatgtcaattaaagtaattgggcaacgaaaaaagtgtgaaattatcaaattttttttacattcatcataggggattaattggcttgggccaggccaaaagaaaaaaaaagtggtctattcgattggtagtctagattagatgttaagtccatatccacggctgtttaatgtagaagctgtatggttgatcgtgcttccaattgatatcttcgttggtcgtgtccttcactccttctgtatatgcaggtcaggtcaagctgtctgagtatattggggaaaaaatatgtggttctgttcttctaccccctggacttcacgttcgtctgtccaacagatgcgttgaccttgtcgtgctctgtcatggaaatgccttttttttcagttttttttcattcctaaagtctaaatgcatgtttgtaagctctgcagagatcactgctttcagcgacagatatgaggagtttgagaagataaatactgaagttctcggtgtttcgattgaccagtgtggtatgctaacttttaccggcatgactttagatgttgttacggtgtcgttacctggtctgttgctctattgagaatttggtatttccattccatctggacatgtagcttttctcttgacaatatttgtggtttcttgaatgccttaaggttgtgatcaatattttagctttcctctttatgtgatcaatattctatttgttcttaacgtctgaatatagagcattagatgaacccttgcattaggccataagttttaacataagattgccacgtgttgaactttcattctgtattataatgaaatgtgtggtgtttgttatgccttatggaaatattgaatggaagtaaaaaccgatgctctctaatatttagacaatagcgttataaacattcaattcagttattttgaaacaactttgagaaatgagactgatgtaacgtcttaatactctggtttgcttctgccaaggagattcattgcatactcaaataattatcacaaattatatccagtaaaagtattgattttgctactattacagtgagtagtttgtaggcagtagtggtactgtaatttattttttactatcctctctttctgcttctgcattaagcatttcattttttttatcttataggtatcattcactgttactctgtcgactataaatatttaataagtggccacaacctatgcttcataagtgtcgcatactaatttggctttgaaatatcttttgtttgcagttttcccatcttgcatggattcagacagataggaaatccggtggtcttggtgatctaaataccaactgatttccgatgtcaccaaatcaactagcatagtggcccgcgcagattgcgcggctagcatcattatatttttttctcttataatagcatatatgttttctcaatgtattattaaaatatattaaaataacaacataattttgtgtgtgttcatgagagcgaacttccaatattcctttgaattttagttatttgtaaattgtatttctatatgtactctaaattctactttaattttattagtttatttctgattttannattctataatggagtctatactcgtcttctaatatcccgtattttaattcctaatttatatantttgtaattttatttctatatatggattctaaacttatctttcaatattttttaattcttaattttaattatttttaaattatatttctatatggactctatattcttcatccaatatatttttttaatttcgaattttttatttctaaattgtatttctagatggactctaacctctatatttaatttttcttattttttaattccgaattttcattagttctattgcccctaatttctattatttctaaattgtatttctatatatggattctaaacttatctttcaatattttttaattctgaattttaattatttttaaattatatttctatatggactctatattcttcatccaatatatatttttttatttcgaatttttttatttctaaattgtatttctagatggactctaacctctatatttaatttttcttattttttaattccgaatttccattagttctattgtataccgacatggactctagtcttaccttcctatattccttatttttaattccgaatttcagctattattaaaattgtatttctatatggactctgttttttctttttcttagattaatgtgagaatttctagaccatgagagcgaacgtggaggcttctttttctattcctttaataatataatagatttcaaagtcttttggtgtactaatccctgatcaggtatacttcagttatgactgcctgttggctatatatacaatatatgtctttcttctggatatttacttgtttgtattcaaagtcttgtgtcatgtattccttgttcttaatctcataagagctcatactttctgctgtcaggggattgctctgagagaattattcatcattgacaagaagggtgtgattcagcattctaccattaacaaccttgctattg

SEQ ID NO: 1955 - DNA, 2205 bp, Oryza sativa
ttcttgatctaatttttccataaactctgaaacactatgtcttctattatctattatatttctatcatatgcttctgtttctaagtcatctgtggttctgggtttgtaatttataaatctaatgctggtatttcctttactattttgataacttatataattttcaggctgactcaaagttttgctttcaattaaatcactaattttccattcttctcctgccctttcttcagaacttatttttaaagggctcatgaaagttattcccttagagtgcatattttcaatcacgtcatttacatttattttgtatttggaggcacttctattagttaatcttcctataaattctatgcttactagcaaatttgttcctttaaattcttcgtatctctttgtttgaaaaccaaaacttattttatctataaattcttttataggcatcattagatctggggctatatatgttatcaacatattctcattcatatcaccttctaaaaatcctaatgctgctttatctattgtgtccaccttttattataaaactttagctcctaatttctttcttatcatacctttgattcctattatatacatacattggtgaatatatttataccctaaatactttaatccattttcaaattccttggctacaatttttaactcaattgcctgtattaaaacacttaactatacttctttagatattcctgataacccatttttattctcaaaaaatcccatgcaatatatttgttgaggtcttattgccctcatagtatctctttgatatctttcgagctgtttgtctacttctgcaatatcttcaagctcatctatgtcttcatttttacctttttgtttatcaatacaacttaaagatttatcgtctctgcttgctattcttctaaacaaactcctagatagatccatttttctgaattaatagcttgagacgaggtaattatgcctgttgaagccaaaactatctcttttcctttactagaatttattatttctaataattttttgatatagtcactgttttgtaatatcttattctgccttatcttatattcctctagctcttttagcactgaatttaatttattactgacaagcaaatattgttcttcagattgctttcgttctttaaacaaatcttcaaaccttcgctctaaatcttcctgctttttatcccaatttatataaaaattatatatcagatcaacaattaaaattaattgactattgttagagtgtcaactatggtcttcaatgtgatttaacaccttatattcagattatctttgatagtaattacctttccaatattagcttctgaatttgatttctctatgatgactggctctgataccactttatgatgactggctctgataccactttgagtttactggttactggttatatgtatatatatacatacatatatatacatatacatatatacatatgcatatatatatacatatacatatgtacatatacatatgtatatacatatgcgtgtatatatatacatatacatatatatatatatatccatatatatatatatatatagacacactatgatttatttttacatatcaaatctaagtatatccaatcaaaatttctatggatgaaaattttatcttcccaaaaaataaaacgcgttttgttatatctcatgataataaagacacccaatcaagaaggaaaatgacttcgcatacaaggcagtgcaaatatgcttatatccagattatcatcattgtgttaatcaaatcatggaccttctcatcatgcaaaacgatgcccttcgtctccttagtggtgctccaaatagggtctcaccatgcttgctaactcacataagcatcattattgtgtttatgtttctttgagtaaaatcatgagcactttaaattagtcgttcaaaaaaatgagcactttaaatatttattttactgaaaagaaatggacgtagtgttagtgcacttttagttgatgaggagagctgcaccctcaacactttagtccaaccattttttgtccccaagcgaacaacccggctagcatggtcacaccgatctgttctgatgcgctctttgaccggaaagtccaaaagatcatccaacccaactctggtcaccaccaaagttcctttaattttaaattcatgcatatgta

SEQ ID NO: 1956 - DNA, 4358 bp, Oryza sativa
tagtatttgatacagtaacccacaccaatggctatatataattttattttctccgtcctaaaatactatatagccattggtatatgcatagcttgtccagatttatactattgtatacgtcctaaaattctaatcaaacttcactgtattttgtattttgagacagatgtagtattatatatgggacttagactgaacacatcatttctattccatgacttccctatttttgtgtgttttagatatattggttcaattgataaatcctaaaacaaaaggtttgatctcttaaatgtagattttataatttgaactatttgaactcacaagccaaaatggtttgggagtagctgaactataaattatatttattcatagagttctttatgttattgatttctttatgccctccttgaatataaaaaaagaaccatttattcaaagtaaaccaaacctgcattttcaagtcaataaaccaagatggttagagattagttcaaccataaatcagttctattttatagtcggtatagcatggacttctttatatatgcactctttgcattaaaaagaatcaccgaaggaaaaacgtaattgattcctcaaaggccaagtataaattaggtttcaccaaactgttttgggtggggttttcgccactccacggtttagcggttattgcagtaaccacgtggttaccgtgaggtataccatggtttttaaaaactgagaaggttaccgcacgtaataaccacaataaccgtatgataaccgcaatcttgtaaatctcttctcacactctctaaggctcacttattcgatttggtgccagatcctgaaccccatgatataactttttttttttgtaaatttggacctgtttcgatcaattttcttgagaaaatattttgatcaacttttggtcaacttttactattttaagcttgaattctgaaaaaaaacattcgaaatttcacggttctcgaccccaccgggcatgacagacgtgtgcaatctgaagcatccgattttgggtacccagcgctccagcaggtgcatgccccgaacgggtcctcatttctcctgctctcgggtgcacgaagtcacgcaccacaaacaatagcggaatcacaatttccttggtcacacatccaagctagttcaaccagatttattttaaaagaaaaaaaaggccacacgagctggcccctccctgcaataaaacaatatagctataaatcgctttgaattatgccggagaatgcaatcattgaccaggggcgtgcaagttgcgtgtgtgcgcgaccacgaaacttaatcaaagctcacaaaaccaaaaataactaatcagcacccacaatgaacggcacaatgcctaccactaccctctcccgcctagtcatcactcggccggtcagtccatgtccatcgctcgcaaagcaaatcgctcaccaatccaccccgttcaagagatgcaagcgggctaacccgcaaacctgttttataaacaaaattagtgtataatctacggtttatctactaatttaatttataaatggatttatggatagatccatttatatagctgaacatgacgtgaaaacccacgagttaccacctatttgattaatatgtgggctcgtgggtcggtccgcttgcatccctaccgatcccccacgcacgcacgcacgcacgcacggatcggagcacggtgtcgcggtggaagaaacggatgagacgggcacacgcgacctaaccacggcgccgcggcgtggtggtggtggagacgtggagtggcgcgcacgagagcgacgcgcccacgcctcctcggtcacactactactcactcgggcgcccgcgcgcgcgcgcgcgcgtgaccgagactgactcgcgtcccggccgtcccgtcgcacggtgcacggtagcacggccgcccgcccgtgatgccgaggaaaaaacccccacccaatccgcgctcgcgcgcgtgacggcgacgagttcgcggccagaaaacgacccgcggattcgggcggcgccgcggcggtgtacgtctggtttttgcgaggacctagcacggcgcgcgacgacgccgatcgaccgagcaggcgacgcaggcagcagcgacgccgcgtgacgttgagaaaagttctcgcgttgtgtgagctgtaatctctgcgtggtgctagctatgtgtgtttgcaaagggaagacgacgatatccaagctcgcgagtttggaattgccgctcgaatctctctgttccttatttgacccgaaaactttcgtgtcgatcgggtttttgccttgcaagtttgcctgccgtgctagagtagaggaggagatagccttcgcgtcgcgatgcccgctgcgatacgtatgctggtagtggtggtgtgttgtcgggtcagttggtgccaaggtacagcgtatgttactactagtacatcggtagacttgtggtctagttgagtgagtcgtactagtattgtattggcattgcgacgctttgagatacagttgtacacgtctccgtccaacagtcccctggttttcttcttcttcttcttcttctggacatcggtaacagcaaaataggcctgaaattcaagctctgttgtagactttgaggcctttgaaatgcggcaattttacaagatttccatatgaatcaatttagtttctcatgcgtgctgggagaagaggatgaaaaagagaaggaccccgcttttatgacagtaaagatgaaatgcagaaaaaaggatgatccgtatgaaaattatgtcgttggatgggatattttttttctttcctcttctcactagccaatgtgcgtaacggcatggttgctagagagagaagaaaaatcccagcatcctaaacttcgtgatacgaatatgatcctcagttgcatgtgcatgttgcaatcttagagatcctgaatccggagttaggccagcagatcaaactgaattctagatggatatgatccgcttagacttcctaactcggactgcttgtttggctcggtcgccgtgtctcttgcggctacacctgttcgcaactagaaggattgaccaaaaactttcagacataggtggtgattgaatcttctgaagatgaagattaagattaagtattcacgtaaaataaggtggtaataatatatgattaattgagttttaattattgcaaacttgaaaaatggattaatatgatattttagaacaacttttatatagaaaattttcgcacgaaacacaccgtacatcgtttagcagtttaaaaagtgtgccacgaatatttaaaacttcatccacttttttaagtggaaacgaacggagactattaccaaacaagttggaatttgtcgaccatctgtttgtttgggcaattctggtttctgaagtcaagttcttctgccacgcatggctctggcccagcgtggcctgctccataaacgggccttgagttgggcctttcctaacatccggcccatttccccctgcgcggcaacatcagtcatcagctgggaaaacgagaagacgacgcagtcctcatctgagtcatctctagcaaagattttacttcaagagactaaaatcaattagactggcatacgtatttaattgaagcttaagaaatactccctccattccaaattaatctacatagtctttttttaaggttattcctaaatgatctacatatttgtgttcatttattaggtctattcgttatttgtgcattggaataaatggacattgataaatccatgcacacaagcatttataacccacatggaatatcttgatttgctattggctaggaaatagtggggatggtgcatacattgagtaaatatagtatgagagagttattagctttttttggtcttggtgtatctttgaaatatgtagatcaatttaaaatggagggagtactagtatactataattaattaagagtgttaatgaggtacactaaagtcatttctcttcccttcgcttgtagtactaatttgcctgtgccatgttataaatgaaatctctctgtgagaccgagcgattagtaaaatatgtttggattatgccaaaatctatctattatattattaaaggaatagaaaaaagagactccacgttcgctcaaatggtctagaaattctcacattaatcggagaaaaagaaaaggcagagtccatatagaaatacaatttagaaatagctgaaattcggaattaaaaaataaggaatattagaagagtagactagattccatatagaaatacaattaggaaatagctaaaatttggaatttaaaaataaggaaaattagaagtagagtatagagtccatata

SEQ ID NO: 1957 - DNA, 8047 bp, Oryza sativa
acatgtgatatatcactccacaaatatgtaagttcaagttcaacttctacatctcgtaacgaaaaaaacaaattaaactacaactagttaacatatattcacagtcaaatttgtttttttcgtgtgcggggtgtaatagttgatttaaacttgtatgtttgtagagtgatatatcacatttaatacatcttctcaaattttttcgatttttttcataactatttgggtgatatgcaaacaacgaggggatatcccctcgggggatgaaaatagtttcccaactcagcagctgcaaaatccaaaatatgaaagctccaagttcgatatataacttctagcgtcttcatattaattctcactagttgaatattcacaagccttttcagttggatatgcttctcagaacctttgtcgcctcaaacagtgaattcagcacacatgttcaaaatatagttatacccattatccaaaccgctgtgtagatgaaaatatatttgatcaccaccaccacaaatatataacagagctccatcttaacgaagctcataatatgccattgtccaaccgcaccaatgccatgatcctctaaagccaaagttaatactagaaacaaaaaaaaccatcaaaacaaatgaaaggaaaatctaattagacgagcaatgagctagctaccctagctgataaacatggatccttcatgtacactagtgttacatttcatcctgccttctgaagagcagcacccggtcgaccgccgtgagcagacagacatcaccggagctgagctcatctgctgcttgatcgctctccatgtcaaggttcaaatcgaagcaagaagagggggcgcctgattcgatttctaatttgtgatcatgatcacttgtgttggcttcctctttctccaccttcatcttcttgttcatcagcggcgagccagctctagacctcgcctcgaagctctcgcagctcaggatgatgatggcgtcgcccacgccgacctcgtcgccggcctggctccggagaacccctctgtcgatggcctccttgacgcccacctgccagcgatggtcgccctgctcgacgtcctcgatgaggatgacgcggtgcgggttctccgagacggcgtcgtagagccgctcgaggtaggcctcgctcgccgacgacgtcgtcgtcgtccgcggccgcttgctccggtggtgatcctcggtggagcccgacgcggacggcgaggaggaggaggcgccgagcttgacggagaggaagctcttgcgtgacccgaagacgaggccggcgagctccctcgccaccctctccttgccgtgcccgtcgcctccgaggaagaagagccacgtctcctccttcgcctccgtcgacctcgacctgtcccgccgcttggcgatcccggacctgcactggaggacggcgctcgccacctccgggacgatctccttctgccacggcacctccttctccagcgcggcgcacaggagcttcaggttctcggcgttgagctccttgaacctggaacggcactccacctccaccgagccattggaggcgccggagcagtcgtcgtgcgacttggccttctcgtcgtcgtcgtcctcgcgcttgggcttccatgggtgcttggcgtcgaggtcggcgagaagccacgagtggtgaggctggtgctgctgctgctggtggccgtggccgtgctcgtaggaggagatggaggacgccggcgacaccggcgccgagaaatgcagcgtcatccgctgagacggcttgccgcagatggatccccatgtcttgccaagatccgcgaaatgtgtcgactcctatcacgagaagacaaaaaaaaaatcagcaatgattgaccgattaattaagataaaaagattagcattcgatcgagtggcacctgcagctgctggtcgcggcaatgctggagccaagaagggaggctcgacgacgacacgaaggagcggggcaacgacgccttggtgtcgtgctcgtgcgtcgtcgtcgcggcggagcagtcgccgccgcagcatctggagaggaggtggctgccgcccaaaagcggcccgcaagacggcgccgggcggttcccatcggtggtgtgagggctcgctttcatggactgattgactgcgcccagcgcgctgcagaaagaataacaaaacggaaattagattcctgcacacactgtcacctcaccgatcgacatgtctccacaagatcagctaaactgatcatctttgtcagccgctgtacctctgaaattgtattgtcgatatatcatgctctcgtgaatgttcaaataatgcgatattagaaaaagagaatgtgaagctgatgaggagctatagattgacctaaagcttttgcccagaaagcacgcaaaagatgcaaaagctttcacccgcatggtactgaactactgatgcttactgattgctcagtaacgaaggggtcagatcacagagaccagaggcatttcgtttctgcaaggccggcgcgggtgcatgattcgttcacctgacgtgacacgctgcgccgcgagaacttaacaaactttttttagatcgatcggatgattttttacctgtcgtcgaaggcgcaggtgaggctcagcgcgaggctgccggcggggacggcgagcgtctggagcccccacatgctctccagcgacggatgccccgccctgcacttcatgtacgtctggtacgtcccgaacccgacgagccagatgccgccgtcgcacgacgccagggcgcgcacctcggtgacgacgtgctcgacagagcagtagtagccgccgccgccgccgctgccgaccctcctggcgccggcgtgcgcggcggcccagaagtcggccgcccacttgaggtcctcgacgacgaggagcacccgcgcgccgcggctcttcacgaggcaccggagctcggcgagccgccgctccgcctcctccctcggcatgtcgcggaacgacgacacgcggaggctgaccacctgcgcgccacgcagcgcgtcgtgctgcttcgcctcccctctcctgaccctgtccacggcggcgcgcgccgtggcctccgcggcggccgtgctctcggcgacgacgacgaccctcctcctgctgccgccgccgccccggccgccagccgctgccggggcaaggcagtcgagcaccgcggcgatgtcctcgtcgcgcgccagcatgtcgagcagtggcagtttggctttgatctccggaggatgagccgggctggtggtggcggtggcggtggctgcggcgccggtgcagctagggttagggttttggttcggtggcgcgctggtggccgtggtggtgctgcacgcctgctccacgttggccttgacctgggtgctggagaagccggcctcccgcatgacgcggctgacgctggggtcgtcgaggatggagacgacgagctgctccagctcgatcttcacggcgagcaccggctgctgctgggtctccacggacccgcgccgttggtgcgcctgcgcccgcttgaacgcccgcgacgagcgcgttggagagcgacggcgggtagtagtggccgtggtggccgtgcccgtggccgccgagcagcggcgacgaggcgacggcggcggaggccgggaggcggttgagcgccacgttgaagcagagctccagggccttgcactgcagcgggtgggagtgcgaccggaggcacgccgcgcggaggagcccccccggcggcgccagcatcgcgctcgccacgtgcagcggcgtcacctgcgcgttgcccctccgccgcgcaagggtcaccgcctgcttcaccacggcggccgcctccgccgtcagcgcctgctgcaccgtgcaccccccggccctcatctctcacacgtacaccacaccacctagctagctacgtatactacaagaacctagctaatctagtaatctatcgatttgatgtggcaacggtagtgtgtgaggagaagaaaaaggagaaggaatgagatgtgcagatatagaagggggacggaggtcactgctgcttcagctgcaacctgcaagtggtgggaggatgcagtgctgctttatatgttggtgaatgttcatcttttgagtagctagagggggggtgagaaggtacagaggttgaaggaaggaggagattatggtgtgtggatttgtgcttttcttgttagggagggctgcatagttgttttttctttctctttgggctataatttttagggtccaaagtgaattttgtggtgggaaagaaaaagttggctaggtagaatgcatgtgctgacaaagcagatacaaaggccccccagctttcccctctatctctctcaagtctcaagtttcaagcaaggcgttctcacattctcatgcagagggtagctagctaggagatcatatggattgtgcacagtatctttgtgactagtcttctgtatatgatcagctgcctctaaagaatgacctgagctaaattctatgcgttcctgcatcaaagtgcgcaaagccgggcgaccataaaatttagaacctgatctagaaggatttggtgaaatgacaagtgtgcattggtcattggagcagacaaggtgccttagtaatgatatttttcaagaataattgttccatgtaacaaagtaagcgcagtaaagtgtgaatataaggtaaacataatgtcataacccctgaaatttttttcattatttcagagggtctccattttctcagggaaaaatatcatgacatgcagcacaattaactcacaaccatgtttggtgagttgtcactataatatatagttgtggaatcttcctttctaatctttatgcaactagatagtaaaatggcaaattgaagaatccatatatactttgggatactatatttagtaataagagacaaacctttgctgcaactcttacctgatagaatttatgccttccctacctctccatggctccatgcatgtcaccatatgtaaacaccaatacatctcccaccaaacctattagtgcaaaaataaaacaaaacgaaaggaacgatccatagcaaaactacaagtaacagcttttgccacttatcttttgcaggttatttctccttttctcatacattgttcaggtgggacaggttacctatctcagtgtattctcttcccttacccatcagtataatatctaaatttatacttcataccacaacttcattattccccgattggacatatgtgacaagtggtattcatgataaaatgataaggatacatgcacaagaaattcatgagaaaatgatgagaatgaaagaaacaatggtatgggataattgttggtaaaccgaattattggcgtaggtatctagatgagaactaaatttaccccaagcaacataatgaattgagtacatatgtacagttttgttctatcacacatgtacatatatagaagcacgtctgtctaggacccatgcatctaactaaacagccactagctgaaaatacatcaaattgaaaagatgcatataatgtagcacaggtatagtacgtccgcatagcttttgttttaagagagggcaatcaatatattcatcatgaaggaagtacatacatacttttatacctgttcactgctcgtcgtatactgatacgattgatcacattactaacagggaaatggggctgatgttgcaatgatgacgatacaacatatgatgctttatgtgatcgatacgatctgatgtggcctgcagtgacctctcatcttttaagagggcccatttaaattggttttcttttctgagagagagagatctttgtgccctaaaagaatcgggaactgtgtacggcctctttctctctagactcaaagtatatggaataaagcgtccccttattgcccatatgctctctgtagactgtatgtgtgtatgcatggaaagattagaatcgctcacaattactaggagcagtaatgcataaaacagccacatgctgttcagcaaagccggggcttttcagcattcttgttccctaaaaagcagactacattactagacacaaaaattgaaacattcactaattaagtttaggcaactgctgaaggttcagtgccaatgtgccgaatctacgagtgaacagaacaaatgtttactactaatatatggcaaagatagcactgatcaagatcaacatgaatatatttgcatcattattaattgcatgattattgacatatataagcgccgctcaaatattctgttgtactgcagtgttactacaagcagaattaactgtcaggcaaaagccaaagtatgtagttaaaagcacgtcgcagcatcattgaccggtcattactgcgtgcatttgcatcaaaagtcgtgcaagaacatagttctttatggggatacgaacagggaaaaggggtcgattaaacagccagcaaaaacaaagtatcaaaaatggcttccccctcaagccttcccaacagatccccattcatttctcaatcatcttgtacgagctagtgaagtgcaatggtgtatgtgcctcttcccaacaatcagaactgggcctcgcattgatgtcgttgagttttcacaaaaccaatatatagcgactagtagtgattactgactatttcgaaactcttatatagtttctgcacagataaactttcaccttctttataggattctggtatcaatgtgttacacgctacatatgcaaagcatggtctgttcaaactaatcagaggcagtggtaagtggtcagtcaaataaagctttggtcacatatggcccaaaaggggaggaaaaggccaagccctaatcatcacaaagccattgccccaaaaggagcgcttcaaggaggaaagtatatacacagtttgaggatcgaccccggaacagagaggagcaaaataccgcaaaagaaaacacaaagaggaaagcagaaaagaaaccgtaatcactgcatactcttcttttgatcctttctttccttttctttttctttctctagttacataaggcagttaggctgctgtattagatctgtacatggcaaaggagttgtggtatgcccaggaattaaactaaccctaagcattgtgttgctgcaagcagctttttaaagtggagcaagaggggatgctaaaaagtgcatgagtggcattatctgcagaaaagcttcccaattttaatatccctggcgcactggtaatgggtgcagcacagaagctgcggcaggagcactacactaccactccaggggcctccaaggtgaagaaaaagtgcttgtggttctgccagtgtaattataagcgtggcttaggatatgcagtactagtgctactattatcttgatttattctttttatatgagattaaatatgtgccacagtgccattgatcagcttattgagataagaacaggaggaatatcatgtttattattaagaaaaaaaaagaagtcattcataaagttaggggaaaggagtactcttaaaccatattcagatggtttggagcggcagaaatccggtgaagatgattgcttccagccctgtgctgtccactctgtgctggggttccattttgttaatttacctaactttgttttctcatgacttcctgctaaaaagaagcaattgcgcatgagcaaaagtttattttgaaaagttagaacatagatcagacatatgtattcaacatgcaaaagatacaataacagtgggaagggaaaaaaaagtaggtgatacttacagtaagagttaagacacatatgggccagggtgttcatgccttcctaggctggcatactgggccgtcctcaagagcgcaaaatggaggacttcttgttccactttataagcaatgtgcttgccatttagattgaaacgcttccaggtacaaaagagccaataacattttattaaacattacacagcttcaagtaacttcttgcataaaaccttaactagcatttcttaaaaaaggtgactagaatcaaataagattatttttcaatggttgaattttcct

SEQ ID NO: 1958 - DNA, 25525 bp, Oryza sativa
cacaacttgggtgaaaattctcaccaactttattttgaagcaattacaaatcgggcacctgaattatttttgactcgattgccctctcctcatgtactacttcacaacacatatgcaattctctcgagtgagtatgtaaaatttgtgctcccgcctctctagttgtgctctctctacctttctcttagatgggcctgtagtgtagtactacacagcacacacacacacacacgattttttctctctcataatttgcatatgtaagtctcttacatgcacgtataaacaactttttgacaagtttcaaattatttttaaacaacttttctcctaaattacttatctaatatatgatccgattacaccatcatatccattgtaattaaatctttaaaataatataatatattattatttttctaattgagatatttttatattatatatgaaacatttactggtaactgctgaaacattcaaagaatataacatgcaatatttgaaatgaactagttacattttttttgtttcatttgtggttgacggtgttgtagttagtatattttgaatgttgcatctatgacatgtatattatatagtgaattaaaacaatttttaaaactggccaaaaaacatttgattttttcatcaaaatataatcgtgtgagatcttgttataaatatttaattgtaagaaatacaacaatgtaatcggatggtaaatcaaaaaaaaatgtttagaagaaaattcgtttaaagattatttttacaagatgaactctaatgaatctagctttagagttgttttttttcatcatagcttatttttcaatatttgctcttaaactataaataacatggatataaaaaaaacactccaactatttttttcttatatgtcggtttacggcttattatctaatttttataagatcaggccccaaggtggtttgcggggactaagcatcgttggagtacatggttgctagaagactgggatcttttcttaggtagagaactaccgcatctatgatactatagtgatatactactttctctgttctaaaatataattatttatagctgcacacttggacaaatatttatcgcatagcctaaactaaatgtattctttttagacatatgtgatatatttcaacttctccaggtgtatatgtaaaaattggtttattttggaaaagaactatatatgtgggtgttggagtatttcatgtgttctcacttggttaaaaagaactttgatatataaaatgataagatagagttggagaatgcttctaatcaaccgtccggcggaaagaaaaaatcgaacgcttcttaagctaagaaaacagtaaggatatgggtgtaagtgcatgcaatcaagatttatgaaagatgtccatattgattgaaaattcaaattgttttttctctctgactatttatcccaactacaataaattttatcatttgattcgctacaactaaatcttcgtaacacgatctcacatcactctgtgctgatgactttttttaacgtctttttttgtgttgcactcagtgttattgtgatgtttcaacaaatattggttcatatttcacatagttatttgcaatgttgtacgtggtgtttttctatgttctagcaagatctcatatgattatattttagataaaaaaaagtttttatatacacgcgcgcgcgcacacacactgtgtgtgtgcagtgtgtgtgcgcgtgcgtgcgtgtatttaagcaggtgcaattggatgtttcacgtgtaagaaaaaaacatttcaaatgaaatttcactttgtaactaattttaagttttttcttgcaacattttactcatagtatcaatgttttttgaaagaggctcatagcattatttagatgtttcaatagatattttctggtgtttcactaattctttataactgttgcacacaatatacttgttgaaacattcaaatacaacatgtaaaacattcgcaaataaagtaatgaaatatcataacatatttattgatttcgcgtgtaacattaaaacaacatctattttattaaaaacataaattacgcaacatagtcaaattctaactgaaatatttacttcttacacgtgaaacattaaattttaatgattgaaacatatatcatttttcaattatgatataatcgtgcgagattttgttgtaaaaatttaattatagcgaatacaacgatataatcagaatgacaaatggataaatggtttggaaaataaatcatctcaaaggttactagtatcgtattaatcaatgcaagcacatcatatagtatcatcacgtagcaattatgtgattagcttgttgatgtagtacactggtagcgtccaatattttgcattatgtgattagcttgctgatgtagtacattggtagcatcccatattttacattgcatgggatgtctgggcggtagtctcctctaaagttaggtggtatattggtttcacgccttctcaaattttggtactccctccgtttcaaaatatttgacactgttgacttttcagtacgtgtttgaccattcgtcttatttaaattttaagtaattatttattcttttcatatcatttgattcattgttaaatatactttcatgtacacatatagttttacatatttcacaaacttttttgaataagacgaacggtcaaacatgtgctaaaaagtcaacggtgtcaaacattttgaaatggagggagtataattttacgatgagtcaaaagttttatagcaacaaaactaaatactctctccttcctaaattgagcatcatatatgtttatgcaccaagactaagaataatttcaatcacatcaatcatgacaccatgcacatattctcccacaattaatacatcgattaaaacgccatgccaattactccctctgtcccaaaaaactaacttctagagtttgaattttgtcccataaaaaaacaacttctaccatactacctaccctcagcacgtaaaatgagaagttttatcccttcaataccctttaactacatatcactcttactacttttttcaataatgaagggcattttagttattctccatatccactaatttcacctcgggatgctaggaatgtatttttttttgggacggagggagtataccttagcatgcgtacattctcccatactgtattaattatattctgatgaaatctatgtccacgcggttatatgatgataaatttgagaaattttaaatttcattatatgatgatcaatttgggaagagggagtaataagattggatcgggaccagtgtgtttggtttgtcagtggatccaccaaatttaataaagtggtgggctgtattggctctaccgtctaccacgaggccactggtaccacatccatggaccatcatgcatgggccatgaaaatctatggcccattttcccccgcgcttctccgttcttcggcccacataaacacactggcggcccgcgcgcacggcgcaccgcgagccctcgcaaagcaaagcatggcctcgctcgctcgctcgcccgcgcctccagcgattgtcgtcgagacgtctcgccgtctcgcgatgaagcgaaaggctttttgtccgctgcgcggctgcgcgcgggcgtcggtttcagccgcggtgtcgccgcgcgcgccgcggccggccggtgtgtcggtgcgcggccggatttttccggctcataaaaccccggggttggctatcagctacgtcgtcgtcgccgaggcgatgattgatgtcgggtgtcacgattgatcagcctcagctatagctctcccatcgactctgcagtgtcatcactcgtcagctctcctctcctcctgcccgtttgatgtaagtgtacgtacgtactcggggacgaccgtgacgcgctgccgaatgccactcccaactcccgctagctaggtacgttggtgggtcactctccatccgccctagcgcacttcatttcatttcatttcctctgccttctcttcgctttcgttggatcatctcgtctgtactatactgtacggcgtgagaaaattgcccacgtacgtacctgtatctcatgaagactcttgctctcgtaatttatggtactcgcacaaagtttgaatgaacggcatgtgtctccgttgaaacgcgaacaggtacgctagtgtcgttgtggggatggaaggcaggcagggcaaatactctgtttttttatacattgttgattcttcaaaaggcatgcaaaaacgatcgatcgactgtattgtaaagctttgatgcataaatgttgtttcgacaatgacaaatgatactaagcggatgtatacatataaaagtggccttttattctgcacagattcagaattgggggggggggggggggagggggggaagacgcgctgactcgataagcttacactgttacaattgctaatccgatactaattacttcggcgaggtgcgccgttgccgttgcgtctgtagctctcatggcaccgccgtgcgtgcgttctcccgcgacaagctaacgtacacgctcactgggggttgcacggtgatttcgcgtcacacgtcgacggtgcagtccgccgcctgcgcgaactgaggagacggtggcgttgccgccggcgcctgccgcccgccgtggcgctcatggcgaaggcgcccgccgacgttgccgccgctggcggcgagcagggccgggcacgtgacgaagaggtggtagccgccggagacccagctgccgaccttccacttgacgcggccgtccaccttgacgtgcagcagcacgtagcccgccgcgatgtcctgcctcatggcgtccgccacgtactgccccacgggcaccgactcgccggacatcaccggcgaccacaccgacacgtccttgtgcccctggtagatcgccggcagctccaccggcaccgtgatcggctcctccctgtacgtcgtgaacacgtgcagcgtcttgtagtacacccccaccctgtcgttcgggttcctcgacgcgatcgtcacctacacgcacacacagaagcaaacgatttttcagtccccccaagaacaagaacaaactgtacaatttttagccagaatttgattaacctgaggttgagggagatggcagggtcggagaggtcgatgttgcggagctggacgtcctggaggtagaaagaaggcttggaggggtgaatcgcgaggtagatgacgagcacgatgaagccgacgaggacggcgagcgtgaggatgcaggcggcgatggagccgcagcaccgccggaggatccagtcgcggtggtgcttgtccttgcccatctcgccggcggccgggccagaaacccaactagctaataatcaactgtgtacagtgcgttgtagtggagcgtgagcgtgagtgtgtgtgtgatactgaggactgtgtgcgtgtgagtagaaggaaagtgtgctgcgaggagtgggggtggccttttattaaaaggtcctaactcctaagcttgataggaggacaggtaagtgtggtggtgcgtgtttcaaaggggattttaatttcttttgggtgtagggaggtgacgaaagctacagctcaactcaccgagattcttctgcttcttctttcccctggacccccttgcactgttgcacaggaggctgccctgtgtattagtgtaccactagtaattaagtacataactccatcaacttagcttaaattgagattggtttgtcgagcacacatgagccaggcagactggtgtccctctggagctctgctgcttgaggatcactccatctccagatggtcaacaggagatgattaccattgcggttggtgttttgcatgtgcacgttgaggctgagttgacctgcggttatggtacccacaacccagtagtagtgcccaccattttacccctgtccactgaactaatattaatctccttcatgtacgcagtacattctcctacactagtattactgatcaggataggatatccagatgataaacgattcacaacatatataacaacaatcagcagcgttacgtgtacgtgtgcgggcgatcaatcatcaatggcactccatacacatggcgtggtcggtggcgcgcgcgcgcgtggctggcgccggagacgggccaaactgccaatctggctagggattacgcgcgcgatctcacccatgtcgatctgagcggcctcgaacggcggcctccgcgaccatcacccgagggccgaggagagcgtcgatcggtgcacggccactacatcacatcgcccgtgcgccgcgccgtccatcgatcgatcgcctcacgcacgcgagatagtacgccggttggtggagcgtagcacgcgagaggcaggccggccgttccggcgtcgcctcaggcgaacagggccaaagaaaaccccacccaaaataaagaaaatatggcagccatcatcagcagatcagctgcacaagcggacgcgcgcatgacgcgcccgccgcgtgcagaggcgtgtgcgtccatccggcatcgtgccggtgcccttcattccttatccccctcctccaccgactgcggtgccctgtgccctatggcagcatctgttccagaagcaccatgctacctgctacgaccctgtctcttaactaatcatcaacgatcatttgcctcctcccgtgaattatcagcgtccagaacgatcttgcacacgccactgcctcgcccaaaaaagaagcttttttttccaatacatacagtggcttgatctggtcatcaatcatcatacaccggatatgcatactactatataccatttctatccattattctaaaaaaaatgaatactactagaccggaaaaaaaactgtagacatttttctttctgttgctgttggataaatttgtggaatatttgcttttatgtagcagagtagcaggatcgctgtcttacagtatattcaaatcaggctttcggataaaaagcgccgacgagaaaagttgtggaagggcttgaagagcttttgtgtcatttgatccatttccatgtagtgttctgagtcaggatggctagcatagtgcgatcgaggttgtctcttttgacaaaaaaggggggaatttagcatgtaatcaatctcaatagttaaacatgcgcattgcaaaagaagtgagggtaatttactttcatctcttccataaaggatggggaaagagactctaaaagggggctgcaaaaaggatggttattcacacaaacttagcctggaagtaaaatgaaaaatatgactgttctacgcagacacgtcgaacctactaaggtttggaactagtgatgcacacatgcacccaaatcactctagagtaatcaatcagacacttcagatatagcaattgccaggtcatataaaagaactttgtttctattagcaattttgcaacgggttcggcacacaataattcacacgcacacattgcagaacagatccacagatgcaggcaccatgcaaaaatacaagcatacaggatgtaagtagtacatacggccagggaccattgggacttcgaagtacagagcttagctagaagacggtcgacctaataccctgctgtgcttatatcagaaaaaatggaggcaagtgcaccatcctgcccgttcttggacatgtcacctaccatccgatcttctttgttccgtttggtgcatccggtagcagtagcaaattggaggcaagtgaagcacgcatgcgattcacggttggtgtgtaaagtagtagtagtactatatacctaaggagaattattgacgtgtccctgtttttctccgctattttgctcgggaaaaggtagggttgggtcaccatatgtgctataactaatcgttccaagtagtgctagtaactgaagtgagaaatgctgtattagtatataagtgaggagcgtctgtcgcggtggacttctgtgacgtgagatgatcggttactctattttggtcgaaacatgtcctagaaagtttcaaattctattataacttattaaagaaatagaaaaaatagccttcacgttcgctctcacggcctagaaattctcatattaatcagagaaaaaaaacagagtctatatagaaatataatctatgaatagttgaaattcagaattaaaaaataagagatattggaagaggagaccagagcccatgttgttatacaatttagaactaatggaaattcagaattaaataagaaaactaaaatttgtttagaattaatatagaaataaaatttggaataactaaaattcggaattaaaataatatagagtacagagttcatatagaaatacaatttagaaataactgaaattttgagttaaaaaataaataatattagcagaaaagtgtcagcgttatggataccacatacctaatagtagtcgactaaatctcggcaggacccaccacataccatgtcttatacggaaacaacatgtggatataggaggagtttcgaataagaaaatacaaccagagttctacatggaaacgacaaggactactcggattgtatccataatggtttccctagttctacttggacaaggagacacctatgggtataaatacaaggccccctaggaggagaggggacacactcaacatagacggaacaacagaagccacaagacaacatacgccaagaaaaaatgctggatatcgacttcatggataagcacggctagtcccctacggtgtctccggatactgtcaggagagacgaaagcgctatctctgatctcgccgggcacggattcgaggaggaagactaccctgttgttgactacgagtagactttcataccgccaagtcgacaacagttagatagactaccccaaatattgtactggtgtgattatggtgaataagagcaataccggcttcggccaacaggatatagggttattacctaacaattcaggggcccgaacctgtataaaaatcctcgtctctatctcttttacctcagtctcgcgcatatactagtaccaacgatccccatactatgcaaataccggaatcgcgacatcaaacgtcgacaaaaagtataaggtccatatagaaacacaattaagaaaaataactgaaattcagaattaaaaataaataatattagaagaaaagtgtagagtccatatagaaatataattacataaataatagaaatttagaattaaaaaagggattattataagaagatatagagtccctataggaatttagaattaactaaaatcatgaataaaaataataaaaattaaaagtagagtttagattccatataaaaatataatttacaaataactaaaattcaaaattaaaaaaatatgggaagaatagcctagagtctatatacgaatacaatctagaaggaactaaaattcgaaataaaaaaataaaaaacattgaaagatgagtttagagtccacatagaaatacaattagaaataataaaaattcaaaattaaaaataaataatattagaagaagtgcctagagtctatatagaaataaattttacaaataacgaagatttgaaattaaaaaataatgaatattgaaaaacaagtctagagtccatataggaatacaatttagaaataactaaaatttgatattaaaaataattaatgactatcacattggtaatttggtaaatttagtacaaaattttgaaattatgttgtcattttaatatttttaataataaattgggaatatatatatatatatgtatatatatatatatgtatatatatatgctattatatgagaaaaatataatgatactaactgcgcaatctgcgcggatcattcgatggaaaaaatagtaaaagtgggggtcttttttttttagatttttagtgacagttatgaataaagggacagtttaagaaagcccatggttcctgtacaggagtcctacgcaacttaattgggccgtaaccttggcgttgaggtgctattgggccgtaactcagatacccgagcgaagcccatgtgttattgggccgactcacgctggactagcggccggtttggccggcccgcagcccgttcacagccgagcttctgggattgtaataagttcacttatgtcccttaatttgtcgccaagttttaaattcattactgtataacaatactaatatgatgtatccctcgacttccaaaatcagtgcaaagaaggttctaaagtagtttggatggtggtttcggctgcgtggcatctacgagtggtgttgacgtgacacttcaagttaaaagaaaccataggactcacatgtcagtaactgaccggttaaaaataaaaaattatagttggacccacgtcatcacccatatgtttctcatcttctctcccttcctcctctatctctcttatggttcgagcacggcgtcgtcgctaaggagcgtgggggatgggtcccctttcttcccctcgaatctccccgtcgcctcctcctccacggccgcatggatcccaccgccaagtcaccaaatatgtgaaaagtccttctcctctctcatctccacacctcttttgttgcctgtccaccatatcgcttgctggagttacatcgccgacgccatgaactggtacactggcacgacgacggctagggatgaggcgccaccgccggtagaggagagagacgagcgaagctcacggaggtgggggaggtggccattgccgtcatcaacgaagacgaggtcggatgcatggtgtgggaagaaggactctccccaactttggccgctccatttcattccttctcagcccgacaaggtcgttcaagcctagggcggcggtggcgtgccacacgcgctccattagcctaccacgctactcccacctgctcctctcccacctcccgagccacatttgctgccatttgctcctaagcctcctagcttgtccatgacgccttctccatcctcgccgacctcctcctcctcctcgtcctgcaggacacgctctaccacgccatcgtcgacgccttcctcctcctcattgtcgcccaccagggcttccacgaggccctcctcgacctcaactaggacatcgacacgtcatccctcttccaccccttctccagtgtcgtccgcgccctcccaccgctctccgtattcttcgccgagatgaacatcctgtcctaggactggttgttgcatgacgtcatggcatcgtgcggctaggtgaccgctcaagctcgtgatgccgccaccacccaaatcctctcctactggcggccgaccgccgcgcaactcctctcccgctagttaccgactggacgagaatcagaagcaattgaaagcaaagagggtgagtactgaactgaaggaagtggggcccaccgagatagatacgtcgttggcttatgtctctttaatcgtgtgttagaagatacaaccattagtatgtaagtttagtgtcacgcgtatagtggtgtataagcgtgccattgtattttgtaaaaacatttgtggatgtgtgagtatagtgttgcatatacgtgtacgcgcgtgtaatgggaaaaagaaaaaaaaggtcacttcctgtcaaatgtgtgaagaagaagggtactcgtactcgttaaatccagaaccatctgcagacgcaaactgcaaaagcacaagcggcgaaccgcgaagctaggccgtacgtccactgggcatccacgcaagcatattcccactcggatacgcgggccccacatcatttcaaagttcaaaccgccccgtgccaagtcaccacccccaccacaggtcaagattgacagggaccacatcccacgtggcagcatcccactcctctgacacctcggtcccacctgtcagtatcacacgcttcccaccttctctttccccccaagcctctcacaccgtcgtcgtcgtcgtcgtcctcgtcttcctcttccccaccaccatcttccgccttcactcgcctcctttacgcgtgtctagaattcaaaccctagccaaccaggtcatgggcggagagaggccgccgccgatcagcggcggcggcgccttcgcgttcatcttcaaggggtggcgcgaggtgcgggactcggcgagtgccgacctgaggcagatgcggggcgcgcgccgaccgggagctggagcacctcctcgcgtcggcgtgggcgctcgcggccccgccgctgcccccggtcgcgggggggcgcccatcgcggaggtggagttcgtgcggaagcggatccagcccaagatcatggagctgcggaggcagtactcgtcgacggtgcgcgacgcggggtgggcccccaaggccgccggggccagcctccgcgtcgacctctcggggattacggcgatccgcaacgccattgtgtccaagggggacgacgcgccggacgtcggcgggaggtgggggctcgtgcggtggaagggccacgcggacgacgaggggaggaaggagtgggaggtggtgaggatgatacgcagcgggctgaaggagttcgagcgccggagcttgtcgagtgaggtgtttggtggatttcgtggccgcggcgagttcgtggagaaattcaagttgagcttggtaattcgaaagttccatcttaaatcatgatatgctcctacttggttaggacgataaacctttccacttgcttaggtacattttctgtaagttactgataaatgaatggagcaattgagtcttacacattagtagaactttggcatccatgaaaaggaatctaagggagttacatattgattgatacatgttccaatgcttcatcaaatagaaggattgtgtatttgcaaaaaataagtaacatggcattgctccatttttgttcatatattgtttaatattttgtctaactctatatgactaatccatcatttaaaaatattgaaatgcttccctgaaataaagtacttttaaggactgccaaaaagtagcaattccagttgctcataaagccatatcatttacatcaggtgacaactgacggcctgatgcattttttgcagaattatgcttttgagaacactaagtgtattatatgatcatcaatttttgtgtgttaagtggagcactgattcatgtttctcattttgttgcagaaatctctgaacaaagagtcacaagaatccaaggtaatgtcagaacaaactaagcataactgttggaaatcttctgctatttagggcaaatagttagtaacttcagatgaagaaatgcttctggatcactttcctaattaacttgaatttggtttacttgattttattttttcgctgcctagttcagtccagctagattctcagaacatttatgctctactattttgcaaaatgcaacatattagattaacctttaaactttcagttgtttcagaacatttttcgttatagccagttgtaggtcagaattagatgcttatcgctttgtaatggcatagtgaaatactgaaattgtaacaatgactacttgagttatatggcggttgaatttctttaagtccaagttttaagattcttagacactgcattattgagtataactaaatcatatcttttaataaagcatttttccgaaagcagttgattataatgataatgcaatcttcattgttatgtcatcttattaatttcacagagtgcgtgttttctaaactgaatatttgcatacaatccaggaggttctcccactggatcttactgaaattctggcatatcttgtgcggcaatctggaccatttctggaccaacttggtattagaagaggtacggcgtgttttatttgcctgcactttcccaactcttgtcactttggtgctgaccatcgttaaatctttctatattatgcagatttatgtgacaaaattgtggagacattgtacagtaaacacaatggccggctcatttatcattctctttcagctgatagatctttaattggaaatgagaacatgactgatgagcttgatctgagaatagcaagggtgctagaaagtactgggcatcacacagaggaaagtttttggaaggatcatgcaaagtacaagctctcggacaaccggcggcatgttgcaattgtcacaacagcaagtcttccatggatgactgggacagcaatcaatccattattccgtgctgcgtatctagcaagaagtacaaaacagaaggtgacactggtggttccttggctctgtaagtcagatcaagagctagtttaccccaataatatcaccttcagttcaccagaagaacaagaaaattacataaggaactggctacaggaaagacttggctttgaagcaaattttaagatatcattttatcctggcaaggtaaaaatccaattatcatctgattttgatgtattcaaccatacattattcttccccaatgatttaatttctttatttaaaatttcatgctatacagttttcgaaggagcgacgtagtattattcctgctggagatacttcacaattcatttcctcgagtgaagctgatatagcaattttggaagaaccagagcatctcaactggtatcatcatggaaagcgttggaccgacaagtttaaacatgtcattggtgtagttcacacaaattacctagagtatatcaagagagagaagaatggagctcttcaagctttccttgttaagcatatcaacaactgggtgactagagcatactgtcataaggtattgtgtttgcttgtctcgtgtaaaagccctgattgctagggtgaaacttataatgggtgcatgcaggttttacgtctttctgcagcaactcaagatctacctaggtctgttgtctgcaacgttcatggtgtaaatccaaagttcctcaaggttggtgaaaaaatagcagctgataaggagcatgggcagcagagctttacaaagggagcatatttccttgggaagatggtttgggctaaaggatatagagaacttatagatttgttatccaaacacaaaagtgacttggagggctttaatgtagatgtatatgggaatggtgaggactcacaagcagtgcagatggctgctaggaaattgaatttgagcctcaattttttcaaaggaagggaccatgcagattcttcgcttcatgggtgagtatcattttagcaagctggtaaatgaaccctcattctctggcttatcatttactatttattgacaatggccttttttcttttcttaattttaggtataaggttttcattaatccaagtgtcagtgatgttctatgcacagcgacagctgaggctcttgcaatggggaaatttgttatctgtgcagatcatccatcaaacgaatttttcaagtcattccccaactgcttaacatacaaaacttccgaagaatttgttgcccgagtgaaagaggccatggctagtgaaccttcacctttgacccccgagcaaaggtacagtttgtcatgggaggcagcaactgaaagattcatggagtactcagagcttgacaaagttctgaataacaaaattggttattctggacaagatgggaagagaagtaaagtgagaaagatacctttacttcctagactttcagaagttgtggatgggggactggcctttgctcatcactgcttaactggcaatgagatcctcagattggcgacaggagcaattcccggtacacgtgactatgataaacagcaatgcatggatttgaatttattgcctccccaagttcaacaccctgtatatggctggtgatgtcaagacgcttttattaaactaatatatatatagttgaaggatgttctcattaggtatgtgcctattaagtgttatgcagttcacacactgactagatcctgtacttctgcagtgtccttttagggtctgtatggaattaattttgtttagactctttgcttgtaaatactacatccatttttgttacccaaataggttaggtgtattaatggcagtatgcgtgtatgatgtttccttttttctgacataaacgaatttaatgaaagttaagtcttgaagtttaaattctttttgtgtgccttatgttttggcctatcctatctgtgataaaaaaaattgaacaggcaatttcattttgtgctaggaagtcgcacccagcttacaaattgtcttaatatggtttctaatctttaaatgtcttagattatagataacaaaaatgtcattagtttctcaaagacatgtagacttggttccttttaatagttttaatgtcaatggtttctcatatttatatacttcatactggatgagcaccaaggacataaaagaaaagcttaattatgccactacgaaaaagaataatagatggcaacatctaaaagtagaactaacatgggattaagaataagccaccaactccggcaccattaaaataagtgcttggtctccaattggcaatgttttgtttttgtttttttgtaatccattaatccttcactgttcataaggaggtttattatagtaatttactttgcataaggggctgggatgctttgcttcactgcagtcggtttggtgatgattgttgattagtaggtattattccaattatgtgtagttcaaattgttgtatttctgctatattcatggtaacaaaatggtaacatgggaaggataaagaaccttgcttgttatattacctcttcttgatccctaaagtagcacacagttggaacatattagttatgacttgttatctccatttcaaaattctgtcctcaaaggtaagtccgtaccttttcccatgcaacttggttcccagtagtggttgacagtgcaaaagatcaactaactaatcgctccatctatcaccaatcactgttatccaataacttgtggttgatgatgatttgcatctatggagtcgggtcaactttatcacctataagcggatcatcttccaattcagctgtttatcttacttctacaagaatatctttactatattaaaaggagttggaggtgagaatgtgctctaccccattccacactccacaaggcttttgtggccacatatatgagtttattgatgtacttgcatatatataggctgtttattgatctcatgtagtattgtatatacaattttgtaatttaaagataattattttttacatgccatgtaaatctatgttacatttatttgcatttgtcacaatgcgtggacactatgcaatttgtcctacttaaaaacaggtgttggtggtgattatagcaggctttatgctcatcttctgtgttcatctatgtatagaggtgtatgccatctgtaggatgttttaaaataactgcaccgtatacgtatacatacgtagatagctggttggtatggttttatttagttttggatttgaatatgtgacgtgtatgaatctgaaaactgtatgagctcacgggcctgtgctgtaatatttggcaaaaatgattaaagaaaggacagtcttattttactagataaatatcaccattaaaatatgtttgttatatcaatatcacattttttctgcttcaatagtttctgaaaaaaaatctgttactttaccatcacaaattttgaaatgatctgaatggatattgtgaaaccataattgtcgtccagttattttctttggcgcagcaacacatagggagcggttcactcattccccaaaaataagaagaaaactgttcatttatatttagctgcttataagtagtctttgttgtacggaaggctgcaacgttttatttttacagttcagcatcataattacttctagcatcgaagaattagtcacttgctaatactcctacacaataaaattgcaggccgtactagtttgtcccatttggtgttgatgctctcgacgtagtcagtttgtcaactcatgatgttgatagccacttctttctgagatttttcagggactttgaagcaggcaagtcgtgccaggttatcgacagattctgcaattttctttacttgtgtaaccaagtctgaaagaagtgatgcagtaactgccacatgcatcacttgcagcagagctttatcctctgatagctcgctcctgagtgttttggcagctttgatggctgcagacatggaggttgtagatggtacggtcattgttcgaagtgctgccgagagctctctgagtgcctgagcagagtgtgagctcatctcactgcatgctgttcgtactttgaaggacagctcaggattggcttcaggatactgtcatcagggaaaggtacgagctattggtcaataaactgggttccagtgtctagatcatgaaaattattatgatttgtaggttgtaagtacctgagattttgtgagtgtgatgacataggaagccatagcctccatggaagaagcgcactggcgagaaagagctccaatcttctggtattggctccatgggtgtttgaaactgaattttccatgaccaggctcccatctggcaaagttgcactgcagttttgggaataatgtcacattgcatcattttcaccaccttgcttgaagatgtctgtaggacttcgcctctcggcacggggtatgtatatatataactgcatagtatgcttaccagagagtcttcagtggccttcgaattaagtatgctcttgtacgcttggagaaaggctttgccctccaaactctcactcgtagcgctttcttcaaagcattcggtttccattcctgcattcatgtataaaagtttaggccccactctggaattaatctgcctgtagcatattacttctatagctctatgtgagtaacaagtttactattagtaatttaatacatgatatagttggaattctgccttcagttgtattgtgcacaagcagggcatagttaattagaaacataagtgaaaccagaataacatgaaagggcacactattcttctgtgacatatcggccacaagctgccatttcagcttgcagcagtgcgtacgcaccttcaaggaagtcggccagcttgtcgaggttgccggcggcgagcttgggaggtcctcgccggcccagacgggcatgacgaagatggtggtgcagaggcaggtggcgacgccgacgacgatggtggagaagcgctggtgcgcgagctggatgagctcctctacccggtagctcgacacggccaccaggctgaaggtcaggatgaagatggtcaccccgtagtcgtacctcgcctttatctccggtatgaaccgcgagaacgtcgccgccgacgctgccatcaacaaattaacatgaatgccactggtaagtacatgctactagctacctactgcttctctcctcgtctaaaaaagttagtgcatgacaacatatgaactattatagccatcgtttcgccggtatatttataaaagaaaagtaatttatgaataaaacttttatataagtatttttggtgatctaagagcaaatgctgaaaaataaactacaatgaaaaaactttaaaatcagtacaaatttaatgttgaaaatttaaattttagctgataagtataaacataaacgaaaagataagaccctaaacattgaatagtcaatgaagaacaacaaacacacatgcatgcatgcatacacacatacctagtaggaagacgaagacggcgaggagtatgggctctccctgtgcgccgcaccggttagccacctgatgcgccccgacggcgatgaacccagccaccagcgtcgcgaaggccctgttcaaccctttgctcagcgtgccacctgtcgcgtacgtacgtacgtacgtccaaaacacaaacacgtcactgagatatgtactaatagcgtactgcgtacgtagttacgtacgtagagcgtggtaggtaccaaggatatatagctagcgtatatatatcgtcgcctagctacgacgatacgtacgcccgcgtgtatacatatacgtatcgtcatctgcggcaacgacgactttctggggatggaattttgtccctcaacctcatttatccaaagctactattttttttttattttgacaaatagattgatatagtatatattacttcacaaacatataagattaaattcgatttctacaaattataaaagtaaattaaactctaatcagtatacatacatttgtaattctttttttacaatttgtataaatcaaatttaagcgtgtttataacttatgtatcatatactaaggatcaacttatcacattttctcaagaatgttttgtaactattcaagtgatgatgatcagtaagaaactcaatgagtaagaaactcaataaggccttgctcggtttagagaggattgaagggaattagagaggattgaggggaataattccacaccatcataggtgtagaataaatctccttcaactcctccctcaaagggattaaccgaataaggcctcaacgagaatactttcccccgtgagaccccgacgtacttggcatgcattagcgctagctagcttggtacacagagaaaattacataccgacggtgtactccatgacgacgacgacggtgagcacggcccagagcgtggagaccccgaaccccttgaaaagcggcgtcacgtagtagagcacggacaccagcgtcagcgccagcccgaccttgagcgagtgcgccaccctcctcgggtcgtccgccgcgatcccgcccaccttcctcgccagcccgcccacccacgtccgggccacctgcaccgccgctcgcacccgcgcccagcatccatccacccaccccccgccgacgacgacgaccacttggccgccgttctccgccgccgccgccgccgccggcgtcgtctccacggcagcagattgcatgatcgccttgaagtacgatgataagttatcgatcgagctagctatagctagtgatcgatgtagctaattagtatatatagctagcgccgcgtacgtacgtctttgagctgggggcttgatagatggagtagatagctacaagtgaagcacgggagacgatggctgggtgcaggggagaggggacgcttatatagacgtgctcgcgcgctccggtgcagagaacgcgcgggccagctgcatacatgcatgagcgcgcgcggcgcctttttgcagacaggatcaacaactttttcggagaatgacttgggatattgttgttgttgctgctgtttcattttattttactccatccgtttcagtttacatgacgttttgactttggtcaaagtcaatctattttaagtttgacgaactttatagaaaaaagtagtaatatctacaacatcaccatagttttattaaatctataattgaataaattttcataatatatttgtcttggttaaaaatattactacttttctctacaaaattatttaaatttagagtagtttaattttaaccaaagttaaaacgtcttataacctaaaacggagggagtatttattatcgagaactgagatatatattgtgctacgtttgttgtttctcgtttcgactcgtcttcgtttagttgctctcgttgtcgttgatatgccatcggtattgccagctcatgatcatgtcactggtccgaggaaatgtgaagtactcctactagactattttggccgggttaagtttaattagccttgtatcactgggtacaaatcaacaattgttggtttgttttatttgtggtatatataatctcataattaacatttgctatagtacagtagctctcaacacatcagttgtaattgtgcacctttatgacttgtacattcacttggaaacattgttgttggttgaggtagaatgcaacttgtcctttgccttacaaatatatgggtgcggctttatacttagctgactcatggcctgtaaataaattaagcaagctacatctttccactctctgacttttttttaatgaaccgaccaagtcgagccgtactgaagcatttttcacaaaaagaagcactttttttggcatttgtgataagtaaagcaactcttatgcatcatttgaaaacagaaaaaaaaagggggatcgatgacctttttgtatgtgctccatttcatgtccgtagtctctctactacgtaccatcactagtggctatcaagatgtggcctgacttatcaataaaaatttctgaaatttaggtggatctcaacccatagcttatcacattgaattccataaaagcttcgatctagtccaagcacgcacttctatttcctgacagcacgaaatttatgagctttttgttcaatgcatgtggacaaattgttaatcgttgtcatcctttagtcaaaactctttttctccaccgttcagagctgaccaccactaactacaaaacccactattactgtttacttgcttctgtaccacgtaatttccgtagcattcagagctctcatgaattctgtgagcagacacagtggcagtcgtactcccaggtgatccacagtatttgcagacgttgatcagtggttcagagttcagactttactgtctgtctgcctgtcgctagctacgtatgtacaggcacagctcatacagcaatacatatacttgactactgcaaatatgcaattgagtggttcttcattttcctgcaatattcttggtatatatacgttaacgttacgtactcagctagcagctagaatcaaattcattccaagtgaagtagtgaacccaaagtacaatccatctatccatccatcgcccaaaaggctcagctttatttcttttttttttttgaaaagaaggctcagctttatttcatcaagaacacgatatgatacgcatatatacatgaaatggctgagtacacacatgcacaaagctagctagctagcacagagtgatctgaatcttggtgccgatcgattcacaggcaggagagcaacgctacgccgcttatttcgcctttaaattcttctctccctgtccaatcctctctctgtaaatattcgcgccttatcctgctgcataatgcaatcgccaacctcaatatgtacagtatcaaagccacgaaatctagctctcgcgttgtactagaaatgagtcggataacaacagcatcgatatgattcagagaacaaagaagggaacatgtgaataactgtttcgtcagtaaaaccggaacggcacagcatagcataatccagagaatatgtgctcatatgctgcttccagaggttctccctctagtgctagctcttgcattggtagcctgtggcctctgtggatccctgaaatcccactagtagcctacatgtctaaaggaaaatcattaccacattatctctcgaccattcagtcgtaaaatttccgctaaagcgaaggacagataactctgaattaatgtaaagcatcgtttctgccttgcatgtgccgttgccaaaatgcatggagctagctagggtagtgaccctagatcatagtcatatagatgcaatatatatgtggtgacaatttgtaatgggattacagtcaaaaaaaaattgtaatgggattatggaaggtgctgcgaagctgaagaaaaatgggtttagtgggattgcctttgtcgtcaggaaaaaaaagaaccttttggacactggtagatcgatagtggtgttctcagacttaattaagctttagcatcatttgatcacgccgtcatggtatgtatgacttctctttgcactttattttgcactttaatttcgcactcgtcctgtcgaccaccgtacatctctgtcctgtgaagttggtcgtactacgtacttctaggaccatttttctttgtggcagaattaattgagaattctgcactatcaagtatcaactagctgaccttcttgctcatgcttgtctctttctacctgttgcttcattgatcttctagttgggagcgtctctgctttcttcagggagaagagcgttaattgtatcaattaaggatttgagctgaaaaaagaagggtttttctcgagtctgacggctgcatttggcgtttgttaggtcaggatgaggttagtacaaatataccatggcatcatgaagtgtactttggaaaaagaaaatgacgatctagggggatcaaaggacgaactagatgccatgatcattctcctcccctgatttttcttatccgggcgaaaaaaattaaagccgaaatcgccgtcgaattttgtgtctgtgtttcataccaagaatcgcgcagctttaattaatttgcctgttcttgcaaccgcactagctagcgtgtagcgatcgacgagaaccgtgagtggtacggaaaacacacaacttgaccggaaaaaaagaagaactcaaattaaaggtgttcgacaagaacacgtcgcaattggactccacttataattttctcatcgatcgccaccagacagacgccacaggccggagagctggattatattcatgacagggtattcgaattctatctctctctctctctctctctctctctctctcaaaattcagtcacatttcacctttcaatcctccagatcgatcgatcgagctttgttggatcgatcggtgcatgcgatatatacgagcataatatcgatcgatcggcccaatttccttgcagcaggatcgagttaaacagtagaaaggacacgcacaggctaatagaaggcttcgatcgataccacactgcaggaacaacaagttggtaaagagaaacagtttactgctgccatcggcagccacaggcgtcacgtccttggtgagttggtgtacgtctgaatcgagcttgttgcaagcatgcttgcagtgctagcttgcggcagatcttgggcaagtagctagcacaatcgatcgatcagtaagtgaccgaccgatcgagatcgacgtcgaccggaaacatagaggcgaggctacacagccacctcatccagggaatagaacagattttgcctcttttgctgcgatacttgtgagcagctgatgagctcgttgggaataaaggcgaccgcggttttcgaggcagcaaaaccggcctgcaggtttctggagatgcgagaatcgagatcaggttcgtgtcgtgtatgtatgtgctacgtacaaaggtgatcgatcagaagctagaaaaggagacgatatatatgatcaaaatagtcaagcacgatgatgagaaccatatctgcatgagtgcatgggcacggcatggacaaacggagtctaaacattggatggcgtaatatttagacttagtggaggtacaatatagcagactattagctaactacaaacatattataatgagataaaagatgagagagaagagcatcgggctacagatctgtagctagctgcagcacggactccaaagcgcagtgtgtgtatgacaggtgggaccatatattaatagtatagtaagcaactattatatgaattaactattagattggctatagatgaat

SEQ ID NO: 1959 - DNA, 8979 bp, Oryza sativa
ataggtgggtcccaccattttttaattaaaaaacgttgactgggatgccacgtgtatgtcacgtagactaaaaccaccgcggattaggtcgatggggtaattcgtccagtttgcatagttgggggtgaagaatatccggttttatggctcagggagtaattcggacgaccgcgatagtttagggggtaattcgtactttttcctcaacaatatggtattatttctgagtctggttgctatgatgcacgacgcatacgtgcagtcgtgcagcatatcgatggaccgaaacctcctgggcctccatggcactccgcgcgatcgagcggcttgccgcggggcggggccagtgcggaacgatggggctgaggcctgcagcctcggacaccgcacggcccgcgcatgcagacaccccctcccgtcgcccgcttccgcggcccggtccacctcccagctaggccagcagccggcgaggcccaatgggaccctgactctatttgggccgttagctgcaccgacaatacacgcgtaacgagcaataagtcgtcctttttctgattttagttctgggaaaacgtcgtgctcgtctgcagaaaagggacagaagtgtataaaccgcgggacaagcacgttctttctccagtctaatctcttacacagaattcagggcgaattctcgaacggttagccccaacacgtggcacttccggattcctggatttggtttcccaccagccaatgcgcagatcgtacgagttgcctccgcgcgttcgtgcttgtgcccgcaaggcagctgggcgcctggtccctgggccatgctgcagctgcacattgactagggaggtgatggcccaagctgatgtccgaaaacgggtggaaaccttccaaagaaatacaaatacaagttaggcttgtcttcggcagcccctcttcccaacccatctccctctttttccactgttaaacggtgtgttttttgtaaaaagtttctatacgaaaattgcttagaaaatcaaattaatccattttttttaaaaaatagcaaatacttaattaatcacccgctaatcgctgctccgttttccatgcggtcactttgggttggaaaggggttccgaatacacctttcctaacatgtagtagtagataattgtatcagaagatggaaattagaccatcttaaaatgaaaatgtacagattagcaaaccaaggaaccatttctgaagaaaaaaagcaaaaacagatttaggcacctgtcggtgacatggggccgggggtatcgtgactagaggcttgggtagccgcggtcacccacgtggcccgaccccctcgggggggtcgggcccgagggtgacgtggccacccctccttctgtctccccgagggatcgggccgctcccgtttcggccccgagggctggggcgccccgaccccctgtggttttggcgccacgtgtgtgggttaggtgagcacagcgggctcacctaaccgcatttatagcaggttggatgagcgcgccacgccgcatttaatgcggcgcagcgcacgcttatccggtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccgaagccggcgtgctaactcctggagttggtatgtcagtcccggtcagatccattcaggcttcagcgcaagtatggcgaggaagtcgctggccattaaatgaaggttgaaatgggcgtccaccggaaaagcgggcgagcggggcaggaggcgtgtgctttgcttgtcagaggtcacttccggctgtagactagccctcattgtaaaaagcatgtttcccttctcaggcagcaggaggcccatgtggtgacccctgaccagataaaaaggaggcccaggcctaggaagaaaaaggggggagaaagaggaaggagggttgggactctggcgaatgggttctagagcctgaactctctctcgctctccggctctctgtattccttcacgcacagatccaccagaacacaggagtagggtgttacgcttctcagcggcccgaacctgtctactcgcccgtgtcttgtgcacttcctctctcgctgacgttcctcagatcgagggcgaagaacctcacttagcgcccccggccgaacctgcaaaggggggcctgcgcggtctcccggtgaggagccccacgctccgtcagcaccatatatagattccatatgcctccatactatactagattacgtcacaaatcccaccgtaaaattttggcatcaaagaaaacatcacgtgacttttatttccttcaaaattttatcattacaatagggtaggtaattgaaccaacggaaaatatttattggtgaaaaaaatgctactactcaaccaagaaaaaaatacaaatcaaatgaccatactaaagaaatttcacaaatcagtagagatactttctttttaccatttagacaaatgatgatgtgctcaatgagctttggcattatcaaatattggcggcagataattgaaccaactgaaaagatttatccatacaaaactgctactagaataaataatgaaaacaataaatcaaatgacagtaaaaacaaattttaatcagaaattaatattgaaatcaaaatagaaagacagtcttttacaatttatacagatggttgtgtgctctatgagctgagttgcatgttctcaaaattctgtcatgccctaaacaatgttgaaaaaaaatggatttataattatctactaggggttaaaaatatttaattttcttcacttacacaaatgggctaactacaaggtgtgccaaatggcgcaccatttttctagttagaggtaattaaggcaatattttttaaaccaaagaatggcatttggaccagaaaaatgtctaacgatagtacccacttttgcggctccgaaagtcggaaagcacgcaaaatcgtcgtcggcttaaaatttaaaaccgtgatcagccgaccgatctagcaaacgagtattataatatcaaaccgttgaacggtcaactagagcttcaatgattggtgctaagcttcatatttataattaaccacctctcatacatataacaaataccatagcctagctactaacgagtttgtatatacaagatcgatcatccagtagaccagtacagtgtacatttctgttcaatcggtttcactttcagcagctgccttggatacttcgtatgctagctactaattttttttacttgtattgtttgaccactcatcttatttaaaaaaattgtgcaaatataaaaaacaaaaagttatgcttaaagtgctttggataatgaagtaagtcataaataaaataaagaataatttcaaaagtttttttaataagacgaatgatcaaacagtaagaaaaagtcaaaatccattatataattatgggacggagggagtacttggaatcttggatacgatcatgaagcccacattggcctgcatccatgccaaaagctcccagtctaccggccaactaatctgaacatactgaatttcacacatgcatgggcctgcaggggcacgatcgagacctggtcaccctcgaccagcggcgcacacatgcaacaagtgacaagtctcatcgccttccaaccaatcaacctgctcccgtactattttatgcgccaagtttcttcggctccggattatactattgacctagtagtatatgtaatatgtggctccatattggacacatgtgaattgcaatataaatgctttgcaagcgctcgattattttccggttggattctcccctaattaaaccatgggcaagatatgtttattcatgtgtgtacctccactgcaaattgaaagacttgaacactcgcgatctttaaagatggtcatacttgccaattgatgatctcctaccatctaacttttttcttcgcagaactatcgatcgaaattttgaagcggattcatcattctaaagtatgcaattgattatgagattattggcactcagctgataatttttaacagatcaacgttgaagatcagattttgcagccattggacagaaattaatggatgcctcttcatgttcctcctctccattgccatctctggtgcttccacggtcgaccatttcccccagcctttcctattctaattcccttctcccatataacacataccgcctttcattttgcttagataatgtataaaattcgacctctatatatacaagtggatatacacataccatgcacagtctagctccatggcccaatcggtatatcgcttttggccttcttctaagagcaagtttaatagtatagtcaactattagctctaaaccatatagagccaatgtaaatagctaatctatacaatagttgcttactatactattaatacccgatcccacatgtcatacactcgttatgtcttggagtccgtgctacagctggctacagatctgtagcccgctgctcttctcttttcctttatctctttaaaatatatttatagctagcttatagcctgctattgtacctgctctaaacctaaagatccccttgttcccccttccacctcacgcttatcctactctagccatttcattgtagacgattagttcctccgaattgaagcaaagggaatctccatggccaaactaaggttagaaaattgattatactgaaaaaatggtaaaatttagcaatggataaaaaatggatcatcatacaaactgttgacaagttgaagatcatactactcacttttaggagttgggatcctttcaggtatcaaatctttcagtgagggcaaatgatcttatttcttttcagaatcatcatccaaactaatgttgttttccaaattgtacacttgcttttgcaagcctctattgattttgttctctccaataatttcagagaacgagctactagtcgttatacacgtcaaaacccttcggccgattgtaacaaataatagtcttaatttacatccaaaaatcgtaggagaagacctaaggaataaaaggttaattgaaccttaaactcactgtatatcaaatcatgaagaagccaagatcgaagagaaattaatctcttgcatgtgatgaagatctcagcgagggtaggaagcattcaagtgcgaggccaagcatggcgagtccctccacaccctggcgtgcatcttgagcatctccctcgccctcgccctcgtccgctcgccggaggcgccgacctgcaccaggaagagcagcctcgccaccacgccgacggccagcatctcctgcagcaccgccgacgtcgccgagtgcctcgccacggcgtgcagcgcgcgcacggcgctctcggcgcccgccgcggcgggcagccgcgtcgccgcgcacgccaccgccgcgagccccgccgggtgcgccaccagagccaggcgcccctccgcgcagccgcagatgtggtcgatcgccacggcggcgagctcgcacgcgcgccggtcgccgccgccgccgccgcagccctcgtcgaggaggaggcgcacgagcgccgacacggcgccggcgtcgaccgccttgacgcggttccggccccacgggcagagccggcagagcacgtggagcgccaccttgaccgccttcgccgacggcctgtccgccaccacccccaccacgccgtcgaccagcgcggctctcgccgacgtcagccgcgcgggggccatcgccgggagcgccgatttcagcaggtggattccctgcatccgcgagaggtagctcggtcgccgcagcacgcacgccatggtttccaagaaatcctcaccgccgctgccctccaagaccctcttgaagctctcctcggagagcttgagcgaatgcaggatgctcagggccgcctcctccggcgagctcgccttcgccggatcatgcacgccgccgcacgtcgtctcttccggcttggccgacgtcgcgtcgtccacgcccgccacggaggcgcgctccttgacgacggacaggaggaactccacggcgccggaggcgccctggacgcaccgccggttgcggtcgctctcggcaacgatgtcggcgagctccctcagcgaagccatcagctcctcccgctgacgacgccggcgcagcagcggccgcgcggcgtccacgatggcggcgacgcgggcggcgtcgacgggggggcgcggggtggggaagcgctcgacggcgtggacggcgcaccacccctgtatgaggcggcggagcgtgtggttgggcgtgggctcccggtccgccggcgccagccgctgcttggtcaccgggcactcgccgtggccgtcggtgaacacccaccgctcgatgctctcccggtcgtaggtgatccccgtcgacagcgtcaccgggtcccgcatgatctccagcgagatcgggcacacgaagtaggacagcacctccaccgccggcgccgccgccggcgacgactcctcacccatgcaagcctagtagcctagcctagctggcctaggagaagcaagaaatgcactagtggtcgatcgaaacaggaaagcttgtggagctagcttatataagggacagaagagagagacgatgacacctgaagtccacgccaagatggatagttccagcgagtaaggcgcaagtcttcgtttgtttttttttatgcgactgtatcaaccgaaaaaagccatatacatgcttgtctagtactccctccgtttaatgttacaagatattttgatttttagttaaaatcaatttatttcatatctaactatatttatagataaatatagtaatatttataatactaaattagttttatcaaataattaattgaatgcattttcataataaatttgttctggattgaaaatgttaatattttttttacaaacttaatgcactttaactttgaccaaagtcagaatgtcttgtaacctgaaacggagggagtaggcttctaaattgaaccctgagggttatgtttaaagtggagttatggaatagcttgggtcatgctccatctcttccaagttttattttgtgacagtactttagtctactccaatcattttttatacgtgaagctgaaactattcggttgagcaggagaggtgaagctagagttctaccaaatagggatgaaaacggctcgaaaacggatggaaaccatctctattgtattctttttcatatttttttagaatcgaaaatcttggatatgcaaacggaatcaaatattatcgaatacgaaaataaaacgcatcggatccaatacaaaatgaatagttatcggaatataaaaatctctcaaactgaacttctcaaatcaacggaaagatgtagctcgttatattacctaaaatagtaaatcgacatttataattttaccagtttcaataataatacaactaatagtatgctttacttttcacgagaacgagatctatattcacataatgtaattagtatggctcagcctaataaaaaaataattagaccaaagaaaaccttaaaagaaacatcttcatctaactaaacacctcaataatcataagcaatctgaacattttagagtggagaagattgaaaccacttgtatatgaagagtttccgaattcgtttttgaccgattccggtttccaatggatggtagccttaccatattcggttccgttatttatataacaattctaaatttgtttcaaaaattctccaaaaaaaaactaatcggcactttccgtttccaaaaacacatctggaaactgtaaattttttgaactgaaccattatcatccctactactctatccgttctattttaagtacaggagtactctaaatacagttgtgggtctctgtatccaatgtttgataatcctttttatttgaaaattttatgataaaattttctaaaaataaatcactcataagtaatatttatgttctatcatctaacaacaataaaaataataatcataaaagaatttcgaataagatgaacgatgaagcgttggacacacaaacccacgattacacttaaaatgggacgtagaaagcatcaaatagacctaatcccatatagtttcgaaaagtcggcgcgctgatcaatttaatatgaggatgaattgaagttagttgtttctcaaaaaattgaagttggttggtgtggaagggagctgcgtgaggcgggcggtggaattataatatgcatgggaggagagggctttgatcgaacgctaattcgctatggcgcgcacggccgatcgttgggtcggtcggtggatggatcgatcgggtcgtgtttgtcggacgggcgcgcgggggcggccaccgcgcgcgccctcatgaccacggaaacgttctgcttccagctttgacctcgcgcggggtgggggttttttcttaatcaatttttcaacggttactgtgccgttcctcgcgtctactcttctcgcgcgtcgtttctcaggtttgctcgctctcgtttggctttgaaaattcgtgatttcagctcgatcgagtgtagaattttcaagccgcaattaattttctgccgttgtttttctaccccaaatcaacgttttattactgtgaggacgtacgtatgttgtcccttccgatcgatcagcagccagcagctgatcgagcttatatactccccacttaccataatataagggattttaagtttttacttataatgtttgaccactcatcttattcaaaaattttgtgcaaatataaaaaacaaaaagttatgtttaaagtactttggataataaagtaagtaaaaaaataaataataattctattttttttaataagacgagtagtcaaacagtgcaaacaaaaactcaaaatttcttactctctccgtttcgaaatgttt

SEQ ID NO: 1960 - DNA, 13267 bp, Oryza sativa
catgtttgaccgttcgtcttattcaaaaacttttgtgagatatgtaaaattatatgcctacataaaaatatatttaacaatgaatcaaatgataggaaaagaattaataattacttaaattttttgaataagacaaacggtcaaacatgtgataaaaagtcaatggcgtcaaacatttcgaaacggagggagtatattataggacggatggagtatgctggtatttcatgtttgaccgttcgtcttattcaaaaacttttgtgagatatgtaaaattatatgcctacataaaaatatatttaccaataaatcaaatgataggaaaaaaattaataattacttaaattttttgaataagataaacggtcaaacatgtgataaaaagtcaacggtgttaaacatttcaaaacagagaagatatattataggccggatggagtatgctggtatgtcgtgcgctgaactggaatagtagcgatagtataggccgccgcggagagcgtggaataatgatgttttcagtgtacgtctgctctgacacacaacgatctagaatccatgtatttttgtgtaaaatacaataaaggtgcagagtacattatttattttgcaatcacatagtatcatcttttaagtgtaggaggccaattatgccctacacgtttttgttagtttaagttatttgttcaagtttaaaggcctatttagggaagcttttggcagctcaagaagaatcttctagaagctgtagctactataagccccccccccccccaaacaatctaaattttcactcagattttgaaaagctgtagttgtagataccagaaaatgaagtagaaatcaggagctaggtttcccaacttcatcagattctcatcagctatttcttatgattttaagctctctaaacatagcctaagtttattttaactggttggtacatattaacttattacgttatcaagatctcaaatttgaatctaattaacttacgcaattacttttcgctatgaaaataagaatgtccagacttataagtaaaagtttttatattttatcatggagttagtacttacaacttattttcatttcatgccctgtcggtgaagtataagtgaattaattactcgtgctaatttattgtcaatttatttatttattttcttaaattggttggtgcagctaattaactaaattagttttttgtgtagcttcaattaggaaatgcatagtatggagtcacatcattttctacatgcccacatgtggccaacgatacgcctttgacccgtctcacgtcttaacgcacgcgagcatttcttagtggactaaatttttgctaatcaatatacaaataacgtcacttgcattgttgtcatctcgtccactattctgcatttaccatgtgttgctgacagtagactagcagttccattccaacttatattattaattctgacgggatagtatacatgcatctaacctaacctgtggccgcgattaattatcgtgacggggcagtcgtcgcacgactgcaacacgtctcgaaccgtctatcgatctatgcttgacaaactcgttcatctccaaattaattcgttgcaaaaaaaaaaacacattgctactcatgtgcgtaatcttgaagaagtgaaaaaaccataagatatacattcatgcgtatgtattcattcgtacaaattgaatatgcaaaccgttcaacacgtatttgcgcgtagctaaggcctggtactacgtacaaatccatgaggactgtcaggttgattttcacagtgtaaagaaaaaaaaaccatagctttttgccttattatacactccctccgttttaggttataagacgttttaactttggtcaaagttaaactactctaagcttaactaattttgtagaaaaaaagtagtaatatttttaaccaagagtaatatattatgaaaaaatatttaattatagatttaatgaaactgtatatgttggtgttgtaaatattactacttttttctatatagttagttaaacttagagtaccaaaatcaaaacgttttataacagtaaacggagagagtatatatttccacagttggttttatcccgcaacaataaaaaaaattcaaaagatttatatagctaatgaggtaagaattaggatagataaggggattaagcaaaagctcgggggtatacatacattagaagtgcgtacgaccgtacgtacgtgtatgtagtaggtttcacaagccaaattaagccacgatttgattaggcaaagcaaaaaaaaggttcaatatattctccgcatggaaaaaaagagaaaaaattgtaaaaaccagtcataaatcacttaaaatttgacattccatccatataccattttttgtaaatatcgacctacctatttagttttattgtaaaaaccacctcagtacgcatatgcttaaacgaatcaacatgttttcataaagagcgagccattagtgtggtatttatcaaaattcaattcttccgaagtattgtcttgacacttttttggagattccaaaaatagaattgttgatgagggtttaaatgttgtcgcactgagtttcgctatatacgtacacacaaaagttcaatcaaatgcgaaaaaataagtctaatacaaacacttagataatattgactccactaacttagtatgtagtaactctaactctacgataacgggctgattgattaagcacatgtgtactgtgatggtttttgcaacaaaactaagtatggaatgaatatttgcaacaaaatgacttacgagataaaatatcaatcttcaaatgatttgtcgggtgatttttgcacttttcaaatgaaatgaaaaaggcagtgtaaacgtatgccactgtatttgagcacgtgccacatgcatgaacccaacatatcgtctacgccagtgggtaacaatccatatgtttttggcttgtgcgcgcgtccctttcgtttctgccccagacgcacgcacgcatgcattcctccaggtgatgcaactactttttaaaaaaaaaatcttttcttttcttttcttttcttttctcttctctttttttttcttctggccggccacatgagaaaaagaacagcatgcgcactagggatgaaaacggtacgaaaatttccgagaattccagctaccgtttccggtttgtaccgaccgtttcaatcggtatcggtaattgtccgtatcggaaatggaaacgatattctctttcggaaatgggacggggtttttttcgaccattttgtcgggtaccatatttgatcggtaatttccgttaaatttccgataaaattctgaagaagaagcctaagcggctgggtgcctgggcctggctagcaggagcagcccatttggccgggaagaaaaaccctagggcatgggcatcagccggcttgtcgcttctcatcctatccctgtatcgcgactctcgcacagctcttcgccacctctacctccgccgaccgctgccgccgtaaccacgccgccacgccgctgccaccgcaaccacgccgccacgccgctgcttgctagtcctagccatcgtaccctcacgcctcgccacgtcccttgccggagaagcacgatggcacctgttggaagaaaacgccacatccatctggatccatccgacggcaacaacggagcaatattgagtttgccaccgttgccaggtccaccaggtatagccgtataggtgtatagcttgaatgcttgagcatgattagccttgatatgtttgagcacgattttctgttgatgcgcaagcaccattttcccatgatatgagagccttgatctgtcaactcattaattatcatacaacggtgttatgtggcagcatgatgatgcaagggtaaaattataaggtcatctttatgcatagttaaatgtgggatgatgccacggttcgatgtttccgatatgaatttttgacttccgaccgatatcggtagatttctgttccgacggttccgtttccaatataccgacattatcgatatcgttaccgtttccgagtacaccgttccgattccgttttcgagaaaataaaatgaaaatgaaaatggtagagggtttttccgaccgttttcatccctaatgcgcacgaggtaattaggtagaggtatctggatatttgacacaacgatcgatgtggcaaaggccaaaggggaaagctaattttgacattttatttaccaagtttttctcacggcgttgtgggatccgaatgtccgatccagggctataggccgttcggtcagagctagcgtgtgtgccggcgcgagtcagcaacagcggcggcgtttaattttgccggtgctgcgtgcatgcgaccgaccgatcgatcgagacaacgtatatgtaattaaagtctacgaacagatcgatctgatcgtgttatttatatacctgggcttcgaccgtataatctggcatgcatatgcatgtcaaagttcgttcggcgtaacgtgcagggttcatcagatcggggtccaaggccaggagatcttgtggtgatcatcgtgtctatctaacttaattaattaatttggtcgtcattccggttgatcgacaattcgacagtctagctaggagaaaacagcttttgacaggaataatttatgctgcatttgatttgattttatttgaacatgtacccctcagtcccattataaatgcactcataaattttcgtacccaacgtttgatcatccgtcttatttaaaaaaattataaatttttttttaaaagttaagtcaaacataaattactattaatattctaccatcttataacaatgaaaatactaatcataaaaaatattttaaataagacggattgttaaagttagagactaaaacctaccgcggtgcttattatgagatggagagagtagtatctctgcgtaggggccccacatggaagtcggctgctgcttgcgtttgacaaaattaattggaatcgctacgcgttctcgctagcttgggttctgcttggtgtgagatgtacgtgcatgcatggcggcgggccggcggcggtggtggtggccggtcgccgtggtcggtgatgagagggcgctcagggttgactccaattaaccgaatcgtgctgctacttacgaaagctagcttcctagtactaagttttagcttgtcctttgcgtgtttagccagtttccactcttcttttctttgaactcgggacctatatattatccacaaatcaacgtgtattaataactgctagtacttcttccatccctaaatatttgacgccgttgactttttcaaacatgtttaaccgttcgtcttatttcaaaattttaagtaattattaattcttttcctattatttgattcattcattgtgaaatatacttttatgtatatatatagttttacatattttacaaaagtttttgaataagatgaacggtcaaatatgttttaaaagagtatttgcgtacgtttactgccaccaccaattgatatcccctcgtaagataggacttgatacagtagtcaaatagagctctcatcgatcagaaaaaaggggaaaaagaagtccactagagctctagatatatactccctctatccaaaatataattatttttaaactttgacacggtcttcgagatgttattttgaccaacaatatctatgttttaaataaaaagagttagatattatgatagtttgtttaatgataaatttagaaacatcaattttacatgattgattttttttattattttgctatcaatagtcaaaatttaaaatatttgatttggcattattgtaaaaatatttatattttgtaacagatggagtagccatatactccttgtacgtatatacaataatcagacttccattatatacatgctgtagttgctatatctctgaggttttggaattatatatgaatctctgcaccatatgatcgagacaactctatccgttccaaagaaaaccaacctagatatagatttaacacaacaacaataaatttgaacataatcgttgttttaggtggtgtcaactcctcatatagacatttttttagacagaatgagtagctaagctactccctccgtctcaaaaaaagtgaatctaagactggatgtgacatattatagtacagtaaatctggacagatatatgtcagattcgatatactagaatatgttacatatattatatagtattaggttagttttttataggacgtagagagtatagtttgaacaaatcaacagtacctcaactgtgatcggcagtacaagagagggagagatacggaatcgcatggatccagcactaaccagaaagttgcacaaaattcagaacacacaagagattaccgcagcaaggccaaatgggcaatccattccgtccgccctgcgttttgtcgggtcatttgcccgttccacgcggagtagccgccgtggcgccggctgccggggcgctggccattggccacttacatccgacccgggccacccggcctgccgccatttgtcagctagcccaccaaaaaagcaagccgtgccgcctgcatgcgccggcccggcgtgggaaaaaacaaaggccgcaaatccgcgtgaaacagtccattttgactccctcgactgtaactccaatccgatttatatcactagaccacaaaaccggatatctttatatcactgaaccacaaaaccggatatcttgaccccacagctattaaaattggtgcaatataactttctcggtaattttagaggacggttttattgatgtggtgctttgacttagtttgacggactgactgaacttgtgggacccacatgtcagtgccgcctcatcttttccttctctttctttctctctctcttcctggcacgggcgacataggtgggtggcgctgagccggtccatacctcccttgactgtacggtgtgtgcagtcgtcagggcgcacgaagagggctccctatggtggcgtcgaagtcaggtgtggacaagacaatgtagcgctgtgatggcgaggtaggcggtggccacagcgggaagggaatgagaacgggagtgagtcgggcgccgtagtgacacccacctccttggcttgatggtcgtatcctcctcgttagttgccatggctcgcacctctctcccgaggacctcacctccacgcttctcctcctcggcgcgctcggtgtcctcctccgccgcctagctctgtgaggccgttcaccgcgctatgcaccccactcccctgctataccgacaagaaaacattttgggaggaaagagtatgacatgtggaccaaactttatttttattttctttgatgactagtgacggagcgtggggcttctcaccgggagaccgcgcaggcccccctttgccggttcggccgggggccctgggtgaggttctaagctcttgatctgtggaaagttcgcgagagtaaaaacacacaagacacgggcgatgtatacaggttcggcccgctgagaagcgtaataccctactcctgtgttttggtggatctgtgtatgaagaagctacaaagtgcgagccagcccccgatcgttctgggatcctttttccttccccccctttctctaagtgggcaaggtcctccttttatatctcaaggggataccacatgcaccatctctccctctctttcttacttgacttctcttcattaatggacggagatttgtatggctgccgtccgaatgaccttctgatgggacggcccacacctacctccacttccgccggaagcaggcgcgacgtgggaacatggctatctgctgacgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggttccggctagggacgagtgcttggaggctctcgtcctgacgggatggggcgaggcgtgcgtcagaccgcctgtcgccacctaacccacgatctgatcggtctgtgactggtcactgaccggataaacgagcgcgctgcactgcgctacatgcagcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcgaccgtatcaccctcgggcccgacccccccgagggggttaggccacgtgggtgatcgtgtctgcctcaagtctctaagtcatgatactcccggtcccatgtcaccgacagtagcccccggcgttatgccagggcgatcgccctccccgagggaagcggtcgggcgtgacgccacctctaaggcctggtgacaggtggggccggttcctacaggtgccgtcgaactacatcacccagagggcggtgtgaggcagctgcgatgggctcgagctggcctcgggggcggagacgagctcgggagctggggtccactccaccacaaagtcggcgagggcctggctcttgatcgcgtggcttggttcaaagcgcaaatcgaattcagagagttcgattgcccatttcaccacccgtccagtaccctctcggttatacaagatttggccgaggggataagacgtaaccaccgtgacccgatgcgcctggaaataatggcgcaacttcctcgcagccatcagaatagcgtaaagcatcttctgggcctgagggtatcgggtcttggcgtcccggagggcctcactaacaaagtagacgggccactgcacctttcggtggggccgatcctcttcgctaggggccacatccctggggcgctctttgtctaagcggcctcacggggtgcactcgtcttctgtgccgacgacctcggggtcggaggacgacaggggcggccttcccacagtggcctcggggccatcctgggggtcgggggcgcctggcaccgtcggacaagcaggcggagggccagctccggccgtcgggggccttgggccgcctttcggctcgggggcctctcctccctgctctctctctcttcgggtagaatcccggcggtcgcaaatcgcgcgcatcagcaagggaaaaccgaccaacaataatgagcggcccctcggctcgcgtttgccttcaactccgacgaggagtgcggtgacgacggtgcggacgacagcgacggcgaggccggctacccgggcgcgtcggagtgagcccccaggcctccgccaatcttaatagcttttccttcttcttccgaggccttcgggcccccttcttgttataggctgatttaatctgcaatcaaataaagaggaaatttttgtgtcaattctatttgttgtgtgtatgagacgaggatgcctgtgccgcggtccttttgtgccttggcttgaacaagggctcgtgcccaggtcctagtcctcaaatggctcgggtcggggctagtgcctggggagatccacatgtcgagactggccaggccgggagcatggtgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctatttcaagtcaagatccttcaaaaggaaacaacagcacagatacagcctttaggaaatcgaaaatgcttttattgaaatacggaagagaaaaaagataagcccccggccaaccctgcacgcccgggggggtgcggggttggcccgagcccaagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccatattggtgagagcttgctcaatccagcacgcgtttggacgcggcgtaggacgaggtcgtcaacgcagagtgatcgggcccggacgtggcgctgatggtagcgccgcaggctctgctggtagcgcacggctcgaaggaccgcgcgccaccttcgctcttccaagtagccgaggtcagggagcgtcggcttccttctttttgttgctcgcaggcctcccctttcgggtggccagcgaaacgccttcgacggcgaggacatgaccctcgtcgtcggaatgggccgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacacccctcttgaacgcgtagatcaccgcgtgtgcagggatgcatggtatggtgttgcggacttgacagaaccgctgaatgtacgagcgaagtgactcatcatcccttcgctgtactgcgtgcaggtccgcttcttcacctgggcgcggatatgtgccttgaaagttcatggtgaactgttggcacaaatcctcccaggagtggaccgacgcgggtggcaagttcattagccaaccccgcgcctgtcccttcagggctatgggaaagaaattcgccatgaccctgtcatcacccccggcggcttcgatcccggtcgtgtagacctggagaaactcggcggggttgacgctcccatcatatttttcggcgatggtgggccggaaccttgggggccaacagacgttccgaaggctcgccacaaaggctctacagccgacaccaccaaccgggggcacggagggctgatccccgcgtccgtgttgaggtgacactccggacgaggaggcgccctccgttgcgtggggagcacgccgaccattacgccggcgctcgatatcgatgcgggcatctggccccccacgctgatcttcccgggtcggaggcgctgacgagggagtggcagccgaatggcgagcaacagccgccgctcgtcgcgccctccgccttgacgacacggagccggtggtagcagcgccagaggtcttggtggcggaggaccgaccaccagcacctaggcgccgctgtgccgtcatgaccaagttggccacgtcgtccagccatcgttgggctggagactccgggtcagggacgacaggcgggtgacgcaggagcgcgcccgcagcttggagcgcgccctggggcgtgctgccgtcgccgtaaacgaggaggcgacgctccccatctcggcgcccttctccatcacccgtggatgtcgaagtcgcggatccttcgaccctctcgagcacctcctccctcctaggactttggcgtggagggggcggtggagtacgagctcgacggcgtgggtttggctccccatcgtcaccgctaacgctcggagagaggttgtgcgcctttgcttgttcggccattgggctgaacaggaaaagcttggcgcacacgaaagagtgcgagagctcagaagatcactcgcagaaccccctacctggcgcgccagatgacggagcttgggggtcctcatcgggagaccgcgcaggcccccctttgccggttcggccgggggccctgggtgaggttctaagctcttgatctgtggaaagttcgcgagagtgaaggcgatgtatacaggttcgggccgctgagaagcgtaataccctactcctgtgttttggtggatctgtgtatgaagaagctacaaagtgcgagccagcccccgatcgttctgggatccttcatcagattattatatctaagtatcatgttgacatcataataatattaactattcaattgaaacattgctactccctctgtcttacaatgtaagttattctagcattttccaccttcatatttatgttaatgaatctagaaatatattcattaatatcaatatgaatgtgggaaatgttagtatgacttacattgtgaaatgaatgaagtactattttgtaagaatatttctacgaaaaatgctacaggatggtgccccgtattctcgttcagacggaatgatgcctctgagttatcgtcggatacttattaggtatcgatcgataccctatttagacaggttgatatctctaaggtatcgtgtgatacctaatacttataatatctctgagatgtaatctgatatctgataagtatcaaccaatacattaaaagtatcatttcgttcaaacgaggtgccgttctacagcattcctatgtaaaacaaaacaataccctccgttttagtgaaaaaagaaaacccacgcgtcgcattgacttttccctcccgtttcttgcctttgccgaggtgagctccacacacacacacacactctctctctctctctctctctctctctctctctgccccactctgcctgcctcatgttgaaccattccccttcccattcccgacccggctcgctgtcccccctcctcggcgtcctcctcccctcccgcgccgccgcagagcgcccgccgccgctgaactccatcagctaccccgagcccgcgggggcctgccgggtggcgatggaattcccgtcgtcgacgtcgccgtcgccgtcgccgtcgtccgggcagcatcagcagcagccgacgacgccgcggcggcagcttcagggcccgcgccccccgcggctcaacgtgcggatggagtcgcacgccatcaagaagccgtcgtccggggcggacgcggcggcggcgcaggcgcaggcgaggcgggagcagcagcagccgccgccgcgggcgccggtgatcatctacgacgccgtcccgaagattatccacgccgagcccaacgagttcatggcgctcgtgcagcggctcaccggcccggggtcggggtcgccggcgccgccgcatcaaggggaggcccaggcgcacgactaccccatgatggacgaggccgccgcgcagcagatcttcccgccggagctgctgctctcgccgtcggccgcgatgtacccggcggcgaggctggcgaccat

SEQ ID NO: 1961 - DNA, 7051 bp, Oryza sativa
  unsure (1)..(7051): unsure at all n locations
cagcggcggcggcggcagcggtggcaacaccagcaacggcggcgccgcccgcccgccgccgtcctactacgccgacccattcgtccccagcccacgtcacctcctcgccacgcccaccgtgccgtcgccggcgacctgcgccgagctcttcagcaacctgccggatctctagcccgccgccggccgccgcatccgtccaaggcagcttcagtggcagaagcttagctccatttcctcttttcttttttttcccctccattttttttctctctctggtaggctcaaggtggtgggcccgatcactgatgacaaattgattagtgctccgtttcatccatgcgctttgttaattattcttgggcaaaccacttagcaatgagaaggagcaaagaggaaaagaattgagaagaagaagaaaaccccaaaagaaacaataggcagtggcaaaagtagtagcagtagcagatgagagtgtaagactatagaacaaaccggctggcccagccatgtctcttttactcctagttttcttttgattcagttacatctcttgtgtaaggttagggaaagattgcttgcttaatgcatcatttgtttattctttactgctggtgtgcctctgattggatttggattctgcatgctgacttggtgcactagactaataaaaaccggtactgtatgagtaaagtaaaattgtacttaaagtactgtggataataaagtaagtcataaataaaataaacaataatttcaaaaatttttgaataaaatgagtggttaaacgttacaagcaaaaacttaaaatctcttatattatggaacggagggagtatcactactagtgtgatgtttgtgtgtggactgaccgtgtcagtggtagcaaatggagttttcgtgccggcggaaaattggagaggagagtagttgttgttggggccggggggcggagaaaaaaaacggtggtggatagggatttgcgggtgtgaacggggaggggattggaaggctccgtttttttgtcgctggcgtcgcacgtgntcccnnnnnncngngggggggggggaagattcggtgcacccgttcacggccgggaaaagaggcttcgcagccacggacgcccggaaggagggcagaatgggggcctgtgtcgtgccgttctcctcgctcttttgccatgtggctgttcctgaggccgtcggtatcttacggggaccaaagatcctttacactgaaatgcacggtatcattaacatatggttaatgggtccagggtttcacatgtaaatgataaagtcaagtgactccgattatatagaataatgatctattttttggtactacggatgtgtttattgctgaccgtgctgagtttgatggatagattgttagttataaagtattataaagttgataaaaaaaatcaagtctataatatacgagacatagtgagatgttcggctgctgggttgtgactgcgctcactgcgagcagctgcagctagcacgaacaatgccgtactcactgtgagcagccgcagccacagcagccggcctaccgaacactcctagtattaaaaaaaatatggtaaaaccgcaattgttgagttaaacaaacgtatatgcctaataccatcgcacaaacaaacagacgacacaccaaacggggcaatgcttatttcaagactataaattttagctaaggatttctttttctttacaaccgtagtctgtatattttatacgatctgtatatcctcatctctttattatatcataaattttcaacgtgaatatgacatatgctaaatattagcatttgtcgatctggcgagaagatcatggaggaaatattaattcacactatctaataacgttctattttattttttttttattttcggcaaggaatattcagtaatatatcgatgtatttcagatagctctttcgaggcaccatatgagttttccagttaagcatgtggatttttccttttttagaaatcggtactgctcaatagatatacgacttacttcctccataaaaaaaaggaaaatgctaaatactgggataccgtcgtgctacagctactcgcgccagctgaggacggcagcgacgcgtggggcttggccgccgtcgctgaggtgctgtgttgacgagcagcgcgagctcggcgtcggagcttatggaggtgggttgtcgcgacggccggggatgcagctgtcgccggagtggatagacgtggagcaaggaggacacggacgccggcgacgagctccaacgtggcgtggacaggggaagatgcggccgtcggcaacgagctccggcatggggtgtggatgatggaggatgtggctcccgcgacgagctccggcgtagggtggaggatgccgccagcggcgactagctccggcgtgaggcgtggatgacggagtacgcgcccgtcgccgatgagctccgacgtggcacggacagggaaggatgcggccgtcggtgacgagctccggcgtgaggcgtggatggagaatgcggccatcggcgactagcttcggcatgaggcgtggatgacgtaggacgcggccgccggcgatgagcttcgacatggcgtggagcgtggaggactccaccgccggcgacaagctctggcgtgagacgtggatagtgggaccaccagcgacgacactttggtgcccggctcctgataccttataagtattacctaatacgtggtaggaatcgcctgataccttacaggtttcacctgatacttcgcaagtatcacctgatacataatagaaatcgcttgatatctgacaggtttcacctgatacttcgcaagtattacctgataagtagtaggaatcgtctgatacctaacatgtttcacctgatacttcgcaagcatcacatgatacatgatagtaatcgcatgataccttataggtatcagctgatacctcgcaagtatcgcctgataaaggtgaagtatcagaacatgatacctcagaggtagcaggatctaatatttaaccggtatcatccggtcccaacgggattctgttgtattagcagcctcctaaaaaaacaaagctagtttggtacggagggaatagctcattccgacgatgaaatagtgaactcgctcctaaacagcagcaggcaaacgtacagcaaaatgagtcaacatatatactcctactttttctggaactaaagagtcaatcaacatatatatactcaacactaggtcactagcactagtagcaaccattaaccatgcatagacttggaagacaaacgcttgatcgaggccacggtgatagtcatgtactccctctgtttgacaatgtaagtcattctaacatttctcatatttatattgatgttaatgaatctagacacatatatctatctagattcattaatatcaatataaatgtggaaaatgctaaaatgacttacattgtgaaacggagaaagtacatgtacaaacaggggcggagctagtattgttagggaggtgcccagaaacccggttcgaaaatttttttacctatagtttatctattttgaccatatatataccccgtcagtttaaatatagacacccgtatcaagctaaatttgatttaaaccagagtaaagcaagcgagtgaaaccccttttattttattctagctccgtccctgtatacaaaacatagctcactgcactccatttcaagaaatagcgccgtccttagctatcaccattcgccttaggcttaagatggtggtggtagtgttgtggaagcagcctgagcagtaacttcttgtccgcctggttggacatttcaccgctggattattccatctcgggtagcagattttgagcagctcgttcttcttctcctcgacttggctagtcgtacgttgttgtcgttgttgttgttgcaggtaattctctcatgttgccggccggattcgtatgatgagacggcgtgcgcggcgtgtgatggtttggtgctccgccggccgcggaggtgaatgagcggaggagcggcgtcgtacgtcgacctggcgccgccggtgccgggggaataagctagcctcggcagcagcaacacccgccattcttcctccttgaggatagtagccgccgccgccgccgccgtccgtagcacgcgacgtacggccgccggctccgacgacactcttcgccgcgtgtcgaaaagccgccgccatgcggttgatttcgctctctgcgtacccaggtgtgggcgtttcgtgatctcttctctattttcgcctgccctttttttgtcgatcctcaaacataccaggagtttaggtggacatatgcatggtgacaccatttagctatccgatttgcactattaatagagaatcaattacaaactaattttattatggccgtttcagttccaacaatataagtttgttgtgctcttgctttgttcccgagtacggcttgtggatcatgaatgagtccatatagaacgggaattaccaagtgtcctatactaactacgtagacataactcctttctttccgtaccaatatgataaaattagtggcatataaatttataagtaaaatacaccaacagctcctaaatttgttatattgtgtcatataggttcttatactttgaaaaatccaaatccatagatcctagaccttattaaagtgtgtcatctcagtctaaaattgtcatgacccattagaaatcctacttgacgctaatatggttgtcacctcctcctaatttttttagaaataatattattttaatgaaaaattataaaagtagaagctgatcggccgccctgtcaaatatccacagtttgacagggggacatatcaaacaaccataattcgacagggtacctgtcgaactgcggttgttcgacagggcataaaaaataccctatcgaactgtccctgttcgacaggagataaaaaatgatagaaaaaaagagatcaatcactatgcgcaatatacactactgtgcacctctgtgcatgcagacctatcgaactttggatgttcaataggccccctgccatgctctttatagtccttttctttttttttaagtgaacaacaaccctgtcgaacaactgtagtttgacatgatgttaaacttgcaattttagccgaccagtttctacttttgcaatttcccattaaaataatattatttctaaaaaaattccctcctctctaccctagcagcaacaacctacacagctccactgagaggcaccgctggcaacagtggcagagacaaggggacggccggtggctggctctctgtaacaatttttaatacacagttatctaattaattagttaattaacctaagtaatgatgtattagttgattctgccgctggctgatagagagggaaagaaatgaggtgacaggagggaggaggtggcagccgcgctagagctaatagtagcccactactgtctccaaatcatttatagccaatgtaatagtcaattcatataatagtgttactatactattaatacatggttccacctgtcatacacacattacatcttgaagtctgtgctgcagctggctacagatctgtaaaccgctgctcttctctcttttttttatctctttaaaatatgtttatagctggcttatagcctgctattatacctgctcttagcgtgacttatattatgatcccgaatgagccatgacaattttgaactgagacaacacattgtaataagtcctagtttagggaccacttgtgtgtttcactctagatttaggtccggttggcacaactacagatcacataggccctgttcggcaggtatggctgccgcagccgctgcggctgcggtagttcaaaatcgttgtaagctgcagcaatttcgaaatgttgcaaccgtagccgcagctgaaaaaatggcagccgaacacacccatattcactgtaaatttgaaatttcaatgtttaattaaagaggtttaaaattttaaattttatctaaaatattaaagtggtttaaaattttaaattttagctaaaataggaaatgttatgaaaataatcgcaaatatagatttatagatttatggagttatgaatatccagctctaagaaatattggatctgtagctgtgccaacaagagacttaacctatgcccaacacaccatgcaagctgtatctagatccacccataaaataatgtattgctacctatgagaattttcttgccaaataacaagataattgaagaaagggagtagctatacaatattagacaattgattatacaatattagacaattgattggtagaaaaatttaaatgtgacaatagtataattaaaatataattatattataaatttacaactatattataattacgttataacttacatatagcttgtatagaaaaaattgcatgtggccagttggttgttataacttagaccttgtttagttcccaaaacaaaaacttttcacccatcacatcgaatgtttggatacatgcatggagtattaagcctaattgcgccatgatttgataatgttgtgctacattaaacatttactaatgacagattaattagacttaataaatttatctcgcagtttcctggtagaatctgtagtttgttttgttattagactacgtttaatacttcaaatgtgtgttcgtatatctgatataacaaacaaacctaaaaattttccccaactaaacaagatattacatctatgcatccttcccaccacacttggcacaaaatttgttctccctaccccgccggaggtcgtggtcacggtgcattggaccatggagccgttcgttgtgcatgtcttgtcacattttccacatgcgttccctcggcttccccttaccatcaaagcgcgtgtattaggggacctaccaaatagcagcactcggttgatatttgtcaagctcccaaaaatagctcccttttatcatccactttggcgtttcagctataaccaccacaaaggtaccaatccttgcttttt

SEQ ID NO: 1962 - DNA, 1842 bp, Oryza sativa
aacaaatgatcacaacgcgcatatactcacttttataaatacacacgtacttcttactctcgtaagtatctttgaaagtttaagccggctatcttgtgattgataaagttaacacggacatcacaccgtcgacgggtaaagaataattaggcaatcgattgatctattaacaccacggttattagctgaagagaaattgtgaggcttggccgccttcccctcccataccaccactgcatctcggcatgtacatgttggtcacggtgatcccccctgatcctgactaacgataagtaactggaggagccacggactgaaagcgctatgcccaggatcatacgcggtcggcgattgtcctcgtctgcttgactagaggtagactaacggcctttttggtttccagggacttatttcaagtccctgtcacatcggatgtttagacactaatttagagtattaaacatacactacttacaaaacccattccataaccttggactaattcgcgagacgaatcttttgagtctaattacgccatgattttgacaatgtgatgctacagtaaacttttgataattatggattaattaggcttaaaaaattcgtctcgcggattagctctcatttataaaattagtttttttactagtctatgtttaatactccaaattagcgtccaaacatccgatgtgacatgggctaaaaagttttagccccatctaaataccccctaaaatgcagacaaagcatctcaacttcacacagcttggcctacgtagggatgacagggatagcaggcgacgtcagctgagctgagccaacggcatcgcatcagctgctggttagttgcactttcttaattattagatctgctcgttaattacctcggagagaggtagtactccagtatttctgaattgttttctgatcaaggtcagattcagtattcagagggaagaagtcttcccacaagtggagcagtacatggtaaaaatggactgaaatggtacagaagcatatggacaagagggaaaaaacgcttctggattgaccacctcgtttcgacaagcaccacaagttcagattctgaattcgcagtacaaaaaaaataagatcctctcctcaccttcctaccatctactaccaacaaaaaaactttactgtgttagtaaaggctatcaccaaagctacagttttctgtagcttcttcttcagcgaacacactcacgcacgcacgcaaatcaaagtcagactataccaaagctgattgccttgcatttgcagatcatcacaatctcacaggcaagccgtagttgtggaaagacctgatcacaccgtctcgacttgcagtcacgatcaccgtgttccaagcaggcgagatcgtggagagacagtcagacagtcgtggggcatcagcggcttttgcaggtggaagcttctcctccggccatgtcggagtacccttcatgccgtcagcgaaacaccgcgctgcgggggaacggcgttccccgtggcggtgcaaaatgggtgaactgacggattcttcagtcaggctggaagaattcttcacctgctgtctttcttgatgcagcccgggccatggtaccgcggttgtcacgtccttggagaagaatttctcacaggagcgaaccgatttagcttcgcctttatgatcggcgacacttggaatgtcaaagttccagatgtagacattggaatccaatccggcagatatgagatatcttccatctgatgttaaagatggtgaagaaagagccttcaaattccaaggccctgcatcagaaggtatataaaaggagatatcagtactgaggccacaaa

SEQ ID NO: 1963 - DNA, 3064 bp, Oryza sativa
aacatatgtttatggtacatgaaaccatgttgatagacattggacagaaattgtattttcagacaagcaatttgagtatgattaattgcgtatgctagcaatatagtaagatacaagagaaaaacttacatctgactctgaccatgccatatccaggatatcatctgtatggccttggaattcatgtaatggagtctctgaaatgcggaaacccttctttggcactactgcaagggcatgattcttccctcttcctagttccgttttgatgattgtaattttatcatcatagttctgagggttgtctcccccatgcaacttcgaagatgcttccacttccataatctgccatatccgtacaatgcagtcctcaccaccagttgccaaataccagcctgacgggctgaatttcatgactttaattaaacccttgtgagcttggatttcttgacccagatggacagcagaaaattccatagtttttttctttcgatgttgaacttttgttctggatggtatgcctattgtgcagttttttacattgacgtcgtgcttgcaaattccaccaaaactcctgtttttcatgaagctcttccacaagctcttgacaccctttttcttattaaacacattctttttctcttccatagaactgctatacaccttgcgcaacaacttttgaacagattgagaaaggcctggtacgccatcaaactccagaagagacaccaccttatgtgatgccacatccttaagcatgctagtcaattcgccgtatccatcattctgaactgtgtatctctcgccactgtcaatatctcctatgcaacaggaggcatcagaaactgattcattctcaggaacagatgaattcacggaagaaatgtcactggtagtactctcctccaaccccaagtcagcgaaaggaccaacagttgtgatttctccctgtggttgagaaaaatccactctggtagcaagaaattcatcaaaccccattcccttcaggaacctttgccgcctttcttcaacactcattggctcgtttccccaaatatcatactcaaatctccttgatgctaatccttcgtcacttgtgctgcaatcatctgacaatgaaggctcccttgttgaagtaacatcatcaaatgcatcaaagaagatatcatccctgtctgattcggaacttggcatatctaaccgaaatacttctagcccaagaaaaagaatcaacacagaggggggttctctcaccctctgtgaagttagcacgcggtgctcaaaatgtcatctgcaattggcaacacaggtaatcagcctcgtgatatatatatagcaaacaacaacattacctcctaatgtacaacaatatggactacatggacataaaagataattgcaaatttaaccatttacagagcacaactaatacaaaatgcaaacagtgaaacagaagaagcatctaattaccaagaaaaacaaacaagaacaaagcacaggatgctccttgcctctccccacgccaactgttccctgaaccaataactcaccaaccacgcacgcaaaacccaacctcggggatcccacccaacatgaggagcaggaacaggaacaggagagcccaaccccaaccccaagaacccacacgggggcgcagatcccaagtaaccgagacaaagcaacagctaaaaacagcgcagaaaggctaaaaagggacaaaagtaaaagagagttctttgattctttcgactagggggcggctggcaccgtaaaaactgctgctaccgcgcagtgccggtgcttggctggctggcagcacgggcccacctgtcagcgacgtgcgcagccgccgcgcgccggctatcctacctctacgccgatggccacgcaggctcagggcgtaggcgagtagttggccattaaaaccgcgtcctttattaaggtgttcaaagagagagaggaaaaaaaaaaggtttttttttctgtccaacaacgaaattctgtggcagaaatgcaggcctaaaacaaaaggaagaaattttgactcttcgctttccttgtttttccccttcaataaaatgatttaggagtacactgaacctgcaatcagacggattaaagtttcgcacttttcaaaatcatttagcattaattgagtgctataaatctggcggctgtagcaaaatgaaaacatgaacagaaaagggattgctgatttgctggggttgaaagaacattaaagattctcgactatgcgcgccattaaaaggaacaaaaatccgatcatcgtggcgataaagcgatccgagagagttaaaagctcacccgttttcgtaccgacagaaatgaaaatttgaaactttccctctattaaaacgaccggaattttcggtggtgggcgagtgctttgttctcgggggaactccacaaatcctcggctaaatttgcgcagcagaatacaaaaaattcatgcctagaaaaatccaaattcccataaaaagaaccgagaaaaaaatgatgaaaacaatccgcgaattcctaatcggctattcgtgtctcccctcgaactgttccattaaaacaggaaaccaaaccagagagaccaaatcactgcgccattccaaacgctaaaaccacacgaatcgatcctaaacggaaacaaacttagtactactagaaaagattaagaaaacccgaatcccatcgtcaccttgttcgtcgtcgtcgtcggtggttcactccacggaggcggcaggaagaacaaccgccgccgccgttcgtctccacccgcgccgcagcgccatgcccaaccaggtgtagaggaggaggaggggacacagagggggggggggggaaatggtggggagagagtgggatctctcgctcctgcgcgagcgagcgagagagagagagggcttgggatttgggattctgcttggacgcgtccacctcgcctcgcctctcctctcctagtggccttcgttttcttggcgtttcgttgtaaaccggagagagctttgtatccctaatgctgatgatatgctaatatgctaatcccaaccaa

SEQ ID NO: 1964 - DNA, 2481 bp, Oryza sativa
  unsure (1)..(2481): unsure at all n locations
gaatattttcttttctgatagtagtacgcattataaggattattatcataaaaattatctaaaagaaatatatttagtgctactactaattaatactgttgttttttctcattagaattggggaataattttcttttctacgcattataaggtttatcaaaaaaatatatctttagtactgctaaaactgatattgtacgcatcagaatttggtgtgtgtggtcacttgtagaagggattgaggagaacctatccaaaccgtcagatggatcttgacaatggatgaaaggcagtggtggtggggacagtgacgcgtgcatgtgattttgggtgaaggactggaggtagtggccttgattagtttagcatcatctcctcctgcaattgggcgcttttccatcctcgagataaaccccactacggtgcacatacttctaataacatctttttacgaaaaaaaaaagatcattattcattcggcttttagaccttctgaagttctgatcgatcactcacggggtacatatctcactttgcatattgttcttcttcctacaatcacttgcctgggttcacatgatgagaaagaaccgtgtagtgcatcacttccctttacaggagaattggctacagtcgctgtagcatttttcttttcttagatgctagatgtatacaagtttatagagctaaagtctttgaccagctggcccaaccggaacccgaccgggtcaggttaatcacgctgggttttctcttggccgcaagacgcttttagcaaagcaaatattccagcacacgcatgacaagatctaatctggcacaattagcttctcataatgacaatattatattgttatgtatggttgacaacttacgtctgtgctggaagtagtagtactgctacttgcttccattttttctgtacacgttggcacttgattttctcgagaagggtacaggttggccaacttgcccatatggctgcagttgcgccacccacccgtattctgaatattcgctcacgatcgagcgtgtacttatttcttaatcatttcattacttgagaaaaaaatgcgccagatgtctggatgcataacgtttctttatcagagaatgatgatgctcgattgctcgctgactcttaggcatttgacaaaaataaacgatatgccaaactgtgcgcacagaactgatcgtgcctcggatcatcagatatagttatgcacggcagcttagctctgaagatgtagcagtacatgttctccaggaaacaaaaacaaaaaatgcagtgaatgcagctgtgaactgcgtcacagctgcagataactttaatatgtgattgtgggcagcagcgaaatgcagaccacttaaacagaggactagattcacgtttgacaggatcatcataatctaatctagtcaagcaacaacatctgaactagtaaaccgaaattactccctacttgttatgtagcaaatgcagtgctggtcagaggatgagtacgcacctaattaagctgccgctcggcgacggcgagagttgcaagaagagatcgaagccggtctcagtcggtagtgaccagcaaaaaaatgtttcggcaggcagcagatcaagagtgcttagttggtggtagttgtgtgcttagagaaagaagagcatgcaagaacctaaatgtatacccatatataggcatggttaaggcgacagagtaattaacagctaccaatgagccgcaaagatcgttattactagtatactaacactgtactcggcaggtcaaagccatatcgccatcgccaacctcccagatggcaggacaagcatgtgggctctctctctctctctccctctctcggattgacgatgcagcaacgctacgctgcgttatctaatctaatcatgcccaatcaggaagattccgatacttttttgtgcatggatccccgcgcaataattccgaaaagctccactttcccctacttgctcccgcagccagttgcacgccacgccgaccgtccgcgcgcgcgggtcgcgtgcgccattacaaaattgccgtgagacgccccccgcacccgcatccgccgcgcgcgacgtacgcgagacagcattacgcggtggagactactcgttctcgtcagtcgtctcgtctcggctcacggcgcgcgcgggcgggctcggcggcggcggcgacgggaggacatagattatgcgggcatgtgcgcgagggggtacgtacgtacgcccatgtgtgcaagttgcggctggctcgcggtcgcggacgccgatcgatgcgtacgcgccgcgggtgggcgctgcacatggcggtgtggttggttttgtttggagagtagcgtgtggttgcgccggttgcgacgtcgcctgacaatctgtcatgcgagaaagaaacgcgggaaggggggggggggggagtgttgcanaagtggacaagcgatcacttttcggggggggggggggggggg

SEQ ID NO: 1965 - DNA, 16012 bp, Oryza sativa
  unsure (1)..(16012): unsure at all n locations
gggggtgacaggaaggaatcgggagatcacctgcgcgcgacatgacaggatcgcagggacagctgcaggttttgatgatgatggcgatgacgatgaggatacgatcaggaccgaacttttcaggggggtggggacgggaattaaactgggcgatcggatcatgaccgtatcagcctgggtttgtgtcgacggtgttgttaagtggcggtggggagatacggttggatttggtcatttggaggctgggagaggagaggggaggattgtgcatgttgaggctggcaggatcgtcgcagggatattttggttccattcacttggctatcattgatggtgattagtctatcaattggatcatgattccatcgctcaccaggcacttaagatggcacgcgacctatacgtttgcaacttgaaggaacacaagtatgggtaattatagatttatagtcccatttgtcattgcattaggaaacaaccctgacagtcaagatcagactatgtacacggtgtaccctctctcgggacaaagtacgcaggggccatgcctagagccctagagcatatgcataaggtattctactaccttttggacctcttcatgttggaccaaggaggatttcttttgagggccagtttaacatcagagatacacagagttagcccactatgtaggagtttttcctacattaattttccttacaaaaatttccatgttttttaaaacgatgcattcaaaatagtgcgagatctcgtattgatatagcagaagaaaattataaaattacaaccttgtaagataatagctcctagcctcctaacacatccttgatccttgctatttttagaacatgaaaagtacattccattaggacgatgatatagactgtgttattctcccagtttttccaactcacctctttcgttttccacgcggacgcttttcaaactactagataatgtgttttttgccaaaaatatatatatatgaaagttgttttataaaaatcatattaacctttttttaaaaaaataatacttaattaattatgcaataatacgtatttcattttgcatgtcgggaggacctaacccctcctaccaaacaagctaagtggctagctaccacacgagttacaaagttattaaaccaggacaaatgatttgtcgcgttccatggaagctcccaaatccgacaaaagaacgggcaacacgactggacattgttggagtctaacatcattataactagatagcacaaaaagtttatctactgtaaaaattacaacattaacaccattattttgcctcagaatcattcaaaccttaaactagattgagaacaatatatattaaatagttggcagtgttcggcagcgcatggaagagagtagatttgtctcgttttttcacgcgcacgcttgccgaacaattaaactgtgtgtttttttaaaaaaaatctatgaaaaagttgctatgaaaatcaaattaatttatttctcaagtttaaaataattaatacttaattaatcatacgacagtgactcacctcatgtcgtatattcagatttcctctcctcttgtacgcacccaagcttgcaagttgcaatgcccatttccgctagcaaaaccactgttctctctgcagcagcagatgcctcaaatcttgtactaactttttcaacctttcggctacagccatcaacaggttcccagtctcatcacgaatgtagaacacaccccatttctcgtagttgaatcaaaagttccggggagacaggggagattgattctcgttttccacgtgcacgcttttcaaactactaaacggtgtattttttgcaaaaaatttctataggaaagttgctttaaaaaatcatattaatctatttttgaaatttaaaatagttaatactcaattaatcatgagctaatggctcacctcgttttacgtatctccccaatctcctcaatccccttctcctcaaacacacccttaatatttactttcagaatatatatatatatatatatatatatatatatatatatatatatatatatatatatatatatatatatatatatatatgcttactccacgatagacgttctgtactggcctgccttgtttgcaagccgaatcacccatcctgccattcatcattcattcaattttttgttagaaatattcgggatgcaaaatcttttgcacaaatataccatcggtctcacacaatcattacgcgaaaatgacgtggaaatgacgttgcgaccggtatcgcgcaatgaaagcgcacggtctcgcacggtagcagtgcgagaccgcgcggtctcgcccaagcaaacagcgatagcgctgaagcaatcaacgctatcgctcaagcaaagagcgataccgtgccttgccaatttaattagtggttaattatccttattagtgattaattaataattaattaattaatcattaattagaataattaatcactaattattattagttaaatgttaattaagtaattaaccactaatcaaatggatcctattggacaatgtcgctgattgcttctgcgagaccgaacggtctcgctcttccattccgtgagaccgcacggtctcgcgccgttgccgtgcgatatcacccgcgacgtcatccccacgtcattttcgcgcaacggaagtgcgacactgatggtatatttctgcacaagtttttgcaccccgaatattcctgagaaaaaaattaaataaacagtatattttcaaatttaattcactggaagctctctcactgaccatctttttttttccttgcagtaattagcttgtgcaccttaccttctgatgcagctcgatcgcacgcacctgcaggtgcagcgaagctagctgccactaaagagcccgcggtgagtaaaggagccagagagagaactgcatttgttggttaaggtctcgcacgcagagaccggtggtagtgtcgtcacactgccgtttttacacactcatcatacatactatttgctccattctgaaacaactactgcagctagcttggatcggcaattggtggtttcacgtcgccttcttcctacttcccagtgtcaagagattaaatcctctctgatcaaattgttacatgtacgtggttgttcttccaatcaacaatgtgaactcgctaacaccattctagtagaacccgtttccatggccccttctagcttgggatgatcacagcgtggtattgcctgctgcgtgtgcttcacttccccgaatggcgaatacccgatcgatatatcatccacccactcacaactcgcgacaccgaaatggaaaacgggaaagcgttggttgatgatctcgcttctgccccgtggccacatgcgaacataaccagttaaccgccaattaaagcttccgatcgattcacatccttatatatttagtacaactttacaagttaagcatttgagcacagcgcattatttgcagacgccttaccttaacttgcattcggcaacttccatctctttgcaatggtgctttggccaagcaagccggccagttatatatggcaggttggagcagtcacgtctgcgtttccgtttttccttctacattagtgtgcttacgtttaatccatggacagcccggtcttgtattcttgtgcaaatgcactgcctaattggccagaccatgcatgcactagtaatactgaccttaattaacttcaaagatttagtagctagctagatgaccatcctggcatatgagtatgtgcagcaacacgttgtgctggcagccgtttcatttcatttcacatgtgcctatatcactatccccttgaagcccagaaatccattgcgtgccaactcaaatcctaggcagtctcatcctcccatgaagaagcaagctgcagctgcacgatgcaacgccctttttgttgacagatttgagagtgagttcctgttaatccttgaataattcgttttttctgctccaattcccctcccggcccatgtatgatgttttttttacttcatttttttttgtgcctgcagagataatgatgtatcccctggttgcgtcgttggaatacattttttgtttcgggggctggactgcatcatgcgtggtgttcttccacttgatcgtgtcattttacggcacagaaatgacggaaaacctggtaattaacnacatgtgctcctccaagttgtattttgcactgttcgttttagtctgaatctgatgtgtttgtaatatatgctcgtgtagtgttcttgcgatgggatgacggccgaggaggccgccgccatgccggcgtcgaggcgtgcatgctgttgagctgcgcggcgcagatgcccgcggcggcggcggccatggcactgccgacggcgacggcgacgtgggggcggcggtcacggcgcgcgcgcgccgtccgccgcgcgtcggcgtcggtggcactggcggtggccggcctcaccctgtggctgtggtgcgtctacctccggttcctgccggggctccggtgcttccgctgttcggggtgctcaagaaggttgccgtccccccaaaagccctgggattcgccacgccggtgttcgccttcgtcgcgctgggctcgcacgccgtcgtccgcggagacgaagccgagtgggacgagtgacgtctactgatcgatcgatcgatcagtgagtgtttggtgcgtgtggtttcttgggagatcatgttagtggggactaattaattaatgcggtgatgtggagctgattagtttcatgccgattttggtttttggagttcggtctttctcagcaagagtgtttactgatcgccaaccagctgtctagcgtgaaagacatacatgaatgaagtatagttaacttggtaccaaactactagagtactagtccagccataactagaaacgctctggattcgaaacctcaccccttctaattatttgatattaggtcattctctaatattcacgtttttactagtccagccatagaaaccccaaatctcttgcctgtggtaacagctcacagctcaattccatttccatcctactccatcatcagtgtcaggtaggagtagagcaaaactttgtagccagagcagcggggcgctgccatgtacaatcgtagagcggacgtgcaaagcgggctgatttcaatgggctgcggcgcaggggaatggcctgacaaatatttttccagcccagaacgcatggtcaccaagcgatccaatcccttcggcttgtaaggcacggtgcggtcgactgtaggggatcccaataagcattgggccgcatagatagaccatacgtgccaggttgacagagtttcagcccacactggctgaccaaatggtagcgatccaatctgcctccgggccctgtcacactaacgggccaacttggttaggcgggccgcgtgttgaagaaacggcccatttttgtggtcctgtcacggcgaagttacgggcctatattcaatacgggccgaaatggcaggcccacataagcgcacgaaacacaaaaaacatcacgacaaaacaccccgattccacccaccccaccacgaaacctcgcccttcgtctccgcctccgtcgcctccatctcgccgcgatccctctccccggcgatggccgccgccctccgctcctcctgcgccgccgcgcgccgtctgctccggatctccccggccgcgctgtccaccctcaccgccgcctcctcccgccccgccgcggtggcgcccctcgcgcgcccgatcgccgccgccgccgtctcaggtcctcctcccatctgactcttcttgttcttgctgtttcgctaccttgtagtcgatgatgatgatacctccttcagttcgtgtttggggtggattgggctgacgatgcgtgtttagggttctgtgcgtgctgcttgcttgtgcaggctgattccagatttgtgtttgccgtgtggtagaatctgattgttttgggggatttcaactccgagagattggatttgagatgctatcgtgtgtggtgataataatttgccaggaagttattggttgtaaagatacaaggttcgggggtggcgggggtgccaattgttggtcgctgcgttgtagttaaagcatcaataggaaaaatgttaacactctgtgtataaaggtttacatttccaagctgatcctgaacttcacttcagatgtgttgtcctgaagtgttgttcctgctcgtgttgcatctttgatcacataataacaggcaatattgtttaaaatgatgttgctgcaaaccaagaataactggttcaaaacagtgagatttttcacttgattctgaagtaaataagcttattattctctaacctttttgtcaaagaatacgttgacgggaaaaaaaaccactgtttgtcctttatatgccataagtgtataagaatgggagaagcatggtaagaggatggttgacaaagagaaatatatttggaagagtcattgatgtcatcttgccttttgtggtcttcattttgctgcaatgtaacactgttgccttagttcaaaattgtacataccccaatatcaaattttctgtgctcaatgttgtttaacttatacttgttttaaattcaggtggcaacaatgccttttcatggaacttgaggcgcttgttcagctcaaatgaaaagcatctgccggcgatatctgacccagaagttgaatctgcgtttaaggatttgatggctgctagctggactggacttccagattctcttgtaattgaagcaaagaaagctgcatccaaagctacggatgataaggctgggaaagaggctttgctaaatgtatttcgtgcagctgaggcatgtgaagaatttggtggagttctagtcaccctaagaatggctctagatgatctttgtggtataactggtgaggtcagtacctaatcacatatatccctcattgatgtattgctttctgccaatttgggggatcagtcatcagtgtctctttcttatgcttattacttgttgtaccactccttgctcttgcagaatgtgggccccttgcctggttatatagaagatgctgttaaatctgcatataagcgttacatgaaatatctggaatcatttggcccggaggaaaattatctacgtaagaaagtggagaatgagttggggactaaaatgatacacctgaaaatgcggtgcagtggtgtagggtccgagtggggaaaggtacactcttatgttacctatccctgttgtatattttacctttgtgacagcttctgtggtagatttgcatttgacaagtccatggattgtgggtcctgatgtatgctttagtgcggatttatgctatcatttttaatggtttcttatgattgtattcaagatgttgtgtagatgttattttcagcgtagaagcagagttagtatgtgcagtttctgctatcacaaatgtgttatttgtgtttaagaatatattcctttctatggctaaggatcatttaatatcagactgcatcttgggtcatcacttgtcattggagtaggttgtactatgtcaggacagtcctttattattattttgcttgatacaaagggagaaatgagattctacatccatctttttacttgacgattagaacattgtcacagcctccagggctcatgtttgatcatatcttttctaattgaatatgtatataaaaatcattaaaactaaaactacattaaagtgtttttcacgacaaatctactacagtcattttcacatcaaatcttaatgtttttgcaaatatccgtgatttaggattttgaggtttgaccacatacatcctaaaaaatcatgtatttgagaacggaaggagtagcttagagtgaatataaacacctcaacctcatccaaaaaaaccaagtgaatgaactaggaccatcatcttgtctatctattcatttggtttgaagaagggaaattgcacaggtaagttgagatttgagaacaattgcagcgcattctcattttaccaagtcttgtgctagatatacttcaaataaatgtaaatgtaaaatggaagctaaatcagtttatcctgcacagctatacactgtgtaaggctcggtaataaaaggtacatgcttgttattttgttgtttgcttgcacagagacctgtagtacttccaattgagcactggcatacacccctggtaccatgtaacatgttaactttcaagaagggggtatgcttatcttattttatctgtaattagtcaaaaaaaaaggagctgttcatttaccattgtcaccacttacttcaaaccttataagggcttataggggtgtttgcttccagccaatttggaacatatgatttagaccgagtttgaattgttttcaaattaaaatagacgagttcatgcttgacgttgtaacatgtgtggaataatattttcatgtcagtgtatagctgatatgctcgttcctccttgcttcgactggagttagaaggacaaatctatatccaacacctgaagctcatgatttatttatttcacttgcagatcaccctgattggcacctcaggcatctcaggatcctatgtcgagctaagggcatgaggaaagtctgcagatcataaccatggcagaacatcgttttctgagggaaggatgcatatcagaacaaggtgttccgtttctcttttcttcttactgtgtagctaccttgccaataacaaggagatcatcaaacagatgtgcacttaaagtaattcagtgtgctccagaccttcctgctgtaataagaacgtgtttctggggttcacgtcgatttgtttttgctccagtcatggtggtgcgtgaagcatgtagattcagttgattccttgcatgagccgtgaattgtttgttcaagctcctactctgtatggctctattgaactcagaagtagcttaatcggtgttcagattccttgcatgagccctgatatgagctctattgagtacttcctccattttataatgtaagactttcttatattatgaaatggatggagtactaatgtttggctttgttaaacattagcacttgaatcgtcgttctgaatacagtacgacatcacggagtatggccgtgtttagtttcccctctattcccgacttaccatcatatcatatcacatcaaaaacttttctacacgtataaactttcaactttttttttaaaactctcaactttttttaaactttaaatttttttcatgaactaaacataccctatgttgatatgcgggacgtttgtctatccttgacttcagaagttataattagctagaatcggtggtccagaacttaggagtgatgtgatatgggtgtgtgaagtcgtcatccgaaggcaatgatgctatcgaccgcaattggacgacgaaaatgcctcggatgcccaaacatcttcctctcgctcgtcggctgacaatggcgctgctgctgggaacggggacacacctgccagttcgactaatcaatcatccgtcaccatgcgttagggctaatcatccagtcatccgtcacaccgttcgctcgagtacttcccagtgtcttgctgtcttgaagcattacagctaaatctgtggcttccaaggcgggggccccgttgccggcggtgcggcggcgactggcagtaacaagcagccatgggccatgcatggcgaagcgcgcgtatgagaaacgacgacgacgaagacgaacgggggggcacagcagcacacagcactacgcgtctacgcgcgtgccggtttgaagtatgcagtggcagcctgcagagacgtcggccgcacgcgcacgctcatacacacgtacggtgtcaaacccccaggctgctactgccggtgctcgtggacgcgcgcgccgctgtgcgtgcgcctgttcgttcgtagcagcagcatgcagtcggccagcgcgcgggcgtgcggacttcgcaacgttgcgtgcgactcggccccggttgcgtgtccatccacttgtgccagtcctgtagtactcctgttggcgtagaggaatcctgtccgaatctactacagcatgtactgtactacttcctccgttttacattaaagtcgtttattttttttattagccaaacttttaagtttgcttaagttcagaaaaaaataacaatatttttaatacaaaataatcatattatcaaaatatatttaatgttaaatttaataaacctaatgtgacgttgtggatgttgctatctttttctataaacttagttaaacttaaagaattttaactaaaaaaaataaaacaacttgtaacataaaaacatagagggagcttttatttgatttgtttggctggtagtttttttgagcggccagtagttaagaattggtgcagcttgtagcgaatttgcgatgcagcagctgcagcttgtattgctgacgaacagagccaatttaccctctccgattcgacctgcgcgtatcacagtgcattcacgctagcgttgcatataaatgcaatgcgggctggccggcgtggtcgcgtatgcacgtagctttcttcctcttcttgagttcttggtcgtcgcttcaagcatgatgcaggcaggccagctgcagcgtcaccctctagtgtaaattttgcagcagctcatcacaagttcacaacttacgcacagcacggttgcattgcacgccttgaccgatcgagaggtcaaaattgggtaaaagtcgagcatactgttctcgcacaggacgacaggcaggctggcattgtagcattctactacatttctattgatctttcagacgacggacgcgagacgaataaggcagggttcacaattccaatgaaaaccagtcgaattccgtaaaattttgacactttgacatggctcggaattaagtttcgattggaatttcgaaggttaaacaataaatttggtcaaaatttatcgaaaaccaatcgaaatttatcaaaaatcgtgatactgatggggctcaaaatttagtggtcaatcgttattgtaaaccctgaacggaggctagcagcagcagctgcacaggttatctttattggccgtgaatgtggtgcattggcctctttcgtctgcacctctctgaaacgtcgtccgcattccctgttcagatcgaatgacgagtggtagtaactgcgaaaagggcggcgaaaagatcacactattcgtgcgctcttgcgtcgtccttgccaatgtcctagaaagcttccaggtcactgtgtgggcgtctctgccagttaatgagctgagctcacgttctgcagccaccaacaagaggctttttttttaatcgcttgtgatgatctgagaggtcgtactgcacgattgtgttttagttatgatccgaaatgcaatttgaagatcgaaaaggaccgatgtctgacatgaacctctgcaatcaggcgttgtgatgaaagggttggtttcaatcacgagttgttcagatgatgtctcgcatgagcctttgcaatcactgtactaagacgttctaattaaaccactaatctcctcgcatgcattgcttggatgcagtctagtttcctgcctcctaggctcctggctttatctttctgaactagtcgatatcaaaccgtgtttgttagttcagacgagcacatcacaatttccaagcgattttccaagcgatcagcttattagcattctctccaggggaggaaaaaatatatattttatactgtacgaaaaagcagcatgtccaaatagcgtcatgtcatcacgccttcatccttctcgtccacacctgcttgttctttccatcgatagatctctactacttgaccaaatatcacaggcaaaaagtgtcaaccaactaccctctgcagaaggctagtaataagcatacgcactgtttaattagcgacaacatatgacgtgatattagttagttaattaattagcatcgactgacaaaggttagcgagatcgcatccaactacctggcgcaagtttaatgcgtatccaacacaccaaactttgagcttgtgaggataaatgattcagttgcaaaccgctattactgtcgatctcaacggccatttaaatcaaacgtttctaaatataagtatcttttacactattgagactactacttaattatcccatcaatcatatttcatttaaatttctttctaacctaccactaaccgtgaaagagcatgtagtctaatagttacagtgacctgagtagcatcaaaaatcctgagttcaagtctccatagtagggaatttcatatagggttattcgagagctaagttccatatgttcgataagctaagttcctaacttttaaaaaaaacttatcgctaaccaatctcacactccatgggcatcaaaagtatatattttctcctcgatcttaatctctactagacaatatataaatgtaacagttggaatggagagagtacatgggggcacacatatttaaatgtcttcatggagagattgttttagaaaacacatatagtttcgagaaatatttaaagcgacttacatcatgcaacaacgttttatctatatataatgagggataaaaatgatagggatacgctgccctctaaggagaaaatctttaatttatatggtcaaagaagtaggatcagctgttgggcaaggtgctcccaacttcaacgtttttcgtcaaagctggccctgcaattctgccccaactaagctgcaggaaagtcatcagcggccgaccaatttcagacatcctctccttttctctcgagagaaagaatgccatagcagtatgcatcatcatatcattggccagctgtaataaacaaatgaaatcaggtgtacaaataaaagaaaaagagcatcaccaactctgcatccccgagtaagaaaatggcagagaagctcccccccaagtgatcaaagtcgttgttaatcaccaaaacctgctcccttttctttgatctccaaaatatgtaaccacttcctacatggcacatgcaggctgcagctcatatatatatatataatcaatactactaattacaccacataaaaaatgtatctatataatgatctctatactatatactccaaatctatagctctccttctccttcttcttcttcttcttcttcatggagtctgcagctggctgtcgaggccgatggagttgtgctgcctcgacgggccggacggagggatgggccctctcggcaagaacccgaggaaatggttggaagctcccctctccaatggcctggccttgaaggtctgcatgcccctcgaagccttgcatctcggcaccatcagcagcagcagcagcagaagaagaagcacaagcaaggacgaccagcgaaactgtagatgatgatgagccttcttcttcctgcagcttctctgccagtagcaacccatgcagatcgagcagctagcaagatgaggatcggagactggagttcttgggagagttggtatgatgtgaaagtttgagatgtgatgagggttttggtgagtgcaaaatgcaggtgagaggggagaggagctgagggagctgagagatggtgatatataagctataagctgctagcgaaagtgttgagaacgtatatatgcgtagtatggacagcattgagaggagaggagagaagaagccgccattaaatttatataggagcatatgctggacatattcacagctcgcagattaaagggaagaagaaattaaaatgaaaatccacatgcatgacgttgttgctggctgctatgtatgtctgcgaaatgcttgtgtggaaccattcttctggtgcaaactgaagatatatatgtgtcatgtacaccaataattaagctcgatcacataaatattttttttgattatttgttggaaaaagaagaacaaagtggtgcatgatgttaggaggtttttaatgttgaatctaaatcgatacaatcgtgcatattggtgctcaaagtttaaaactgtattctaagacgacatctaaatataatacattaatacagctacaatcagataagattaggtcaaactgtcgaaatttataaaaaaaaattcaagtgcttagcttataaacaaagaatatggattttgatttgtcaagacgtaggtgtatggttttatccgccaaccctgatgtcatacttgggccatgttctaaagagctaattgaacttaactgcttcttgtttttcgttagaacgttttctaaaccgttaaacagtgtcttttatgtaaactttctatatatatggtgctttaaaaaattatttaaaaatcatttctttaaataattcataatatactaatcacgtttcttgttttagttgtagctaatcatccaaaacctatgggccgaaaataacacgcccctagtttgtgtttaaggatcaatttagtccctgatattctatattgtccaaacaagttaataaagtttattgggtgattttaatatagtccttagacccactaaaaagccacgtgcacacacatcatctatgcattcaaatcaataatcaaatatccattctacccttaagtttttcatatgaaaaaaataaaaattattgagaaaaaaagtggcatttggccattggctgccaaaagatgtagcatgcaatggcaactaaaacaatgtggcattttcctttgttttatgattgctttctacttgtttttccctttgtttttcttttctttggttatagaaaatgtaaggttaaaatggacatttaaatgttgactttacatgcacgaattatgtggcatgtccacgtggcgttttaagtgggtccaaagactatattaagacacatgataatatttaaggacttgtttggaactttagacattataaaacatcaatgactaattcgagtcctgagcaaaagttgaaggattgaactagctattcacccaaagacaaatgttacctttcattattgtaagggattgaccccccaaaattgtgcgaataaatttcatgagaaaattataaagaaaaatcaaataagaataatttggctccaattgggattgaaataggttctatttattgctcctagattacaggttgtacatatgtgaggatgataattatctcaggatgcacctatagaagattgatcaagttggtgaagaggttggaaataaatgtgcacatctacctctagctagccatggcctatgaagatatagttttgagactttgatcaggcacaacagtggtgatgaacatggtcggtgtggggttgtgcatggtgggtctgaggatgttgagtgcattaataagagaggtacttgcacctgtctagagagaataaattcttttggagtgagaaaataagggtttcttttcttctttttttttttttgagaggagatcaagggagattcagaagaaaaggaggcaatgtgctagtagcagcgaaagaaagctcatggccgcaaggaaaaaaaaaggtgtctgtctcctctcatcatccgtaggtgagtgaaaccactgcatgccccacttggggaattcaatacccgacttgggcacttgctgatttgcataaccgttcgtgcatgtacctacaaacatcagtgattagctagcaggatcagcagctgcggctcggtgcttagctgcttgttgtgtaggagtatatcttctgaattttgcaactaggggtgtgtggccatctctgatgtctccctgcatgtggcccttgtgcagttgtgcttgtgtgcccacagtacttagcagaaagatacttgccatgccgtcagatactgatatgttttcgtactatatacaatgtacattgtattgtatccggaagctctcagacgaaacaaattaaatgcagatatttgaccagtcttgcgtagagaataatacagtacatgcctctttgatgactggcgattggcgaacaactgtttctgaggaacagcactg

SEQ ID NO: 1966 - DNA, 2506 bp, Oryza sativa
atattgctcatcttgaaatattttttagaaaggtggaacaaaatgggttaatattatccaaaaagaaaatggaaatatgcaaagaaaaaattaacttccttggacatgaaataggagagggcaaaattcatttgcaagaacatattgctaagaaaattttacaatttcctgatgctatgaatgataaaaagaaattacagcaattcttaggacttgtaaattatgctagaaatcacatcaataatttagcaaagatagcaggaccgttatatgctaaattaagaaaaaatggtcagagatattttaattctgaagacattaaattagtaagattaataaaagagagggtgaaagaattaaaacctctagaattaccattagaagaaagttactttatcattgaaactgatgcatcacaacacgggtggggtgctatattaaagcaaagacctactaaatttttccgcttaatcagaagaaaaaatatgtagatatgcttctggaagttataaattaaaaactgtcaataatacagatagagagatcatggcaataatcaatgcaatcaatgcctttaggttgtacttaggatttaaagaattcacggttagaaccgattgtgaagccatttgtaggtactataatcagctaaatagcaagaaagctcaactagaagatgggttttatttgaagatattataacaggaaacggctataaagttatatttgaacatattaaggggaaagataataatttgcctgacatgctttctcgtttacctgaattgcaggtatgaaaagatcaatgaattacagcggaattgaatgcttcacatttggagatgacaacaagctcagaatattcccaccaaattcatataaatttaagccaaaagaccatataatcttagatgaagtgcaagaatgcatcttggataatttttggtaccaatacaataataaaagggaagaaaaaggatatatgttatcaatattgaatagcctctctgaatattttcacttaataaacgggttattaatgccagctaatgaagatcatgaaataatccaacggaagcctatatatgtcgtatttgatagaaagctcctaggggtctatatatcttttgaagaaattgtggcccaaaagatagatgctaaatttgatagactgatgcatgagttcgatcctgactgctgctacgtaacaacaatattacaggaaaatgcatatttgcactcaggaaaatgcatatttgcactcgggttcatatgtacctacaatctacaccgttgatgtgtttcaagattcgtgctgcaaaatgtacctaaccttaaccaaatgaacgcttactataggaagaaaatataattaggattaggttggttcacaatatgtataacatgtatgttgcattttttaccaaataaaattttcaataataatcatatatgacatttatatatctagtgcattgtatttctgtaacccttattttgtttataacatgatatttagtcaaaatgagaaaacaatatatctactatgtcaccaaattgtcatcttgcaaaaatgatatttccaaaatgatatatatctaccatcaaaaactacataaacaagataatttatataaacaaggtaaactacataaacaagttttgcatacaagaaatacaaaaattatataaacaaggtattttacacttgtaaaaaatatagtataacgtaaatatcatgcatgctacattttgttagcacctaatatacttgtcctaagattcgtgcaatatacatatattgtgggtacatgtgaactcgcgtgcaaaaaaatcaaacttatatatatatattcttctcggtaaccatgattacagtctcactatggtgctctttaccgtaagtagaaaataatctgagccgttgatctaattttatcaaagggttcaaatctcggttggcgctagtagaaacgtcgaggatataattatccaaaaaaagatcttctttccctttaaataggaagctacgtgagattttaggaaaaaaaaaagatcgatctccacctcacgacgactctagcctcgctttcgatgcatctctatggctgcccttaccggccatagccacagccgacgcaacattcacggagctgcagtcaaaggttcacaaaaccgatgaaattttacgaaaatcagtgagcttttgtgaaactgttagatgtcggtttataaaagccggtcggtattaatcggtttttgtacggcgttgataaaaaatagtcgggttttacccattttggtcggactttagtaaaccggtgaggagcaggttttatttcgaaatcgaaaaggtaaacactggctagctccagtgcccacgcacggcggtgaaaatgggttggcgtgggattgcaggggtgaatgttgccaaagtgtattgccgtggacgggaggatctcacgatcagaagcgagcgaggtgtttcctttttctttttttttat

SEQ ID NO: 1967 - DNA, 3468 bp, Oryza sativa
  unsure (1)..(3468): unsure at all n locations
aaggtgggcgccagcagctagaacgccatcatcgttcccgtcgggagcaggttcgctaggctcgccgtcggcgccagcgcctgcgagaatagcgatggccttgcagctccggccggacgacgaccaccgccgtcgccggtagcagcgctctctccttctccagcttgcttacctaccgctggcctttgcctgacgacagcgggagacaccatgatcgatcgaccggattgttcttggataggcagctagctagctcgcgctcgccccgatctcaacccaccgcacgcgtttttggcgaagcagaaaacgagggaaagagagggcaatccgggcatttagaaaaatatctcacctttttttttacccagaaataataaaataataagactagtgtcttacagccaattacacaatttttttagtgtacatcagccatatcacgttttcgcggtatctcctagctaattacacgttttaggtgtctcctgtgataaattttgcctaatcaaaaacaggacaagaggaaatgagcacagaccaaccaagaggacagaaacttaaatatcaaacttatccctaatcaatatgctagtagtaaaatagtgatatgtttttaagaactagtaactgtttagatcatttctattcctattagtattaaagcaccgtaccgtttctcgggttaatattagtatatgttcgaaggtataattggggacttggctgtgttcggatgcctgagtttccaacactaacagtacgcacgaaaaacagagtggttcattagcgtgtgattaattaagtattagataattcattttttaaaaatgaatcaatatgattttttaagcaacttacgtatagaaactttttttaaaaaaaatgcaccgtttaacagtttgaaaaacatgcgcgagaaaaatgagaggagagtgttagaaacttagagttctgaacacagccttagagcaggtacaatagcaggctataagccagctgcaaatatattttaaggagataaatgaggagagagaaggccagcgggctacagatttgtagccagctgtagcacggactaaaagacgcggtgtgtgtatgataagtgagatcatgtattaatagtgtagtatgtaactattgtacggatgagctattagattggctatagatgaattagagctagtagatggctatactattaaacttgctcttactagttactcgtgacagtttacaccaaatttaagatagggtaaagtttcaaaagtttgagtaaattgagagtaccatggaaggaccttttggatttagggcagtcccagcccatggtgtctataagtagtgtctatggtgccatgtcaataatacatcacaatagaaactacagtgtatattccatggtttcttaaagtgggccattaagaaatgtttcatctctcttctctatcaatcatatttattcttcatgtattatgaagacattattttctcccaatgcaaaacttggtagtgtctagtgcataggttctcgtgttggagctgtgtagacccagtttcttcctctctctccactctctctctctcttaattaatatagtgccacataagttaaaagtcttatatgacaatgtagttaatatcatatacaccattctaagcgaagagttaggactgcccatagcaagcacaatcccaaggaacacgttggaggaccgacaaggacgtggtaataaagatatttgaatatcgacctttttccgttcacatcttcactgaacttttcagttgcaatattacagctaataatttgatatgaccaacaaatcgccgtcaattgcacaacgacgtctggaaatggatcgatgtgtaccgcaggttgaataatatatactgcacggaacataattgacttggaacaacgttacagccttacaagcttacagctagtcatgcacgattttttttttacagataattgtggttatgaacaatgtttttttttaaaaaaaaggtactaaattcacactatattttctcggggcagaggccggtttatctgcatgtgggtcccagccactgaaagcaatttatttttgaaagggaaaagaccaaaacacaggtccccaaagccacaatgtacatatatgctccttcgcggacaaacaaacaaccacatatatataatataagattaatactcctatcgagggatgatcatcgttgttagagtaatgaaaaatcgtatagatctctctgttatttgtggactggatggtgggtagtctttatttttttttctttttgatgaaaaacatagtaaaaatataggtgtccacaacgcatccacactcaccactatgaatacacacacgcacattctacccctatgaacacatccaaagaattggatcgatatattttgagattagcgaagtcaccatgacgactcgctgtcgacgggtacgtcacgtaccgttgaaagaataattagccataaatgcgaacactcatgttaaatccaggatttgaatttggataaactggttttaccacaagaacctaactaaattagctacgctcactcttcaaaattttcttaaactatcatgattttctgcacatgagaagagataaatttacatgagattccatgaaaaaaagaatagcagtgacatataatatgcacccgcaggcacggatggcactgtttgatcggcataaatgattttggtggccttgtgctatctaaatgattttagtactcgatgtatcatgcatcatccagctaattcggaggctggaaattattagcagcaccacacgcagcgcgtcgtcccaacttccggcggatcagagaagatacatgtggaatatgaataatatttaggtataggatcatgttctttgtgaaatgctgcccccttgcccatgagaatcacaaggtattttctgttgcctgtatnntnnggatatataaagggtagaagaagtttaatagtatagcaattagtatttttttttaggaaaaggaggagttttgcttttttatatagggaggaaagagacgaattagaggtttggaaaaaaaggttaaaaaggatctctagaggaccctctttagagaatggcaggtcggagacaagaatttttaggtaatgtaaagcaactaatgtgaggatacgaggactaatgtgaggatacgaggactactcatgtaagttgtgagctccgtcataggcttttcacatgttggattatggactcaacgacttgcaacactgtgctgtacgccccattgaaaatcctagcatttctttgtagccaaatgccccaagctgtgtagatgaagaggccatcaaagtttcttctttgatctttcgccatctctctcctgcaggccgtccaccatccaagcatgtctccattgtaagtggtggctaatggcatatgaaggcccgcttcctgcca

SEQ ID NO: 1968 - DNA, 1794 bp, Oryza sativa
cacatcgaatgtttggacacacgcatgaagtattaaatatgtaaaaaaaaccaattacatagtttgcgtgtaaattgcgagacgaatctttgaagcctaattgcgtcatgatttgacaatgtggtgctacagtaaatatttgctaatgacgaattaattagtcttaatagattcgtctcgcaatttcctgacggaatttgtaatttttttgtggagtgtaatttgttttgttattagaccacgtttaatacttcaaatgtatatccgtatatcttgtgtgactcctaaacctaaaatttttccccatctaagagcaaggataatactgggatataaacaagctatatgcttacgtggaagagaaagataaataaaagtggagagtgttggctctcatgcaagagctaactacacacaagctctagaaatatgcattaaatttatagtgagagaaagagagaggacgaagaaaataaagataaccttagagcaagttcaatagcagagccaactactagctccagttcatctatagccaatgtaataactcattcatacaatagttacatactatactattaatacctggtcccacctatcatacacacactgcgtcttggagtccgggctacagctggctacaaatatgtagcccgctgggtttctctctccttatttaacttcttaaaatatatttacagctggcttatagcctgctattgtacctgctttaatatagccaacctactatacatgttaattttaacattgactaatagtaagtagtgagctatactattaaactggctctaaacaaggcctccacctgattgatatccctttgtcatcatttccaagagagaatttcttccacaaattaaacacatatagggacatagctgaaaatgccgtttggcaagagaaaaaaaaaatattttgtaacggtagtggtgggctttcacacgagcacggtagaccagcgagcaaagacccactccaccacacttccatattaccaccaccccccaccttctcgctttcctcttcctctccacttccatttccaagaatcgaacggaggcgtctcgctatcgccatcgccatcgccatgggcaggaaggaatcgtcgacgacgacgacgacgacggcggcggcggcggcggcggcgacgaggagcatgaggctgccgccgcagcaccaggcgctggaggtgaagatcccgagcttcttccggtgccccatctccctcgacgtgatgcgctccccggtcagcctctgcaccggcgtcacctacgaccgcgcctccatccagcgatggctcgactccggcaacaccacctgccccgccaccatgctccccctcccttccaccgacctcgtccccaacctcaccctccgcagcctcatctcccactggtcctcctcctcccccgccacctccggcgatgcctctgtcacttcttcccccgcgggccttgtccgccaggtcgcgtcgcccgacgccgacccttccgcggcgctgcgccagctcgcggcgtacctctcggacgacgacgtcgacgagttcgagaagaacgcgctggtgggcgccggtggcgccgccgaggccgtggcctcggtgctccggaggaagggcgagcgggaggtcggcgtggaagggtgcgaggcggcggtgcgggtgctcgccgcggtcgtcgcgatggatggagtcgaggacgcgaacaagaggcgggtcgccgccgggctcgccgcggccgccgcggcgtcggcggcgtccctggcgcgcgtgatgcg

SEQ ID NO: 1969 - DNA, 323 bp, Oryza sativa
  unsure (1)..(323): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgnntttcgcgccttgnattttcagttcagaacggcatgatgtgggtggtcttggagtcgtagccggcgaggcagctcttggcgttcaccttgtaaatcttgagcagctcgagcgccatctgcctcgccgccggcgagcacccgctctgcagcagcaggaggaggcgagtcaggccgccctccgacgccgccg

SEQ ID NO: 1970 - DNA, 631 bp, Oryza sativa
ctgcagcccctcacattctgaacactctaatagcccgtcacacagggaaaccgacagagatttcaggttttgagagaaaccttccagtgctcctctagatccaatcaatttatcgttgttcaacaacatgattaagcttttgacaactgggagtttcacatgcactgctctaaattttgggcattgggtgatagtcaattcttgaaggtttgggaaaattgcttctctctgtgatggaagccatatttctaggttgcgcatgtgaaagaacgagagtttctccagtgaggcgaatgtgccatcatccccatagaattcgtcacctacacgtgtgacagcatttattccacttaattcaacaatcttgagaagaggtaattgccccagtggaggtaggcattcacatgccaaattaactagcttgatctcagtaagtgattttaagtatgctggcatgcttgttatccatgatggaagcttctttgctggacatgagaaaatgcataacactttcaaaccacggtttggcttaagaagttcaagtatttgctgtgcttttgaactaatcataggatctgtacagcttcctgtccaacttaatgccaaagacacaagcctatttttcttttgc

SEQ ID NO: 1971 - DNA, 28862 bp, Oryza sativa
  unsure (1)..(28862): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccattccttttatctgcagccatgagttgatatacccactttaatcttgatatcttctttcttgcctgtcacctcaatccaacacccttgggattcactgatctcaccaaatccacaccttggcaccatcacttatcctccatattagtcatttttttcaataactcaaagccatatttaatgctcttccaagtaactggagatgttgaattaaaaactgtatcaatgatgtcaccagaaggatataaaaatttgagtgcaaagactcttaggaaaaactaataggcgccaggactgctgttctaataacgcttggttgaatagtttcatatcatgaaaacccattccaccttaatttttagggagcatcatgtggctccaatatcataagttcacaaccatacatatgttgaccatccattcattattaattgatagaacaaataatctacatcgaccatttcattgtctcaacttaacctagctcttcaagtgttcttaggatgatttctacgttaccgcaacaactcacaaaggtatgcactggtatgttataagattccttctataaaatatcttatgttgtatgtgcttttatggaaagaaattatatattactcatcgaagaaccctcaagtttatcctactttgccattaggcttctctcatgcggctggtcaatttttcttcatgtgttagtacatcacttatgcaattgtttttattgtcgacttacttaccttggccattatatgtcatacctacaatggcattgtggcaaatgagttatccttatgtaagcattaaacactttcaatacatcgagaacaccataggctcatagccgacgaggtcgaagattcattctttgctacacaccaaacttgttagacgccttgtctgcatggatggcctcaactaattgtcagacttataaaacagttgtgggcaaatagtgtgacagagactttcgacgtggagactgcttgaaggaagaactagagaataacaacatgagttaaaatagactagttgcattggttttttttataggtaacatatgtttggagactgatatgatacaggtgctcgggctatgttttccaagcgtttcgagcacgaagactacttgattgttccagagtattggcaagtgatttaactagatttaacaaattactagtatgtacttatgtatccacaataactttgtaactcaccacacaaatagcatgggcaaattttcaagactggtaaatagctaacaacacatatcttatatgatcacaacaaaaagaatcgtaatgagtggtgaaaaagagaaactacctccgtcctaaaatatagcaacttttagctatgaatctggacacactgttgtccagattcatagctaaaaatgcttacattttgggacggagggagtattgaacaaatgtgaagacatgcgtttacttccaacttccaaggacaaacgcaaattgcaaaaatgggttattcaatggctctctgaaatgattggttctctagccatacctggtcatcaacaataagagatgatccaagggtattttaaaatatttcaaaaggatgtttttttttgctgcctagtgggtcctcctatcggtgcgacccgatgagcgatggtcacgagcttgcgactcggtgaggaggcatgctttgcagtgaagcccatagccactgaagctcaccagtgatgaaaaacatgagcttaaagatgattttgcatatctttgttaatggtacctctagtctctctctctctctctctctctcccttagttgtcctccagtggtaccggtagacggcaatgcgctagtactccacgaccaatggatagtgctctagggagagtgcaatgtcagaggggcataaatttgggcatggtcaccactgtgagctccatatctttgcatgcctcgaatctaataggctttgtgtcgtgggcttcgacaacttatagcaaccttgaaaacacactaggtggaaaatccaggtaagcaggttatgtagacatgttcagataagctgcaagttattaggctcataaaaagcagaaccccaaaaaaatggctatgagggcaatatttggattggtgctaatttggattctattaatattttgataacttcgacaatactttggtggaatttggattaagaccgattttttcctaggtggtagcaaatctactctgtcaaatttggtagtgcctaggttttgacactatcaacgttttggtagggcttcaaaccaaaccaacattgaatttgttactttatgccttggcctattgaatcgttcttgttgaattcatcccttcaaaattgggccttgttggatggatgaataatgtattatatgattttgtgataatatttaaatttacaaatggataaattaactactctaaagttaaaaggttgttttaggaaaaaaatattctaagcaatttttatatattttttttcaaaaaatttaccatctaggagaacataagccaattatattaagatcgtggaggaattttacataaccttacaaagccaacaagttgcaagcatgcagcctgatgggagccgagcaagacacacctgcaaaatttgttgtgactttattaggggaaagctacaattttacctaagggttgcccccgtcagtcccgtagcacgccatgtccaccagtttttttgtgatggctaacccacttagcgatctgctaacaccatcgaaggtgtttcgctatctgcaaattatcgaagtgactaggctgatggtcgtgtcgagcactgctctactttgttttgccatggcttgccatgcttgggaccaccaattattgatgatatgctatacctatggcccaattgagaaattcagttgtttaatattctcctgaacccgttgggtgtatggatattgggtgaacaagtgtgcacaaatctggcaatgcgacagtcgacacataagggatggtatggacaacttggctagacacaaggttgtgtttgtccgatgttaggtgactgccccttgttgctaagaacacgaagaactttgcatctacgtgggatttttgcttttccgaatgaatttgccacatggagccaatgtttttcccaaggaaaactatccgataagcagatgtaaatgaacactattcattcgaattggacttccgacttagttcgttggtggcattcgatttcaggtcgatatttaccgagaccaccaacaaattggggtactccaacaatgtctgcttagagagaagccgcgggtgtcggcgtgtcgcgcatccattgattattgtgcatcgttgcacccctaatctcctatcccttggaacaaaagagaatatggcagggttgtgcccaaggtaatctataattcacagggggtctaagatcaaattcaatggctctctatgaatgtctgcaactcaaagaatcaataaacatgctgcactatcattctatgatctatcagcacttcattatcagaacatgtcaacacctgttgagcttctattaactaaataatacttactcaaagaatgttccgtggtgcatagatctcgagggtctaatatcgagcacgttaggacacatcctaactccacaaatgaatgcaaatggtgagttggtgaccggaacaaggagtgggaaacgacggtgatgaagatacaagctgtgctcgagcttgacgtgtgcgctaaggctgctagggcgctggatgctgccaaccctgctcgctcgcggagtcacgagcacggccaccgcagtatgaaaagcgccgaagacgcgggcttaagcctgacgagcatggtggccaattgacgaggtgtactggaacgtggtgttttggcttggccggatgctcgatgctgcatacccaacaaatcactaatcaggccccgttcgaatctccaacaaaagttggataaacttttagataaacgtggcacgtttttcaaactattaaacggtgcgttttgtgcgaaaactttctatatgtaagttgttctaaaatatcatattaatttattttttaagtttgtaataattaaaactcaattaatcatatgttattaccatctcaattcatttttcaagtttataataattaaaactcaattaatcacacgtcattaccatctcattttacataaaacatttaattttatttcatcttcatgactcaaacaccacctcagtgttcacccgtgcagcgtgcccagctagggcaaagcagtggaactgaccgcccaggagaatgacgtacgacttcaccagcgccggtggcacgtgcaaaaggcgcaacaagcgcaacaagcgagaggccttccttcgcagccgtggcgcgggggccctgcgacgacaacgacgcggccggtttccgcagccacgagccgctcacccatccgccacgagcgcatctccgtcaacctcccacagggcaatcacagccgcggtgacgtgactcgtgagaggcggcagttgggctggatggccccccgggccacccggtcccaggcggcggcgacacctcaccgcgctgatccacacccaacggacgcggatgctctctgacgccaacgcgcgcggccggacggaataaacagatcggataatggcggagatgtgttcatccgagcatctgaccgtccgagcccgagccacgtttcctggctctccaaggaccaaggggctttcggcgatgcggttcagcagaaacggccttcctctcgtcggtttcgaagcgcgggcggtgggcccaccactggcccacgcacatctctcccgttgcgtctagacgcttttttttttcatgtgacgaaaaatgaactaataccggataaaatgatacggctacaactcattttgcagcctatctttgttcgtcgattaatgatttctccatttgcaattatagccttttctttttttctctcgttatcagcgacttcgtaagattacggaaatacattacaactttcagtaatttatttccattaaacttcttttgccttttgaatcgagagcacaagatctactttcttttgtggaggaatttcatcgatgtcatctgtgaagtgttgctgtatggattaccatcagctttgagtccgtgtttagttccaaaataattctttaaacttctaacttttttatcacatcaaaacttttctacacacataaacttttaatttcaactagaggtgaaagtggttcggatagtttccgtccgtctggaccatttttcggattcggatagtttcggtcggaactatccggaaattcccggattcggaaacgaattcggatttttttctcggaacgaaaacgaatacagtaagggtactatctgtcggaatcgaaaaacggtcggaactatccggatttttatctgttggaatcggaatacggtcggaactatccggattttttttatatccgcagacattgagcaaatttaaaaaaaaaacgtatatatacataactttttcatacggaatcagatggagacaaactttatatcaacattgtagagctcgatgagatctacaactttcttattgattattttattatttgaggtcatttaaggagtctaaatattcattataatataccatattaatttttacaagatctcagaactgcaattcaaacaacaacatctgatggagatgtgttccatatcaaagttgtagaactcaacgggatctaccactttgtagtttataacagttgtatttgaaagcatttaaagtataaaacaaacattacaagtttcgaagatgtgaagtaaaataaataacatctccaatttatacaatggtaagtaagttatacatctagtaaaaggtcttgagaatagaaaatgataatcatatttgcatatggatctctaagagcaatagccatgaaaatcgattttcacatagggttgtgggatcgtctataaaattgacgatataaatgttggagatgttgaactaaaataataagcgatatcttttccttaatcaagaaactcaatttgaggggttttttatatactggtaaatattcgctatcgtattcgttccgtctcgtattcgctccgtatctgtattcgataatattcgatttcatttccgtatccgagttttcgattccgatttcaattcaaaaaaaataaaaacaaatatgataattccatccgttttcgatccgatttcattcctaatttcaaccaaacacgacctgagttcaggtccgtggtccgtctctcgccgtctcgcggtctcgctcggtttccccctccgaattccgaatttccgatccccacggtggcgtctccctatatctttcgtcaaccaatcaaaaggaaactcgaagcgtatcggcttcatcgccaatcgatgatgcgacgatgctgatctgatcatctgaacccaacaaaatttctccttcaaaacctgcaagctcaccttcttctcccccagctctctcctccgatcatttgcccaaccaccacccagcccgccagccgtgcgagcgcagctttcctatttaagccgcgcctcgctggctcgctgccgctgcccctgcctcttccccgaatgctggtctctcgtcgccccgtcccctggaatctctccctttctaccttggtccgggaccgcggctcctgaaatctctctctgtccctagaaatttctgcgcgcgtcttccgttcttctccccggtttggttggttcccgagcctgtgacctcgggggcggccgaaaggttggattttgtagagcaggctttacttgcatctgggcaaagattggattttttttgtggagcgattttgaggtcgttgttttttggtgattgtttgccgaagtttggattttgggaggagtttggggnngnggggggggggttcggtcagatttggtgggagcggagggcatgacgatcgatttgtccatgcccgggagctccgggctcctggacgacgtaggggggaagaagcacatgaatttcttcagcaaccgctacgtgctcgcgctcacgggcgccgcaggaatcggcgggttcctctttggctacgacacaggtatatggttgcatgtgtgccatttaccttccaacttttgcctgaacgtttcatcaagtgtagctgttctcgatgaatttcccctcgcagtaataagcgacatgtttttggttgctttggacttgttgggttacttcattttcatatgatgaaacattcagatggtgtttggtccaatttgatatttgacagtatgttcaggaagcctatggttagatatcattgatacaaacaaacaaagtttgaagtggaagtctgaaatgagatttatgaatagtggacttattttgttgagttcgtgctatgatctctacagtactgcataaagatagatattaattttagcagcgggatgaaatcaatgcttgcatcattcttattaatttctagcaaaatcttcgagtgtgtgtaacttcacagaattactgtactgtatacttttgccaaaaaaaaaaaagaaaagaagagaagacagtatgataaatttgtgctcttagctaagaaatttattctatcaggtgtcatatctggagcccttttgtatattcgggatgactttccagcagtcagagacaattatttcttacaggttcaatctaatctagtacaaattactggtcattaaccatatggcacgcctgcaccaactgattttggttcttccgtaggagacaatcgttagcatggcattggtaggagccatcattggagcagctggcggcggctggatcaatgatacatacggccgtaggaagtctactcttgtggctgacatgctgtttgcacttggctcacttgttatgtgtgctgctggtggtccttacattctgattcttggaaggcttcttgttggcttgggtgtgggtatagcatcagtcacagcgccagtttacattgctgaagctgctccttcggaaattaggggaggtttggtgtcaactaatgtactcatgattactggtggtcaattcttctcctacctcatcaatcttggctttactgaggtagacattcaacctccatttaattagcatattttattccattattcctacacattagcagttttcagtttaagttcttttaacattcaactataaacggaacaagttcaagctgaaaacattgcagttgaaatttttttattgagcttccacaaaccaggtcttgcactgccatggggaacttaactgttaactgcaactaagtatatatatgagctcgcatcatatctttaatgaaaaaataacaagcttggggtcggtactcttgcacaagaaccatggaaaagctgcacatgttatgttattcaagatgaactcccttgagaaaggatttcagcatcaatgccatgtttatactacctttttctccttttcatatatttaccttttatggtattaacattcctgttggtgctagttaactgtgtaacacttaattagcaatgaacaagagtcagcttccttgccagcagcaatggatgaatcaccaacaaggtgttgtttggtgcgtagccactctagtgttaatgctccatctttctgtttctgaaattcactgcagtatatacatcattctgttttcttttttcttaaatgaacttcctgtatttatctgaaatgcacattttatcccttggcacatcatatgattttgtgatttcagtagcctattcactgtttgttcttgaagtaccactttacttacctgaggatgaaaaattatgtgtcatttgaatcaaataattcagtcaagtagaaccttataaagcaatgaccaacaatattaaattatcattgtgcgtctccttataatttgacttggggtttcataatcttgatgcataacaaatcctgcattattagaaaacaatataagatgtcctataaaagaagatatacaaccatctttcttgagagttatagtggagatattcgtaagctggtaatacattagtacgagtagttgcaaacttgcaatgatatgcatgctacatgtcataggttcctggaacatggcgctggatgctcggagttgctgctgtgcctgcaattctacagtttgttctgatgctttttttgccagaatctccccgttggcttttctggaaggttatattttaagcttttattcagtcatgtattatctccttttatctgcattttgttgttacattaacttttctttacaggatgagaaagcaaaagctatttctgtcctagagaagatttatgactctgaccgtctagaggaagaggtagagcttcttgcttcttcttcaatgcatgaatttcagtctgatggtactgggagctatttggacattttcaagtcaaaggaactaaggctagcattttttgctggagctggtcttcaggtatgttcatcatctagcattctagcccactcattttaggtatgttcttagtcccttaaacttttagtcaccagggagataaacggttcactgtgctaagtgcattcctcaaggagcatttgatttatgcatcctgttggtaactacatggagttttctcccctaagacatgttaatctgtgcaggcgttccagcaatttactggcatcaacactgtcatgtactacagcccaacaattgtccagatggctgggtttacctccaacaagttggcattgctcctttccctcatagtcgctggtatgaatgccgctgggaccattgttggaatctacctgattgaccgctgtggccggcgtcgcctggcccttacaagcttggctggtgtggtggtctccctcgccatcctagcaatggccttcatactgcagtcatcatcagatatctgttcgaatgcactcaatggtgcctgccaaggtgcactgggatggttcgcggtggcgggactcgctctatacatcgccttcttctccccaggcatggggccagttccatgggcagtgaactccgagatctaccccgaggcataccgtggaatgtgtggtggcatgtcagccactgtcaactgggtatctaacctgattgtggcacaaacattcctctcgatcgtcgggttggttgggaccggcctgaccttcctgatcatcgccggaatagcggtgctggccttcatcttcgtggctctctacgtgccggagactaaaggcctcagctttgagcaggttgagctcctgtggaaggagagagcatggggaaaccagggcaatcgccagagccttttgggcgctgcaccgtagtgagccagctctcatcctgcttgcccttgctggcaagggtcggtggctggctccctttttaagatggccgtgccaccctcagtttctatcggctctctctagctgggaagttttaggaagatctggatgcagaccaaattttattacgtggtagcgactagatcattgttctgtcacctggcatgtattgtcaatttctcatggtggaaactgggataatttcagcattgggtgggtgaagaatcaggttgtgttggtgtcgaatcttgtatacatgggaaggactgtacgagctatactggttgtgcattgccgtcacaagtgtatagttccggtgctagatgtgccggggagacggttaaaaacctgttatggacagaaacaggaatgaaaattatcgctttaatattcttgctcgttattcctccaccaggtgtatctgacttggcaaaccttgagagttatatgcagatgatgtattttgtaactaatgtgtctgtacaatggaattttcttttcttttctccatttttacctgtctgacaggatctagtatggcgcaagatttgttgccaggaaatggtttgttaagcagaacatagatcatcagaggaggcttcttgagctgacattacatagaagatgatcaccataaattattctggcgaagagctatatttttttttatgttaccatatgcattaggatattccacttttagtaatcaccactactgattcagacgaagcacacgactagcttggaggcatatattcagaacttcagatacgatataggagtacctaccaggaaacacgtacaaaccagcagtactgtgatactgtccgatctttcctctgaatgcggacgaaggtgttgtacatttgtctgcttcccccacacctctgttgctaccttttcgtcgtcgtcgtcgccggcggcggcgaggagccgaggaggatcatccagtggatgtgttggccggcatctcaggcgcagctcagcaagggtcggatcggatccccgtctccctcggagatgtccgccaccgcctccccagcctccgccctcccgttccgggccggcaagtccggtgtttttcggcccggcccaaccgtgcggagacgcgttcgtgtctgtccttttccggcccagcttgcgcaaccgaggcccatcgggcgagatcaccgccccccaccgtcccggagcgccggcgtgcggcgagcctcgagggcgacgccgcctctcctcacgagccacgaccgtgatgctctgaggccgaggccgaggccgacgccgacgaggaggacgagccgaacggcccgaaccatccgccgcccgctcgcgttcaggggtaggaggggttggggggaagagtagtgaatagtgatcaacaaccagcctccatgggaagccccccgcggcgagccaatgcgctgggctgcctgccacggcggttgtgcatgtccatgggtaagaccgtaaaggcgtaaagagcagctattttaccattgctgtttcatactgaagtagcagtctaattttcacctttttttgcctaccattcttgcagcatgtccattgaaattttgctcagtcttcctcttcgataggagagcatggcctcctgcttattccctcgtagtcctcccatgcaccgatgaagtgattgagcgagtcatctgttacattgggggtggttaagtggtttgctgggttgggttgcattgcagccctgcggcctcgaaggaaggcacttcagatgttcgatgaaatgcttcacctgtagcctcctgcctggcactttttcaggcgcgatgtcctgagagaaggaaaaatacagtgcgccggataattatcgtatcttgcttactgcattcttggcagttgggctgcacagtggtgactctataagtcaacaatcgtctgtggttggttctgttgggggcaacatctataatctattgcatagaatagccaatgatctttcacttgtcatctttctttatttagctggggccactttgcgaggaaaaaaaagtataccatatgtctatatatacctcctatgatggaatggaagtatgcaatgnaagaagtagtaatcaagtgcaagaagacgctaattcatctgtagctgatggtggttggaggctttgtggactggaggggaaacccgatagacagaaaggtacatggaggagtcagagctgcatggtttatgttctgtaagttgctctactgagtccattgattaatatattgttcctggcttcttgcgttatttgtgtaattactcactaacagtaggttttcctattgaaatcgaagtgtttttttatgcttgttctctcttgtagttctgtcagtggtaacaaacatggaaaatattccaaacatgctgaatttggttacatatctccatggaaccatgcatatgggagtttcaagctctgcaaccacagttactaacttcattggtgccacatctggatttgctttattaggagctttcctctcagactcgtacatcactcgctctagaaccatactactctttggtccgttggagtttctggtaatttgcctcatggtctattcaacggtctatatattctgggtatcatccattgaaatttcttgatttcactttctttttatctttactagtgacagcctgccaagagaaggggaaaaaaaacacagtactcgtcgcagttattttaatcacagctaatgaatgtaaactaatagcatcatatagttacatcagatgttgaaagaaacccatgaaaattatttcacatgttgcctctgttttttcttctaacattattctcagctgtaatcacaccgatatcgaaaaagctgcaggttgcctgaaacttcaaaagcttaggttgctaaatcgttttcccaagctcaaagtagctgggaacttgggatacatacaaaacaagattcttacaagttgctaaggaaaacaattttatatctccttcagaattagttaggtgtgaattaagccaaaacaccagatcatattctgttgaacttttttttttttttgaaaggaatatattctgttgaatttttaactatggtttggtcatcacctactgtgggtctgtggcataaccttgatccgaagcctacttgataaagatattaaaggacctctatgtaaaaaagtacatcggcatcttcttgtttgcttgtggttaaattagcattgattttcttcagacaattaacttatagatactttcactagtttaaaacttaatatctggatataagtttctatctttgctcacagccaccgaacaagtagtttctgcttcatactggtttaagttccaaggtaacaatctacttgtgcaggctcttggattgctcgctctgcaagcctacctcccctcactccatccaccaccttgcaatattgaagcagagctaagcaactgcgaagaggttcatggcttcaacaccgtcatattgcacataggcttgtacacctgggcattcagtgaaggctgtatccgtgcttgcacgccatcacttggagcagatcagtttgaccatgaagatccctctgaatcccgccaacaatccagtttcttcaactggttcacctttggaatctccttaggaggatttataggattgattctaatagtgtggctcgagaactacaaggggtgggacattggatttggcgtgtgtgcactgctaattcttcttgggttgctcatagttgccactggcctccctttctaccgtaatcaagtaccagaaggaagccctctaactcggatactgcaggttataaacttaaactagcatggtggcccgcgcaatcatcatcgttatatttttcccataaaataccatatatatatattcacattttattattaaaatagattgaaatgacaacataattttaaattatttatgtactaacttgataaaactaaccaatgcgcaatattcatactgtaatgtatatgcgtgaaagttatttattgttttttactttagttatttctaaattttatttatatatataatttatacttctctttcaatatttcttatctattaatttcatatttctgttatttttaaattgtactcctatatgaacaatagactgttcttccaatatttcttatttttaattatgactttatgttatttataaattgtattcctatttggagtctagattcttcttccaatattttttttaatttcaaatttcaattatctctaaattatattcctatatggactctagactctttttccaatcttcttttttttttaaaaaaattatgaatttcagttatttctaaatatatttttatatggactctaaactttacttttaatttttcttattttttattttcgactttcaattagttctaaattcatatataggctctagactcttctgtcactattccttatttttttatttcgaatttctgttatttctaattgtatttttatggactctaaacccatcttctagtattccttatttttaaattccaaattttagttatctctaaattgtactcttatatagaggttccttttattaccaatctaatatgttaatttgtagcacacaaatttatttgttagacgatcctttgctataagattatggcattcttgggtgccaatttattattgaagtggattccggcggcaaaacttccgtcttgctaatttattggtaaagctgattgcggctggaagatttatggctgaatatttgtgttttgcgttttgttttcattgctaggagtatcgatctatttattactacgggatgaatcgtgtacaattcagaaccgtataaactaataccgccatggatgctaattccatgaaagaatctaattatgattggtttgttaactgttgtccgtttcctacactataaccatacatgaatatttattgttatatcacagttccaaaaagaatcctgcccgtttgtttttttgcttctaattttcatccgattaagagttgtgatcagtttcctaaacctatacaatgcgtgcgtgagtatgttcctagtatgtcatgtttccaaaagaataatgtccgtttgtttttttttctttttttctttgattaacgtggtaatttttaggccgcgagagcgaacgtggtggctcttttttctattgctttatagatataatagatttccatctctcaggagaaaatcaccattccatatctgccgcctatctgaaaaattgccttttccaggttcttgtggttgcattcaagaacaggaaatatgaacttcccgagaaacttgaggaagcacaagaaaaccgtaatggactggattctattgaagtaccacgtcctacaaattttctgaagtaagcttcagcaagatacacacattttttcagttaagggtatcacacatcatgcatggattttaagagaatatgattctttagtaaatgttataaactcttctgcacacttttttttttgccagatttcttgacaaagcctccatcaaccatggtgaagatggagcctggtcagtttgcagcacaatgaaagtggaggagacaaagattgttcttcgaatgcttcccctcttcatcagctccatgatcggttatatctcaaaccctctgctcctcactttcactgtgcaacaaggtagcatgacaaacacaaggctgggcaagatacatatctcccccgcgacgctctttgtgatccccatcacattccagatgctaatgctcgccgtctatgatcgcttccttgttccgttcatgcgcaagcgcacaggatatgcctgcggtatcactcacctgcaacgtgttggcttaggctttgcctccatgatagttgcatcggccgttgcagcagtcgtcgagagaaagaggaaggaggcagctgtgcagatgtccctcttctggcttgcacctcagttcttcttgcttggcgtgtcagacgttacatcgttcgtcgggctgcttgagttcttcaacagcgaagcaccaaaggatatgaagtccattggcacggcgctgttctggtgcgagctgggtctcgcttcatggatgggcacgttcctggtggagctggtgaacaaggctacgaggcatggacaccatagagggtggctcgagggtacaagcttgaacaacagccaccttgacttgttttactgggtggttgctgttatcgggctgcttggcttcttgaattacctgtactgggcgaagaagtatgcctaccggcacaatccacgcatggtcaccccatcagctgatcaggactcaccgtgatagatttgattgctcttgaagcaccatttacttcacagatgcaaagcaaaaggtaaccatgtactgatgtaagttgtatcatgctgtttgtgttcagttgattggctggacttggtcgttgatcatttcgactcaaatgtacattttgtaccattccgacccaaatgtgtgtaaaagtggtcgttttctgtggcaaaatatatcattcagagacaactccaatacaactgtatgtctatgaccgtacaaaattttactaatgcccaattatatctcttcctactttcctggtacctcatggaattagtcgtgatatagctgcccccagtgcaagagactactagtatcaagagcagcattcagaggatcttctgaatcttctggcacacaacaaaatcagtgatgcactgttattttaatcatctttacacacagaacatccttgaaaaacatatttcatgtctactaatttacagcacatgaaaacttcattgaatagaggatcacgtggacataagatattgaaatttgtcaaagcggcatgtgcatcacagctttacaagccgtttcagtttactgacactcgtaatttcaactcgcaggacacgcgcggggaagatgtggcgaccactcagaaaatccaaattattcgggggagatctgcagcggtagcgacaggcaagctccaggctaaccggagagcggagatctgaccagctagcgacgggacaagccacgtagtagtaaacacatgcatcattaggctgagtttgatcgagagttagctgattattatgttttattagcgtataattaattaaatactaactattataaatttaaaagatagatttgtataattttttacgatatttatatatatatatttttataaaaacacccagtttaatagtttgaaaaatatactcgcgcgtatattgatatagtattagcttacccaaaaccctcaccccaacgcagcctaaacgtgacgagatctttggccacgtcccggagccccgcgcgcagtccatacgccgcgtcacctgaagaaaaatgtgggaaatgcacaggagaccacgtgagtatatacaccaagagctagctagctacttatatatattagccatcgtctcctgatcatgagatgtccaggatattaattacttgtctcttctgagattcgaaaacactctccaaacatatagagagataggagcagcagcagtctgttttgttcgttaatttgtggtacaacggtgtatatatatgtgcattaaggctgatttggagaagcatatatagatggcacttgatgaagggtatgtagattggagagggaacgcagtggatgcaaggaagcatggaggcaccaaggcaacagtctttctctatggtaagccactgcatgcatgcactacacatttgtgttttaactttaagtagatttagtcttgtctattgtttctaatcgtttcttgtaataatatatagctacacattaatttgtgtttcttgtttcttgtttagggagatgcatttagtctgactcttgttttcatatagtgtagtgcatggaaaataaatttgttgtataggtaattttatcgtccttgagaatgtaactagaggtatattgtgtcttgttgggtaaatgcatggaaaatgaattagttgttttcatttagtctgtctcttgttttcatatttgttggatattgtgttcttgcaaccttttctgtgcttcttttttatgttaaaaaaacacgaatattagggaaggatctaatatcaaataattagaagaggtgatgcttcgaactcagatcgtctagcccatcaccttgtggagttagccgaaagaccctaggcgtttctctgtagggggtaagaactaagaattaaggatatgaaagaggagaaatcttcaagtttagagcgtaagtagatcttctttttagttataactttgtaggatccgtacgtaatgttggatgtggagtcaccatattcagtcccaaaagctaaaaattttcagcaaattcagcattagtttgaaccatagtagaatcatcgtcgcttattaatttgatcattcaaatggtgcaaatttgttacacgcaagtaaacaagattatgaccatctgtatactgttttgagctggggggacgatatgtatgcccactgaaatctgcaggcccatgatcgatcaaacattctaacaatttttaagagagcctaaatgacaacagttagaatatttaactccagcataaagaactacagaacatccaaaatctaccgctctcgatgactttgacacaaaaatcagttaaaagagggctgtgctaaaatctaaaaattttgcgcaaaatgaaaagcgtatgttcatcccatacttcttacaagaatttttttcgaacggaaaacggcacaagagtgcgccttttcattgaatatagaaggagaaaatacaacccctaagggtaaagcaaaaaagactttaagctataaactatacaatgtgtgggacgaattcgcgcaatctttttgcccctgctaaggcccacaggctagcctcctcttttatttttgctaggagaaggcctaccgccatctctttgtgatcgaaaatcctacgatttctctccttccagatttctcagactactagtaggatgagggaccgaaggcccttttttgggatgttgggagtatttgctaggctttcccaccattggcggactgaccgggcttcctcccactgggacggctccaattgatgatatcccacccatccggcaacgtggtgccatattctctttgtgtatctgcatgtggcgacaggatgcaatcccgtcttagcttcgcaacgacagagggggcaatggccgttgttctgccaacctcttattgcaagtcggtcggacgtccagactctattctggatgatgagccaggcatgaaatttgcatttccccagggcccatgctttccaaatcaaagagttgaggtttgtacttggcgcccccaagcattgtgcatgataggccgaagaggctgtataatggccattgcctgtgaatttccaaacaatctgatccggctcttcactgactaactgcacatttcggaccgcttcccacaagcggaccagctgttccactaggttgactgtgatggttgagcttgcgtcaaagattaggtcatgcacccatgcgtcgtcctctttcccttggcgtagggactttttcctatttttggagattgcgtagaccaatggcataagatcttttggcctgcgcccatcaatccaagcggaatcccagaagcatgtcatattcccatcaccgacggttatctttgttgaggcagcgaagaggtctttgtcgatttcatcacaaggcgtgtccaaacccacccacggcttgttcggatctttccattcgtgccaaagccatcgcagtctgaaggcccttgtgaatttttttaggttcaggactccccaagcctccctggctagtcggcaagcacgtctttgtccaattgaccttgcattttcccccagtgatatcgcctgtgccagcccagagaaaatgacgtctctgcttatcaagttgctccagggattctttcgtcacctaggcagtcaggaggtagattggctgcgctgagagcacagacttgactagcgtagttcttccagctgctcccatgcttttccccctccaacttgcgacctttcctgagattttgtcaaaaacaagttgcaagtccatcttccgcaatcctccaagaactagtgggaggcccaagtattttaaggggaaacttgccatcattgctgggacaccctgtagcacgtctgtcagatctatgttatcacatctgattgccgcaacttgggatttctggaggttggtaacgagcccagtagctgtaccgaaacggtgtaagatgtccgcaaaggccgtgacatcgtctcgggtgggatcaatgaagatgacaacatcgtccgcatacatcgaggtccgcaaccgagttgttcttcctcgcaactttgaaattgcgcccagctctgttgccttggagaggatacgctgtagagggtcgattgccaagatgaagaggagcggcgagagggggtccccttgccaaagtcctcttccatgtttgatccgccgccctggtgagccattgaggaggacttgaaaggtggaagtgcttcttacaagaattaaggtttaaacaaataaccgcaccttgtccaacaaaagtgagagagaaggttccgcttccaatctccttcgaaagttttaatcaacattcgaaacaattacatggtccttgatctcaacaaattaattaacaagcgatcacaatatttgcaccatttgagaacgttcaaattaataagcgataacgtcttttttttttcaaactaatgctgaatttggtgaaaatttgtagcttttgcaccattccttaagcctgtggccaccattttttaagcaacaaagatcattggcacgtccagttaccatcttcttaaacgactactgtacaaaagagttaattttagagctattaaaggtcatataatttctatgtaaccgtatcgttcagcaaaaggttatcctgaaatacgagattacggatataagcttgtgtttggctcaaagggatgggaactaatccctcacacacacaaaacggaacaactcattagcacataattaataaagtattagttttttaaaataaattaatattatttttaaaaacaactttcatgtattttttaaaaaaacacgcgtatttaacagtttaggatcaagcatgcgtgtgtaaaacgatatagtacacttgggaagatgcacccggccaagaacacagccaagtcataagaaagatcgatctagatcatggatatcaatatatcatatctgattatcagatatcagtttgtcaaaaaaaaatgtaacatcagaaaatattatcatgatttgtacgtttgctaccacctaatataaagctgttctctagtaagtcataagaaggaacgttctagatcatagatattatatcccattatcagaaatcagtttgtcaaaaaaatagtgtaacgtaaaatattgtcatgattggcacgctcgctagccgaatatggaacagctccacgcgtaaaaaaaaaaagaataagtggaaaatcatatagaacgtgcagtggggagatgctaattgtataacactcgaataatttaacgggcatgcaggacacatccaacatatcaacatcgagtgagtcttgcagtaggattacattccgatcttccaagattgtttaaatgaaataaagttataaagtactaatacacgtggggcaaattgatactattatatatatagtcatccaactccaacagacgataggtcgaagatgaagtgaaacgtaatttaacttgttagatatcttatggtgaaacctattatctaggttaaagttttatatttgatatgggtgctcgtatttatagataattattttttaagtatatgttgataatacacgtagtgactttcgtttatcttaagatatatcggtccaatctactcacaaggaataaagtgtacgtgtgtctatttatagggatgtataaggacacctatgtgttgtgtttcactcgcaataaagaaaagaaaataggccaaaggataaaggacgcagtgcaaaatctcttcccacactatgtaccatctacttatctccatccacacatctaagcattatttttctatgatttggtctgaaaagtctgacgaaaatctcatgtccaagaaccaatattcattttgtctccatcagggctagcagagcaattaaaggatatctttcacttatttggtgcttgcaacgcaactactaataaaggcaacaaaaaatatatgaaataaaccaaaacgacatcacaactgacaaagcgttagataacattcgaggtagagaaaagacccggggtcttctggctagcaacacaagctgcgagctagccggtccgggttcgagcctcatcccgtcctgcaatgagaaccatttctacttatttctttcccgcagatgtacatggtaggatgctactctaaattattttgaccccatgccacatgaatacgtggtaatttaagctgtaaaaaaaactagtacagtagaaaactagaaatcacctcctgtacagaatatttccatcaggattcagaatcagaccttaaactcctcaaattaattctgaagaagagacaaaagtaaatttgagcaaagcctgataggccccgcacacacagtcttcagaaattagatagctaggcctaatgatatatttgcatgaatttctgattggaatcctattttttgatggacttgcatgaattttctggacaattcctaagtctgttatttaattatttatttatgagtaaatttcacaaaattaaaagtactttggtcaaattatcaaaaactataaatttaacacaatactacatatttaacactatttttttttatcatagaactatagatttaaggtaaaataacacaaaactatagttttagtaaaaaaattatcgtaaaactacatgtttaatatcaatttaatcataaaacttggacatttacaactcaaacataacattagtttaaaaaaattaaaccccaaaatatgatgttttgtgataatttgattattaaatatgtagttttatgatacttagttttaaacctgtaattttgggataaatttgttgctaagtctatagttatgtgatatatgacattaaatttgtagttttacgataatttgactaaagtatatgtagtttttgtgaaatttactctttatttatttattgcagttttggtggctctgcgcagctgccctaacagcgcaaacttcagtttagtggcatacttccatcagacattgcatctggatattgttacctcgtcatccatgattacatatctggttggcgctgtgtcattcttcactgcgctgatgaacatcctctcaaatgcatatatcaaaccaaccactgccatctttgtgtttagcccctttgtgatcctggtaatttaatttctcgtttccaacccattttagagaactgtaatttgtttcaatgactatttacatgcatgctattataaatgatcagttttagttgtacaaagtttgagttaggaataataaggctgagttcttatcctagttttcccaacccacctgtattgttttccgcgtgcatgcttttcaaactgctaaacggtgtgttttattttaaaaaatttttatacgaaagttgttttagaaaattatattaatccattttttttaaaaaatagttaatatataattaatcatttaatcgtgcaataatacatgctccgttttacgtgccggagtactcctcccaaacacaatctaagtttagtagcaggtaaaagataactttatcaagtttcattagttggataatcagttcgagttcgaaattttaattcgaacttagttacttatagttaaaaatatttgatccctaaaattttaaaatttaaaatccatgcggaattcgagttgaaagtatcgtatttcactgaaaatactttgtcatattaggaactcccgaagatgcccttgccctccggtctcttcacccccattagcttctccgtggagatgatggaattccggccggtcgccggatttctccccgctctctccgatcgctgccaccagctaccggccatcggccgcgcatccaccgggatgtgcactcttctccgcgctcgcgcgcggatctgtcctctttgacctggatgacgtgggatcaagcgagagcggagaagcagggcgatcaccgatggctacgagaagagttcgccggaggaggagcagcaggagggagccggggggggggggtgggtgggtgaggacgagccggcgaggttaaggaagatgtaataggcagaattgggagaaaatcgtactagggtggaggtgagtttacaatggcatccccaaatgttagaatcgaacactttggaagcatatttttcgtgtcactttcgatttgctaacattttgttcgaatgagtaatcaaatcgaagcttttattcgcctaaaagaattagtacaggattttaagacgagggagatagtatatgctttcaggacattttaagcttctaagatgaggaggtagggttttttaaaatgctgagttataatcaatttgtgtttgaaatgcagggctatatgttgctagcattgcaagcgcacttgccttcactccatcctccgatttgtgagataaacaaagatccaagcaaatgtgagccagcgcaaggctggaacttaacactgctctacttgagcttattaatgtttgccattggggagggctgcatgcgcgattgcgtaccagcccttggtgaagatcagttcagcaatgatgatccagaagcatcgcatctcaggagtaacttcttaagctggctcaagtctgcaaactctcttggagcacttattggattggtattcctagtgtggatcgagaagaatctgggttgggacattggctttttgttgtgtgcccttattgttattgtagggctgctcatagcagccagtggactgcctttctatggaatgcgcaagctcaatggaagtcctctaactagaatattgcaggtaaaaaatcatatgccacaattatatacgtttgtcggtctaatttggtatgcatgttaattataacgaatttgtgtatgattgatttattttgacgccaactggttagtgttgctttatattatccacgatccattttgtggaagtcaaatatatacaagaaggatgctgttatccaagttatgttttatactcttttgtctgatagcattacattgcattattctaccttccatgcttattgctggaaagtcaccatgcctatttctagaaatttcagataacagattaattacaagcaataaagaaattagggcagtccttccacacatcaatctaaaacaaaattgaatgtagcaagacaaagcaaggaaaacagaagatcatattgttttgaagttgtattactggtacctttccaggttcttgtcacatcatcaaagaagaggcaggctgctgttattcatgttattgagctgcaagagatcagtacatcagatcatgtagatgaggacggggaagacaaatgtgacagcaaaaatatttggtaagttccctgataataaaaaaatccccagaaaacaatgtatttctgaaaacaatgtatgaacttttaacttttaaataaatgttgagaaccaagagtataataattcctatttttgtggaaatcataatctccataataccctaatatatttgtggacaaatcctgaatacatgacgggaaaaaacaatttgtattttctgcagcactactcgagttgatgagaaaacagaggctattactcggatgcttccaatcttcatcagctgcatattcgcctacttgcccttcacattgctcatgacgttaaccatacaggttggcagcacgatggactcagggataggaatgatccagataccctctgcctctctcatcgcaatcccaacaacatttcacatgctgatgcaaccgtgctacaggagaatcttgataccactgctgaggatattcacaggccacaccaatggtatcacccctctgcagcacatcggtgttgcctctgcgtgtgggataatggcagcatgcattgccatgttggtggaagcaaagaggttgatggtcgtggagcagcaagggctaacattagtagctgacggtgtcccaatgtccgtcttctggctggtgatgcagttcttcctgctaagcatcatggatatagcatatattggtgggctggttcagttcataaagagcgaggcacctgaagcaaagcatattgcaccagcagtgcagtctcttctggtcggaatagcagcctggtcaggatgtgcctttgtccagctcgtcaacagaatgacaaggcttggagacaatggaagaggatggttagatggaacaaacttcaacaggacacgccttgatcgcttcttcttgttattggcaaccttcgagctggtggcatttatcaattatgcattctgggctaggagatatgccaacaagaaaagggtcagtactgttagatcagacggcgacaattttggagcttaaagatccaaacagtatgcaatagataggtaagagaaaacaaagagttgtgattaattttcttttgttagcctgtctgtgttgtatagatcgtaacaaagatatcctataatctccattggcttatggcagcttgacagaacttacaagttacaatcaatgcaatctagcgtacagtgatgttatctctatctgtcgctatcttgcaaggccagaaaatagattttcaatattgaaagtagttgcgtaaactgtgtcttaggaagaacatcaatatttgtggtacctaaactgatgactaacaaggtttgtaaaaatagtatagctgactagtttactgaagaatgagagtatgtactgtactgacataaaagtatcatttctgcttggtcttcaagcttcaattatgtcatgtcataataaaaatatgtaattttatactaagaatgaaaagttgaaaacattgtgctcaatgaatgccttccaatgaaacaaggatgtcagcaggacaccacaaaccttagcagaaaattatatttgtttctttcaaattgaaaccaatcaacaatacaaagaagttgattttctctgtatatgtgttgcatgctcgaagttcagcttgatgaaatttaattgcttttggacaatcacccattcagctgccaatggacaagtaaatcattgttttagccaccatgacctctctaatctagtatggttaagggtgtggttgaatttgaaaccttttctttttgctactgatgtgcatttcagacaatctgtattaattgcatcggcccatgattaaaaataatagctactccctatgctccctttcacttgacactagatactattcatgtacaaactttgaccattcgtcttttttataaaaaatatttaaaaatatttaaggagatattatattatcaaagtactttgcatgttaaatataattaactacttgcattcatcaaaacatcataacttaaaagtttttattggtcaaagataaaatcaaacttgtaaacagtgtcaagtaaaagggaataatgggagtagcaaatatgttttggttatcttttttaaccaataatttttagggttttaggttttaatttctcttgtttatacttttcatatgcgtatcctgttcgagctgatgccatctccttgaagacgcattgtagagtagtggatgcttagattaaaaggtaaaaccacaattgggttgttccatgatggttaatatggaggaaatcaactgtaagttacaaacctgagttttggactgataatcaagagtaatagtaggttaacctaattggtagagtttattatgtaactcatgcataagcatttcgtgctcataatttgagcagcaatgattctcataggaagcgtctttaaagacgacttctcagaccaattaataaattaagagcttagtttcaagatagtccagaatgatggcttggacttgaagacatgcattttatctaagatatttgtacatcagtgtcaatgcatgccagtgacagattgcttaaaaaaattgtcaggatacacctccatattttggttagtagggagtaggaactctgaatctgatagtcaactttagtgttggac

SEQ ID NO: 1972 - DNA, 7324 bp, Oryza sativa
ctcttcaactacagtcactaatgttcttggtgccacatctgggtttgctctgttaggagctttcctctcagactcttacataactcgagctagaacaatactcctctttggtccattggaatttttggtaattcgctttttggtttactcaactatctacatcaagcctaatatgatcaaaggaaactatttttgtttaattctccgttgccaattactgtgcgcaaacctaccaataataaagaaattggcatttttttctggtaatctgcttcttggtctattcaaccatctaacgaattattggcaatcatatatgcagggctacggtttgctcgcactgcaagcttaccttccctctctccgtccaccgccttgcaacgcggaagcagaggcaagcagctgcagagaagtccatggcaggaatgccgtcctactttacgcagcgctgtacatcagcgcttttggcgatggcttcatgcgtgcttgtatgccgcccctcggagcagaccagttcgaccatgaagacccctccgagtcccgccagcagtccagcttcttcaactggtacaccttcggaatctcctttgggggtttcataggattgatcctcatagtttggctggagaacagcaaagggtgggatgtcgggtttggggtgtgcgcgttcctgatcctgcttgggctgcttgtggttgctgctggtctccctttgtaccgcaaccatgtacccgaaggaagtccgctaactcggatactccaggtaggttgtgctccttgttgggtcaaaacatgatgtcaacatcaattctcaagaaaagagatcctgtgcatgttagttgactgcattctgatctatctatcccaggttcttgtggttgcattcaagaacaggaagcttcaacttcctgagaagctggaagaagcacaggaagaaagaagcactgagcaaggaggctctactgaagtaactgaaatagcttctcaaacaaacagtagtctgaagtatgttcaacgaaatactgagtactttttctagactactttgaatacaaagcagaaaatattggcaattgagcattgtcctcttggcagagtgcaatactaaaattttgtctttgcatgcatcttggcagattccttgacaaagcttgcatcaatggaggcaaagacggggcctggtcagtctgcagcacgaagaacgtggaggagacaaaggccgtgctccgcgtgctccccgtcttcatcagctccctgatcggctacatgtcgaacccgctcctcttcaccttcaccgtgcagcagggcggcttgaccaacacccggctggggaggatccacgtctcgccggcgacgctcttcatcatccccagcgcgttccagatggcgctgctcccggtgtacgaccgcttcctcgtgccgctcctgcggcggcgcacgggctacgccagcggcgtcacccacctgcagcgcgtcggcgccgggttcgccgccgtgatcctggcgtcggccatcgccgccgtcgtggagaggaagcggcgggccgacgccgcggcggcggggcagatgtcgctgttctggctggcgccacagttcttcctgctcggcgtctccgacgtgacgtcgttcccgggcctcctcgagctcttcagcagcgaggcgccccgtggcatgaagtccatcgcgtcggcgctgttctggtgcgagctcggcctctcgtcgtggctcgccacgctgctggtgcaggtggtgaacagggccacgaggcggcacggcggcggcggcggcggcgggtggctcgagggcgccaccctcaacaccagccgcctcgacctcttctactgggtcgtcgccgccgtcgggctgcttggcttcgtcaactacctctactgggcgagcaggtacatataccggcaagacccacgcgtcgtcgtcgacgtcgagccatcggcggatcacgattcaccttgaaaaataccgcgcctgtagtgttggtcaaaccgtgccaaaggattagtcaagttttgcgtagatgtgattttgcctatagtgctattattagtcaaacgtccgttactagcacacacttttttctaaaaattttcgtccaaaaaaaactttaatcgaaaaaaaaatatatgaaaactttcatatgaaaaggtgtgcgctaaatagcaatcctggtgatttggtagtgatgatctgttggattccatccattttatccctcctagtaatttgcagtagcgagatgttatgagaaggtagccgtcgtgtgtgctgtgtttagcatcatagcatgtacgtatggttgtccgtggcaaagctatgtaagatctgatttaaacatggataagcattgtttagcaagacatatcggagtttcatatacaagagagtaaaacaagggcttcatctctacacaaacttgcgaacgaggcaatgcaagttagccagatcgctgtaccaacagtcgcagctgctgcaacggctgcagacacggcgatcaccaatgcggggagcccgaacttcggcgtgcacggcgtcgtcgaaatcgggcatgggctcgccatagatgcggctcatgtaccgcttgctctggaagcgcagcctgctggtacagcacgtcgagctcaggctgcgcgcgcctgaactcgtcccactgccggaacccgagcttgcgctgcagctctcggaagacgccgacgagctcgtggagggagacgagcagctcgtcctgccgcgtcagctcggacttcctcacaaactggccgccgatgacggcgccctcacgccgtggtggtccacggcgcacagcacgaagcctctcctgaggagccggacgccgccgctggccatcgtcgcggcggtggtggctgcggtgtagcatctgctgatgccgccgctgccgcaaaaggcgatcgggccatgatgaatcgccttggccgctggagggatttcgttgccatcgtgttccgggccttctgagttcttggtggcactaatatttgtggaggttctaacgaattcgatttgtgtacggtaccggcaggatacagtccgatcccgaaccgtagatactagtataatctgatgagtttataaatcgggcaatttgctcaagaaatgaaattcaacatcctacaagggttcagaaaaatggagttgaatttcactatctgcaacatctgcagactgcagcaggatgaagttgattgcaacacagtctggcctgatcagactggtactctaatatccgtgtgcatcttctttcaactcatcactcatcagtaggaggtttacaacaagatgccaggaagacgggagaggatggctgtatggagtcatggagccaacttcaaaacaagttgatcacttgttacttgcagctttcaagcctatgcaaccaatcgacgagtacattttattttttgacttatgttgcccaataagtctataaacattcgacaatgtgaaagtatgcaaggatttgtgcttagaaatgtaacacagttagaagtttaatatctttatatatgctgcaggacaattgccaattgccatcttaccagacagtgattggcaatgtcttcagaattcagatatactgctgatcaaatatatccttcaatattcccatttccaggcagtaattctgcaccctattggacccagctcaatacttcaggtcaacacaggtgcaatcgttccattcggttctttccgccataacccttttccgcaggaaggccagggctgtagattttcacattcatgtgcctccaaaacatcgagtttcctgaatgaatcatgcagggcagtccatgaatagttcatatgtttgaggaaccttagccgaagtacagtcacctcccaggacttcaaatcacccaggtcactgatgttacctccgctgatgtagagcttcttcaattttctcagcttttcaggactaacccagtgaggcaattctacaaggggaaaacaacggagctccagcttctcaagacctaaggggagaacacaaggcattgcatgaggagcagcatgacttggagaactcccgtgtgtagatattgggtgtgccccccaaataagtgtaagcgaccggagagcacagagctcaccaaaattcgcaaactgaccgctatctatgctataaccaattctaatgctcagctttcgtaacttttttagcatgacaagttcattgagatggcatagatctttgctcttggcgtttgatagaacaaatcccttcagaacttcaagttgaaaaagcttgcctagtcctttaggcatacctgagagcaggtaacaatcagaaacgtccaagtactccagcttcactagttttactatttctttaggaagatcctctagattatggcacgctttgagatcaagaatgacaagtcttgagagctttccaattgagttcggaagggcctcaattcttgatatgcctctcaaactcaggtacttcaactgcttgcaggatttgacctgctttaggaacttggcattgttaatctcaacgtgatgtgcccgagggtcataacttgcatcgtgccattgtcctaactgcaaagtggtcaaacggttcttttcagaaaaccatgtcttgtttaactctacatactgttgcttgatattgtaaatcgtcaaaacatcaggatggaagtttgtaaggatctttccagcatgcaagcatgcacggcgggtcctggtaaagtcattcctggagctgccatctgaactgagctcaacaaatgctttgctctttgcagcttcaatcagtagcccacggatccaaggttgcaccttgcacgagtggactttgtcacagtggtatttctttactggcgtaatgaacccattggacagcagcaatttattaaagaagctcttgccttcagaaaccgaagttacaaaacattctccaatccaccagtgaattaacagtctcttcttgatgatggcatccactgggaacacagcaaggcatagaaggcagtgtctcaatcttgtctctagttcatcaattataactttgagctgccacatctgcgcactttccatggtaatgcagaaggtatttgatgctgacaactgatgagaagatgaagcttcatgtgctgcagccatgcgcatgacatggcatgagacctcctggaccttgaaagagtcatccacctttccccgtatatttgttatctcttcatgaatcaactggagcttgtctcgcagaccacccatctggttaagttttaaggaaccttcaacattcatatgtccgtcataaatctcatcaatatgttcttcaattgcatcaaagttactgtatattccgttctctttctcttgaaccatctgaagtacatctttgagctgtgacaaatcatctctgatcctgtccaacagaataaaagcatctgatttatcttcatgggctaaggtttccaacgagatgcgcctgaaggtgtacatgcatgtcaacaatggtgagaaggctgctttgacaatgtggaaattatcatttccatcccgctgcttctgctcaatcttgtcaagtacaccttccaagtaattcactccgtgtttgactgcatctaggaagctcaaagattctgattgatcattgtatgtggccttaaggaatgttaataatggtagtatgagatcttctattaatctgaagttctcataaacctcattcttatttctatcaatcaaatctagtgcatcctgtaagcagttgacttcagcatcgatcttgacaaggatcttatagttctcagacttgttgttgcgggcagccgcttctgatactagatgattgatagttttcaaaagtttcagtagcggggagaagacctgttccacaatgcaccagctcctgttgtctgcttcctttcttgatcgaatggtggctaacacattctttatgcactgcatcccactcttgatactttccaggagatgagcttctgaaccaccttgtgcagtcttgacatatctaagtgattcaaaaagctcatgttcatcaaaatccaatatctcatcaccagctcctttatattattgtcttcaacccacatctcatgatactccattgcccatttcattccctcaaaaggtcgaggatctctagctgcattttggtatgctatagccaatcttctctgccactcggagattgcaaggctaacagacttaaaaccctcatagaccgcctccttgtcttctttaatgccctcaaacaattcttcgagatgttgcacttcccatttgatcttctctggaaattcaggcactgtaggacccttctcaccagtttcagatgagcccactgtcccaaaatagtgttgcgcaatttcagaaatacgcatcacaagtggctcaaatacatctttctcaatgcttctatggacaagcatgctgatcaacaacacaaataccaaagatctaaatatggatcaagccagtatggtagagaaaggagagttcagctgaaaactgttctgcttgaaaacaaaaactggttaacagagcaattatgtatattggaaagtgatgaacagctaaaagcttgaatattacagtacctctgttattttacagtgctccagagtccagaccactcaaacctattgttctctgaaccatagatagttgagaatgcagtgtcatctgtttttgaagaacaagttagcaggttcataaactgaaatttcatgagggaaaccaggaaggtgctctgcaggttcctacaatcacgaaataatccaccaataatattccaatactgttcgtcttttactcagtactatgagatatgacaaaggaccattgggaactctggaaagtgtggtacaactatgacttttcaataaagtatgaaaatgatcctatctaggaagaaaagtcacagcacaacaaccatatagactttgtcttcactaagaagtttcctatgtaatgcacctaaccgagccaaataaaatagtttggcagagaaaaccaaggctgcattaagttcccatcaaacgatgttcttcattctttaacatgaacaagctccccttcaagtttgcgcataatccatggtgatcatatctctcaaaggaaaaggaagaaaaaacccatgtcagtggaacatcaactgcaagcaatggtggaaaagctttacgctgagtctgcgcaggagcagggtaagctgctttgcattgaaagcctgctccaggacctgcatacacttttcaggatggtccataggaagatcagtggcatcaacgacagtgcacttctcatgatcagcgcc

SEQ ID NO: 1973 - DNA, 781 bp, Oryza sativa
tctccaagataatgacagaacactactatgatgtaatgcagaaacctcgacacaaagcatacgctatttacaagatgcaccctgggatgcaacttcttgcacaaatgattacaggggatttcacttacaatagatgccaggaaggaattagtttggcctgtagaaaatgcaaaaaaaagtgctcggtgcctctccttactcgttgactcgaagacaactgagcttccaacagaattgtttgaaatgggaaatctgaggacactaatcttgctcagagatgaaaagatgcttttgtctgacaagaagtgctcaatcacagacatcccagaagaattctgcaaatgtctgatagatatgcgtgtactacacatgcaatcttgcaggatcaaaagagtacctaagttaattggtatgcttaaaaaattagcctatcttaatctctcccacaatgatatagagattataccagattcaatatgcaaccttcagttcttgaagaatttcaacctttcacgaactgagattgctgaattgccagaatcagttggaaagatgcaagctttgcaagttttggatctatctcattgtgaaaaacttcttcatttgcatgaatctgtaagcaatcttgtgaatcttcaaatcctaaaccttgaaggctgtcattaccttgctattttaccaagaagcatgaaaaacttgaaaagtcttgcctacctaaacgttcttgaatgtcctttactaactcaaatgccctgtcagatgaaccaacttagaaacctcg

SEQ ID NO: 1974 - DNA, 20566 bp, Oryza sativa
  unsure (1)..(20566): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagccccttgattaaaattttatggaggtcactttccaaaggcgataagacagtaggagatgcatttgtgctatgacgcaagaaacaaattgcatcagtttctttcctaaataaacaacacaatccaacgaaaacaaaaacaatggcagtacgagcatagtactagtatatcttgaaacaaagatgatgctatcacacaatgttcagactctgacctggcgtatctcctgccccatttgatatgctaggcaactccaattttgactgaagacagggtccaggactgcatcgaccccaatcttggcgacaagtatcctcctaccggagctctcaaggtttctctcttaactattcacctgcattgcatttttgcacccaaccattaccatctctatctatgtatctctagtaggtttctacttctaaccgtcagggtgtggcaatgtcacaatgcagctggggagaatcgcggtgcagtgcctgcagtacgaccctacgttccggccatcgatgggcaccgttgcccgcgtcatcaactacgccgtcgtgcgagaccagcaaggcgtggtctgatgatccacgaggattttttttttttttgcacttgttcattttgatttgttcgtgtgaatcaaccgtgtatatgccttgcgttgtgcaggctagttagacatgcaagagatacaattcttgcagtaatagttgaagagagactatatccaaaaagcctctggttgatataaactggtaccggtaaaactttcccaaagcttaggagtccatagggggaaaaaaacagaacagaaggccttattaaggccatgtgtgcaagctagttagacgtgcaagagtatgctagtagtacagtaaatcgctcaattttggatggagttgtttctcttctttttttttctcctgaagatgcatcatctaaggaaaaaaaatgtactgagcagaacactgagcttgttaggaaaaaaacagttcagtagtataaatggtacgaatgttcagtacaattgtgtcccgttaacatacatcgattttgccaaaagaacaaagggaactttgtatagtatgagtgtatttgtatagggtcggaagtcttgccatccgaatgtttgccccaaaaatgttggggtaaaaaaaagagaagagaaaataggataacctgaaacggagctatgaatatttcgtttcattctatagtttacaactgtttattttactcatcatgctacataaattctgtgtgattcatggcaaaaagaatttcttctatacctacctgcagaatcaaatggaagagtttatcagagctattgagaatgaacgtcttacaaagctgttgattgtaataccaacaaacaggaatagaaattgtttgcaacaaaaaataggtagttttgggttgctgtaagcctaggctctcaaatagttttctttggtgctaagggcttctattccatgccatgagagtacctgttgttttacaaccatgaactggcttactagtagtgatagatagtaccaatcttagtagtagtcatataactaagatgaactctgattccaactatgttacacccaactgattatgcactccttgccttcaaagtcacaagcatctgctctaacatccatctctactctaagcaaaagagaagctactgacaatagtacataacaccaaatcatcaactgtctctgtcagtctcctgatggcagctgcaggttgccgcaaccaggtctataaaatcacctcctaccatcatagtctaaactttctaataggtgacccctcacccacccaacccatgttttgaatttcaatctgaggtaactaacgctaacagtaatacagaaactgatcgtaagcagttccttgcgaatgcagtttcactgacagatagcttacagttgtaacaaagtgacattttcatccaacaaacactgaaatgacacagcaacatatttgtccatgagaaaagtgtgtgagattcacctcaaacagaaggctaaataggcaacaatggttttctctcatcggttgcagtaagatggcttgcctgaaaacatagtcagcacaagagataagtccatgagaaataaagttgtcattcttggttttattcaacaaaacaatgagtcacttacatcatcagcagcgccagcagtcatatttacaaaagaagagtcggatgacctgccacacaaaattgttttatgagattagatgttctgaaatatttcataaaatcatgacactttcacttcaaatgtcattaatatgaagtataaatgcaagggacaagcgatgtttacctatgattctgtgcatcttccggttctaatgctccagctggtttgtcatctttgacctttgccagtggggagaaaaactgaacaagaacagcacttagccacttacatatgttcaactaagacacaataagtagtaggctaaagaatagacaataaaaaatcacctggtgcatcgaaataaacactattgagatgcctaggagaaagttaactgtcaaggtatgtcccaaaaatgcagcagatgctagaccggtaaatattgtggccacggttgatgaatacttcttcaaaattgtgtctgcattacgattttagtcaattgttactaaagcatgggaaatcataacatcatgtaactgaaacacagaaacaaagaattggaaactcaagattgtgtaagagagtaaatcaggtataccatcctttacctgcatacttaaagaagaatgaagagagaatgccttgtgcagcattgttacaaatgagaaacattgtggcccttgaatgacctcgaaggatgtcaaaactctctggccctgcaaacaatggggcaaagttatatcatagacatatagccaatagtccaaaacaaaacataagacacggtacgacactaatggaaggtagtaagatttggccaactcgacagtttgtgagacacagagtattaaacacgaaatacaaagtaatgcccgtctggctgcttggaagaggtgatgcatgcataggctatatgggttcccctcttgaacggtactttaaatataataacaaaacatgctacagtgcatgattttcagtttctgactggtagcgctataaaaatttgcaggatgaaaagacgcactgatttcaaagtacatattcaaccatataccaagctctaaacagacatccaatttcctttgctttgcaacacaaaagacacaagagtcctcgggtaccacatctgttgtttgcaacacctgaaatactaatgagaatattgcatgcatgccattttccatcaggcctaagtcaccccacatgttgactttcaaatactgaaatacattataatgcataacagcatattcatcaccttagaatctaagttgcttaccttgaaatatgacagtccccaggatgccaaggaagttgaaaattgcaccataaccatatagaaacaaattctgcatgttgtgccaagagttagtgtgaatgaagggagagagaagtcaaggaaaaaaaatgtgaacaggtaagcatcaaaaaccaagggactagatcttatcagtttattgttttcagtattatatgcgtgtgttataagtaatttgaaagagttgtaaggcaaacttttttagtgcaaatcacctgaagatagatgcttgtgtcgaactggcttttcaaagcatactcattgtagactgaggcaagtgatgggacagtaacctacaatctcaaatgaacataaatatgaacatctcgattcaaaatttgttcaggtggctgaaaaaatagtgaaaactacacagatcaagatactatgtaggtgagtaaaacttacaaatataagtgtatatatgtatgcaatagtggtgactgcaagaccaaaagatttggttccatcaggtatggagcttagttgattgacactgattccaataagcaacagagcaagggcttcccactgatagccataaaaaaagaacagggtcatagatcagcattgttggaaacatttgaagaacatataattgctctacattttccctaggatttgattcagtttaagttgttgtaccattctagacttcaagtccatttttaattaatttggcactgcatctaaaagtgtcaactactcaaccatcattgctagttacgattctgcattggtactaacagagtttgtgaaaaattcaaaaatatagtcagcaaaaggcaaggcaaaaaccttgagaaaagaggcgaatggtgcctattgatttctaaaatcctagcagtagtaaaacatggaaactgcatgcactatattcacaataacaaaccaatagcctaataggaaaaaacatctaaatgagagaaattcttagctgaattatagagactgcatgcactgtgcagtttaacatgtaatggctaattgtgttttttttttccacaaggaagattcaggaataaaaggaccacaatactaatctcagtctcacctgaattatagagaatttccttctcattatgaattttaggaggatagctatgacgagtaccttgatcaggaataaaagaatatgatattagtaaatcttgcttcttgccaaacatagggaaaatacacactcgcatcttgcaaaaccacatgaataaagcatgggaaaaatggcgaaagagggtaccttcaggttgcttagcatcttcacagttgcagggctgaagtataactgcatgtgcagtacagcagattaaattaaaaccaagaccaaaagctatatcagattggaagactccaaatccgaactctagaaaaaaatcttaaaacatcattggtctctcattagatagattcctactgcaatggcttggaaacattgataagtattaaaattcatattaactaactcaaatgattggacaagttgcaatgacaattaaacagttcaagaggccttgagaaacacttaaggccatctcttttgcattcatattaactaaaagtttctaaatagtttactagtagctgaataattatatctttttgaacattagcttatcatcatatgctataaactccttttcagcattatttcacagcattgtatttcccttgaaacacatgtatttaacataagcataaaatactgatacactgcaggaaaacaagatttcataaagttcaatgaacatttacctgcatgatgaactttaggtagttgttgatggcatataggagagcaggaacagctaagagtgcattattacgtgctgcctaaaaagagaaggattcaagaatcaaatgataagttgccataactagaaagctggaattagagcaatttgatgcataaagttataaataaataaaggaaagctgaaggcaagtcattaaggaataaaaactacaaatgagcttcttctaaggaattaaaaacaaatagacaaaaacaatttgtggttaacactataaacataagtcatatatctaatctgtgtgcatgttgagcacagtcaacaaagagtgcatgctgtgctagcattgacaagataaatcacctgtacaaaggttgaaagtgacagaagtggcttctccccaaccttttgttttctagactgtcaaacacaaataacaacattagggcgaaatactaaaacaacaagactacaagagccaggaaggctgccaatagtaaatccatgactacactgttggtctactgaaaatggtgaattatgtgtgcaaaacaaatgctttgattagccattccagaaattatgtgtgcaaaacattgatattacatagaaggatcatgcatgctaacaagagatggaacatttaaaaaaaaacacttgtagaaagcacggatcagctagaactaacctggattattagcattacaatagcaaatataacttttgtaacctctgtcaaaaagttgacactgataggactgaactgaaacttcccatcaaccttggacataaatactagaataggctgcatatacaaagtaaaaaattagcatggtttgaaaaggttggcaatcagatatgtccaataatttggcagcatattggcattgaagtcaaacactttcaagtagagtggagtacctggaggccaaccaaaatgcagtcccctgacacaagaaggaagttaagcgcgcggtacttggacgatatcttgctgcggtgcttgtcatatgccctcgacacactcctggggctcggagccaccaccttggagtggcatacactgcattccatcactccgttcctctgcatctcctctaactaagcaggaccggaggccccaaaagcacagcagcaagatatatgtatcactctatagccgtggcctctgatccctttgcatgcctgcagcaaaaaaatacatttgtgaactaagcaaactaatcgatgaaaactgaacacatttctctctaaattcacataatctcgcaaattcatgtgtagcaccgctacccagcccatctcaccaaaacacatcatagccgacagcatcaaccgaagtaaactacaaataccagcactaaacttcaaatcacccaatcagctagataatccatatcagatcactagaagctaacttcgccaataaacatccaaaataaatcacgaccaaatgcagcaagcgcgtgcttctatatactagatcacacaatcagcaccacacacaacaacaaccaaaaaaaaaagtagcacaatcacaggtgagcttgaacgacggagagatccgagaggacctcgtatcagcgaccgtaccacgggggagggtgggggggccgggcggcgggatctaacgccgcctgggcgctcggcgccggcacacgcgcggggcgaatctggtggcccctgtccggatcggcgcggtcgaggctcccgctccgcacccccccgcccggcgccgcacggggagatcgggcggtggcggcggggttctcctccccctcctccttggctcgcttcccagatttcgtcaagttccggcgggaggaaggtggaagagggagaggagcaggaggacggcgaaggcggggcgtgcgcttcgcgtgtattttattcacgtttctttctttctctttttttttttgtttgagatgttcgtgatttctcttgttcacgtttgtatttgtagtaactttttttccttgcagctgtctgtgatgaaaaattggtaagtttggtcattttacgccagaatttttttatctgtaaaatgaataatgccatgctataactgcaccatcacactataatgtgtttccatgtgcaagctatggagtaatactctcccctaaaaaagatataaaatggagtaatactttactaacttccattctcaaaaatagcacattcaagttatgtatacatgtatttgtttatgtatctggacctacataatgtctaggtaaaattcttatatatatttgcggacaggtgcattatctatttactcaagtgaataattatcattgttacaatataaaatcaccatatgtgttgctatttcattattgaaagagaagtcatcataggtgttgttacttatccatgttactgtaaatgttctgaactatatttgcgattgattacataaacggtggatacgcaaattatattcaaacgaatcctacaaaatatgtgcgagggagagaggcccaaaacagatctcactcatattcgaagttcgctccatatgaattgggaggtggcgactagtctgaaggaatagtctctcactctgttgaccatttcctttgcgattcgtgctacagtgataatagtaacttgttgtgtgtcatttactcgcttcctattggagcacgttgccagcgtgtatattcaaatctttccattcgacgcatgttaggtccaggtccaaacacactggcaaattctcaggcgaatattctaattgattcccgtctctttcgcaaggaagagcagctgacacgatcacaccagctagccatcgttacagtggcattttgagtttattctttttctctatgagagctcgttgaattgagcctttagcgttgcttttgatagagagtggtcatgagcaatttgcttggaccactgtccaccaaaattttcattagtgaaagtagatgcaaaatcctatctacaaaaggtaataatcactgctatatagtgtaatacttactgaatttgttgtaagagccatattcttctactcatatttgtgtcgtcctggtatgaaaatggtgcgattttttttgcggggaaaagcactcaattactcagacatggggtcatcactgacaacccatgataaaaaaatacaactgttccctggctacaggcctgacaaatactcacaccgagctttattcgctaacctacgactagctcggttttggctccgatgagctttatacaggaggatctcccctatcaccgctgaattaattcttgatttccctgagaataaacgccatctccgacaactccctctcctttcactgaatcattgcatcgctacctgacagtcagtttcaaccacaatcggcctgagaaaccattaaagaggaagagccagtccttccttgagagcaaggatctccgactctagtgcatgacatgtgtccggaattcagttatggttactaatatgtgtccgtactttgaacaaatctattttcggaattgatcccagtacatgacatctccggtaccctttcattgcatttatacaactacagctgctatagcagctgtgtttcttataccatagttgtactataggtgcatcttcagcaatttgagctgaacatgttcacaattttgagcggattctttataatatatcgattaacttcttatgtcgtgcgatcaaattttgaccttctaagtagagttattttccactgtttttggtgaccccatataccagctatagaaagatacaaatccaaaagacctagtaagatgactttttgagtggacaaaggtactaataaaagttttagattgcatctttgttggagttgtttgcagtgggatgtaggttgggcaagagtgcacacaactattggcttatcatttgctcttatattattgtttcatatccttttgtaaaagctaggtgaaaccctacgcgttgatgcgggcatttagtatgataacaaatataaataatgtgtaatatagctagatgacgtaagcttacataagttgatgtgatttacaataatttaaatagtatataaaataacgattcaaatgtaaaattaaagtgatgtagctttgtaagagaagaaaataagggagataatttgcatcatagattaattatctatgggcaaaaaacaattgaggtgatatgacttaataagagaaaaaaaaggaaggagataatttggaccatagattaattatataagggctacaaacaattgatatgatgaactcaagtaagtttttagggttttcttaaacaaattttactgttttaggatctattagatagagtttgccttttgtacatagaggtagatttatttcgagtttgtcttttctatctcttcgttgatgtctatttgttaggtggatcctccacggagacctataaaggtttgtctattgggttgctgatgattcaatccgtggcactggtagtattgattgctaacatgtcacaggaacggagatgtcagatgatgcttagtcatgttctttgtgtgtgcttgcgtttttcaacggtgttattgtgcttgtctattcacgttgcagcaatccaacatatggagctctttatcttttttgtgaggttttatacttcttgttcttgtgacaacaaggttatagttatatttcttattccatccgtcccacatagaccttgtttctagaaattctagaacaaatcagtagtgcggcgaattgatcaaatgtttctcattaattcatggttacaattcttatgttctagtttaaatgtgtatctggagcatgtataacttagaattaaacacctcgtggacggcggccagcgggggaggccacgcgctgctcctccgccgcccaccgacagctcctcccccaccactgccgcgttgcccgttgccgccttcatcgctgacgcctgccaccgaggctggtgcctcgcagagaagggacatagaagggagagagagaagaggggaaaagagagaggaggttgatgtggcctcgctgacatgtagggtccatgtggatcgcacgttgactcagccgccacatcggataaatcgggttcaaaaccaccgaatgacctaatgtgaacggttttgtaaattgagagataccatatatctagttttacggttgaggttaactcaataacaagttgaggcatcttgggtgtactttttacctttagcataatcgaacaaggatgctaacatggcatacaaacctttccgggctccacatatgtccacgggccgacttgtgacttggagcacgtacgagtgcacgacacggaccgagcctgaactctgatgaagtcgactctcaaaaagggtccgtctcctccggaaaacagaacacggctcggtggagaaaaccgaaaagaggaaaaagaaaaaaagaaagaaaaagaagaaaaatcctagggctagcctccgcagacacacgccatccgaaattcccgtatcctctcgagtctcgtcttcctcggcgccgccccatctcagccggacaccgcggcggcggcggcggcggacaggctgttcgcgcagaaccggccgggacgcattgttccgtcggtcgcgcgatccangccggaggagaggggaggaaggagggggtgggtgagtcaacccctctctctctctgatcggagggggtagccctcctcctcgtcgccgggaggcggctgatgcggcgcccatggccacggcggtgctcacctacctgcagagcctgtggccgctctccgctctcctgagggaggacgacctgcgggcgtccgcgcggctgctgcggggcgtccccgtgccggaggagacgaagcagttcgtgctcgcgctccgcgaccgcgagcccggctccggctcgcgcgggggcgtgatctacatcctcgcggcgcagaacctgtccgagcggtcggcctccgacgccgactccctgatcaggcgggtgcgccccgccgccgtggtcacgcagctcgcgcacacggcggccgacgacgtccgggccgaggaggagtgcctcgagggcggcggggccggcggcgtcccggcgtccccgttccaggtgatcaagaggtgcgtcacggagaagaggagcaaggatcagtacgtcaaggcggcggcgtgccaggtcttgcaggagattttcggggtcgggttctacggccatgtcttggccgcgaagagagccgcggaggagacgggctcgtgttttcttttgctcgagtctccgtatgagaggaattgcaatggcggcgcatcgggtggccaatctaccatggaagaaggctcaggtcagcaattggcgagtcgctgctcgctcgctcaaagttcaacggatgatggcacgggtggacagtcacagggtagctgcttgctcactcagagcaccagttcaatcgtaagctcgcatgtcaggaagatatgccttgtggatgacattgggggacaactcgtgaagtcgctagcgccgaccgttaatttgttgatgtcccaggctatctcttctgatggtgtttcagagtgcaaactggctgaatgcaagccatcggacagatacgaggctccaccttttgcacagactgtttatccgttgcttgctgatctttatgatatatttgtggacattccgtcaattggaaaagctatggcttctgctcaggaattgctcagacaagttcatgatgggaagccaatttccactgaaatgctgtctgatgtgtatgtatttaggatcgcaatagaagccctcaggataggtttaaacaacgcaggaagaagccacattgacaccagagataatcatggttcaaaaaaattggatttttcagaactcaactctgaggagaaatgccatattcttcttgtgcaagccctcagaagccaggttagggagtttggttctgtggtggctgtagtcgatgccagttgcttagctggaataaggagacactgggatacccctgttccttcagagattgcacaattagccagcagttgcttcaagcaatacggcaataaaaatgacagtgaggacaatgagctgccatcatcagttgacagcacagataaaaagagttgggtagctgagaaacctgtggtcgtagttggtgcaggaggaacagcgattctgggcttttcatctttatcaaaaactgtacaggcatctgcctttcttaagctggctccctataaaacaccggtggtcctgaagtatggcttaatacagctgcaaaggcatgcttccatcgtgttaagcaaggtcctatcgaatggggtttttagtgctagttcaaacgcatccgttttacaattcacagcttcatcggagaagattcgagcagttactcacactgtaatttcatcagcaaagagaactagcttgatggctatgcgaacttcgttctacgaaataatgcagaagaggcaaaaacaacctttcaggatcactccttgggcaacatttggttgcagcatggctgcatgcgctggtctcctgatgcatggagacgggattgagtgtgctgctgaggtcgcaccttctgttcccatgattgccactctgggacgtggtcttgagatcctgcgcctcacatcgcaggaagtgaggcaaacaaggggccaacatataaaggaagctttgggcgcgctgatgagcaacttaaagaaaacagcaaaataaagacataacaaaaaaataactgagactgtatagatttccatcatgcaattttgttgttagatagatttttttttgttacctctgtacagtgcattcttcttgcttttactgaggtaatcgaattcctacaatgtgttttggggcggttctacttctggagcatttcatccatatcagcccaccaaccttctgtacatacatgtatacaacatatgcctaattgacatctctaatgctttcttcgggatcatctttaatgctttagtaactcttattgaatcagtgctgataccgataagaatgtgatgcagctatctgtaatgttctaagtgaaataccacctggagatactgccacatggacagtaatgcttatcttttgtgaatcatcgtcttggctgttctatttgtgtttatattttcccaggcctggttcagccttgtgaatttgcatatctctgattgccccattcatttgctcactcaatgttgtcttcaagcttatctgtgtacttgactgcccttttctttattataaacaattatggttgctcattgttgattttgagctaaggacaagtggtcaatagtatccattgtgatatgcacttgtgttacatataatagtgtataaacatttgtctcatggttacaaaacaatgtggaaagaaaaagcatccttgtgaccttagttgctaaaaattggcggatgccgcctatacaaaagtaaggggcctcgcccatctgtaacacatttacttcccatttcttcagacagttgctgctttgagggtgagaaaatcagaaatttggtttgtgtagaaatctggctggatcgagttgtcagggctctgaagcatctgtacagaagtgacacctgcaaaatgcatccaacacttggtgcttgtactaacataaaatcagcagagcatgcatagttcagaaggagaggaggatcaaggaacctgaaaggaccagaagagttttgcaacctccgttttggccaaacaagatgtcggtatccaaacggtcaccaaccatgcatatctgggatgttgtgatcccaaacctgccacagaggtaaacgagaagaaaggtaagaatctgaaaccatccatccagctacatttctgataccgatggatgaaacatgactgctgctgagacagttggcctctcacttctttgccaggtagtccatcatgaatgttgacggcttcccgacaacgagcggttcttgtttagttgaaccaagaattgcaccaaccattgaccctccacctggtgaaggcaaaatcttcatcatcttaagcatttatccatcatattctaatgtaggaagagctggaatgcctgactaacctgcccactcttgggcatcagtaagatgggtgacggcgtcccggtttgtggcaatgaaaaggcaccctggattctcacgaatgcacagtgtcccgtaccttcagaagttgattagttgtaacttgtaagttagcaaatcttttgtattggttttggttaatgccaaacttatttacatgaacacgagagctaagatgtgatttggcaacacaggcagacagcattggtcaacattggtaaagaactgcaatcatcaattcatcatctgaggcatcttgcatgcatcaattatcaaatggatgcatgattatgatagaactactaatctgattctgcttgccttacatatatgttcatgtcttcttgacaatggaggaaagaagaagaaacttactgtactttgtagtagttaaaatagcgatcgaatcccacaacaactgctccaacctgtgacaaatccaaatggttctcagtgcaatgatcgcattttactgcaaaccaaagtagggatcgtagttacatctttgtcatgttccatgtaaaatccaggcttcagctctatcttcttgtctccatcagactgcaagatgattgttatgtgtgttaatctgtcccaggaatgcagcactgaacatgggttcagaaattttataacttactggcccgccgaggtactgaaatccagccagctccagctccttcagaatcccgtcctctccaatcacataaacctgaacaataaaaatgttaaccttgcgcaaatattatttgccaaaattgctgaacatgaacagtaaaaatggtaacgttgtgcgcgtatctttgcaccaaaacatgttaaaacttctgaagatgatgatatagattagataccttcttgtctttggggaaatcgatggactgcaggtacgcggcagctgcgaacgacgaagcgaagatctcttcctgcgtagagcgttccaggctcatcagaccagattggttggacaagaaaatttggcaaagaaaaattggcagttcatggcatgaatcctacctcattgacgtttagtcccagcgtctcaaacttcttcccgtattgcttcctcgacttggtcgagttgttcgtcacgaacaccagcctcttgccctgcaacgccacaaccccatcatcatcagcttcaactccagcagattgctaatgctaagttggactcggagttcgagaagatcattgcagtttgcgacggacctttgatctgagcatgtcgagcgtctccggcactccgtcgatcagcttgtcgcccttccaaatcacacctacgcaaacaaaaagaacgcgaaattcataacaaaatcacaatcaatcaaaccatcgagcgatcagtgtgccatctcaccgtcgcaatcgaatatgaacgtctcgacggagtcgatgagcgcgtcggcgttctccagcttcgccgcggggaccgcgccggccgccgccatcacggacctcctcctggcagcacagcgctgaccggccaccggagaagaaacggagaccaatccacctccccggcggtactggctcctcccgaaggtcggggaggacggcgcctgctgcggcgagggcgaggcggcggaggtggaggggaggaaggtgggggaggcgcgcgtcaggagcatcgcggctgctgctgctgctgctgctacgtgcgtttttgtttatccggtggcgtctgtttggttggttggtgtcgtttcggtttcggcgaatgtaacggtcacgtaggagtatgtgtagtgtagcaagggaggctgctgctgctcatgtggcgacgatgatttgtggctgggagcagagggaggagggatcagggatttggggtgtggccggctagtgttgtggctgtcaataggcacattggcacggcgtctgtgaggctcaggtgagaccgtgaggagaggaagcaatcaagcaacatgtccggtccggcatatcaatgtaccaaatggtctgttcgatagaactttaacttttttaaatttagcttcagaagttaagtctgtagtggaatcgtacagcagtctaaactcctaaactcagctccatttctttagttcattttgtaagaacgctccacctagctccattttcattttaggtgaagctaaaactgtttgactgtgttttagttctaggagagttgaagctgaaactgtgctaaacaggcacttattgttacttgggatttagcatttgaaagaagctcacgtactccctttgtaaaaaaaaagataagatatcccaatacaaagaactggacatgaacaaatttttcatttttcgtgcgcatacttcttaacgaactaaactatacatttttttttaaaaaaaaactaccgaaaaattgctttaagtaatcatattaatctatttttaagtttaaaataattaatactcaattaatctaaattaatggctcacgatactatttttgtctcccctcaaacacactttaatgctctctttggaacataaatttttggtgagagataatatgatgccaccaaattcttactcataggtacaagtaggtacttctagaaattgtacagaatttacttgtgctaggttagatgacaaacagggactacaaaagcctgctacatgtacaaataaatttctgctaattttattggtgtagttttcatgctatgtttggaatagatgaattttagtaagagccgatatgccttcttacctgcaggttacacgtgaaatcggaggtgttatataatatacttgctccgtccctaaatatttgacgccgttgacttttttaaatatgtttgaccgtttgtcttatttaaaaacttttgtgaaatatgtaaaactatacgtatacataaaagtatatttaacaatgaatcaaatgataggaaaagaattaatccttacttaaatttttttgaataagacgaatagtcaaacatgttttaaaaagtcaacaacgtcaaatatttagggaaggagggagtactattttgtttgttcaacaaaaaaaattttcatgtataacaacatgtgggtttgcaattaaaagattttgtaagcctgctttggtatagttttcatattggtttgtatacgtcaggtgttgcttatgatgaatttaatttactaataaacagtagaccttttgacataaaaatacagtagatcgatcatttgtgtatttgtttttaaaaaatatttatataattcaattagacgttgaatggtagttaatgccacactgtgtgccattttctaacccttttgtgttataaattattatattatgatttttctacttataaatattgcattatgtttcatttggcttaatttacttacatggttggggcttggaagccaacaagtgttggctaaacttctctgcagtttgcactcgatatgtttgagaggaataagatgtgatccacacgattaatctttttgaaactcatcatcacaatatcggtgaatattctcgatttctcctttggctctatccccatttctctatattttttaatcgtaatttgaggtatcttttattattgtgtgtacacacaccccttatcagtctgtcttctgtttcgtaacttctgctagttttttcgttgcttttaatttgtttgtagttgcttcatggaagagttttttcgttgcttttaatttgtttgtagttgcttttctagtctttgtagtcgtctcccatttgtagatgagaaagatgaactgtggttggtttctcattatattagttggatgtttgacttgtaaatcctgaatttgttgtgctccagtcgtttacttatgttcagttgtcattattgtaagctcttctgaattttgttgagtcttgacttttttcaccagtactttggtgtaaaaggttatccttttatatcatccttaattttttgttgcttctttgtacgcgtcatgtgcttttttcatgagttgaatattaatttgagcccctctccgccgccccctaaggcttttgattgtggttttgttcttttcctccctctgttagaccattgcttttgaactcttcttagtttcttcacagtattgttcaacctttttgaatttctttcgattgggtcaatggagtaattcaaccaggagctaactatccataccttgccgtcttcaatttatatagcattttatttgttcttgttctttttatttcattatctatgccaactattgtatttatttgaggtgcacctgacgcccaagaggttgaacctgaacgacatgcatctccaccaaagctatttacctagtgagtgtcgctcaacttttgctctaccaaattcttcattcgatgaaaatgcatgatgttggtggtttgaaggtttctgtgctagggaaaaccataagggaaaaaaattaccgtaagagagcgcggcaacaagtgttgggtatattgagctgggaagtcatgacagtggatgttggaaatatgaggtgttttgccatgctatctagctactactagtagaaccattctagatcattgttttttaatccaatggatcatatttattatattactggtagtagaatattatttttctactggtggtagaatttataaatcaatgttggatatcatttttctagcacgaaaatactggtagtataaaattaccactattttttgatttttttttgaaaaagattacctccactattatcactagcttgttcctattctctggaaaaagagcaccgtaaaatattagttgttcttgttctcttggttgggacgtggagagttgtttgtagatcgagttgaaagttggatcatccatgaagtttttttatgtgtaaatcattggagtatgcttttgtgttgcaacttgtttatacatatactccatatggaatgttgaacgcaaggccatggccaccgtacctggcaaaggcctgcccgtcaaatataatcaaaggtaactgtaatattattcaatttaaagcaccagggcacatatagtttaggatcggatgctccccactttctgctagaataggtccttcaatgtattatgtatagaatctattctacgttgaaaagagatttcctcataacaaaaaataatcactacactatgctaaaaatgcgttttttttcccagccacacttagtgctctaatagtaataattacgtacttagccaactatagcaatatatggctgtacatattgagctatacagtggtgtatagtatatgtacagaatctattctacgttgacactagacaagttttatctcataaccaaaaaaaaaatcactacattatgttaaaacatgtgttatttttctcagccacacttagtgctctagtacacctcataattacgttagccaactttagcaatatggctgtacacgttgagctatagtgatatacaataatgtcaaacttgctgcatccaagtatggcaaggtattgctatacattgccacatacgataggcttttactccttcattaaatgcgtccacctagtaccaaatcactttcagctttcaaatctcaaactctttaaattcccagccttgaatccacctgacctgtgcctcgtactcccataatcccatttcgcatccggttctagctttccttggcttcccatttcctcgatctccagcgatgtcgctcgccgacgacctggccgccgtcgagcgcggcggccacatggtgccatcgaaggcggcgggtgtcgacggcgacggggagccgcggcggacgggcaccatgtggacggcgagcgcgcacatcatcacggcggtgatcgggtccggcgtgctgtcgctggcgtggggcgtcgcgcagctggggtgggtgg

SEQ ID NO: 1975 - DNA, 1273 bp, Oryza sativa
gcagcccatggacgccgtccgcgccaacctcggcgggaccaaggtgagggctctgcggcgtgctgcagttcgcgacttcttcggcgtctgcgtcggcatcaccatcgcctcctccatcagcatgctgtacagtaaaccaaaaccctttctctgtctctctccgccgccggcgccgcgcgccacatctcgccgtgaatctttacgctttctttcttcgcttcttgtgcgtgcgcgcgcgcgcgcgcgacgcggcgaacggcggcgagcagggcgatcaagagggcggggtgcttccacgtgagagggcacgaccagagggaggcgtgcggcggctcgagccggccgtacatggtggtgtacggcgcgctgcaggtcgtgttctcgcagatccccaacctccacaagatgtggtggctctccacgctcgcctccgccatgtcgctgtcctactccgccatcggcatcgccctcggcgtcgcgcagatcgtaggtgagtgaggagcgaggggctcgttgtttcgttgtggtttttttgaagtgcttgacatgtttgagatcgagtttgcagcgaacgggggaatcaggggcaccatcacgggcgtcttcgtcggcgccggcgccggcgtcacctcgatgcagaaggtttggcggagcttccaggcgttcgggaacatcgcgttcgcatacggcttctcgttcatcctcctcgagatccatgcaagtcaccgttcatccggatatcactaattcagtatcccgtttgatctttcttgattgcttattactatgcatgtgtgtttgtgttcgatatgttccattcaggacacggtgaagccggtggcgccgccgtcgacggagacgaaggtgatgaggaaagcggtggcggtgagcgtggcgacgacgacggcggtgtacctgatgtgcgggtgcgtcgggtacgcggcgttcgggaacgactcgccggacaacctcctcaccgggttcgggttcttcgagcccttctggctgctcgacctcgccaacgccggcgtcgtggtgcacctcgtaggcacgtaccaggtggtggcgcagccggtgttcgcgttcctcgacgggcgcgccgcggcgggcgcgtggcccgggagcgcggcgctgggcaagaggaggcgggtgctccgcgtgggctccctggccgagatcgaggtgagcccgttccgtttggcgtggcgcacggcgttcgtgtgcgtgaccacggcggggtccacgctgctcccgttcttcggctccatggtgg

SEQ ID NO: 1976 - DNA, 720 bp, Oryza sativa
ttcctgcagcccattgcagtcataatgtaattataatgtaattgcactttagttatactgtagttacatataaaagtttctgcctcaaaaaatttgctgcatttatttttacatactcccaatttcagagcttgtaaaagtacatttcttaaaagaaaaattgtgcaaaagtacaatcacgtgtcccgtatatatgaaagtaaccattgtttgtaccaaagaaaagacatctcaactttcaggaaattttataggtggggtggaccgtggacgaactaatcaagttctttacttgagagtaactagttcataactgacctgtgtgccaggttgagctggcccatcttgtagggtgtcaggagatgagtgtcctccatgtgtgtttgtatgcttttgacagcccgatctatataacgcacctctgttcctttcgaggctatttcggctcgcttctacatcttctagcttggcatcttgagtacttatagtggaagaagaggtgtagttaattagtcatatcaaattacgaatcgtatatatgcatgttaatggctatgtgcttttctggtagcactcaacacgtactgcttaacaaccggagcgcgcgagccgcgaggattcgtattgatccggcagagttgacttgggaatgagaggattcgtgttgatctggctgtggacttcggagttgggaggggtttgcacgctatatacatcggt

SEQ ID NO: 1977 - DNA, 278 bp, Oryza sativa
ccgcctgcaaatgggcggcggggggcctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaa

SEQ ID NO: 1978 - DNA, 1527 bp, Oryza sativa
atacaagtttggactttggatagaggaagtttatatttttccaaatattggaggcgcatggtacctcgtactttttttgcattagaattttactaagaacgaaggataaaacagtacaaacacgacacaatcaaaacttctaaacaaaaacgtacaaccttctgggtgtgccgagacccagaagctgaaatacaaacatacagaacattaacgtactagctcagctgaacgccacccaggcacccacagagttcttccacactccaggtaaaagaagaggatagaatctgcagtagcctgtaaggaagaaaaagtcaacccatcccccccccccagttctttcgtcattatgcctaaaatcaaacagccgcactttatgggtaattttgctacggccattggagttactgacacagtaatcgcaaaaatgcagactttgcaagtctgaaatagattgcgaactccattagtctccatcagatcacgtcgccgattgaccagtcatctattggtcagcgcgggcatttcctcaaacaccaagcgtgcgtggcgcgacgccccctgtgcccgagagtccagacagcacccacctcacctcaatgcccccaactctctctctctctcctctcgtacacggaagtataaaaggacgcacctccatccgccgtcttgcccggagcggatgccgcctcgccgctccgccactgcatggcggagagagaggtggtgcttgagagtgatgccatgacgctctcgtctctcgtgcctgatgttcagatcgagccatcgagagtgttcgaggagagagtaaaatggaaaagagtaaatttaaaactgcaaacaaaactatcagtttgctacaacattagcgacatgttcagtttgctgtaacaatagcgtggaaaattatcaccaaactggtaccttttaggttatatgtggtaacagtacatatatgtgacaactgtagcagcatataacataaaaattgcaattttatgataattttccgtgctattgttgcagcaaactgaaacatgtcgctaaagttgcagcaaactgatacatttatcactaaagttacagttttctgaaatttactcaatggaaaaagaagagatggtactgatgggctgggcctaaaatgggggaaataacaggagtactgatgggctgggcccctcgccacctcgtgccatgctaggccttaaattttagtagccctagcccatcaacgctctctgaactctactctgaactgaacacgagcaattgacacacgttcgactacacgagttgctaattgctagtactttgctactattactttgctagtagcatcttactgtttgcagttgcgaatttgcaatattagacagtacaagattcgatacaagttctggctcaggtggtcagttttgactatcaggcttgattcgtttaatccctctcatgggattgatgggatttgaagggatttactcccttcgtcccataatataagggattttaagtttttgtttgtaa

SEQ ID NO: 1979 - DNA, 644 bp, Oryza sativa
acatcgctggagatcgaggaaatgggaagccaaggaaagctagaaccggatgcgaaatgggattatgggagtacgaggcacaggtcaggtggattcaaggctgggaatttaaagagtttgagatttgaaagctgaaagtgatttggtactaggtggacgcatttaatgaaggagtaaaagcctatcgtatgtggcaatgtatagcaataccttgccatatgacacctgatagaataaatttcttagctaagagcacaaatttatcagactgtcttctcttcttttcttttttttttttggcaaaagtatacagtacagtaattctgtgaagttacacacactcgaagattttgctagaaattaataagaatgatgcaagcattgatttcatcccgctgctaaaattaatatctatctttatgcagtactgtagagatcatagcacgaactcaacaaaataagtccactattcataaatctcatttcagacttccacttcaaactttgtttgtttgtatcaatgatatctaaccataggcttcctgaacatactgtcaaatatcaaattggaccaaacaccatctgaatgtttcatcatatgaaaatgaagtaacccaacaagtccaaagcaaccaaaaacatgg

SEQ ID NO: 1980 - DNA, 532 bp, Oryza sativa
ttcctttgtcttgtgcctttgggccttgtcttgataggattagggtcggtaacaagagggagcagttgattacaagccctgatggcagattggcagaggagccttttttttttctgtcaatggaagattacaaagcaggatcaccaaattaatgggagtaaagaaatgttctgatcagatcgtggttgacgtcatgcgttgtttgttttgtttgtccgtagcttgttcaaagattcctcggatcatgcgatcgccaagagtaaatttagtactgctactctccaagttggtgtgctgaaagtttcagaaaatattttcaggaatcagcgaactgcctcttgatgatgcccaagagataggcatggcatctctggatggttcagtatactagttcattttggtgtgataattgttttctaaattcggcaaatcaatgatggtttaggaaacacgttagccaaatgctccgaactaaacttctgtctactgattgagctcgtcagatcagcagacaatacacagttggtgtatt

SEQ ID NO: 1981 - DNA, 1117 bp, Oryza sativa
caccttagtgtctaaagtcatacacccacaactccaccttctcttgattatgaatatactccctccatcctaaaatgtagcaaacgatgttcagattggacagaggtgtcacgaacccctcttgagaattcaatcgaacagcttgagaacgaggaaggaaggaagagtccaggaagaatagaggagttgggagaggagagaggattggaattgatttggggaagatagtttgtacataatatttttcaacgattctctctccttgctcgggtaacatctttatagactcagatgttcccttacacaacccagtccggcccactcacacgggtattgggcttcctttgtcttgtgcctttgggccttgtcttgataggattagggtcggtaacattcccctcttcttgagaaccagcttgtccccaagctggagcatccgagaaacgctccttcaatcgctccaagtcttcccaagttgcttccgaggaagaacacccagtccaacacaccttgacttgaggcacagcggccgctcctcgacggacaagccgccgcgccaacacttgtgctggaactggatcaacctccgcgaccacaggagggagtgctggagcatcaggtacttgaggttgagatgccttccgcaactgagacacatgaaccaccggatgaattgcacacgaggctggcaacaccaatcgatatgccactttaccaactcgtgcagcaacctgaaaaggaccaaagaaacggaaagccaatttgtgattaactcgaacagcaacagacgtctgagcatgcggctgcactttgaggaacacccaatcgtcgacagcaaattgatgatcagaacgtctcttattagcttggtgcttcatccgttgtcgagctcgatatatagtccatatataaatgacctcaagagaccatctatataataagtactccatctgattatatatatttaatcagctggtcggtcatcaacttctaaaaacttattacatgtcctaatttcgtaaaaccacatgtactccatatataagttagaccaatgatttttctttaaaaaaagttgcgcggtacacataacaacctcgagttatacatacttgag

SEQ ID NO: 1982 - DNA, 7786 bp, Oryza sativa
  unsure (1)..(7786): unsure at all n locations
ggagttgagtgtcggccagcttgaacagagtagtccaaagtgtgctagtaaaaatacgatcccgatcagagatgagagactgcggcaaaccatgtaacttataaatatttgtcaagtaagcttgagccacatcaaaagctgagaagggatgcgccagggccacaaaatgagcatatttggagaacttatccaccacgaccatcacgcaatcaaacctagaagacactggtaatccctcaataaagtcaagtgataccatctgccaggcatgctcaggaacgggtaaaggttggagaaaacccggatagcgcacacgctctgtctttgcttgttgacatactgtgcaattttcgacaaaagatttaactgaacgccgtagcccagaccaagcaatggaacactccagcatgtaaggtctgcaagatttggtgctgtaaagaaggattctctcccacccagattcgtccctgataacgcaaaatgccagcatcaaaggaaaaaggtggacaggcatccggttgcagggtaagtttggcaatcagttgagtggcgtgatcatcctgagcatagccacgctgaacctcttccaaccatacgggtacacagactgaaatggaaagaacttcccctgaagtatcctgcgcacggcgagagagagcgtcagctgcacgattgtcagtaccctttttgtagaccaaacgatactgcaaccccaataacttcgtcatagccttctgttgccaaggtgtggtcaacttctgatcacccaaatgtatcaaactccgctaaagtacggatcacaaattcagctccttgcaaatatgagcgccaatgatcaactgccaataaaatggccaaacattctttttcgtaagtagacagtcctcgattgcgtggtcccaatgccttgcttaaaaacgcaagaggatgtccatcctgcatcaacatagctcctatgccaaaagctgaagcatccgtttcaatctcaaaaactttggagaaatccggcaaagccaataccggggctgatgtaagtgcattcttcaaggcctgaaatgccgcttgagtttctgaggtccaatggaacaccacgttcttcttgagaagcttaaaggccgacttagtaacccaaaatggcggacaaatttgcggtaatagcccgcaagtcccaaaaatccccttatttctttcacattacttggaactggccaattgagcacagactatatgttacgagcatcagtggacactccttgagcgctgatcacatgtcccaaataagttaaagaagattaggcaaagacacacttagacctcttcacctttaactgctgctcggtgagaaaagagaagactgctcgaagtagtctaatatgatcctcaagagttcggctataaataagaatatcatcgataaaaaccagaaccccctttcgcaagaatggttcaaatatagtgttcatcaccccttggaaagtagccggtgccccagtcaatccataagccatgactttaaactcataatgtccatgatgagttttgaatgccgttttatgttcatcttccggcttcatacgaatttggtggtatccggcccgtaaatccaaacttgtaaaccaacatgtacccgctaattcatccaaaagctcatcaataattggcaacggataacgattcttgatagtaatcgcattaatatgacggtaatcaatacaaaatcgccaactgccatccttcttctgtaccaagagcacgggagatgagaacgggctagcactgcgctgaatcaccccttgctgcagtatatctgacacttgcttctcgatttcagtcttttgcgcagggttgtaatggtaagggcgcaagttaaccggcgacgcccctggcaaaagtggaatactgtgatcaaacacacgagaaggaggcaacccagttggttcatcaaaaactgatgcaaattccaacaacaaagtttcaatatcagctggcacaattgtctgagaaggtttcacaggtgtgtccaccggacagagagccactgcctgcaagacaacattatgatgcagcaaacccttaagctgattgcaggtcaccggaggacaatcacttgtatcaggtataactccctgtaatgtcacttgccgattctgccactggaactgcaaagttttgagtttccaatcaatttgcattgggctatgccgctcaagccagtccatgccaagtattacctcataacaacccaacggcaaaactttcagaggagtactgaaagattctccctgaacccaccattgacaatcaggaaactcccttgtgcacttgagtaaacctccatcagtaattttaactgtcaacggcgatacagaagcacatattccctacaatcgatttgccaattgttcactgataaagctatgagtgctgccggaatctacaggcatcaagacttcatggcgctgaattaacccttgcaaccgcattgtcttaggagactcaatgcccagaactgcttccctagaaatggccagcaattcctctgtttcaggttcatcaggagtagcatcattggtgtcagattcaacaacatcctctgagggaaataattgcaacaattcctccaccacatgtaattgcactgtcggtccacaacgatactcctgactcctcttctctccacaagtatgacataaacctttggaacaacggtaagcacgaagagcagcaactttatcttcagctggcacttcagccttcagtcgttcttcccctttcatccactgtcccccaaatggacgtgccagagtggaggtagcacgcaaagtatttctgccatgtgagtcaatcttacggccttccttgagattagtttccaacacttcctcctgcaaacaagccaactccacagtagtatccaaattggcatgtcgatgtaacacaatagcagccctaatctcagcccttaacccttctaggaattgagtaacaaaaaattcagagttccaagacggatgatgcgcgtgcaacccatgcatcaactcattaaaattctctgcatacgccatcaccccttcagtttgtctcaacctattaaactagcgcaccaaacgctggaactcctccctaccaaatttcccacacacccacgctgcaaattcttcccaactaccgctaacttcatgagcatgggtggactgcaaccaagtcaatgcagcacccgtgaactgaagaatagccactccaatccagtgatctgaatgagttccacacaacccaaaataagtttcacatttcagtttccatgccttaggatttcccccatcaaaaactggacactcaaccctagatgtagtgttttgaattccccaaaccctaccccgcgaattccctccaaattcatgaacataattagtaggggaaaaggaattgaacgcaccttgaccgggagaaactgtgaagagggatttccccacacagccttcccccggtgattcaagtccacgcgatggctaaatagcccatgagattcttcaccgcgctcctgcggaatcgagcgctcctcctccttcatctgcttcagcttcgggcctggtggagttggaagcagcgcaggtaactcgtcaggcttaatgttgggaggagtcgaggaaggcgctggtcgctcgtcggccttgacctccggcgtcgtccccttggcgagttgatgaacttgcgccctgagatcccccatctcctcccgcagctcggtcaccgccttctccaccgccggtttccaccccaccagctccaccaccattggcttgatttcttcgatggcccctatcgacaccttgatggcgtcgttttgcttttggattgtcgccatggtcgtcatgagctcgctcagctgctgctccatcttgtttgccttgagttgcgctcgcgagtgatagcggggtttctccaagtactccaggatcgactgctctgataccagatttgtcacgaacccctcttgagaattcggtcgaacaacttgagaacgaggaaggaaggaaggaaggaagagtccaggaagaacagaggagttgggagaggagagaggattggaattgatttggggaagatagtctgtacataatatttttcaacgatcctctctccttgcctgggtaacatctttatagactcagatgttcccttacacaacccagtccggcccactcacatgggtattgggcttcctttgtcttgtgcctttgggccttgtcttgataggattagggtcggtaacaagagggagcagttgattacaagccctgatggcagattggcagaggagccttttttttttctgtcaatggaagattacaaagcaggatcaccaaattaatgggagtaaagaaatgttctgatcagatcgtggttgacgtcatgcgttgtttgttttgtttgtccgtagcttgttcaaagattcctcggatcatgcgatcgccaagagtaaatttagtactgctactctccaagttggtgtgctgaaagtttcagaaaatattttcaggaatcagcgaactgcctcttgatgatgcccaagagataggcatggcatctctggatggttcagtatactagttcattttggtgtgataattgttttctaaattcggcaaatcaatgatggtttaggaaacacgttagccaaatgctccgaactaaacttctgtctactgattgagctcgtcagatcagcagacaatacacagttggtgtattgcactcgtctgattcggaagagtgtcctggctctgcaatctttttcacccttgcagtacaattttgacattccccatcagaatttatgaacaatccggacaccctgacataaccaaaagtcaacaaatagatttttgtcaaaaacaacgccattacaagtgcaattagacgactcctttcgcatcataacatccagtgaaatcactttttgactattaaactccatgcaaatgcaacaattaatcaccaagtgtgtttatattttcttttcttcaggtgtcatctgcatcctgccacaagcccataaccaataataaaccccccaaccagagagaatggggttcggttgctgccgtcatggccccgctgtgatgcgggccccacccacccccgtaacgcgaaacggaacggaacgtgggaaccgcgccgccgtgcctcaccgtccccacgccatcaccgtgaagatgacatgtgggccccctggtcggtgggccccctgtcggtgggccccgcgtgtcagcggtaggcgacagtagccgataccgtgccacgaggaatcgcgcctccgacgtgtcgtttcggcgatttcctttttttggtttgttttttttatggtacctttcgtactctttccttcctttccgttcagctttggcattttcttctgagaaagagaaacctcgtgctcggcgaggcccaatatttcggcggaggctgaggcggaggcggaggcggattgtctcctcgccggcgttcagttcagtcgccggataccgtcgtgagtcagctctccttttccctcccgatgcatcgctttgttggtcgcagcggcttccgctgtcatcgcgtgggggcgttaaacccaatgagttttttgtgtgtgcgtgtgtgtgtgtgtgtgggggggggggggtactcgccgctcggatcgctggcgacgagcactccgcgtaggctcgtcgcggccacgtacgccatcccgagctcgggggctaccccggtcggaggcggagcgcttgggggccggggtttaatcgtgcggaggactcggtagggctcgccatacctcgcgccgtccggcggcgcagagcgcggcgtcgccgctggggagaaggacggactcaacgagacgagcgagcgacggccgacaggcgaaggcgttctcgcttcttggcctctcgccgttgaattggagacccacattgggcttgttttgtgtgttactagcatcaccaagagttcccctactactcccaatttcaaattttggggtttttcgagcaaaaaaaatggatccaacagatatccaaaccagcttccaaaaattttgagaccctaatcccgtgtttccgttctccaccagtagagaatacctcccgctcccaatccactgcagccgggcagttttcgcgcgctgccgaggtgcttggttcccccatctccattgattccccatctcgtgcgattggcggagctgatgagtgacgacagccacgggcgagcgggaggtggcacgtcgacaggcggcggagggccgccagcgcagctgcggcagccggcaagggcggctgggtgggctgcaggctgtggctgcagttgggcagcgcggcagtagcaggtggcgggccaacaagtagcagggcaggccggcagcagcagcagatcaacaggatgattcaatctttgctatttgccttatccaccttaaagatagcctattaatcgatccatctttgctaggagtatctgttttgcagattatttatatgtctatcctcctttggctatcccatgtactgctgaaacttcattacttgaggtaatttttagtgtcatgaggggttgttgtcatgcttaatatagacttgttaagataatattgtgtggtacaatgtggtgcaatttgagaatttttttcccattattcttgggttgattctcatgataattcatgagccacacctcttctttttttagtcctctgccactgatcgtgcgtgtgagaatttgatagtttatattttggtgtggttcgtggattattattacacatggacagctaatttgcgcacgacactttgtttttactattttttcttgtgaggtgacaaattgatttatttttccccatgcattttcttctcgttagttatgagtagcatggaaaggttgcaacatttttttgttttggctagtggttgattggttgccacttgccactgcaataatgttttaaaattgttccactcacattacccantggagtaatatggtttgatttgtcatttgtgctgctgattaattaggttgttggttgatgcagtttagattcttcagaacactctgatttttagtgctccaatattatcttgctttggcaattatgacaactataggaggctgaaattaccctttattgtgtaacactgatttaaaatctcttcaaatttgtgcattagttatttcttattaggtggccctgattacatatggactctagttaagatatattgtgtgattctgaagatctttttcttttagcaaattgattctgaagattgagatgtatagaaatgtgcaatatacatgtgttggatttccaaaaattcataccaaactgccatttcaggttatattcatgtgcatcctcgtgcactcctgtgtccatcttatatggtaccaacaagaagttgaagtgtttgggtgatcgctttggggaaatggaaggcagcaacccacctggtaatatgacacagggaccttcctatgggagtttagatttgcatggtatctccaagcaaatgcatcctccaaactcaggaaatcagggcttcaaccagcctcagataccagggaattttaccattcctatggatagggttacagagcctgataacatctctgatggagttcagttaggacaacatgggaagattgcccatcatcaccatcaccacagacaccactcaaagaaccatgggagtgatgaagaggagcacgatatgaatgaggatgctgctgatggcaaagacaa

SEQ ID NO: 1983 - DNA, 2004 bp, Oryza sativa
gaagatcccgcacttcagcagtcactacagcttgcgcttaaatgtaaagaggataatgatttcatgaggcatgcaagtggagatgctgactagatgatgatcagagtgaagattcagattatgaggagaatgaggaagaacatcgagcagttgataccaatataagggggcccctcaatgcataaaaggatgtggcatgttgtagatcatggtgatgtaggttttgtcacctcatgctcgaatgatggtagtgggaggtctgatccctatgacgtgttggatatcaacaaaccctttccagatggatgtgatttggctttggtgcaaaaagacttggctctgaaagcagcagagattcaaaaacatcgtttgcagattgaaaccaaggctgtgcaactcgcaaagcaacgtctcaagtgggagatgttcaggaagaacaaggacttggaattggaaaagttggcgttggagaatgaacaaatgatgcttcagataagcggtttgagcttgacctaagacacaaggagctagaacttgagattaagataaagggcaatgctaatcatccatgatctttgttctgttagcacttcatttcgcaatatggtaagcaaatggactagattttcagttacttttactaaaaaatgctcaatgtttataatttgggtacttcttgtgggagttttttcatgacaagtttttaggtagtactgtgctactagtgtatatggaactatggaaatcatgcattggggctgtttcctattgatagtgtttacttcagctttatagtcccaaacccctgtagtacaaaaattagtcccatccatagatagaggcggcatcagtttttgacggagattttactgttctacagcaaagaaggcatcagttagatatgtactatcaactgggagttatttcgtgactagtattaagatcaactgcaatgactgtggttctatacatggtgtacttgggtgtaaacataatcagcgaataaaagataacaaaagggaagcaactgcatcaccaagatacaaatagtgatgctgctcggatttggtgatcttgtgtgctgtcagattggcacttccaagctgagtttcaatatccaataatcttcatgattcaaagtcaacaatatccaaatttttctttttcccctgattaaacagatattagttcttactcttgtatggataagttgttaatgggtaattggtatggtgtttgttatcttgacaagaagtagcttatatttgttcaattgcacgaacaatgtttacagtttgtctgtatgtagaacactgcttttaaatatgatggtatgctttattacagagagtttactctaaaactcgtaagtatataactgatgagtctagcttagctggttcacctatgcttagccaactccatcgtttgctctttagcttatcaaccacagccaaaatttgaattttaaatcttaaatttatggctaattttagcgaaaatatgtgacttaactctgaacgtttgcctctaaaacagattacattgttatagttttttctaaaatggattgcagatggttatcagggtagcatcctgttattttctgcattgagttttgtttcttccatgctcttccaataattccaagttctctctagaactgataatggttgtctgaaactcaattcgttccccggattgttaatttcaggttgcagatcaattcaattcaggaccgtgtttatgcaagatggtagaggtggcagattgtttatgcaagatggtagaggtggcagattatctgtgactactgacaagtgacaacaatttcaatgctttatagctagctcagtgatcctctcctcttgctgattatatatcattatatctcctgattctctctacttgaaaatttccatgtgatactgggctccatctgtattctaaagtcttcatcatttttttctatccaacttcgatccactcactcaagggggtact

SEQ ID NO: 1984 - DNA, 17708 bp, Oryza sativa
  unsure (1)..(17708): unsure at all n locations
aaaagaaaacagtgggtctctgtgtgtggggccctcggtcaatgttgactgttcaactcgtatgttgaatggtagctgcatggaccgggcatctttgctgctgcttgttgttgctgtaatatcacattttaccaccttcgttttacagtaatcatgtcatattggcgtatatggctgttagttttgacttttgaccaggccttggtgggcccgggatgagagccatcgccgagatgcagaacggaggaccatacacagtgaccctgcagcatcatcggcagtacagtacgtgctgccgggcagagagagcgtacggaaaattcgaccgcataattgcaataaatgtactccctccgtccccgtaatataaggggtcccctaatataagggtactgtttgactactcgtattatttaaaaaatttgtacaaatataaaaaataaaaagttgtgcttaaagtgctttggataataaagtaagtcacaaataaaataaataataattccaaatttttttaataagacgaatggtcaaacagtgtaagtagaaagttaaaatttgttatattatgggacggatggagtaacacagcgcttccgtaactcgcaatttgcaaacgattttttttacatacaccaccatctttttgctatggatgcagaacgtctgcaatgctgatgcaatagcagaagctgacaactaatgcatcagcagcactacacagataatcccattgtttcgctatgtatgtttataaaccaattttgaaaatttaaaattcaaatttgaagtttattttatggttttatcattgtagtttatttggcagtatttactttttaaattgctaaaaatacgtatataaacttttcatctataaattattatttggttgctaataagtaatacaaatatgcataaatataagccaaatgatgactccgataatttaatcaacatatatgtcctgttgtattggagcaaaaatgattatcatattattcatgtcgttttcttatgtcgtttttattagatagtaatactttgaaatttataggtttaaatcaacagtaggtcaatactgcaaatatatttaccgtataacaattgtaacattcaatactaaaaatgctttcagactctgattttataactactaaaagcatattttgaaagaaaatcaacagtcaagttttaattgtgaatactcttaaaattaaaatactccgaagtatccaaaggtattttgggataatatctttgaagtttttcacgaagataaaaaactagattatcctttattattggcagtatccagataaataattaccttagttgatataagaggtgacggtgttacacctacaaatacaatgtttaaaagactaagggggtgtttagatccaggtgtataaagttttggtgtctcatatcgcgtattatatagggtatcgcatggggtgttcgggcactactaaaaaaactaatttcagaatctgtcagtaaaccgcaagacgaatttattaagtctaattaatccatcattagcaaatgtttattgtagcatcacattatcaaatcatgcagcaattaggattaaaagatttgtctcgtaaattagtcgcaatatgagcaattagttattttttagcctatatttaatacttcatgtatgtgttcaaacatttgatgtgacatgatgtaaagttttgggatgggatctaaaacaatgcctacaataatcttcgctttatcacatctcgatgtatgtatctaactttattaaattctaatatatttgattgtttcaaaataaagtctttgcggcgataaatgggtgggggaagttatgttattttttaattggaaaccccggcgaggantaatagagaaatgatatatcttaacataaagttaaacaaatcaaatacttcatctgtatcacgatataagtcattctagaatttttcacatttatattggtgggaatgaatatacacaccaccgcaccgtatgaagtagggaccacgacacgttaaaataaataaaaagaaatcccaaacactctcgcctcgtctcctctcacaccacacgcctcgcatcgcatccccacctccgccgatcccgccgtctccggccatctccgccgccggcaaccaccaccacctcctcctcttcccctctcccccttccgcccaattggttgccccgaccaaaccctacgcgcggaagggctcgctcgctcgatccggtgcgggcagcgcgcgcgcggggctcgacgcgggcggcgacggggggcgggctcgatccggcggagcagtgggcgctctcttccacgatgcgtctaccctcttcgcgcgagcacgacaaggtttgcagtagcagagaattttgtttcgtgtttatcgattgggcatcttcggcgcgggagaccggggagtaggttggtaggtaggcttgccgaatccagcattttcgcgtgccccctcgtagcttccgccctgctactgctgctgcaatcggtgtggagagagataattgggggcattgtgacctgcattcccgcagggcaggggcaacgtcgccatcgtgcgcggcaccgtcgtctagtctcccatctttttcaagaaagaataatcgaagattaatcttgaccaattcaattcatttgtgctgcaggttctttttgcggggtcaacaataatgaggagaatttgagttggtctggaattactctgggatgttatcattggcgaaaagtatagatcccttttggtagctgaggagagatctcaattttttcagagagtagatgtcgtttcgcagcatcgtgcgcgatgtgagggatggatttgggagcctatcgaggaggggatttgaggtcaggattctggggcatcgcagggggaagtctcatggtgctgtccatgagttgcatgacccggtgcctgtaatccagagcagctgctgggctagcttgcctccggaattgcttcgtgatatcattgagaggttggaagaaagtgaggctacatggccttctaggaagcatgtggttgcttgtgcgggtgtctgcagaacatggagggagatgtgtaaagagatcgtcaagaatccagagttgtgtgggaagatcaccttccctatttctctgaggcaggtgatcatgcaaattgtgttgtttttagttttatatcctttacaagcaatatcagttcgtccatgttaggtgcttgtccttcaacatattgttggaatttcgaaacacaaaaatagaaagaacacccacatattgcaggattaccgtttgcttatatgctaataagttcatgttattccgcttctatgtacagcctgggccacgagatggaactatgcagtgtttcattaggagggataagtctacgcagacctactatttgtacctctctcttggctctggtatgttacttgttacatctcatatgctttatgttgtatgcgcctatgtaccagagcccatatttgcttctgcataagaagattcatatgtagttgtatatacttgtgagctgctgaatgagtgcatatattctgccaaaactatgcttgtattgcatagcaaatgaagagctgttctttcttatagcccttgcatagggtagatggtgccttgggatggtaattggtgccatgtttatcatttgacatgaatatgctagaaacatattattccttatttgtcattgtctatcttccacaatcatgcacaagcgaacttgtgaacagatcattcagcattccttggctttcatacagttaagttaggttctttataactacaattctgtaataagttgtctcatttttgtaaccaaaataataggatacagcacacaatagttgttatgtataattaagtgctattttttagtattgtatacctctgtcatgcacttgttctactgttttacctgacctataccacttggtatttactacttgacttgacaatctggaaaaaaagttgacctgatccatgataatgtcaattaagcaacagtacactaataaaatatattcccgttgttatgcacaagtaggttgttctcttgagattgtttgcattcgaaccacttcaatagttcaatgacacccatatggtgcgagtatattcacaagtgggactggttctgtgcaattgtaatttgagctgctgtgtcctttgcttgattggaattgcatgctatctgtttgctgtgtccatgtgggtgtgcatctgtcattgttggtttccaattataggtaacatagtgcacatcagatacaaagggcctcaaggctatactgttgtgcacgcatgcatcgtgagaatgaggcgatgagctcagcgtgcttgcattgagctcctagctgcacaagctctgccatcggccggcacgggcctcaaagtcgaccactgctagccctttgagccctgttgtgcgaactcaatcctcttctgttgccttgcgtccgcctgctagtaacatcaagtgagcttagctaattgccgactagatatattaggaaatgacgacgaaacaaaataggagggaatctcgggatgagatgtatggaaagacatttactaattttatgtgtgtaaatgcaagacatatttgagctgctttgatgtcggcatatgttcttaacttctcataatatttttatgcacaacgaattaatattatatggtggaaaccgttgtttgtttgttatttttaatcgtcttatgagttgtaccgttttaatatgcaagcattgtcattcttttacttcagtatgtcttgtgtgtctgacccacctaatttttgcgcgtgctccgtcactggtgcacatatatgttttgtttccttgctggaatacttttagtatttcagtaccagcatttactaattttagatgttttgatttcccttttctgcagctgtgcttgttgacaatggcaaattccttctatcagcaaaaagaaactggcatgcaacatgtacagaatatgtgatatctatgaatgctaacaatttatctaggtctaccaacacaaacattggaaaattgaggtattaacccgaagaaactacaaccttatttcagaacttaccccattttaatctaaaaattattgctgctgctaatatgtctccattttgaattgtaggtcaaacttccttggcacaaagtttgtaatatatgatacccacactccgtacaatgcaactagtgattcacagtcagggaaaacaagccgaagattctccaacaagggaacagcaaagcatccctgcagcacatatagcatagcaaacatctcatatgagctaaacgtctttggaactcggggtcctaggcggatgtgctgtttaatgcactccatccctgcctcatctcttgaggctggtgggactgttcctagccagccggatagcatccttgcccattccctcaatgaatcctcctttaggagtgtctccttttcgaaatcgtccgttatggaccattccatgcatttcagcagtgctcagttctctgacatctcaattggagatggcccaaggattgggggccgggtattgagcgatgatgaggagtgcaaggagacacctttgattctccaaaacaaggctccaagatggcatgagcagctacagtgctggtgcttaaacttccggggccgggtaactgttgcttctgtcaagaacttccagctcatcgcagccacgcagcctgctgcgggagccccaactccatcacagcctgttccaccacccccaccagagcatgataaggtcatactgcaattcgggaaggttgccaaggacatgttcaccatggattaccactacccgctctcagccttccaggcatttgctatctccctgagtagtttcgacaccaagctggcctgcgaatagaacttccaggcaggccagaaacatcatggatgcttcttatttgacgccctgagggcatgcccctggatggagctgaccatccccaagtttagcctgggacgccgttctgttgtatgttactgatgatgtgttaactcagaaacacccaagcaacaaaaggcaaattgttattttagcatttagcttatttattctgattttgctttgtaattgaatgttatctttatttctttttgacccatagctctctctataacaggtattctgtatgtgcatcggataattttcgcagaattcatttgactgttctccagtgatttattaactgagaaagctaataatttggtgattcaagtccacatgatttcagttgtgaggtggataattgtaccttgtattaggctcaagtagtccagtgtcaccatcagaaagcgcatactatgtttgcttccaagagtgaccaatagttaggcttttgcaacccaaatcatgcagatcttatcacggcaggcactaaaataaaccgatcttgtacaatccatgtaagcctgcatctccatccaaataaagattcgaaagtgacttcctattttagatacagtgcttctctttctagagttaggtggccagaaagggacagtagaggatacaacatctgcttctattacaatcaacttttaccggtataaaaaaaaaaggtggctttaccctgaattaaggtgaaatatatcttgtttagatcaggaggtatctagtagcagtgactgaactgtcaaatgtaatcgatcaacttggcaagcatgaacacatttcctgcagcccaagaaatactaaagaattgggaccaaaaacatcaattcagatagtatatattcctatcactgagagcgaaccattctgataactgagattactgaccgcctcattctttcgcttatgcttaaattcttatctttatggcttattagaaaacaaataataatttatgaacacaacttttgtacaggtgtccctaccagttcaaaagcaaatcctgtaaaataaaactatggtgaaaaaagcataaaattgatttcaaaattagtttttaaaatacaaaatttgacttataagcttaggcgaaacgatagggttgtgtgagtgaggccatgaagcatccatccactttaggagagaaaaaagaaagaaagggaaccagcagatgctccctaatgaatgcaaacttgatgtatcctgaattcttcttgattcccaagcaaatgaaatgacgacgtgtcagtactcagtaccaggtactgtaggtattttatctgatactcttagtactcaggttcagtgcatgtgtctctgcctatatacaagtgccaagtgtgtgtgtggtcaggcttcaagtctgaacttttttctctggttgaaattagcttatggtctgaacttgttcaacgaacaactaccaccgctactggtatcgcatggtcaacacttcagctggaattttgaccggttcatgagaccaggtccatctgtacgttcccttttattttcacgtattaagagtatcagatatttttcttcgaatccattactatgtttacattattaattttatagtgaataattaaattcctacttgagtgacgaaatttaaaatcccccttgtcaaaactctatttttaacacatgactagttaattgcccgtacattacgataaaaaaaattattttcacacacaacaagtagaattatgtaaaaaagcataacttccatgatgggatatatggaaatgtacctctagttgtttggcttctattggttagtttggcttctattggttgtgcctagctttccacagctaaatttgtcataagtatggggctttgccatacaaaatttgggcatatggccaataatttgttcatcacaagtatggtaatgtttggctataaattgtatctatgatatgtgggtctataaagtagtaaaatgtgacttgccacaatttcaacaaccaaccaaacactaacctaacaaactacaactagtctaatagtatttggtttggcaatatgtgacatgtaaccagacagatccataggctattttatgatcctgtgttcaacaggtttaaggttttcgtgaagaagtgtagttaaggttaattttaggacggagatagtatatgttaatgctaaagtaatatatggtaacaaactattgcataatttaagagtaaaatgcaccagcggtccttaaacttgtcaagaggtttcacttaggtccacgaacttgcaaagcgcacatcgaggtccctaaacttggtttattgtatcatctcggtccaaagccgtgtttgaccgtggtcttgcctacgtggcacgccacgtggacgatgacatggattttttatattttttttctcccttcttacttcttttttctcttttatgaaaagacgatgacatggacgatgacgtgtgcgaggcattttcgtcttttcgacaaggaagaaagagaaaaaaagaaggaagaagggagaaaaaataaaaaagggctatcgaaaagacgaaaatgcctcgcacacgtcatcgtccatgtcatcgttttttcataaaagagaaaaaagaaggaagaagggagaaaaaaatataaaaaattcatgtcatcgtccacgtggcatgccacgtaggcaagaccacggtcaaacacggctttggaccgggatgatacaataaaccaagtttagggacctcgatgtgcgctttgcaaattcgtggacataagtaaaacctcctgacaagtttaaggaccgctggtgcattttactccataatttaacctatgtttaataagagcagatacaattaataatgggcagtagtagttccacgtaggattttgtgatgatctggaggagagaggggaagagagagagagagatagagacaacgactaatttgttgtcgggctgcatgcgccgcttgaggagtttgtggggcctacctagatggagaagcatcggccatgccttgcgttggcctgcctccgttgccaactcccgcggccaccagaccgctgcccttagactcacaggtgccgacgcacagccgccgctgtctcccacatccgctgcacggcccccgtcatccctcgcctgcacggttgccgccgtcttccgcctctgcagcgcggcccggccaccgctatcttcgacgcccgccgcacggccaccgccgtcttccacctccactgccatctcctgcgtctgccactgccgtcttccgttgtcggtgacagcgaatcgaagctagctcaagaaagaagaagacatgaagacatgaactaaggggataggagggagaaagagaatgtgaggtaggagaagatggtgggtcccacaaaacaataaaatattcgtgttatagtatttctattgtagacattagctacactgcttactatagatgtcatggctatttttttgaagccaacagcgggctatgttattgaccttgctctaagcatgtcaaaattggccggtagaagggacactaaacaatgtacatagactgtgtttagttcgtgtgccaatttttttttaaagtatacaaacacacatttgaagtattaaacgtagattaataacaaaacaaattacagattcctcttgtaaactgcgagatgaatttattaagcctaattaatccgtcattagcaaatgtttactatagcatcacattatcaaataatggtgtaattaggctcaaaagattcgtctcgcaatttacaatcggactgtgcaattggtttttttttcgtccacatttgatgctccatacatgtgttcaaacatttgatgtgacgaaaaagttagaagtttgaagaaaaaaagttaaaatctactcgaaacatagccatggaagcaggggttaccttaccgccgataactgcgcggttactgcggttaccgggcttatcacggggtacggtaatataaataccgcggtaacctccttaaattcaaataagtttaaaaaacaatttaaatttttgataaattttacacggttttatacagtggtaaccgtgcttaccgccgggacgcggtaaccccggccacagtggtttgggagaccctgcatagaagaccacatgtccatgtcataatccatcggaatggatgaacaaacagtagtgagtttgtccaattagaacatgccggctagctaggcatgcagcactgagcatgcaagagacaagacaagcaacaagtcctcttcccatacgatggcaacagcaaggcaggcttggatttgccttccctcacaagtcacaacaacaacggctgccggccgtgtgttccccggaaaaccaacccttggctatgctatcctctcattcgctggtttacgtgtccggccacgccacctgggcccactggcagaattgttttcttggagtactcccctttacactggagtatttgcaaattgcaagcaatggttttgtgacttttcttcttctagaacaatttaatatgtttttttaccaatcataaatatttgcagggtatttgtacacctaaaatttaatgtattggtgcacagaccgattttaatttgctcggtttttgatcggtgaatcgagggagagtagatgagttcatctggaaacgataaggtaaaccctcgattaatacgagactagtaccatgtttgttaacgagccattttttatgcgttttgggttctggccaccacttctccacgtcattgtagtagcattttcaatgccccacctttgctttttttgatttatcgtacctagtgtttttttatttcttgcatcacctcttatttttaagtcaactctcttctcatgatttgtgtagttaatctgtgataaaggaattctccaaattaattccacagcttcaatactttaagagatgtattaaccgaacaagatctaaaataaagttccatagcttaatacgttgattattgaatcctgtcttgaaaaaaggagacatatctgggagtatatgaattgctcgatcccaattattattagacaatagatgttcccggtgacattttcataatagaagtacttatatatgctgtttttttttaagaaagaaagaaagaaaaaaaaatccacaccggctaatatcgaatgccaccatcggtgaaacatttgctgatagtgtggcttggagaatgacaaaagtcgtacaagatcgagtggccaaaaagcatcgccgatttttttgtaatttgacggcctaccaaacgttaggcacaagtagtgtggatccccgaagattgatgcatgattgcgaccacttcgcccactgttgcttcgattagtacgggttacaaagcggccaagaacttcagaacattccgatgcaaaacattaacggtaatataagcacacgtagatttaatttatttcataaataaatcacgttattgactatgtatactaacataaccacgatatacgatctagacatatatactaaacagtaaaccctgagcacatcgaatagatgatacatggtgaacacataacgaaagctctggtttgttgtggattagattgatgaggagcagcgcgcactgcaggaacaacggcggtgctggatgtccctagagtgtagaggaagacgagccgtcgtgaaagaccagcaagcagtcacgcgagccgtttccaaaaagctaattatcgtcttctcccgatacagaatgtcgaaggacgaaggttccaagaggggacctttattgatttttcaaaaaaattaatctccatatgagccttagtagcccacgtattaattccaacaaaaatattgtacagaaatccgtacaaatatatgcacacttatttgtataaacgaacagtcgagcacacacaacatgacactatgaccacatccactttccgagggactaaaccagtgcgtcttaaattgattgcgtcattacaaacatctcactatcgatggatataaatcacctaccactaaaaatataattagcagtaaatacgagcacccatcttaaatttaggacttaaaattgaacaactatatttccatggtaagagaaattgtttacatatttatggttttattggttggcttcagctgataagccgtaaaaaaaaagtgagacaacagaaactaagattgaaaatttgaatttcagcttataagtcaacaagcaaacaatcagattccatttaaacaatacaataacatctcactgtacataaacaccactgagaatttagctaggacagaacttcagagtatgaaaaatttcccttagtccaggagaggattgagaagatttgaaagagatttattccacacctattataatgtgaaactatttcttctcaactcctctaattcatctctctaaaattgaaatgactgagtttactgattttttttaaaaataaaatcctgcaatataaaagagcatatcacaaaactccaaccataaccagcagcctctactacgtgccagctcaccatgtcacgcacacgactccagtccctgataggcttttgtacacctcaccccgtttcaccggcaccaacaacggccaggtccggtccgtccgtacaaccacccgcacgcgccgcaccacactccggctccgccaccctcacctcatcccaaccgtttccgacccgcgcccgtgcggccgcttgaccgtttcccactgccacctgggccccacctcgtcgggccccgcgccgcgcctcaccggtggccgcgtggcacccgcccaccggccgcgcccacgccccgcgtgcgccgcggtagtcctattcccaaactgcccccgggtcggtcgccggcgcgagcactggagtgcggggggtagaaaggtaaaatcgtgggggtggaggtgtgaacgcacgggccccgcgtgggaggggcgggttacgcgtgtcgggcccacatggcagggactctcgggccgcgtgtaccactcccctccccgcgtagcactagctttttgctgattgattcgtctcggctcgaggggcttaactcggtttggtttacttttctcttttgatttgatgataatgaattgatctaatgatcccctctgcaaatggcgactggtcaccggagtttgatcggatttgtttagttttgcgatttggttaagctaaacctcgccaattaatctggctgctgatcctgcccttttgcagaaaagccctccaggattgatggtttttgtgtctgcctcaaattggccatgcatcaacatgaagtatggccaattattgtgcatcatgtcagattgtcagtatagtcagctgatcactgtagtagcacagtgagaagaagatgaatacacaaacaacaatctttgctgatatttttcatatccacaagaggggcctggcctatttggaaggtatttctatggctacgatatataaaaccaaaatacgcgacgactgaaggaatgaaagataattttaggataaaaactatatgattgtactcttggcagtcaaaaagttcaaggttgagaaaacccattagactaattctagaattagggtctgaatttagctacagcttataagtcgtagctcaaacaagcatgctcgttaacgtattcaaggcaatacatttttaacaatgataagaggagaccggccgatttggaaggtatttctatggttgcgatatataaaccaataatacatgatcataacaataaaaaaataggataacaattttgtacttctactcttagcagttccaaagttaaaaggtcggcaaataaaccattgaattaattctaaaattacgacgtaaaattagcaacaacttagaaatcgcggctcaaacaagaagggctcttcaagtattccactatagtaaaatgctcgtacctcattctatgcaaaagatgacaatatttcattttaactttgtaaggacccaggagtaattacaacccttttagagcccctcctaccaaaaccccctgagagagaaagctaaacaaaaactagaaacattctcagttccagaagaatatttgcacccacagaaagaaatcatttacaaaccaaagattaaacaaatccaaacaatcatgattagctaagaccacttccccctaaaccccaaaatatcattaaactaatcccctccctaatcacaatcccatacatatatacacccatccatccatccatccacacatcaccacctcaccatctccatccatctcacccgttaacccgctaagctctctctccaagatccgcttcggtttcctctccggcgatctcgccggcgaccatgccggcgaccgactaccagggctcctcctcgacccactcccacccgtcgcccttctcctcgttcggccgctccctcctctcgctccgccgcgacagccccgccgccgccgccggcgcgtccccggccatggcgtccggcgaggaggccgacctggaggcgttccagcggcacgtggcggcgcacctcgccgatctcaggggcggggaggacgagctcctgtccatcgagtggatccggcggctgctcgaggcgttcctgctgtgccaggaggagttccgggtggtggtggcgctggcgcgccgccgcggggcgctgtcggcggcggcggagaagatggtgggggatttctacgagcgcgcggtgaaggcgctcgacgtgtgcaacgccgcacgcgacggcgtcgaccaggtcaggcggtgggagcggctcgccggcatcgcggcgtccgtgctgctcgccccaggggagatccacgagggccagctccgccgcgcgcggaaggcgctctccgacctctcggtgctcctcatcgacgacgccgcggccgccgcgggtggcggcggcgtcgcctccttcctctcctcccaccgcaaccgctccttcggccgcgcccgcgcgtcgccctcccgctccgcgacgctcgcctcctcctcatcctcctcgtcgtcgtcctcctcctcctcccacttccgctcgctctcgtggagcgtctcccgcaactggtcggcggctaggcagctgcaggccatcgggtccggcctggcggcgccgcgcgcgcacgaggggggactcgtggcgccggtgtactccatgggctgcctgctccacctcgccgcgtgggccctcgtcgccgccgtgccgtgcccggaccgcgccgccgcgctccaggcgcaccacctccccgccgcgccgccgcgcgccgcgttcccatgggcgccgccgctgctcgcgctccaggagcgcctcaccgaggaggggaagcgcaaggacaggcgcaactcctgcggcctcctcaaggaaatccacgcgctggagaaatgcacgcagcggctcgccgaggcgatcgacgccgcacccgtcccgctctccggtgagcgcgaggccgaggtacgggaggccgccgccgagctggctgccgtgtgcgccgccatgagggccggccttgagcctctcgaaaggcaggtcagggaggtgttccaccgcattgttcgcagccgcatggaggggctcgattcgccgatgctcaacgccgattgaaacatggagaattcacatttgatcgcgcaatgtggtggtgataggtaatgccgatcgaaccgtcgagaatttggatttgatcgcgcaaatgtggtggttataggtagctctcctgttcttggtttttttcctcacttgtggtggtctagtagtaattataaaatgtgtgccgttctgtaaaggaaggggggaaaggaaaggaaccatctttatgtaaagatgattccttcttcccatgttttgatgctgcatttggtgtatatcatggcatttttgttagtcctccatgtgtgcgcggctaattctgggagtaacttatagttgaaaaatctgtgaggtcgctatgaaatgtggcctgttgtcgagaatgtcgacaaaaaaattaaacaagaaaaaaaaatctactgtggtttagttcgattgtgttgtgtcataattcatgtttggtcctgatatttggatggtttaatcaaaaggtcaaatcttgaaactatcatgcgtgcaaaattcagcaatgtttgacattatgaagtactgctgtagcggtgtagactttttccatcctttcagttctacatatggttctgtgaaatccttaatttggttttatattcaatatgggaatctttttaagagttcctcattgtggattgcagtttgtgatggatcagttctgttgtccaatttatttgaaggcttcttgccagcagaaaatataatatattaagaattagattaggagatcaacatggatagagtgcggagtaacagatttcacattacacacacttatgagttaaattctagtgccaataatgataagacccctgcaagattgtctgtgtgatattgtcaataatctatatctaggtgatcttcttatctcctgcataattctatctgacataaaagatcaggtcaaactgtattagtgctgctaccaaactattataaaattaggatggaaaagatactagtgcagatcttgtcatatgttaataaacaataacctgattcactgaataggtgcatgtcggctttgtagttcagcttggttagatgtactcctgtataatatttctactttggttgatgtacttgaccctaatatttcagtcttctgtgcaatctttttcatggttctggacttgtagttgtccctgacaccaaaactcaggcctgaacaagtgaacatttccacttgttttgaactagtgaatgcttctgcatgtcacaactcacaactgaaactcctgagagtgtttgctaatcttgtacataaccaatagaggaaaaattcagcttctgatgtacctaaaaaacccactagtttgagatgcattttctcacagttgtggcaaaaggtcaataatgatgtgcagaagaagcacaaggttggaagaaaagatctgatgatcctcaattatagtgatcatctcctccttttacctctgaaaatgtagtattgagtttccatcatcatcatccagtcactgtcctgtatcctttgtaacctaaagtatttctccaattagtgacaacattataatggcttccctgctggttcatctgccacgtgttcacattataatcagtgccctcctttcatgagctttttgttcacaagatgtgctcacttctgaaatgagaggagcttcttctgttgtgctcacttctgttcttcatgtgaatcatatatcatcctgatgaacaatgattcatcatcagcagtagcagttacagagaccttgtgcagatgtgtggctggtgtgatgatgtgagctgtatcattcggaaggcctttttgtggggttgaattgcattggcttgatgatgaggtgtttgtttcttggcgctttttccagctgttgctgaaatggaagaggtgagaaccggccggcgcatgcatgtcgcctctcacctgctgctgcgtctgcgtgccatttggtcccattccccgaaattttgggcgtcaccgcagcgtcatgctggcgtcagcgtctctctgtataagggcccacttgtcagccatgggaagattcaataatctggttattattatagtttggaatttttcagagattaaggcccatgccagaattttgtccaggccggccttaccggagggaggtctggttttgggctttttaagcccaacct

SEQ ID NO: 1985 - DNA, 13442 bp, Oryza sativa
tatggtcaaaagtttttgagctgagactagagtaaagatgaaatataatatttactagtgatgtactaagggtgatgctaaatttaaagttgcataatttctaaatttttactcaaacgttgtgtttgaagcacgtgatctaggggcattcttgtctttcttaacaatttatcttttcaattaagtcgaaaaattcatatagcaaattacaagttttttaggatgtcttttaaccatgacatgtttttcaatgtctataagcaaattacacaaaatttgggtatcatgtagcaacatttacctaaaaagaaaagaaacaaactaataagcaccaacacaagacgaaagacccacaattattgaattctattagtgaaccttcatccgaagttggcaaaaatttacatgaccgttgactcaagtttacgacatgtatcatttattagcttgatgtctttatcacacttttgtagttgagcctaacaccaaagccactatgttaatgcttttgcagtattaattaggtgtcgcacaaatcagaagaagcattcagctcacggtagcgcatttcctagcatgccactgcagagaagctacgcttcatcatgggatttggcaacaagcatggttaagttttttgacctcttgaaccccccctcgttccttgttgtctatgatttttttttctctctgtctcttcgatccgttttgcttcgttctaccatctgatttgatttggttctattcaagctgtgctcatgttctccaatgcttttatttgacaaatggacttgataattttaattctataccatttcatgattgtgcagcaacatgagctacctggttgcatacttttccattgctcatctgtgtgtggcacattttcttccgacagaaaggcatttggaggtgagcatcagacagatggggtcgggtgtggttaacctcttgcaaccgtggatctaatgttgcttctctttgccaaagttcaatacaataacgtttgaaatttgaaatgtgagttggcgtttccggggttccattgtataatcagcatattggattgtttggccatgctctttgcgacccataactataattttgcactatacacaaattaaatagtaattttgaccagcaatagtcacatacttgtaattaacacaaaactattggagggatacaataattgttgttttatgagttcacaaccatacacaatcacctatatgatagatcttcgaaaagccacacaacgtcagagcacacaatattttatagacggtacatatcatagtatagcacacaaatctgcttctcctcatcgaaatcctcgtattaaaacaattccgtttatatgaagagccttatttatacagaacccatatagaataattaagcgatatagctagatacctggatgttctagaacgaaccatttattggttcaccttacaatacttttgtggttttcaccatagagaatctccgccgatcgaccgtcgtctcgatctatgctgtttaccactcgatccctgtaagtgtgaaagataagtgctgaaaattatgcatatagccaactaatccgaaaacatttgaaatataggttgagagttcaatgtaccttcaaaagaagtccggcgaccaggtgacttcaaccactgcagggttgtcgccgtgggatatctgttgtatctgctggtcacggccggcggcgaagtccagcttaccttggaaacaagtgtaattgatactctcttcttcgttggaagtttcaacatacagcttcgcctctatctcaacccgatggtggagtggcaccgcaacaacacaccgcgacagtggaatggtcgcggtgtcagaggtgagtgccactgcaaccttgttctgcgagccatggctgaagagcatgctcgcgacgtcgaagcagtggtgcgcaccgtgatgtcaccgtagacgaagagggtgtcactgccagcaaacgtggcggcgccgtctccagtgagaagcaggagcttgacctgcacggtggcctccacggcgttggtcagcaccgcgtaggtcacctcaacggggccaaggcttgtcctgatagtgtgagccaatatcctgtcagacctagtgtagttgtaatcgttatagctgtcccagaacagagtgccatcaacatcatcagatgagacctcgctctcattgttttttcttttcttatcaggatggacatcctcattgttggtatcaacttcaattagaaagctcccgtcagctgagatggccctatatggtccagtcagcaccaaattgcgctgcatgcattgtgaagggcaaattaatgcttatattcattggtttgaaaatatatatagtccatatataaatgacctcaagagaccatctatataataagtactccatctgattatatatatttaatcagctgttcggtcatcaacttctaaaaacttattacatgtcctaatttcgtaaaaccacatgtactccatatataagttagaccaatgatttttctttaaaaaaagttgcgcgttacacataacaacctcgagtaatacatacttgagagtcgtggatgacagtatgatgtccttggtggtgattgtagacgatctggccacgtttcccgtcaaagatacttatcataaagctgtcgaagtcggaactcacggccaacaactccactaatcgtcggccatggacttgacctgtaaattcgtcctcgtaatccgtcgctgcaggctcctcgtcgactacgggcgcgaagtcatcggacgccgccgactcctcatggtcttcggacgccaggtcatcaatgtcatcgctcgctgccgactcctcatggtattcccaagccaagtcatcagtcgtcactgcgggctcctcgtcgtttactggcgccatgtcatctatggctgcaggctgctcgtttgcttcagtggctttagctttagtgttggagtaatcaaaatccatccaatcgagaaagggcaaggaggcaaaggccatctcatcgggcgaggaggcaaaatgcatgacatcgagaaaggccgaggaggcaaaaggcatgtcattggcaaaggacgaggaggcagcctccgtttcggtcattcgcaacggcatcgcggccgcagcgttgagcagcagttggactactgcccgggcatcttcaacaagtctgatgggccatggccgccagccttggcgcagcgcccgtgacataagcccccagttccacaagtagaatacgtgcagcttggtgaggctggttgtctcgtcgtgaacgaagcccttgtttaccgtagtgtagtgtggcctcatccttgcagactcgcagatcacgataatcaggcgtgccagatcccgtttggtgaatcgatcaatacgatcatcttgccctcgctgtgtgtagcgcgacaacctatggacggcatctagcaccaccgtcttccgcagctccacctccaccaacctactcatgacctgttctccttgtggtacatcaagtaagtttctataagcgacgtcgcattctaaaaacttggatgattccggaagaatgggcacgctccacttcgaaaagcccaagtgaaaccattctccgttcatgttcctgaagcccataaggtagacattgtcatcccgaacggctacggttgccctgtccttcttcctgcccaccagattaatatacatccacctagccggctgtctaggagattgttgccttgccagcacgggaacatcatggatcatctccttatgcggatgattggcgagctttttccggagatcctcgatgaatttactgtagtcgtctgccatgatgttgtagttcacgtcctcaactctcacctccataaccaattttcttcggttcgatccatgcatctccaggaattagctcacctatatccagaggaaatatccagtgaaaactatcaaacagataaaaacaatgtaacttgtaatttagatcttttttcccattcaaattaagttaagtttggacttaagctagatttgacggtaatatagttcatgcctacacatgtttttagtaattctttttataaatttatagaacttttatgtccacttattattgaactagcatggtgtcctgtgcaaattgtgcggctagcctctttatatttactctcatataatagcatatatattttcttattttattattaaaatatcttagaataacaacataatttaaattttgtactaacttgaccaaactatcaatgtttactattcattttgtgttgtatatacgtgatagttcttaattattttttaataccaaatctattatattattaaaggaatagaaaaagaagcctccacgttcgctctcatggtctagaaattctcacattaatcggagaaaaagaaaaagaagagttcatgtagaaatacaatttagaaatagctgaaattcggaattaaaaaaaaggaatattagaagaggagactagagttcatataaaatacaatttagaaatagttgaaattcggaattaaaaaataaggaatattagaagaggagactagagtctatatagaaatacaattagaaattcggaattaaaaataaggaatattagaagtagagtatagagtctatatagaaatacaattaagaaaaaaatagaaattcggaattaaaaataaggaatattagaagtagagtatagagtctatatagaaatacaattaagaaaaaaatagaaattcgtaattaaaaaaataaggaatattagaagtagagtatatacagagtccatataggaatttaaaactaactaaaattcagaataaacataataaaattaaaagtagagtttagagtccgtataaaaatacaatttacaaataactaaaattcgagattaagaaaaacatgggaagaagagtttaaagttaatataggaatgcaatttagaagtaactgaaattcgaaattaaaaattaaagaatactgaaagatgagtttagagtccacatagaaatacaattaaaaataaaaaaaattcagaaataaaaataataatattagaataagagcatgaagtctatatagaaatacaatttacagaaaattcggaattaaaaagataaatattaaaagacgagtctagagtccatatacgaatatatataatttacaaataattaaaatttgatattaaaaataattaataactaacatatatataaaatacaatatgaatattacccattagtagtttcgtaaagttattgcaaaatttaaaattatgttgtcattttaatatatttgaataatatattgagaaaacatatatactattatatgagagaaaatataatgatgctagccgcgcaagctgcgcgggccaccatgctagttttagttatttctaaattatatttctatatggactctagactccttttccaacattctttgtgtttttaattatgaatttatttttattaataaattttattcctatatttattattttaaattcaaaattttagttttttttctaaattatactcctgtatgaactctagacttctctttcaatatttcttatttttcaattctgaatttctattatttataaattgtatttccatatggactctagacttttcttttagtaatgctttttttaattccgaattttcattatttataattgtacttctatatggactctaaacttatctttcaatattatttatttttaattttaaatttcagttactcctaaattgtattccaatattcccttcttaattgctgattttagttatttgtaaattatatttctatatgtactctaaaatcttcttttaattttattatttttattcagaattttaattagttctaaattcctatatggacgctatactcttcttccaatatttcttattttaattaaaataatattatttctaaattgtatttctatatggactctaaacttatctttctatatttctttttttaattttgaatttcagttatttataaattgtatttctatatggactctatattcttattccaatattctttatttgtttaatttcaattttttgttatttctatttgtattcctatatggactgtaacatctactttaattttcttttttaattccgaatttccattagttctactgtatacaagtatggactgtagtcttctctaacaatatttcttatttttaattccaaatttcagctattttaaaattgtattccaatatggactctgttttttttctccgattaatatgagaattttctaggtcacgagagcgaacacttaataagttaatagatttcacttatttttttagttttaacacataatatccactcacctacattagggcgtccaagttaatttaatcttaaagtgagcacttatatctaacttgtatccacatgttataaaaaataagctaaaaggagaatattaagtaagagcaattacaatagcaggctataagacatataaacacatgtggatgagataagattgtcttataaacacatgtggatgagataagggagaagagagaaaggaaagtgggctacataattgtagctaactgcagcacaaactccaatacactatgtgtgtatgaaaggtgggaccaaatattaatggtgtgatatatatatttataggtacttaactatagcatgaagactactagattgattatagctgacttaaggttagaagttagctatacattaaactcgctctaaaaggtatctccaacttcactttatagaatcattaatttcttttcgtgtgcgggccaccagggccctgtttggttccatgggctaattattaacccccaccttttagccctgaattagctcctgttggaggtatgtcacgagggccttcagccaacctgccgaaaccattcaaaccatctagcattggctaagtcccaaacgaacaccaaggggcgaagccgaatgacgaagaccaaatggttcgccatcatgccagggcgaagccatggaatgaagaccgaagggttcgcctcctagcctgccaatcaaccgaagatccatcgcgggcgaaggctgttgtgcgaagcataaggccatcgcctggaatagggaatgcctttggctaaaggcttgggaggcccagcggcccatagaggcccttcgccaactagtgggctggcccaagaaggccgccttagggtctgtgaataccgaagacactgtatacccattataatgtctcaccatctagtggaggaccattcttggggtatacttccattctctctattcaattagaatttttactgttaatcgcaatgtcagcattgcgttactatgtgattgttgatgcttattctatattaagcatgctcatgttgattatatttaccactatcactggatcaaatcccattccgaatatcatgtttattatcttattattttggattaaaatatgcagaattatgaccaaatttccaacaggggtaataggcaattttgggctcatatcgagtccacctcagactccaggagcagtcaacactaaaattgtagcctagattgcattcggactctgttttcgaaagtccacgtatgcatggaaagccaacgagagcacatttccaatggatctggtcccacgttaaattccttctgagtcaacatgatttgttgaaacaagaaggcatctagaatctgtccaggtgggcccgttgggctgtgtatcgtgttggagtacaatggggacacatcaatgggtccaaggttgaccctagaatctatatatttagtattaatcatcgagttagggttaggttttgcttagattatttttgttattgcaattttgccgttcatcggtttgtggaaacccaacttcgagttctttataaatcattcatctgcaattgagttgtcatcttttttgttcttgttcgtgttctccaattcgcatgtagggattagccttctcaaggagatcaattgagtttcgacactatcaataaatagatgagacgtggtgttgctagagctggtgaaatgagaatcctgagagatgagcacactcctggacatgttgttggagctcactgttcaacagcaattcattgcagtgctgctatcgttcatcatacatggagaatttaaatggactacgaagttatatggggtgaaaataattgtcctgttcaattaattccaattattgttttatgtctagccagaaggatcttggacaaccatgggatctaagaggattcactttactggcttgaggacaagctgaatttcgaagagaggggattgttaggaccggatgggctcccaaatggtcgttacaacaattcactaaagctagcccaaggcagataacaaaagcaacaacggtttttttaaggggatcaaacaacagatgcagaatggcaacggggaaggcttgaaattaacttgatcttcctttcctcctacctccaaccctttccctagtttctagaaactcacagaaacttcttatctcccattttcttcttcttccgccaaaatacttgattgctataatgctagttgttgcttggagaaaagggggcctgttaacatgttactcctttaataattttgtatagtccatcagttcataaatatgtgacattttgtattcaataattatatatcttggtaacttttggtactttgtctaaatcattttacctgcatgtattttatgcagtgagttaagtgccattttgttaaatggatggaacatggtccaaagtgcaaaggagggtaactatacatgcatggtcctagttcatgctgaaactttgcctattaaagctggctcaaattgaaattcaagtatttatgaccgaaaagagaactaagataatcaaacgggtaatatagctgaacgaagaagtggtgcttactgctcggatgacggtattcgatcgattggtcgatcaaacaacaactaattgcgtccaaggacaccagacttgctagcttcgcaaactaagaggtacagtatgacagttgcagagttgcaggcacgatctgttggtaatttataggcgtaacaaatcaatcgaattagtatcatttcagtgggacgaaggaagtactatataatatccaacgtagaaaaaaagaaaggttgacctcaggtcagcctagccgtagttttcacggcctggtcgtgacttgtgaaaagcatgcattcagattgctttccggccggtctccttgctgtgacatttcgattttgctgtaagtttagttgacaaaaggcatagaagaagtcaaaccacattaagaattacacggtaagccatacggtaagcagtatatattcacatgtttaatgcaaacatctcaatccatcatataaatattgtccttggtcagtataattcgtgtgatattgagatcatcagactgtaagagagactgtcatatggctcttaattactctacctccttgacaaggggtggttaattggctgcccggggtacgttgacaccaggtcaccagcgaaccaataaataaacagttggcgctggcgctgtccgcgctgcaccggaaatagacagacgcttacagatcagtttccacgggcacctcgatttatataaacagcaggatttgtatagtgaagtaaatggttaccaagatcgagtgcaatgcaaggttggacgaaacaggagtagaaaaaaaaggaaatctaatccttcaagaaacgtacgtattttaaaaacggaccgcgtgctaaaagcttatttaaatgttttaaaagtaaacctcaacctaaaatgccaagtaacactgagcttcaccatttcaatgccaacgagactagcactaaacactattatagaaatcatctttcgtggcagctattttgggttttcgttggcggaaatcgcagccgtcataaagcaaaggccagtgaaaatgttgatctgcgcatagagaaaatcgtgctcctaatggtgctcgaagttactgtagctgggtgatatagttcagcgcatttttcctgacggtcgtcatatgtcggttcgtttgaaccgccattgaaaataatttgaggtggcggagggttaagaaggccgccagcgaagatgtaggtatcttcgctggcggtccacgtcaccacaccgccagcgaagatatatatggcatcttcgctggagttaagttaagagggccgccagcgaagatgtaggtatcttcgctggcgggccatgtccccttaccgccagcgaagttaccatatcttcgctggcgtcaacttaagagagtcgccagagaagatatcctatcttcgctggcggccgtcttaagttaaccgctagcgaagatgtgtttccactggcggcccttgacctctcacccccacgattttttgcgctggcggtttttccacttagccgccatgaaaaatatttttcaaacgcgtgaaaaattgattttctagtagtgtgacttccctaccgccatgggtacgagtctgatctggtggatcaacatggcgggtggttagtgtcttcaaataacctcagcatcaaatggacctagcaatgagataggggccttgatcatgagctcaaaatgactacaacatctactctctccagactgataatacttgtccttttgaacaagagtgaggtcaaactttcgaatctttgattataaatcattttttaaatatttatcttttaaatatggtgactacatatatattagtcttaaaaagtattttaataaaatcatatatttgttaacgatttatacatgttataataaaaaataatgtcaaaattattttttgaaaactatgctcttgtccaatacgataagtattatcaaaccggcgggagtagataatatgatgtcatccaactcgagttttagcgtcaccagactcccgtaccgctactaactcattgctattctacacaccaccgttgttattgtctagcctcatcacatctagtgcagtcatagcattgttgagatctagaacttctaataaaaaaaatcctttacttcatcgctagaatcactggcgttgaggttgggaggtccgcgccaaaactcttgatgttgagtgttgacccccttttcacggtggccaccaactcactagggcagcatggcggcagagaggttgctgccctatgcaacgtttagttgttagatctcatcatcttcggacttagtattgaggttacagtcgaatttttgaaataaggttttttttatggtccactattaaattaagttttttaaagggtaattgttttcttgtccttattttaagttgtaattacgaatttatacctttaagcttcttttatgtctaaggaagtgaagaattttgccgaatcttacggtattaaattgttgagttcttctccttactacgctcaggctaatggacaagctgaatcgagtaataaaacattgttgaaattagtcaaaaagaagattgaagaacacccaaataagtggcataaggtgctttctgaagcattatgggcgcataggatatctaaacatggtgctactaaggtcactccttttgagttgatttatgtatatgaagccgttttgtcggtcgaggtaaatcttgactctcttcggtatatcaagcaagacgatttgttgagtggagactacaagaccttgatagggataatcttgatgatgttatcaacaaacgtttaaaggctttggaagaaatagagaaagagaagaagagagtggctaaagcatacaacaaaagggtgaaagcaaaattgtttcaagtgggagagggtactcgatctaaggagttcggtaattggtctcctagttgggaatgtccttatcgagtatgcgggattgttcagggaacgcgtattttttggagacacttcatggagagcgttttcagagagcagtcaatgggaactacttgaagaaatacttcccgagtgtttggcaagatatttagaaagttctatggccggtaattggattatcaccctaagacaacatgttctatgccttcaggttcacgttgttcaccaaaaaggtagggggtatgtgtttacacccaaatttagcacctaggattgaaataggaataattgccaaagtttgggatccaacggtgttttcctctagcaggccgatctgaccgccgtgtataggccggtcagaccgtggcctgaactccggtcagaccgccgacatgtggctggtctgaccggcagagtccgagcccgagtctgttttgtcgggtctcgaatttttcttgcttgggaaggcatgtttcggatttcttttggtttctatcccgagttggacgtggaggagagcctgtagagggtaagatcaacccctatataagggacaaggccggttcaattgtaatctatccaacgatcaatcaatagaatcgtttttttcaatattgcttttttactttcaattagttctagtttagttcgtctatctttgtcgatttgcgttgtaaattatccactgccgctgtgagagtgcgacacctctttgtaggtttgttctgaaaaccttccatttgcctacgagatggatagttatccctagttttcatctaaatcggctctgctagctggtttaatctatcaaaacccatcttgacctagtgcttgctgggttagggtggttggtgactctacaatcaccgtaaggcgtttaggtacagtgttgtgattgtgcttgttaacttgtcacaaaaagttgccaacagactccattgcaagcaccggcgttcttgggaggattgtcgcacgcaacaagcttctcgatgttggttgcgtcctgttctacagcgacttaagtagcggcacacatataggatcgaacgggttgatcctagagatggcaacggtgaattcaccgtcgggggtcatgcttgcgtccccgtcaccgtggtgaaaatatttcaccgtccccgcccccgtcaaccacgacggggctataatttctccatccctgatcaccacgcggtgaatttttcctcgtggtgaacccgtccccgcacagagaagggattagggattgtagtatgctcaccttgcatcgtcgctgtcgtagcttacgggggagaggccgaagccatggtcgacagatggcggcggcgacggcggctctcggcggcgcgccgacgacggctcccggtgaagacggctgcaggctggcggcgcgtcgacggaggctgccggcggctcccggtgaagacggctgcaggcccggcggcgcatcgacgaaggaggccagcaacgacggcttcagtccatggcgacggcggcttcagtctcccggcgagagaagg

SEQ ID NO: 1986 - DNA, 28460 bp, Oryza sativa
  unsure (1)..(28460): unsure at all n locations
gcccggcggcgcatcgacgaaggaagccaagcaccacgggttcagttcaaggcgacggcggcttcagtcttccggccaaaaaaagcaacgagtggtggcatgcgtggtggctcccggcggcgtcggtggtggctggcgaacggcggcgcgcgcggctcccggcggactggcgaccggcggcgcgcgtgactcggccgggagtggtggctggtgtggatttgggtgggtggaggatttggagtttgacctattgacttagggttagattatatatgtgcctgttaaatgggcttcaatattgtgggtcaatacatctaaaaagtctagaattcctcccttgtacagtacagtcgggtcaccgtggggggcggggacggttaatggttcacngtcnccgtcatcccgatgggtgagagggttttaaccattttattccccatggtgagtagatattaaccatccccgtcacctaataggtgaattcaccgcggggaaacggtgaacgggcccccattgccatctctacttgatcccattggcagggcgtgcgttcgcagaaccagctatatatgatgctgttgacgatcgatttggacttgcgttctttttccggtgatgagattgtcagagctgccgtcgaatttgaaccttagactagtgatcaacatgtacaacgtgttattggaatgggtggtgatgagatccaagtaacaatctcatggttggacttcccttggtagtgctctcatgaccatttactgtagctactcatctgagagcactccaaagtagagcaatttgttaatcactattagtggtgctcttatcattttttaccatttgaaaaagatactttactgaatgaccctcgctcatcttctaggttctattgaaccatatgagacaaagcgggagagggagacggcgggcggcgacgacgtggtggagtggtgggtgcggagggcggtcaagaagaggaggtcctcgccggcgagcagcgagagggtgaagtgcagcagcggcagcgcgcgcgtcgagtggaacgatttgatcctcaggctagctaatattattctgtcaaatgaaaaggactgttttgtatggtcgttccataagaatggccaaattttaatcaaatctatgtatggcgcgatcatgaactgtaaattctagtgggacttaaaaatttcactaaagatcaaggtctttatgtagtttcttcacaagaaagtagttctagcgaaagataacctggcaaaaataaaacttggggacaaacattgttcattctactatgcacaaaagacaatccaacatcttttttttagtgtcatgttgctcggtttgtttagagatgtgtgttttttgctttaatatccctccaccccgtgacgccaaaaatatttttggtaattggcttagaggggtatctaggtccattaaaaagattattctaataggagctagtgcggaggggtctattgggcgatcgattgccagggcgatcgcccaacgatcggatcccgcccccctccccctatagccactcctcccacttctccccttcctcctccccttcttctcttcctattacagtacaccacaaaatttttttaaaaaaacaaaagttagaaaaaattatgtataaaaaatttgaattcaaattcaaatttgaatcgggtatgtaaacttttgacttataaactttggatctataaactttaggtgtataaactttagatgtatagaaatactatatacaaaaaatatttgaattcaaattcaaatttgaatcggatatttgaattcaaattcgaatcggatatataaactttaggtctataaactttaagtctacaaattttaggtgtataaactttagatgtatagaaatactatatataaaaaatatttgaattcaaattcaaatttgaatcggatatataaacttttggtctctaaactttagatgtgtaaacttgaggtgtataaactttaggtgtataaatttactaaaataggaaagtaatacggcgccaaaaaaggaaaccaggtggagggagggagggggaggaggagggggatctgatcgccctgggcgggcgagggcaatcgctcgcccagtagcatttccaagctagtgttgtatgttggtcaatttggcgttgtcgtaatgataaagtttttaatggtaaccaattatctaaccctatgcaggttatcttaatgtcttcttactggctccacttttggtctaaaatgctaccacaggaggagcaggatactatgcgcaatggtgctacactcttcgaatcggtagccaagggtctattattccactatgggtgatgtagttccattataattgctaactaaaaaaatttatgtgatttaacgctagtcaatagtaaaggggagttggagatttgtcccatcactttatttctcattttgatttacttttatctttacctttttttattactataaaatttatggttgtgtgtcataacagaagctggagatgtaatccattttcattaatgtaaaaattaaacaggagcagcttcgacaatcaatagtcacatacttgtatattatagttaacaatcaaactattcgagggatctaaagtattgaaagaaataaagtttcttgcaatctggttgggccacgtcatccataaaacagggaccgtccgatacaactgctggtaaacgaccaccgtcggatctgcttaatgtgagccgttggatgcaacagaaattcagtccatgccgtacgatctagtgaaagaagctcagtacaaaaagagcaaacagtctagagacatcgggaagaagccaacgaggggccagatgctgtgcttgcctaattcttttaccccagctcataaaaacatactaggaactcaacaagcacttcagtagtatgagcataaaatgagcatttttttattggaaccaacagtaaacggtcaattttgaatataacgtttgaaccttttagttggaaataaaggtctttctagatttaattatcatgtcatacaatcttgcaaatattcaaatttcaagcatataatttcatgattatacacctgccttttatatacatgaagaaaagtctcgccaacaaattatgcctcaaataacacccgtacacaattcgcatggcagaaggtaaatctattcagtctcatcttaatgagtttaattcgctcatcattggtgattttgatttaattacgatgtatatatacatggctttcatatgggaattcaaagtcgtgcaacgcacgactaagtggctagtacaatatgagttcacaaccacacactgacacacaattaatcacctgtatgataaatatcttggacaaatcacagaacgtataggagcacatagtatatattgtactagtacagatcatatatagagcacacactaacctgcttctttactgaaatcgtcgtatttaaacaattccgtttatgtaaagagccttatttactggaacacatagtcatgtagagtaattgagagatatctagatatataccgacccaacatattttctggatggatgcagttggctgtccttgcagccactgtagtagttgtaactgcagataattaatctccttgtcaacttatgctgtttagcactcgctgtaaaattaaatattggaagatatatgatatatatggtcaatctaatatatgagtccaaaaaatgtaattaagaaggaacatacaacgttaatttgaagtaggttgatagttcaacttgccttcagaagtacggtgtccaagtgacttcaatcgctgggttgccatggaggaatatttgttgtgccagctgttcaccgcccgagtagaacacgagaatacgatggataaaagtgtaattgatactctcttcgctggaagttccaacatacagcttcacctctatctcgacctggtcgttaagtggcaccgcaacaacgcatcgcgacagtggaagaagggtggagcccgaggtgagcgccaccttgttctgcgagccacggctgaagagcacgctcccgacgctgaagcattcgctgcgcgcggtgatatcaccgtagacgaagatggtggcagcgaccgcgtggcggtgctgtatccggcgagaagcatgcagcagcttgacctgcacggtggcctccactgcgtcggtcagcaccgcgtaggtcacctcaacggggccaaggcttgtgttgatggtgttagtcaatgttatgtcgtgctcatggtcgttgcggtcgtcgtagcagtcccaaaacagcgtaccatcaacatcgccagcattgttggtatgaacttcgatcaggaagctcccgtcggctgagatggccctgtacggtccagtcagcatcaaattaccctgtatatatagcaccttcagagtttcagtcaatcaacaagtacttttctaatacacacacgtgtgcacacaactacacatatactgcctccgtactaaaatataacaatctataattggataagacatatcctaatccaacgaatctaaatttatcttctattatatactaaaagtctattaaacttcctaaaaacgctctcaagcggccacatggcgatctaaaaacgctctcagactgccacatatgatttttcttccattaaactttctaaaaacgctctcaaacgaccatatggcgatttaaaaacgctctcagactgccacgtatgatttttccttgaatgtgtgggtccaatgttgtacggcgtcgttgccctcgcctcccctcacgcgcctgtgtatgcgtctctcctccctcccctttttttctccacggtggttaagatctaaatcattattttgttactgattttaaataaaaattccatggatagatagcctaatctcccagttacgggtgtctcatgcaagcctacatgcatgtggagacatgagctaatatatgtgtgatcgtctaggaataactttttataagttgagttgtttgatgattagtcttttttttatatcatgacatttcaatcaattatttaaggtgcacatggactatgatttattgtcaaataaaaaaatagtgtgatccctatacctgcacattatacattttattacttcctccgattttaatagattgacaccgtgaactttaacttttctatatatatttgaccatccatctcattcaaacattttatataaatatgaaaaaaatagttcatctataaattaatcacattccccgaaaaaaaattaatcacatatattttttaaaattgagacggatgatgaaacatatacataaaaagtcaaaggtgtcatcccaggcccaccctcctctcccgtgctcgggcctaccccggtcatccgaatccagctagggtgtgtttggttcacggtcaagattggataggttggatgggatatggcggaccatattttgttggatagggcgattcagttttttgtttgattgggtaaatatggcgatccagttttttatttggttgtagggatgaagatggatttggtgatccaattttttgtttggttggaggaagtaggtggatgagcaggtgtggtcacctctcacttagaaagggtgagcatacccccctcatcaaattcatatatactacaaatcacaaattcccccaaaaaaaaaagagagagaaggagataggaaaaaaaaaagagaaggcctccggtgcctccgccgagctcgctgctcccgccgcctccgggctcaccgtcgctcctcttcccgccactgctaagctcgcatctggcgtcgctgccgagctcgcctcccgccgccgacgagctcgcatcccgcgccgctgccgagcttgcctcccgccgccgccgaactcgcattgccgccgtcgtctccttccctcctcccgctgctgccgccttcgggctcaccgccaccccctcttctccttgctgccgccgctcccgcttcccgttgccgcacccgcgccggccaccgtgcccgcatcctgccggccagctcgcccggcgaccgcctccctccctcgctcgcgggtgacgcgaccgcctccctcgcttgcctagcttgcccggggcgctcgggcggctggatccgggcaaatcggtcggatccccccatccagcatctgaggagaatattcctcttcgggccgccccatcccacccctgcccagcaaccaaacacccacaaaaaatgggccgccatgtcctatccacccatgtcctacatgacgtgaccccatcaaataggcaaatactaccaaattagggttaattatgcctctgtgtgacaagcttgcagttgcatagcttgtagttgcatagaccagaaattacatatgtccggcaggcatataggcatggacgtaagaaatagtccctgaattttatgattgataaacaacacaaaaaaaatttaaaattggtcatcccaatccagttacatgacgtgaccccatcaaataggcaaataccacgttagggttaattatgtctctgtgtgacaagcttgcagttgcatagaccagaatttacatatgcccggcaggcatgcatgcacgaagtaagaaatagtacctggattttatgattgataaacaacacaaaaaaaatttaaaattaaatcaaatatgtgattaatgctcctaaatattctcttaacaagttaaagaaaattctaaaaattctgataaagaaaaaagcaggcgtaatttaatttatatatggttatatatctaatgtcttttatagcaatataagttttctctatttttctatttttctaatggaacttcaagagtcagctgccctagataccataatttttgaacccaatctccagcaggtaattctataaatgacaaaattaaatttatcatgcaacgctaacggataaaattcatgaagaaatcgtacttttaaaatccaataggtattattcggttagtataccacccttataagcttttcaaattcgtgagtgtgcgtgcgttgtgagtgtctgctttgtactatttaattctaaaaaaaatacaacctacgactaaaatatgttcaatccagtttcaaattattgtattttaggacagagagaagtactggctggagtagtatatgcacatccacgaatgtgccatctttcattttcacaagaagtaacggtaagactatagctagaaacgtactccctccgttttataatataaaaaattttagatggatgtaacatatcttggtataataaatctaaatagacgatctgttaaaattcaatgtacgaatgttatatccacccaaaatcttttatattatgggacggagagagtccatatatatatactccgtcctccttacctgagaatcgtggatgccatcgtgatctcctcggtggttctcgtagatgatctggccgcgtttcccgtcaaatactgcgatggtacagctgtcaaagctggaccacacggccaacacctccactaataagcgtccaacacagtagtcgacggtagatccttcgtcgccatcagttgatgctgcaggagtcttttcttctacggaggacgcatgaaagaacggcacacgtaacggcaatgacggcggcgccatagctaatgctgtaggactccatctttctaaggaggacgcatgaaagaggggcacatgtaacgccaatgacgacggcaccgatggcgatggcaaccataacggaggcgccggtgggcagggtactgccggtgccgcctgacgtggcagatagagcactggcggcggcggtgaagctcgtggtagatctggcaaaggccttctcgccgtgttaagcagcagttggagtactgcgagcgcctcacttatgctgttgattccggagtttataagcctgatgggccacatcttccctccctgctgctgcaccacccacgacataagcccccagttccacaggtaatccacgtgccaaaggtcgagtctaatttgcctgttgcgaatgagccaaccatcgtttaccgtgttgtagtgtgcagccatcctagcagactcgcagatcacgacaatcaggcgtgctagatcccgtttggtggctccatcgactccacatcgacgctgcgcgtagcccgatagtctatggacggcatgtatcacagaaatcttccgcacgtccaccctcaccagaacatctttcacatttccaccaagtaagcttcgataagtgacgtcgcactccaaaaacgtggatggttccggaagaatcggaacgctcctcagcgagaaccccaaatggaaccattttccgttcaggttcctgaagccaataaggtagacattgtcatcccggacggctagggttgccctatcgttgttctcgcccacaaggttaatgtacaaccatctcgccggctgtttaggatggcattgccttgctagcacgggacggccgtggaagttagcctgttctggatgctcagcgagcctgctttggaggtcgatgatgaaatcactgtagttgcttgtcatgatattgtagtccacattctcaacgacgactgttctctccatcctccgatttattacttagctagccaagattattttgccacgccgatttcgttcggtcgaggaattttaattagtgtaacaagtactaaaacaatgcatatcatatactaatatattaattctctcaatctcaaaataaaccaacctagtataaaataagtcacatcctaatatcataaatctaaacaaatatacattctaatactacaaatttgaatagaaaatatgtcaaaaaaaaaacatacatacacaagtactagagaaatgatcttttatatcctacacccccaaaacacaaatatcttgattagattaaaaaacagtgctaaagatgctttactaccagttctaaaagtataagtccctagaaacatttttagcaccggttgttaacacaccaaccgagactaaagctagaggatctttagttcgggttggtgttaccaaccagcactgtaacatcaatctgaacttaagatattttagtaccgattggtgttactaactagtactaaagatgtcttcagggttaattaaaaaacaaagtatcttatccaagctagatgtgtgtagtaggtatgatggcaacacgcgtgaggcctgaggtgagagatcttgagttcaaatcccacatcccacatatcgcggtaaaccgtgcggtaaccgcggtgaaaccgcgaaaccatagagttttgaattcaattttttggaagtgatttttgtgcgattataggcggtcaccgcgtgattatcacagttatcgagctaccacggagtgacggtaaccccggcccaaacgataagataaaccctagggagaggtggtagcagactagcagttgttgccctctttttctccggtgtacagatcctcagcctcacctttataaattaatatttataatttttcactcttgtttgaggaatgtccagaccctcttcatgttcttgcttgtgattgatttatagttaatcttccggttgatcaatctgggattgagtgttcttgttgtcgaaggggattgattaagggatatgaatttgaaaacgtggatcatgggggcgggctcgaagaatcggctagagccgattcttggagccgccgcttcatattcttttttgctcgtacatgcgcatcaatgccaatttctaaaccggtactaagggctttcatagtgtgtcacgaagctttggtggacttcgcatgccacctagaccaaaaacaatgttagccacatgttctacaatgcaagatgtttatagtgggtcccaccactactactttacttttcacttttcccctccccctctctcccctcttcctttcccagttttccctaccatagagagccaggcggtggggcctagtgctcgccggcacaccacccccctcctcctcaccggagctcggcggcacaatagcgttggacgacgaggttagcccgcgccgtcaggggtggagcaccacctccgctgtgcctcccctcctcatccggctgccgcgcctcccctcctcctcttccacgcggcaccacgggttgaccgagagctcctctccctctcccccctcctgtcttcgtcggcgccctctcctccacccccaacaatggcggcggcggtgaggcttaagcgccggcgtggatcgacgtcgagctcccctttccccctcctcccttcttcaccccttccggttcttgtccgcggtggctgtgtcgccagcgctagcccggtcctctttctctctcttttcgacgagctcggtggtgtggatgcctctcctcctttggtcctttctctcttcccggagggcacgggacacgaaattgtgtgagcctagagtaatagttttgatgaggaacaggtatcatattttggctttccgtgcttggtgaagcaaccaaatgtgctgaggtggaggggaatctatgagttggccgattgaggctgaatgacacgtcagaagttgtttcagctcgactacccatttcgcaatgcggccgacaacgtctttgtttctcacaacttcactgagagggaaggaggagacaactgtgactatgtgggcttgaaagtagtggtgtagcttccttgatgtcatgattacagcgtaaagcagcttttggatctgtggatatcttgtctttgcgtcgtggagagcttcgctgacgtaatagactggtcgttgtactttctctctctcgacaacaatgacggtgctaacggaatatgacgtggcggcaatatagaggaataattcttcattaggttggggagcaacaagtacaggggggtttgataggtagcgcttgagtgcaacgaatgcctcttcggcttcctgtgtccatacaaatttgtcttgcttcttcagcagagtgaagaagggttgtcctcgttctcccatcctggcaacaaacctgcttagtgctgccatgcatccggttagtttttgtacttccttgagtcttgtgggcgacttcatgttctcgattgccttgatcttctcgggatttgcttctattcctctgctagagacaaggaaaccgagcagcttgcccgacggtactccgaacgtgcacttctctggattgagcatgaggcgatatcgtcggaggttgtcgaacgtttcccgcagatcgtcaatcaattagtcgcttgtcttggtcttgacaacgatgtcgtcgacgtatgcctcgacattgttgccgagctggtcgctaagtgcgccctggaccgtgcgctggaaaatattccctgcggttatcagtccgaatggcatcttaacatagcaaaataccccgaacggcgtgcattggtgcccaaatggttgtgccaggcagggaaccagcactgatgggtcttcttgggcagtaccgatgaggtttttttttttttggtagtggtcctgtgtctagtcacttaaccactatgtctggttttagtaacaaattatgatagggacaaaacaatcataattttacaaattatttgtattatttgcctacagttctgtattattcactggttgttttactataggtgtatacacacatatcaagtgttaaatgaattctttgtgggaaaatatgtagtataaacctgataattactataagataaaataagaactagctaggtggcccacgcaatcgcacgacaagtatccatacaaaattatttacatatgagttcacttaaaatttgttaaatggttatctcattattttcggactttaaaagactgaaccttatcatctccatatttctaattttgtagtttttaaaagtcacacctatcactacctcttactcctttgtcacccatttatttgcatgctcgatctattacggcttctattcgtcctccttggaaatttaaaattgcaccttataaattttagagttaaatatcttgttggctttcatttttataatttttagaagtcccgtcaaatgccgccactctactcctctactgtccgtccgtttcctttctttatcgtcattgagattttgaaactcgaacataattagtatcggtgttcacttttaactttatagaagtcctgccaaaccgtcatctagaagtcctctacaccctgcacgatacttttttttaattatcattgaatattttaaaatcaaatgtgattatattgtggtttatttttactttctaaaagtctcgccaaccaccgtgattgtgatgcttaacgagttgcccgtcatctctcctattaatcatcactagtattttatttggagttttgtttatagtttttacacttgttgcccttcctttttattgtcattgagattttaaaaatcatggtgattatcattgtggtttattttttactttatagaagttccgccaaccatcggcttaacagatgcctaatgtcctggctgtcgtccctcctcttaatcatcattgggattctatttgatgtttatttatatttttagatgtcacatcaaccactgtcgccctgctccttcgcggccctcttgcttctcccttttttattgtcatttgtcatcattgtgtttctagatggattgtgtttttctgaaaaattaatattttttattccgatattatgttatttataaattgtatccctacttgttgtactcataatgacgttgataagtctcagacatgcttttctggaatctacagtaatatttaagtttgcgctacatatatggttttgcattattttttttcatttgtaaagaatatagttacaacgtactcccttgttccgtaaaaacccaatcctgcgtttaaatatagacatatacatgattggatttttatagggcaaagggagtactttgtaacactacaaatgagtgttttttaacctatgacttaatgagttacggagtacaaattcgtgtgttctgacgctttaaaacagctctatacactagtccacaaacgatttttgtgtacgagatctcacgatatttgcaaacggaccataacttaccgtgtctggaaaaatcgagcggcattttcgcatatggctccttaagacgcccatatggaaaaatcgattttcctgaaggggccatatacgaaaataaaatttgaaaatatgcgaaaataaaatttgaaattttgaaactagtttatcttactcatatgaactccaaattggatggttttttcctaaatatttttaaaatcatgctctatcatgttattgtgttcttaatgctattattttggccattttttcttgtgactttgttttatcaattaaaattttgaatttaaaaagatgacaacttcaaataatattttgaagtagtagataatttcagctgaaaaagtcatgaacataaaagttgtagaactcatcaagatataaaattttaattttagccatttcttcatccgacaaagtgatagtaacattgttcaaaaaatttacatatctctcttataatttataaaaccatatgagatatatgttaaattggtgaacaatattattataactttgtcggatgaagaaatgactaaaataaaagttataggtcttgatgacttatacaactttgttgtttttgttgttgatgactttttcagttgaaattatttagtatttgaaatattatttgaagttgtcataatttaaaattcaaattcaaattattgaaacaaagtcatatagaaaaatgaccaaaacaaaagttgtagatcttgatgctttatacaactttattgttgacaatttttccgtttgaaatcatttactagctgaaaaattatttgaatttcttatattttaaaattcaaattttatatagtgcaatcaaattcggatggagaaatgaccaaaagcaaattggcagatctcaatgagttttgcagctttatttttgacaattttttcacatgagttcatttagtattataaaattcgattcgaagtttagaaagccgcatgatttttgcatgcgaacgcttaagttgtccgcatgtaaaattgcggaccacttaagatacccgtatgcaaaaatgccacccctatttttttcatatccctccactctcttttccctctcaccacttcaatttttttctaactcatttcctctctctacccctctattattttactctcccctctctctttctctcctctcctctctctctctttcttctatcctctccctctccctctccgagagtgggcgctggcggccaggagcaggctgggcggcgatggcgtcgacggacagcgcatccggcggcgccaccctcaggagggccagctccggctatggctacggcaggcgcgcaacggaggcggcggatccagtgagtgggcggcggcgcaaccgccatccccaactcaccgccgccgccgacaacgacgagaaggcgaccggctccattcccccccgatgctgcaaccgtcgacgaggaggaggaggaggtggcaatagcggtcgacggcgggcgcacggcctcctcccgcccaggtctggcagcgggagcggctagcggcgacgccggtgggagcggcttccacgacgccggtgggagcagcagcggtgggcctcctcccacccagatccggcggcggcgggccttgtcctgcacagatccgatggctggagtggacggcggtgggagcgggcagtggtggctcccacgacggtgggagcggagggcacgacgccggtgcgcggccgacgtgattttttttttgcgattttattttttttggatttttattcttgcatgcggcctatgtaagcaaccgcatgcgaaaatagcgattttcgcatgtggttgccctagccggatgcaaaaatcgtgactttcgctgatcttttcatgcatgcggctggtccaaccacatacaaaaatgtttttcgcccgtttgcaaaaaccggtttcgtagtagtgatatatcagtgaaattatgtgagaaatcctgcagtcctagagcaattagcaacgcacgcttttacaattgcgttgggatagctcaagagaatatgattacgatattgagtatatataaaactatattttctctaaaacatcggagatctggagcaaaatatagatcgtactatatgtttgtcttaattaacttcgttttgcggaccttttctggttcaaaaaacgccgtaccacggacaattcctcagaaatcgtgtgggaaacttggaatgagattgtcaattcagcggcatagagtcgatcaattttgcgggctatctcgctctctataggctgtgtttagttcagcgcaaagtttggattttggttaaaattggagatgatgtgactgaaaagttgtatgtatatgacaggttgatgtgatggtaaaggactgaagtttgtatccaaactttagatctaaactatgccataaatgtgtactccctccatccgaaaataaaaaataatcgaaatatgacccctactaatacaacaaatctgaaaaactctttgtccattaatctatactatatgtttttattttggacggaaggagattagtgtgtttttattttggacggaaggagtatttcactaatctgtagataatgaaataggcaataaagtgaacaaattaaaaacttacttcttgaccaggctcatgataattgcaaacaccggtcgatcgagcaacagcagtagagcttgcgtctatggacaccggactgactagctataaattggcagcagtacagaatgatcttggtttcttcttaattatatgcgcaacgaataaattgaagtaataatctcatctagctatctactgtgtgccagcgtgcttgttggttgctgcttactgtgcgcgctgtgggagaaggtaatacacacgtcccttttgcagacgtgaggcatatatataatgcagttgactatatactgatcgacattaattaattggaagaagacaatggtattaccgtgggcatttgcaacttgtattatcgaacctttgaaaacagtggttcgtgtgatttccatctaggaaaattaaaatgaaattttatcagagaatcattttgttctgtcagggcccttttagaatgcattattggaaaaatgaagaaaatccaaataccccccataaaccttagatagaaatccatccatcatcctgaactttaaaactagaaattcaactccctaaactttgcaaaatcgttcatattatcccctaaggtgattttgtttagtgatttttatctaatttgtatataacttggatgaatttgatcatgtgatatacaaattggacatatatatattaaaatctccacttaattaaatctttctttttatcactcgttagctcacatttataaataagaaccagtgtataataataatatagtatcactgtatgagtataaattggtgacttacaattgatggtatgcaaatatattatattagttattcaaagttgttcatgtaagctttcaaaatatgaaaaaccaccatccaaaatcatcttagagggtaatataaaatttagggggttagatatcgggttttaaaactcatgattctagatggaatttcgtccaaagtctaaggtgatatttggactatttccttgagaaattcttttgaaaaatacaaaagtagaaaaaacacattaaaaattttccatcgtggcggaggcacgcggcggggccggggcggctcggggaggaggggcacacgcacacggcggtgcggcctagagagaggtcgtcgtcatgcccggatccagcctccacgctgctccccggcccgccgcatcccggcaatcctcgtcgagtagtcgttcgatcttctctccttcctttttgtctagttctctcctagagtgctactccacgcccgacagcggtgatcggtgctccggcgccgcaaggttcgacgatcgatctcctcctccactccagcttcctcctccttgattcttctccttctggttttgatttccgtttgcgtctttctctacccactgatttgatactattcgctcagtgcagactgtccccgatacattcggtaatcggtgggcgggtgccgatcgatcgacgagagtattcgatctctcattcatggcggcggcgacggggtacagcgacgccccgaccggcgacgatctggccgcgtacgaccaactgcggagatcttcgcgggcgccgccgccctgcggcaccatcagcttctgcaacgacgtcatctacagccgcagccgtactgacgactccacctacccaccgccctgcgacacccatgtaagactaggggcggagctagagaaaagacgagggattcctacctttatttatgtaatactaacatctataattatagagcgatattatactaaatagttgcataccaataaataaatataagcattatttcttcatttgaagggaatataccacaagaaatacataaaaaaataaaaaatacgtaccataatgaagaaatcaactaataatatgaatatatcatgcgaatgtcaccgtcttcattcctccataggataatgaccttgaaaatatagtttaattttcaaccgagaataagttatgaaatgatttggtacaaattaaaacaaatttcttcatattgttcgtactatccagtgctatatagcaatctattaagaccaaataaaaattttcaagtttattttggcacaaaactacaaactaaggataagaaaaattgagagaaagagttcacttattcagttgctctcagctagtgctgctggctgcaatttttgtggggctcagagtagatcgataagctagggtgagcggccagccggcaagctccagctattggccgttgctagcttgcagcttgccgccgtcctcctccagtcatcctcctcctgcccccgtcatctatctctatatgcctctatagttgcaagccctaagctagcctaatcagtgcaaaattttggaaaagggaggcaaacctaccagggaaaggctttagtgctttacacatgagaaatttcttcgattggggctgccgggctgggtccccggtgaggcggcgagaaaagggcgacctcccggggagaggtgacaggtcagacgaatgcgaggagagagattgggcgttgaggcgactcaggcgagaaaatcgaaactaccgcttcggtatcacgcgaggcttcgaggggaagcgtcgttggacgtttcagtttctcccactgcttaatttttggtttgggagtacctatacatctttcaaaagatttttataatcgtatcacacagatttttaatatttgtattaaaatccgatagatataataaaaagcaaaaagcaattaagaaacaccataatgaacattaaattaccatatcctcgagaaaaagaccaaatccaatacaaaatttaaaatttacatgtgaagattcaaaaattacagtgtaacttacaaaagttacagtgtaagtttcataaattacactgtaacttacaagaaaatgcactgtaaatttaagtgagaaaatcgagtgagagataagaaaaaatcttccgagtgagatatagcaaaatcgttttggttttggggctttcttctggttgggcctttcaaatttgggccggacgagaggagggtgtggtgcctctatgctgtaggtatgaggaaaaagtgcatccaaggtccctcaacttgtcatcgagatataaaatcatcctccaaacgcaaaatctgataccgggcgtccctcaactgataaaaccgttcactttaggtctctcggtggttttgatcctggttttgtctgacgtggcggctgagtcagcgtaggacccacgtgggccctacatgtcaaactatccatgttagcctcctctcccttcctcctctcttcctctctcctacacacacccagatgagtcgtcggctctgtcgacggcggtggcggaagcgcgtctgcccaggagcggttccgtcggcggcgacgactgtagcgcatcggcagcagcggcagtagcgcgtccgcgcgtcggcggcggcggcggtagcacgtctgcccaggagcggcttcgtcagcggcgacagcggatgtagcgcgttggtgcgtcttcgtcgtcgttgccgccaccgccgtcggcgacaacctcctagggccggtaccgtcatcgcgggcaccatcaaaggagcagcgggagcggatgaggacagcggcggcgaaaaatcccgcatgcaaagtaattaagatcgatcgacaaccacatatttacaacagccaccacgcacatcatctcttcatcatgcatatatatacgcccgcatgcggagtaattaagatcgatcgataacaaggacaatggagaccaccggcggaggaggatctcctaaggaggcggtggtgccgtccgctgcctccggcgacaccacactcggccgccacttggcacaccgcctcgtgcaggtgggcgtcagcgacgtcttcgccgtgcccggggacttgaacctcacgattctcaaccacctcatcgccgagcccggcctccacatcgttggctgctgcaacgagctcaacgccggttacgccgccgacggctacgcgcgggcccgtggcgtgggcgcctacgccgtcaccttcaccgtccgcggccagctgctgcacggctgccgtcgccgcagccatcggttctnngatcaggtgacgggcgacgaagcgcggaagcaggcaccgcctttaggaatcaggagcgcgcgggcgcggctccgtcgttgctgtcggtggtagatcgtcggagcggctccgtcgttgtcggcggtggtagcgcgtctccatcgtcgccgttgtcgccatcatcggagacgacagcctcctgggaccggcacgcgcggttgaagcgcgtgggagtgagctcgaggccgtgttttccaggagccaccgccgcgctcctcccccgccgggcctgccgtgcccactgcatcggtaacgcactccccttctcccgcatcgtcgccgccgagcgatggctcgcttgctccgtcggacaagaggagaaaaatgagagagagagatgaggaaggggaaggatgggaaagagagagagaggaggctgacatggatagcctgacatgtgggacccacgtgggtcccacgctgactcagccgccacgtgggataaaaccgggtcaaaaccaccgagaaacctaaagcgaatggttttgttagttgagagacgcccggtatctggttttatgattgggggacgattttgtatctcgatgacaagttaaggggccttgggtgtacttttccctaggtacgagggtaacaaggtattttagattttgggccgggttcctgggcacccccttggtccattgggttccgcccctgtgtaagactcccatcgtattccacaattctagaatctgactcataaatcagctttcctgcgtaaaccatcagactttgtttcatactctgaatttaggctgtgtttagatcgtgagacgaaaagttttggcgtgtcacatcgaatatacggatacacatttgaagtattaaacatagactaataacaaaacaaattacagattccgcctgtaaactgcgagacgaatttattaagcctaattaatctgtcattagcaaatgtttactctagcaccacattatcaaatcatggagcaattaggcttaaaagattcgtctcgcaattttacacgcaaatctttgtaattattttttattgtctatatttaatactctatgcatgtgtccaaacattcgatttgacatggtgaaaatttttgcgtgggaactaaattgggttttagccaaaactgtacaacagagtctaaacctacacaagataaacctacacaagagttgcaaacattcgatttaacatggtgaaaagttttttttgtggaaactaaactgggccttagctaaaactgtacaacagagtctaaacctacacaagagtctcaagactaagggcctgttcactttaatgccattttcaaccataccctttttttttaagctgtcaaaaaaatatctatgtttaggttgtcgctaaatttgttaaatacataagaaatcctgccaaaattttaacaatattaccatcttgtcaaaattttggcattgctaaaatttggtaagttttattttggctataatatgaacagggcctaatattcccgtgactagtaatggcgaatgagcaattcaggatttgtgtagctccttaatttgttccggaccaataattattggtgctacatacaagtacattgctttttttcttattatagtgcaaatgaaaaactcaaaaattttgaactcgtatatttgcaactagcattcatattaatcaagaaagaaatagattaactttagtatttaacccaagtttcgatttggtttagcatattttcactttggacaccctttttaaacatcttcttgattcactttagtcccattttcctgaaccctgccgtctttgggtatgcaaaggacatcaatgcaacggcatggtcgagatgagcaccagagtgcagtttacgttgtcacacggagagtaacattgaggattaggtaaaaaggagttcaaagtgaaacaaaaaaaatgtataaaaaacaaaaataaaaatctaatattctaaaattgacgggttctcttgcaaaattatgcgccacgtggcaccaatagttgcgcaacgcgtgctaccgcttcatcaaacgctcgcgctacgcccgcactagagccaaactggctgctgctggggcgtgggcttcagctcgcctggcccaacaggtaggagacgggtgctgggcctgtttgtcttgggcctgccttgcccccccccccctttctttttttttccctctatcttccttattattcttttcttgctctatttcactcctacatgttgtaaagaaagctaagtgtaaaattataaaattttatatttaaaaggatgtcacgactattttttattacaaaaatctgagcatatataatctaataaacaaactggtatggacttagccactttctaaaaaaaaaatcaaatacatacattgtacaactatgtaacaaaggtttattaccctaccaaactttgaaacaccaataaaataacagcactgctatctccaaagaaaattataaactaactcaaaaatactgaaggcacaaaagggctatagtaaaaaagaaaatggagaaaaagtaaagttaaataataatgctacatcaatcatatatatgggaaggtaataatttcaaatcgcgcgtgaactcatttgaagtgatgatcctatcaataccatgatgcgtgcaacgatattatgctaagtcaatgtacaaacatagcgttgtatttttaggaaaaagtacgaattacctcttgaactatcgtagacgactgaattaccccctcgaactcgaaaaccagaccttttagaccctcaactattaaaaccggacaaataaccctcttaactcaatccggagtggtttcggtcctacgtggtatatgcgtggcagtccagtcatcaattcatttaaaaaagtcggtggggcccactatcaggtcactcccctcctacctctctccaccaccagagcaaaccaccacctcgctgctgccgccgccgccgccgcactcctcgtaatcgaccacccgcgcaagcatcacctcgaccgacgcgcgcagcagcgtgtccaggtcgtacggccgctccggcacgctgtcgaggaacaccagcttgttgccttcgcctgtcatcatcgccagcgagtgcgactgctgactgcttgacggcgacgtccttgtctcgctgtccgtcctcgccacggtcaccgtgatgggctccgtcatgtcgggggtggccgctgcggtggtggtgctccgaccagccgttgctctgctcagcgccggaagcatgccaagtaccccacggcgagcattgttggctcaaaaccgggagaaagcctttctacaccccaaaagctagctcatgaggtgagggacccctcccgtttttaagttggtgccactccccctaaactttcaatgtgggactattcccaacaatctctcccgtcacacattggtgccccttagccctgaccaggctccacacacgagcacatacaggcctcacacccgcggtccactgactggcccaacacataggcacatacgggcctcacacccgcggtccactgggcttcgggcttacaccacacgagtgtgcacggcacttagagagattgtgggcccagctctgataccacttgttggcccaaaaccgggagatgttggcccaaccgggagaaagcctttctacaccccaaaagctagctcatgaggtgagggacccctcccctttttaagttggtgtcactccccctaaactttcaacgtgggactattcccaacaagcatgacgatgagcacagccacgacgtcgaggatgatgccgatgaccgcgccacgggtgagcttccctccgcccttgctgttcccgagcgatgacggcagcagcgcggggttggcgcacggggcgagcagggcgccgcagagcgtcgtgccgaggaaggcgctcgccggcatcccggagagatccaccttctcgagcagcgccagcgagaagaacccctccagtaactcgccggtgagccggttaccggagaggttcagcgccggagctcgccctagctcccgcgtgttgatggaagccgaggccgcatcccgtttcgccgccctcgtctcgcacaccattgccgcctgccgccgggaatgctgccgccgccctcgcctagactgtcgcgccgtcctccgccacccctagcgcgtgccgttgaggctgcaagacgcacgctacctgctgctcctctcctcccgcgttggtgatgccgttgctgccattactcagtgctccttggtgactggagagagagatggatgggaggggaaggaggtggaagaaagcaaaagagagaagatgctgataagcggggcccactattttttattatttttatcgattagactgccacttgtgtgcctgtgggattaaaaccgcttcgagactaagattaaaaccgcttcgagctgagttataggaggtaatttatccagtttaaaaaatttagggttaaaatagtctagtactgtaattgggtaattcgtacttttttttttctttttttacaaagctataccttagcatgctccacccgagcacagcacagccggtctaaccccattccctgcgggttgcaacaagctagcgcagagccaatatgcatttttttaagataatagaatatatcatcccagcatttgcttaaaaagagttacatccaattattacaaagtagcaccccagaaacgagtaaacaaaggtaacctagccaaaataagaagaacacatttaagaagaacacatttattgaagtctatttgttaaccttcacccataattagcaaatagttacataagcattgactccaacctgcggcatgcaacctttaggaactccccatcatactcacatctttgtagcttgcctaaaaccggagccagtgcgttgccctgaaaattacctgcatatatgtaatagatggtgattagcatatgacaaggaaaaatactacctgctataggttacaacaaaatagaaatcgatgtagcaatataagaggctatattgattaaatgatttttttaaagccatatggacgggctagctacaaggcgagccaaccggcagccaattttctagtatgggctaaagggggtgtaacatggaacttcagtaaggagtccagactgaattttcactcttaaaattatttttgtgggatttgatatattttttaaaaatcttgtaaaattgatgctttcaaataatgcatattctaggttcaattggattattttttctctctcaaaacagggcagcatcatgctaaccagtccattgtttgccaccttggcatatgcccctgttatctgtacccattgtctccatgacggtagcgaacaaaatgaagataatgatgagaacgaggtggagataatctgcaatacatgcaacggtctcttcactgactacaacatggccataatcgaggctatatggccccgcttaggtgacctacgcagtgctgaccaacgtcgtcgaaggatgggtcactgtcaaacagggttcatcggggtgaacacgacgaccccaccgttggatccgaagccctctccactgcttccttcccctctcactagatctaggggatgccgccatcgatccatgccctccggtcaagaaaccctagccaccaccgctgctagcaatcggaatcatcgacccggggccaccttctcaggatccggctgtcgcgagcccgccagcgccggatccggcctttgcaagcctgccagtggtagtggaggaggagctgccaaggcgctcggtggctgctcccgctaccattacgcgcaaacagtcggggtcatcgtcattgttgaggttgtcatcctaggccatctccgctggatccaactgtggcaaggccaccgccgttggatccggccatcgtgggtccatttatgccagctcaagcctgttccgcggctcacatcgttgtccctccgggcgtcgtggccgctcttgtcgctgccttcatcacgaccgttgttgctgctcccgtggccagccggtggaggagggggctggtgaaaaaggaggagatgagaggagagaagtggggaattagatttttttttttaaagagaggagagaaaagaagagggggagaggattgagcggttgattttttactaggcacgcctcttaacaggcctgtctacacaaataaagcaatttacctatttgtgcatgcgaacatatcacaaggttcgcacacgaaaattaattttcacatacaggtatttgctggccacctcgaaaatctttgtacgtatgggtcttttttcggcccgtttgaaaaaaaataaagggggtgtgtctaaaaaaaatcaatttttaagcagcttattgaaatgatcgaatcaaacatgccatacacgcatcaaacggagctcatgaattaatatcatcgcgaatgaccttaacaaaattaagaacgtaatctactgctgcaataacaaaagtagtcaatagaagaatccatgaatgaaaatactgcagagcttcccactagttggtaaacaattgcgttgcatgcaatgcatagaacatcggacataattggaagtgagtcgataattaggctcctgcaatgatattatatataatctacatgaacagtaccctgcatagcttttgcacatatactaaattatagaaaatgcaataatcactaattaactagatcgatgcaactcatgcctggagattagtagaagaacatgttgaatacatgatacttacagtatcgatggtgatcaagcagcactgtagatcaatcagcagcaacgagcagtccataaagaagaagccgagtgaatcatcaccataaaactaaccggaggcaatcaaaattagagctagtgcaccgaggagctctgccgcaacgacggcgatttggaagacttggagagtaagaagatgagaagaaacagaggaaacaaagaaaggcagcagtagaacagcgaggaatttggcgtgttcatgggacagggattaatacaataagcgtttaaaaaaatggttgtatttttccggacgtaacgagacaagatgagtgtgaagtatgaccaaggtgcagataattgtagcacactgagacaaatcttgagtatgaataaaagggagtacagaggaaaaactaagggtaaaataaaggtgtccaaggtgaaattatggagtaaataaggtccaatgttaaacctcgataagaagggtccaaactgaaattaactctcgaaaatattttcatgggattcaatataatttttgtgaaaattatgtaaattttatgctttcgaagaatgcttaaaccacttttaattgggttatgttttctctcaaaacaggggaacctcgtgctaactggcccatcttttgccatctcggtgtatgtcggcattgacctgatcaatctccatgacggtagccaagaagaagaagatgacgatgaggaagataacgttggggagatattctgcaatacctgcacctgtgacttcaccgactacaacagtgccatagtcgagacggtcatcacatggtatggcccagctgaggtgacctatgttgtgctgaccaacgccttccaatgatatataggctgtgtttagattcaaaatttggatctaaactttaaacttcagtccttttccgtcacatcaacccatcatacacatacaacttttcagtcacatcatcttcaattttaaccaaaatccaaacttccccctcaactaaacacagccataggtcactgtcaaggtagctcgtcgggataacacgctggtcccactgccaccactggtgttcttgggaggatcatcggcaagctcttcaatgttggctgggtctactggcgtggctgtgctgtatgattggtttgttaggaagcaactgctgttacaataaaaggtttactggtcattttaagtcattaatatggcatcatttttcctaaattaactatattaacctggccgtttggttttttttgaagcattcagctttcgcaaaagtaactttgcgtcaattttcttaaaaactaggaaacatgcatgtgttctcgtgcattttatctcttgaaaattttcctttaagtctatgtctctctcatttgatccctgtgttttttttacagtctaattaacagtcattgatttatagagagcgtcggtttttaactaacctgcagtgattggcggcactgttgtgatgttttgtagtagtgtgtggtatatgaagtagtggttaaaatatcctaggtaagatagaataccttgatggtatataaatctctgaataattatgttgggcactgctttctacccagtgtcacccgcataaatattaataaaagatgatcaatggcatgcatgccgtttatctatgtgaacacatattccgaatctatataaattaggtgaaactccgcgtgttgttataaaattttagtataataacaataagtaaaaataatatataagatagcaagataatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1987 - DNA, 2220 bp, Oryza sativa
agcaatgatatgcgctatgatgaattcaacgcttaaatcctaatggtgtttgtatggtttgcagaagtgcgtcaagagagtggagaaggatgatactgggcataaacactgcactgggcaatatttcgactattggtcatgcattgacaaatgtgtaagtatctgcatgtgtgtgtgcaatatcgcatatctggaaccaaacaaatgatttatggagaagctctgcatatataagctaggttaataacatattttctgtggggtgcatctgcaggtagcaccgaaactccttgagaagctcaaatgatgaccggctgctacttttggatcagtgacttgttctatttgcgtaaccttgttcgcacttgaaactgaatgagttaattgtgtctattgtgactgtttgggtttcatgacttgtaataaaagccaccatttcccatatcaaagcatgtggatttattcggtctgagcattgtggacatggatcgtcatttctgttttggcatgtaatcgaccagcatcgagaaaagaaagaaaactgttccaagcatttcttaaaccttttcaaaccagaatcattctgatgccggaaacaagaacaatatcagaatattggaagtagtaagtagaaacatgctttctatagttcgggaaaatggaagcagaaattacattagatacgtccccactcaaacgtgtcactatatattaatatatctgacctagtgactatatacagttggcataaacgctatatgaatacagccggggaagtcatagtggaagagaatacattcaacaaaatctaatcactcaacaaaaaaaagtccgaacacagcctccggctgctgaagtaacccagctagtaagtaaagatcaacaaactttgtataagtaaagatcgattaacaaaatcgtgcatattgtactctgctttactgctgaagtaacacagctcaacccattgactcatcttgatgttcaatgcattccacccggaccagccagtatattccacatgtcctcaatgcattgactcaccctgttcttcaatgcattccacccagtttgaaacatagcgcaacagccagtacagaaactctgtaatgctaccttcactgtattcgtgaatggagtccagttgtcggtcttccactgtatgaagctattccacttgccttgaagcttttccgggacagcccgaagccaattccaaatatcaacacaaaagttcctgagcttgttggggcctatgtaacgacagaccaccacaatgctggtaaagaccaagttggttgctgtcatttcctgcatgcacacattagaaatactaggataaatacatttatatatgacccttaattttgttccaagtaaaattttcaccccaaacattataaaaatggcagtgactctacatgccacacatttctcccatcattctatcgcataatacagtgaagggatgtgaggagtaaagatatgttaagcacatgatgtgcgggaaaaatgcaagtttttttaaaggcccaaacatatatagcataaaaataatagtgtgattctttatagggcaaaagctaacaatagaaacaatcataattaagatgaagtttgtctagttttataagtgtaggtgacaaatagacatcgagtaaagttgaagtggtaacaatagaactagtaaaaaaaggacttatccattcttttagtagattccattatctcccttgaattgctggaagtccattttcaccctcaacgacaaaactaattgtttttcaccctaacttttaaacttgaacaaataataacttgaaccattcttggcagaatctagaggggttaaaaccttgaatcacttaccgccaatggcttcttcagtggcgagctccagtatcctcttacagtgaaaagccagcagtcgaatgatagcgtgattagcctgatcagagctgccgacaacttgatcttgcgggtggtaggctcatcatcattaaaattgttgtccaactgaaaaggaagaaagactaaataagaacaaagcttattcaacaaccacatatagagtttaaatgagagaaagccatcacctacccaacggccgataggcgaactcaacattagcacaaattggatcagacaacctatggcagcaaatgctcttgggatcacgacgttatattctgtgggcaccaacttagccttgatgaacgt

SEQ ID NO: 1988 - DNA, 7618 bp, Oryza sativa
  unsure (1)..(7618): unsure at all n locations
gaacgattccaagtaaatcccctctaaccacagtgttagcggggtaaagcaatcatagaaagttgaagcccaatttgtggcattcgagaagaagaccctgtattcacaaattcaccaattatacatgaatggatacaaaagaagtaaaaaaaaggggcatgcatcacagagtacatcatactagagatatttaactattagccactagctagacccacgtgtcagatatacgagggcccacatgtaattgacatatggatggcaaatagttaaacataaaaatttaaaaatggcaattaaaagagttcctaattgatgatgcacatataaatagcagtttagtccatcaataaacagagtatggtagattgaaaaggtagcgtaacaagccttaactgcctaaccaaacaattttaaggaactaatggtagatataagtatataacattgagatacaaaataagtcaaacattaaaaaccagctatttatttgtatttttctatttctattccaatatgaaaagcaccggtcatactctttgctagcttcacccaggagaagtgtatacatgctatccttagtcattttcaaccatgtcatccaatggtccagatttcaagctccaccatgtgccatgcaatccaacaagtgaactcactcgatccgatcctatcccctggaccctcgcaaacacattataaggacctgtttggcacagctctacctcccaactccaacttacctagagaagaagccgtgtcaaacggtctagatccttcattttttggagcggagctagcagagttgctccacaaaattgtactatgggggtggagctgggtttttgctgctccatctctccactccaccccaaaacacacattaccctttaatttttaaggtatttacgcaaaaaatgtcattgaacgacctcaaacccacctccttacccctctctctctttcctgtaaccctcacctctcccaaatccggtgcgggtaggcggcacgagggcgacggcggcggccctccggcgcacacgggcggacaacgggacctccggcgcgagtgggctgacgacacgcaagcgggtggcgtgcgggccgtgaacctctggaacgagcagacggcggcccttcaacacgagtgggcgaagcgcgggcggcggctttctgggccaagcggccgcgcacngncggtgtttttgcatttttcctttttttttcaatttcagatctggaagagaaatagtgattttgcatgcatgtgggtgattctatcacaaacatgaattatcatatataaataaacatgaaattatcagatataagaagccatgggcagtattgtccatctttcctcccttctctcttttaagagttttggaactgatcaatctaaccaaacacttttagatcattctcagatcctataggagttagctcctactggagttggagttaggagttaggatccaggcgttggaattctaccaaacagaccctaagactgttttaccctgccatcatcacgccctccaagctccctcctcctccaagttcccttggctccctcgacacgctctcttgacgaccaagagatcgtcgccatgcaaccccgtccgccagcccacacaactatcctcctcgttgcccgctgttgccctactcgccgcctaggccatccatcctcactgttctccgctccaataattgcacattgtttattcatagggctttattttgcacgttatttgtagcacggaaaaaaaagcagagattgttttttagtttagttatagaatgtctctcaacaaagatattgtgttatttaatctattcaaactatgcaacaataagaagcaaagatatcatgctatttaattgattcaaacctgaatttgttaggatggcatatacaaccacacaaaaaaatttgaagtatgtataatctatgtgcttctcccatttcaaggtccagcaaatgtgaatattttacttcaattggctgtggttcgtatactagtaatatgcctaagatcagtacatggaagtttatgttgatgaagtcctaagtgaataccaagtaccgataatgttggttaattttgtttttccagttacaaaggggtatatattttataaatttgggttaaagaggttaattttagcagataataattttcaaaatttcaatgcactgatatattttgtggaaaacgtgtattgcacgtgcatgactaagttagtaatgaaagaatgaaggccgagtttagttccaaactttttcttcagacttccaacttttccatcacatcaaaactttcctacacacacaaacttacaacttttccatcacatcgttccaatttgaactaaacttcaaattttggcgtgaactaaacacacacgaagaataaaataggtaatccagagaagaaatcagtggaaagtaaacaacaagtcgtactacatcagatttggatagaggtctcacaagaaaaaaatggcatgacatgtgtaaaaatataatcaaacaatcatgtaagaaaaagaatgtagtccagaagtccatatcaaataaaaacacaatataattaatgttactctcacttcaaacaaggtgtgtgtattacacgggctagcatcatattatgttgcgaaatgatctaagagcgaaaaaagaatgatctatttctccctccccatttctctacctattttctttccgtatgggcccgctgattatatataaccgtactactctgcactcctagtttgaacccgctataaatcaatcaaacaggagcaataataacaacaaaccaacaacgcgcgcgcgtgttcttgaggcaggggaaaacaacacaagatacatatcagccatgcaactagctagggattggggttttgaacattcaatcatgcaaggccaaaactttatcaggaatttaaaccatcccagtgcatcatgcaaggccaaagctttatcaggaatatatttaaaccatcccatcccagtgcatctggatcgatcgatatatatcagagaaggataatatatagtactacatacatgggcagtataaagtacagcgagcttgtccaagtgaatatgaactcggcccactcgagtgcttccttgatcgatcgcaggtagaagccgtggatggggtcgagcagggacgcgagaacggcgaacacaccgatgatggcgaccaccagtaggaacagatatgctaggatccccatcgcctctagcacctccgcgccgccggccgccggcctccacccacccgccgccgccgcctcgcacgccgctgcgggagaggaagaggaggaggaggaggaggaggaggagggcgcaagaagggtttagctgctggccttcgtgttttgtcgtctagtacgccaaagccatcacctgctcgctttagccatctctcacctgctctcgcttagctcgaaaccaagttatttgaaatgtaaacaaagtttgaccgaatttgattttttgtttgttcggtgaaatagtttcaatatataccggagggtgggcgaggtggtattccgtcattcctgaaattaaaatgcatgtccataaaatattaaaatcaagtattcaagataattatactacctgggatcaacgaatttgaatttttagttaatttttgcctatattaactgtattattagtgtaacattaacgtattatatacgctatatctatacatatattcgcctagctaggtacatattacatagtagtacagtatatattaatttattcatctgagcagctagctagagcaatactagtcttgtttgttcttgggcaaaaggtagtagtggttctttggcaaaaggtatgcacctttcggggattgcaggctagcggctactctttttcgtgtatgtgtgtgtatcagtgtatgtgagaggaggagggggtgtatgcaggagtatgcctgtgcttgctgatcagtcgattgatgttgtcaccatggctaccagagagttcagaggcaggcagcattggaccagccgttcctcctttgcatcaatcacatgcgcagctagctatggacacaatcgatcgatcaatcgaattaaggagctagatacctaggtgcacttccaaattaaccattcataattaaggataggcatgtgtacatcttaataaactttacgatgcatctagtaattcgtctgatcagccattatatacaacaaagaaattaagatttttttttagaactaagaaattaagatttgatcccgttattacatgtgaccgtcacgcacgcatgcacgtacgtaagcatgcaggagcatgcatgcatcgggcaataattaattaatgtcttcaatcgaacttccttgatttccttccatatattagtagtaatatgattgtgagaggtttgctttaattagaaatctgccggtataaattaagtttttccttactaaatgccactccaaattaagtgcacatgctttttttttcctgaaaaaggaagatgacatcagaaatgttagagtttgacagcgttaccatcctacaactacggcacaagacatatatacatacttgcgatgtctgcctctcttttgcacatgcatttttttaacaaataaccttgtggatacccagttatgcacgtatatattcagctcaacgtctttgacttttgaatatacaacttaaccattcgtctcattcggaataaattacataattactcctttagtctttaatgttgtacataattacatatgtttgcccattcatcatatttaaaaactttgcgcaaatataacaacaagaagcaaaaaatcatgctcaaattacctttattaataaaacagataacaacaatatatacaaatgataattaattgtgtatttattttaataaaatgaatgataaatatatttaaaaaatcagccaagtcgaacataaaaccggagagtaccatttatcattttattgtgagatgttttaccatctcagaagtactttaaacacgcatggcttagtgaactccctctgtttcaagttaaaaaatgtttcgactttggttaaagtcaaactgcttcaagtttgactaagcttatagacatatagtaatattcacattaccaaattagttttattaaattaacaattaaatgtatttttataataaatttatcttggattgaaagtattactatgttttttctataaatttggtcaaacttgaagcagtttgactttaactaaagtgaaaacatcttttaacgtgggagtacatttttgcatatttacgtcaaaatcgttgaataagatttatggtcaaacgtacattgtatatacagtgtgtaaaacaggagtagtactcatagacagtacgattgcccctctccgattagagatgtcgaccgaccatcgtcgtccatgtatggcgagctaggctaggacgaccaacggacagtagctagctgatcatgcgacgaagcaatgagggagaggcacgctgtatggaccattggccaaaatgaactaaccaacgtatacgcatgctgcaggcagcctcgatctatgatctgcaggagtccaacgaggctgcacccggcctgcacggggagagcatgggctcatcgtctgcatacctagctagcagcaggtggttgacattgtgaatcttagagtcacctgtttggttggggactaatattgtcattttttttttactaaggtagctaatcttaatcttgccacactttttgtaaaatgacaaactaaacttggataatgtttggcaagaaaatagagtgtatgacatgtcactactggagaaatcatctttagtcgatcaaccaaattccacagtagtcccggtcgcaataaaaaccaagactaaagatcatttttagttctggttaaaaaaaatttagatctttagtcccgattggtgtatcaaccgggactagaagttggtgggtatttgaaccgggaataaatatagcggtctttagtcccgattcttactcccggttggaaaaccggggagggttaccaaccgggagtaaaaagggtttctccaccggtgtgtggaccaggtggctaagagttaggaaaaaataaacttgtggcaagaaccaaacactgtctactaaaattgtggcttgcctaaggttagatgtagcaaatttagttaccaaccaatgcaaacaggcccttagtttcgttcgtttctgattttattagacgtagattttttatatataagttgctttaaaatattagataaatccattttttctaattttaaaataattaaaactcaattaattatgtgctaacgatcgattttcaaacgaatatactggctggtttggttgtgtcgactaactttatctgtattattcacatgttataatatgtcagattttctgagaggcaaattagttaaatacttaattaaataaatctaacgtttcagagacaacaatttataaagacgacgatttagataaaataaaacgacaggcttaatcccatcgatgaaagttcactacatatgaaacaaacttaccaaaatacactacttatgtacagtacaaaaatagttctgggctgggggcatggactacttatagtgacacaaattaaaagaaacaacttgcatgctgagaggctacacagccaactttgcaaaacacacaacttttgctggtgcgaaaggaagttagacatgcagtatagcttcctttgtactctctccgtcccaaaataaatacaacctaaatttccgtgtccaactttaatcgttcgtcttatttaatttttttataattagtatttctattgttattagattataaaacatgaatagtattttatgcgtgacttatgtttttttagctttctaaaaaaacaaataatcaaagttggacacggaattggctcatgactatgtttattttgggacggagggaggacacacttgtgttgttcccttgaatcgaaacttgtttcaccctctgctgttgtgcacggtgcaccctttgcgaaaggaagtgagagacttgttccccatacctctgctgactcctatgggagatgatcttgaccagtatgcatcagtggaaagcttcagcctttttgccctcgcgcatacgcgcaccggcatacatgtatgtccaaatacgggcgtatttaaaatttaaatgcctatagtaaaattaaatgaagaaataatgtattattttactggctattgatataaacaccatatttcatgtgaaatacatctcatttaagtaaagaaacaatatgttaaaatcactataaaaaatagagttgccggtgacttggctgtgatccgatgcaggaagatgaactgtcccgctagcttctctctttgcatgaatctcgaatgcaatctaatgcacaaaaccacatcaggctcaagttgcgttgtctaactttttctttctagcaaaatggttgtgctttgtaacatgtgaagaaaaacttaacgattgataaatactcctttcgttcccataatataagggtgtgtttgaataatgggaaatggggggtgggattgggattgg

SEQ ID NO: 1989 - DNA, 25043 bp, Oryza sativa
ttcctttttgccgctacagttcatcgtacgtcgggttgcacatgtggagaaggaaggcgagacgatccctagctttacgatctctttctccctgtgcatgacgctgctacgatccagtagtgcttattattagagaaaattcgatccgtagcataggaaaaaacccggtaccaaaaaatagcacgacaaattttctacttcgaccagaagcacatgacactaattttcttgcgatttatagcactcccgtcacatttgccatccaaacatgtgagtcgacatgaaaaatgactcatttgccctttttcccgagcaagagggcaatggaggcgcggcgaagaggccgtcgatagcggggagtgacgccacctcctcgaggttccacccctggaggtaggcagcaacctcgacggcgagtagcagcagggataggacagcggaggtgtgggctgcgacgccgagtacggccaccatggcgttgttcgccagcgccatcggcgatgacggagctaatgagcccgagggcgtacaacggcccacatccatccacatcgacgctagggccgcccacgtcatcatcgtcgtcctcgtcctcaagcggcctctttgccgccgtcagtgaagaacgcggtttggtggcggtggcgcccttcgtcggtgggcttcggtttggggtgctccctggccggggacgacagcgcggaacttctccttgccgtcgctgtggttgcggccgatgacgagcttgctgatgcagcgccaccacgtgatggaccccgtcgacccgctcttccgtggggggcgcgacggcgaggatgctggcgacggcgaggacacccagacacagtagctgtccggcgacatgccgtccagctcggtgatgtccaacgacgacgacgacaacctgatggacgagttccgcccctcctcgaggaacagcctcctaagcagcggcctctactcctccgtgacctccgccgccgccggcgcaggcgtcaccgaacacgcggccaaacaagtggggaacgaagggtaaatgagtccgacaaaaattttctccactccgatctaacgccgttacttcaaaatgcgacggaagtgctaccgggcgaaaaaaacggtggcctatgctatagatcgaaagtgggaactttttatgctattttttggtaccgctttttttcctgtgctataggtcgaattttctcttattattaacctgaaagatttagaaaaaaaattacaacgtcttgacagtagtgcatatatgtcagggttcacagataattcacaacatttcatatttgatacttcacagtagaattcatcttgacaagaatcaggaatgctaccattcaccatatatcttcacatgcataggatttagaaacaaactcaccatatacaaaatatacaagtgcaagagcagataactcaagcaaatatacacatctcgtcacactactaaaaaaccatttttcttggtgatgattttaggttttcactggcggaatttggagcagccacaaaacaaaggccagtgaagatcaagatttccgctagcggttatcgaccgctagcgataattcattttcgctggcggtcatcttaagctagtcaccagcaaagatccattttcgctgacggttggcttaagacggccgccaacgaaaatattttttcgctggcgggttacattgtgccagccgggagtgttaatactggccaagtttaaaaaaaacggcggacggagcgacaccgctccatccgccttcgtcaacgctctagcattcaaaaatttcacagaaatttaccaaagcattcaaaaaaccacagaaatttacatcaacaatttacagtcaactgttttcgttcacccaagcattcaagcatcacaaaaatcaacacaagcattcaagcatcacaaaaatcatcacgaaggagggagccgggcagcatggtcgatggcgtcgaggtcggagaggagggagccaggcagtacagtcaacggcgtcgaggtcggtgccggcctccccgcccgcgcccgagcgccaccacccgcgcttgagagccgccgcccgccaggtccggcacgtcgtcggctgcgtcagctccgccgccacccgcctgccgtcgccgccgcggcggccgctgccccctccctccggctagatctgggagagggagagggaaaggaaggggaggggagagaggtgagggcctcgccgtccgcgcccgtcgtcgacgcagtcgtcgtcgtcaccgacaggaggaggaggagggctgggggctccgggagtaggggagagaggtgggggagaaggagaggaatgcggtgggtggagatgaggaagagatagaggagagatgaatgcactgggtgggtgggtgaaaaccggttttaaatgcgtgggtgggtgaaggaatcgatctcgcgcgcgcatagttttaaataccgtgaaaagtttttagcgagcatttgcttttcgtggcagatccgtttttttgttgcggatctctttagtagccgccagcgaaaacgctgattttcgctggcggacatttaagaggttcgcctcgaaaaataagtattttttatggtggacctcttaatgtggccaccagcgaaaatcagttttcgctggcggcccgtgaccccccacccccctaattttctgtgatgggcggtgttttcttgtagccaccatgaagaatatttttcaaacaccatgaaaaatcgtttttctagtagtatcatagcctcggagctagaacgaaatgaaggaggtgcctcttgcttaatttactttactttaaatcaagtttaagttggtgcaggtgcctaagtttacactgagagaggtgcacacatggtgaagatatgtgaagtatagcttaaaaaatttttttgaccagattcctggtaacccccttacatactctacctccgcccgagtcataggcaggtgcatatatatatgccattgagcaacagccacatatgctgattgtgattgcttaattacaggataataacagaaattactgtgttttcaaagcagaacatggtgttctttgatttaaaagtgtaccatatatataaaagaaattcccccgttacaatatgcaggttaaaaaggtcgatgctgctgatcttctagcattacagatactagtaaacgtgaacgtgcaaggcacgtttcccacatcatgtcacactaatcatgtaaaatcacccgaagattattgcttttttccacaatatatatcacacccaacatgtgaacaaccaaagttcaaaaattacatatatattgtagtgtaaattgcaatatcttaataactctttgcaggcactttttgtaaataccaaaggtcaaattagcttcaggtaagactatacaacacatacattcatcctacaacattctctagtttgtcaaaagtcatggacgtgacatgctttcaattaaatatactgtacattcttgcatgtatcaatagagttattcaaggtagctgctcgtcctgccacccagtatgaagggtcagtttttactgttggtgtgtgttggtgtgtgatccagctccttctgtagcatcttgttacattttctatttataaaacatttagtcaaataatgaaatggatttcctatggttaacatcaatgaaacagattggatagaaagagaatgcttaatggtatggttaaactcatgaattagcctgcgaaaatgcatgaaagagaataactcaatgaacaatgtacttgaccatgcaaaataggactgaaagttacccatatcaagaccaaataatggatcaatgaaaaattgatccagccaacattcctgcgtcttgccatgttttttacatgatgacatggtctcctagaactgcaactgtatatgctgcttcacgcccatggatagccgcaatcaaattagttaccaaaccatgtgaaatgtgcaccaatagtgattcttcttcataagaagtatatgttgattcaattatctgcaacacacattcttctctttaaaagaaagcacattcaaacattatttatttgtggttcccattaaaaaaaaatgtaactcatgaaaaactatgtttaatagaggataacccggcacagattgtgtcataacaccatctagaactacatactgaaagaacctagctagatctacatactaaaaagcacctttgtgctaatatatatatatatatatatatatatatatatatatatatatatatatatatatatataacagacttaatctctttatattttgctaagagagtaacttccagcatttgaaaaaaaaaagtatatatatatatatatatatataacagacttaatctctttatattttgctaagagagtaacttccagcatttgaaaaaaaaaagtatcttgcctggcaaaataaatctgtagataatataatgtaaaaggataaatctggtaaccatttgatcataccacattacatagtagtagtatttcatagacaacacaaaaaaattcagctacaatccttatgggtttcatccttgtcaaacttagtgtcctatactttttacaaaaatcattatcctattgctgcctctagcaaactcaaagtcttgtactatatatgctgctgatgaccgaacaaattcttgagaatgtcaagaatatatgtaactattagactccatgtacaatacaaccaaattttaatcacttcagcaactttatgaaactcaagagataaatgtggtagaaaacttagtgtaaaacagtgcggaaatggaaatagagaatagtgcaaataatggtgtccataaaaataatttcaggaagaccatttattactaagcaaggacataattcacctaacaaatcccaggttgatgtatcttacctgtacatcaattgtagcttatagggatagaagatttaatcgtggcaatcccatactttgtgtggtctgaagaaacattttgtgacactgaatggtataggcattgtacattttctgaagaaacaaatgctggatgcaagatacattgtcattttctgaaacggggaaacacataggtatcattacagactgcatatgttcatttcctgcagaaaaataccagttctaaatcaccttggggtgctatccttaatcacattgagtaatcacattgagtaatataaccgtccactgaaatgtttttttttccataggcttacatgaagtagtcatcattcaaaacacatgcctgattcaatggtcaggagcagtgtaggagttttaagcacagcacatcacaaggcatgaaaaaagttggcagtacaggcccatcaatatgtggtatcagattagtcagggttggcacaactattcagaaatgtatagaaacaattaaataaatattaggatggtctagttgacatattgataattagtgaactggaaacgtgaatgcatcagctgaataaatgtaaatgtatcattacctgttcgtgcggacgaatttggtttggagctttcaccagcgttatccactgcatactgaaccgaaacatcaaaaatcatttccactgctttctacaacataatctttatatacaagcaaaagatgcaaggtttgtccaatacatgctgtaattaaaaaattatgcagtgcaagaaaaatgaaattatgcatgttatagttctaaacttctagagcatcgaattgggaaatgaaattgtaggccacaatattaggtgaatattcagttatgatctacaggttgggtactaaaagttttactgaggtttagttatggattgacaaaatagcccacaagatttagttatggaattcatgctctttcttctttttgaccactgctcatcgattcacaattaactaatatctccaagatgagtagataaatgctagcaaaggtactacaaacctctaaccgaagctaccctttcaaagtattgaccgtctgcaattatgcctgtgagaaggaaatctgccattctctacaacagattcagataggaaaatatatgcgtaacaatattggttacctccaattcttccatgtccatctgttccttacctcacatatttggaaaagctaatacaacaatttgttagtcatatacacaaaaatacccctatataggaaaatgttgtgcaatcaaaagttgttttgtgattagagatgacgaacctttgattggccaagagcatttcgtgactgagcactcgcatcttgtatcccaaaactgaaaggattatgctgttgatgcgcctacttcttccagcttgcagcgccaaacccaaatctgttgagctttgcctgctgttgttgccgttcttggtgagggctccgtaattgcaactgcaaggtaaattagaaacaagcatagcaaataaaaactaacagcgaattcctctgtagcaatcggaattaaaaactggtggccaaacgatggcaaaccaaagctttgaatgaatttcatcataaatagtcattaaagcacatctatgtatttgaagtgaatattttttcagcaataaaagttgatttgtagagaaatacaaatttacagcaagaatcaatgctgtcaggcatggaagagaattgagttagatcacagtatcttattgacggaactaaattgaaggcaattttctgtcaaccattaatcacctgcgcaactgagttatttatatattacaatacaaaattatcaagtgccaacctgcagaaagacacgttaatgcgtcacacacctatgtctaactgcatatccatggaaatcaaggaagtccagtggaaagctacttttacacactcacagagtgtgagtaaaaccaaaggcaaaggttattagtagaatacctcaagaagcactgatctgctcattttgaaagaaccagactattaacttgaagcacatgaatcacagtaaggaagaactattgaccgagaggtcagttgcgttcacaggggaaaaaaatatgaaatcaacctataggagcataacctcatatatgtcacctggaaaaatggaatgttcaagtcaatcaatcaagctagatccagaaaatgaaataactgaaaatatgcaccaggagcttaggagccttctttgctatttggttcctcctaattactgaagcccacatatgtcactgcattcacattggcatctgctaagatacgctacattctgtgagtgtaagaaggatggctggcgatggcggcacgcggcttggacgaccgtgatgacggggcagcgaagggcaagggtcggtggcggctacccgactgaggaggtgcaggcagctagtggaaggccggtgggagagaagatcacgtggctgtggtgggaggcgagatccagaggcatttgcggcggggcgacagcgagtctcgatctgtggcggcacgacggcgaccacacgaccctgccgaaactcctgctcccggacggcacggaggcgggggcctaggcggcggtagagggaggcactgactgcgtcggcggcggcggcggaaggggccgccctcggcgctggccgcagcggatggtaggatccggcggcggcagaaggggacctcggctccggcgaggatgcggcggcgcgtcggcagtaatccggagcgagcgagcgagcgaggaggaggagcgccggccgcgacggatggtaggatccggcagcggcggaaggggacctcggctccgccggcggacggagaagaagacgacttcggcgaggatgcagcgggcgcggcggcagtacagaggagcgagtgaggacgccgaggaggaggagcgaagtctccgcgcgtgaatggagagtagtcttcgcggcagtactcaatcgtgcggtggagacctcttgcgcgcggatggacggtacggattaatccggatgatttcacctataggattagagggggacaactcctcctttttatattagtatagataaaaaaggaaaacatgcttaaatatgatgcgatgtccaagaagcaaatcaagaaatcctgcatagagactactcggggcagcccctttgagaggaattggtcactcaaattttctaccaagcaaaatatcaatatttccataggggattgttggaagtaaattatcaattagactaaaactgacagctgatttcatgaacaaaacaattctttctctgcataacagcacgctatagcccacattcagaatacatgtacagagttgccaaattttctaggatttctcctgcgtatgcagcgattaggagcacggacagctcctgaagagtctcacctttgggctggtattgggcgtgaggaaatattaggatctcaatttgtgatttagacttaattcccaaaatatagctttaggggatgtgtttattaggcatctctttgctctgaatagcgtgggatgtacggccaattacgcgcgcctacgtggatctactaccgcccattattgtacctgctcttaccaggatgcttaactactcacgcaaaccaagcggcaaattaacactgaccgggcaaaacgtgctagctaactactaggagcctagccaagtcgaaacgtgtttgcgtgcttctcgccgtgtcaaagcagttataagatcgaacacaacaaatgcaaaagacggatattgcaatatatatatacgcctgcatcagatatgctacttctgcatatccttaacctttttcgtcctgaacctaacacagtgtatttcttcatccagtcaccaccttccaattatgcacaatcagcaacatttacaataaactttaccatacaatgtaagttaatactacacacaataggcattggcgttactctgcctctaagagcactcaaccaaacacctagagaatgagatcttgatcatactttaaaatcgctctttggtctctaagagcaacaaagagtaaagcctggcttctcaaaacggtcatcaaagctcccgcaaatctctaagctggtgtcttctgattcctattcaatcgtcgacaacaaaatttcaatgtcttaagcaatatacgcaagattcactgaaatgttgaacacataatatatgcatggtaaaatctttagaatagtatcaacctacctaggtgaacagaaacaacatgatcgctaacaattaagttcagcatagaagattactatagcaacatatccaagaaaactaaaacatatatatgttttcaaacttacagcttattaaaaaaggggcattcgtgaatcatgatgttcaaaattcagaaaaaaaccacaagagacaccaacaatgtcataaataatcatgcacagttttgcaatagtctaattattaaaagtttcgtaaaaaaaacagaacaatttgctcaaaaactgatattcagttcaacattaagaatgggtctagtgttctgaattactccctccatctacttttgatagtcatatttccaaatctgaaaattttatttttgataggtatatttcaatccaacaatctatcatcttaatgattttctcgaatttaatgcgtgactattcattcttccacacatgattggctacatggacattaagaaatgtaaatattaatgaatcgcttgtttacgaggaatggctagtagcatgtttaaattgatgataagtagaattacttatccttggtctgtgtatcaagatgaaatatggctatcaaaagtagatggagagagtataaagaacagtctaggatataaacattgatatcattttggctcctcacaatcccaccaagaacaagtctagtgttagacatgcaatggtacatgcagcatattcaaattgtctaaatctcatcagctcacattgaaaagcgttgaaaacatagtttgcatgtaattgtccatagaaaaaaaagaacatgattcacaactagttttatatttgactgcataaatctgatcagctaattaaacgtaaaagtaaaataatcttgccaggaacagagatggtaccttttgcaatatgcgtgaaccgcgagacagtatccaaagaatccagccagagccatagtgccaatccaaaagattagcatctcaatagcaccactcacaggtacgccaagaagcacgccaagaacgaaccatgcaccaaaacaaattggcatcttgcagaacagagtgttgtaacagaccagagccccttccaactgagtaagggaaacaaagataacccatatgtagatcagcattgatgcctcaaacgagagctcctcgatgacgtaagagatgagacacttgccgccgcaggggtagagaagcagccacgccatcctccccaccaaacagagggataccgaaccaaacaagaagcccatgtagtagagcccggcctcctcgtcgcctcgctcttggtcctccaatggaggaggtttggcggctaagatggcgctagggcattgctcggtaccacgacggagacgatactccgcgacggcgtacccgagcatcccagcaacgtagaacgtgtcgagatacacgatcgagatcccattggcggtaccaatcaggtgcgtggacgcgaaggccaccaaggcaacataggagacgcggaagatgatagccaagaaggcacctgctagccgttcggacaaggctatagtccacagtgcgccgtaggaacacgcgaggatcgacgatgtccacatgagggacacatgatcggtagcaacgcgccacagcatccatggagcaatcacggcgtagatgatggtgccgaaggacatggagaggaagaccccgttcggaaggccgcaggtgtagcgtagggggtggtccgggggcagctgcgacacccactcgcggtcgcggaggggttgagcacggggatcatcgtcacatacctttgccggcgcggtatccactccggcgatctccgtggcggccgggatttctataacaaccgatccgccgccgccgccgccgctgatctgattggggatttccatgtgcacagcacgggtggagtgagagaggggggttagggttttgggtggcgagaggcggggaagaacaccaagggattggggattgcgcggcggcgacggcgactactgcgggggaggaggaagcaggacgacgacggctttggctgtgtcgatttgtcgattcctcttaggtagcgaagtagtaagatttattggctcggataaatgatgatggtttcttttcgcagtcggacaagcccacatccttctggcccaactcgggttcggcgagaatttttttcgtttttagattttttttaatatttacagaaataatctatcggtgagcaccattgcgggaatgaccctgctgcccctatggtgggcggcaagtttaagtggcacacggggtatgaacgggcggtcacggagggtggttttttttttgcatgaaagccggttgccgccctatggtggggcggcaagggtgcagaatgcaaaagagccgcagggggccgtccattttgcaggaggccccttgccgccctctggccgggcggcaggcctcgctgcctataaaaggcctgccgcccagcccccagccctcattcctcacccctctcaaatccagtgaaaaaaaaaagaagagaggggaggagaagagaagaaggggtgaagccctgccggattcagatgccgatttcaggtaatattcatagttcctatatgtgactattgagttaaatagtgtgtattttttaaaaatttgtttgaataaatgcattatatttttagggttttagttgtactaatttagaagtgcgtattgtagatatcggtaactacgtagatctgctagtttggaatcaatactttaccattgcattggcttacacaagaagatattacgttgtagatgtttattgcatgaaagagtaatatgatctagttaattcgttgacagatatgtcgaacaaaccaatattccaagtttaccatggaccaggaaacgtccgttacgggccaactggggtagatctgtcagattttattgtatcagaaagggaaattgagagaccggctgagaggagtgtaccttctataaaaggatggttaatgaggggcttgagagttgatccacagacaagtgacataacaatcaatgttgtagtaagtcgggcaactgagggtttttattgggaactaattccagttcaaaactctcaagtgtggagatggtatgtggaaaatgcaatgcaacgtgggtggcctctagctttggttccgtttgtgcacccgaaggatccaggtgtgcagatgaacatggatgatggcgagggaccaagtgctgaagtaaatgagacttctgtggaggaggtcaacgcaggagaggataggggcgtagtagctcctgtgggcattcaaccaggtggagtggccgacgaggggaagactgtcgcagccattgtggatgaaatggagagggaggattctgataacgagcgtgtagaggaaggtgattcgtcagatgaggagacggatattaatccagcagaatgggctagtcaggatttttctgggctgatcgtctctaaagaggatagtgtgagatgggagtacaaagaaaatgaggttattcagggagcgatttatagtagagcagaagatatgaaggaggcggtaaaacattttgcagtgtcacttcatagagagttttcggttgccaagtccaatcggtcgcaatatgaagttcagtgtgttaaggaaaaagatggttgtccctggagagtgcacgcgtataaggggaaatggaaggattattggacagtgtcagtcgttaccaagcatacatgttttttacctggtgttcagaaataccacaggaacattacatgtgcatttgttgcatctgagatgtatgcgcatgtcatcgataatctcacatatgaaccaaggtcaataatccgacacatcgaggagacatacaagtatactattagctatgccaaggcctggagggccaaacataaaataatagagatgagatttggaacatacgaagcctcgtatgacaatttgccacgcctgcttggtgttatcgagggaagaaaccctgggagctcttacgaagtgaagaaattcccatcaattgaacatcctggcaagagtgtgctgcaaagggcgttcttagctctacatgcatgcaagatggcattcgtgaactgtcgtccagttctctgcattgatgggacattcttgacaggaaagtatcggggccagatattgacagcaataggggtagatgggaacaatcaggtattgcccttggcatttgcttttgttgagagtgagaataccgacagctggtactggttcctgaaatttggttaaaacaaaagttgttggtatgaggccaaatgtgtgcctgatacatgataggcacgctggcattctgcgagtgatagaagagttgcagtttgggagcatggaaccaggataccctggtgtttgggacgatgtacaaagtaggtggtgcatgtgtcatatgggagctaatttcttcaagcaattcaagaacaaggagctcatgaacatgttcaagaggctgtgcaatcagaaccaggagaaaaaattcaatgagctttggaagagattagatgagttgccagccaaatgcagtgatcagcgtgcagcggctccatctaccgccgttgatgaccctcctcaatctcttggacgtctcccaacggatagtccaactttggttagaagaactggattggagattcggaaattttctcagtggattctgcatgaaccaaaagagaaatgggcaaggcgtatgacacaggtggtgctagatatggaataatgacaacaaatttggcagaagtttacaactgggtgatgcgcggtgtccgtggactgccactagttggcatagtggagttcattttacatgggacatgcaggtatcttagggatcggttccaggcagttcttccctctatgccgaacaacagcattttgtttggaactttcatgcagaaaaagctagaggagttgcgtaaaaaggccatgaaacatcgagctctagtgcaaggtacccaacaacacaggtttgagatattatgtcaagataaggcaggcaggggtatctaccgcaagagagtgaagcaggagtgtgttctgaaagccgacggcacatgtcattgctcttgttcaaagccgaagctgctccacaggccatgcacccatgtcattgctgccgcagcggagtgtggcataccagatgcagtatatgtgtcacagtactttagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatctgcaacgatatggacgagtcggaggctggcagggtgaagcattgcagcaaatgcgatgaacgtgggcacacctacaagcattgtcctaaagacaaggagaaaccaagtgcggcggaggcaggactatcaggatgagcagcagatggagctcgccctacgggtgaaggcactacctccactcgaccacgtcctaggtgtcgtcgtgccacgtctggctacgtggtgtagttcttatgttctatgttggcatgtgggtttgcttgtaatttatttcgaacttatcgatgtgtttatgtttcgtcgtgtaatgtcagacttcggcatgtcatttctttaggtctcgtgatgtaacgtcagactaaggcacctagtgtctttaggtatgctgatgtatgtcggacttcgacacgtaatgttatgttatgttatgttatgttatattatcgaactctacatatatgttaaattgcatgtcatcgttatgtaccattagtaacgtttgctttatttaaatagcctgtactgttgttgtacataattattctcatgattttattactatttcataattttgcgagtcatcttttgttttacattactactttttgaattgttctaacacgaaacactatatttttcagagatggcacgtcaggatacacctcagctgttggacccggcgatagatcagcgacaccggtctcaccttactgcggtgcagggggctcagcttgggacgttccgggcacggacgtgcggtgagctactcacggttcacgactcctttgtcgagaggtacgaacagtgtattactataaattagttgcgctgtaatattttttataatgacatattaatttcttattgcaggctgcgtgaggccggcctcctaccgatgtgtcggctggtggaggctgccgccggccacgtggacccggccagacgatggactgtggacaagtccctcctagcagctttggttgaccgatggaggccagagacgcacacttttcacttgctatgcggtgaggtagcccctaccctacaggacgtatcgtacttgttggggctaccgctcgcgggagacactgttgggccagtgaccacggctgtggactggcaggacgatctgacggcacgtttcgcactagtacattaattcgcaggcactcgcgcaagggtcagcagtcagctggcgactggcccgccaagttggcgacttttgttgagaactggttgctcgcaaccaaggaggtcgtggaccacgagggagagccacacactgaggaggcgtactaagcctacctacgctggtaccagccacgcacccgtactagggtcaccttcgctcccttggagcaacagccccacattgcgagcactagagacctctacgccaggcaccgcgaccaggacttcgctcgttgtgtgagtacccatgcatcgcaccattcctttatgttttcatgtctttctcatcgtcaaattttacgaatatgtatgaacaaaataaccatgcaggtggacgacatcaaccgggtcgtcgttgacggttcaacgacgagccaacgtttagacgcggggattccggtacccgtagaggaacaccggacgacgtacacgcggatggtggagtcgattctccgagtgctcacctgtcgtgcagacgacgttgctcgggcagacacagctgtacagcggccacccgtaccgactggtccccgtccagctgcgcacgttcctaggccgactccccctccgcacagaggtaagtatttttaaggatttttctgtacatgtctcgcacatatatgtgagccgtttcacttgccgattgattcagggtttcgtgcaccgttcagcaccccgccttcctcggctaggccttctggtgtgccccccacaagtacttaaaaaaacaacattacttcgacaatcaatttacatgcattttatgtcctagcttacaaggtcccgttgtcgatgtgtaggtttcgcccagttcgctatgacgcaggccgcccacttctcccaggctgcagggtcagcgtctcaggcagctgcgtcgacctcgcactcagcgcagttccagcagtacaccgggacttcgtcacaggcagccggcacgtcgagtcagggtccaccactggaccatgctgggacctcgtcggactgcttgctgtcttccaccgtgctcttcgacatcactgacttcgacttcgcttcaggctcggcagaggacgtcatcggcccctcacagctgggaggggcgcaccgccggtgcagacgcaggaccaggcgcaggccactcctccgccagacactcgtgctacccgtgctgtgccaccggatcgtttcacctactcccaggaccacgtgcgagcacaggcccggaggaccaagcgtggtcgcggcgcggggcaggggcagtagagcagtcttctctttgtttacttgcttcacttttcagtattgtatgcttgtgtaatgactacgttgttgttatatgtgcacgatatctttcggcgcatgcacgatacctttcggcgcatgcacgactactttctgccgcaccgatgcagcctcctttattcgcgtgcgatacgagtatttgcccgccatttgccgcatacgaccaatgtaactttcggcgccgatcaagcatgcaactttcggcgccaatcaggcgtacccaccatgccccaccacgttcacatgtcaaggatatcactcgatgaattgcgcctatataagtcgccttaacgagtgaggcctcacaatctttcagaactcaatcacattcagtactctcttccccacttcttcattacaaatcctaccggctttcgtcaatggttagacgccggggtgttgaggatccaaactggcgcagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtggggtattttattatctgcatatgctcatttattccgtataggcaatcgctttattcttcgtaacactactctattcggcagacccgcactacggcttgcgcatacatcgagtgggtcgatacagaaaatcccgtcctcgacctaaccacttgtttacaagaaagtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattctggacgacgatttcatggtaagaatattttgattacatgaatccttattttctcacaacatttactaacttagctcgctttacatctattatttcctcctaggaaccaccaatgagatgtcaatacagagaatggatagacaccagaagggttctaactctacctagccgtgttgtgcagcttgaactaccagagcaatacagggttactaaagcgcggtttgagagaggagagggatcctcacgtaggggttagctattatcggacaacttggcatattgaaatttctgctgtcatgcttccttgtcccattactatatcgtcgttgtgttcaactattgcactacctccctcctagttcaaatctaatatcatctatgtaaccgcaatggaaatagttgtatcatgttcaaattgtactactatttcttcatgttacataattctccttgtttaagtccatataatgtttctacgaccgagactgcgataggcctatattaattatccgagtactaatacgtcgaataaggtacaaaataatacctcacttaacatatgaaattgcgcaacaaccaacttcaatacatttttataacaatattaacaagttttaccaacaaatacttctttatttattattaacattgcatagaaaaatcttttggccgtactttttacatctgggtcccttgccgccctctgtataggcggcaagggcctaatcgtaattttggccgacggcggcagacggcgcggtcgacccaccgtctgccacgccagcttgccgccccaatggtgggcggcagggtctatttttgcaattttgttcgccgatagattatttctgtaaatattaaaaaaaatctaaaaacgaaaaaagttcgttcggcgacacgtaactcaaaccaaaacggaatagtagtaaaaaaacaagggatttgctgatttgtggcgacagttttttcaagacaaaacagttcaatgtgtgtcaatatatcatgggttcgtgtcaaaaaaaaatatcatgggctaggacgctgggtttcttgttttatcgtgacaaccatattttggattttacatgcatgtgttctgcgagagtttactatatttcagagaatgtgctattaaaatatggtactacaaggtgattagactaattacattataattaataatgtagttccagaaaaaaattataatatatatatatagttatattgtaattacatcttcgatacattgcaattatatcatagttgcattgtaatttctctacgtacacatctaagttttgttaaattgtattgagatttatgcagagaaaaaaaaataaggttttgctaaatttgtgtcgacatattttagggcaatttacagtcggatgttttaaccgtaagatccgccgatgagattcgtttcaagcacctgcacccatcgtacagcttatgcgaatgaaccaactgcacctaatcaagctccaacctcattagcacttcacctccgtcgtaaaattaataattacatttatactgatttatatagtagttacaccctacttacataccatttacatatgtaattagtacgtaaatttaggatttacatatgtaattttaagacttacatatgtaattttgagacttatattgtaaatacactaaaattacatatgtaatttaggaagttacaatgtaaatacatgccgactattttttcgtgaaaaatatggcgccataaatatagctactcccaaaaaatactcagtagcacacatgtggagaattggatttgtgaccgttaaattgcttagagattcatgccaatcatgcgaagagagaaaaaaaaaattagcactcccaacctcagttggaggctcacgacgtttgcaagtccagcatgaaactaattatactatagatattttttttatataatactccctccatctacttttgatagtcatatttccaaatctgaaaattttatttttgatagtcatatttcaatccaacgacccatcatcttaatgactttctcgaatttaatgcgtgactctccattctaccacacatgattggttacatgggtattgagaaatgtaaatattaatgaatcgcttgtttacgaggaataactagtagcatgtttaaatggatgataagtagaattacttattcttggtctgtgtgtcaaggtgaaatatgactattaaaagtagatggagggagtagttttcataaaaaacaactatcgaatacagggcggagctatgtatagctaggggggtgcccagtaacctgattcaaaaaaaaatttagctacaatttatctattttcactatatatataccccgttagtttaaacttaggcacccgtatcaagctaaatttgattcaaaccagactaaaacaagcgagtggaacccctttattttgttctagctccgcccctgattgaatatcatatagttactccttatcaagcaaactcttctaatcaactagatggacatctacttgtctattgcatatcaataaaaaaaaattaaaaacaatgataaaatatatcaatatataagcatgcaagttcaaattcattgtccataagttatactccctccgttccacgttataaaatgttttgactttggtcaaagttgaactgcttcaaatttgactaagtttataaacaaatatagtaatatttacattaccaaaattagttttattaaattaataattaaatataattttataataaatttataatattactattttttctataaacttgatcaaacttaaaacagtttaactttgatcaaaatcaaaacattttataacctgaaacggagggagtaattagtatacgaatattgacaggtaaattaaaattgttacttttgttgtgccacaatgaaggcacacccagatacatcatacacacgagacgactactcgtgctgtggtgagggactatatgcagaatgcacgtctagccgaaatcatagaggaattaaaaaaaatgttacttttgttataatttgtacaagcaaaatttgaaattacatgtttatatatatatatatatatatatatatatatatatatatatatatatatatatattatgttataaattaatatatcttgtcaacttctaattaaatttttttcatagctctatggatgagacatgtaatgaataagtagacgtctacttgggggactgtctatccatttgtcgggtgatttttaacaagaaatcatccagatttttctacccttagatttacatccaacggactacaaaagaaaattttatatatatatatatacacacacacacacatatatatatatatatacttacgcaatatttttatcaaaattacagtgcacttacatctcatatcaactgaatttacaaatgtaattttagttatataggactgtaattttatattttaaagaaaataacaaatacatatttactgacacatcattgttatcaaaattacagcgcacttacatatcgtatcaactgaatttacaaatgtaattttagttatataggactgtaattttgtattttatttttattttagtttcaaatgagagagaaggatagagagcagcgcgaaaaaacaacaaatgagagaaaaaaaaatcgcacgtctaatgatcccactggagttgctgcatgcaatgctttatcctggccgtatgggcccccaccccaaccctggagatagtagcggccagaaaaaacgtcaaatatcaggtaaagaatcacccgagtgatgtatagcaaaatcgattgcggaataaccggggcctcatattttagccataatatcacacagaaacccatcctttttcatcaaattgcatgtcttctaacatttggttgaatattgtctagaaattagacaataaaagaaaaaactttacggttaattttatattattaaacacacataagttcaaggcggtgttggtgaagacaacccgaaataataagaatttctatagatgcaaaggttttgtgaaatgtttagagttgtttagttgcttgagactacggcagtgcagccagcaccaacagtgaggcaaggagtggactgcagcagccgcagccataggtttgccagatgaccaatctctttttacgtaacacttagcacgtattattagaaaaaaaacacccaaaattttagaatttcactatggaatgtttttctctgtcgccatgatctagcaagcaaaactacaatacattgagttctctgattgatgaactgattatgattccaacccaattaagctttacttgcttttctttccaggggttgcccacatgtggtcatgatcaacacagctgggggggaggaacaaaattaataaagcgagttgatcaaacagcgcaagaacagcaagcagcttttcaggcacacatgggggtgtactaaaatagcctgaaattcttccatccttccccaaaatcaagatcccatcggatcatatcatcagtcaggcagacgacagcgcaggcaacagctgttcctggctgtgttgctgccatgcctagcttaggttaattgtgctgatcccacttgattagcgcactaatcgcacctttaatccgtattgcccgtgtgtgttaatgtatgtgcaccgttaacgcgataattagtaagagcccggacaccatggttttctttttctatgaagaaatgttcaaatggaaggataatatatccttttgaaaaagcattgattaccaagatttgtttggaaacaaatttatcagcattatgaagaaaatcaattcatgcacgaaattgaagaaaattaatgtgatccaaacgaggcctaacatggtttttcttttcttaaatataaaaaggtgtaaattacacatatatcgttacctcaaatcatactggattatatttaaaaaaatctctcagattatttttaaaaaagcatatggatggatgcatgtagactatatgtacaagtacaatattactactaactcatgtaaaaagaaccgatcatatatattacaaaacactggcatacgacctagctgtcaactaggctaacaatataattatggaagaggagtgagaaaaaacaagtaaaataaggcacaaaggaagaatatagagacacatttttaattttaaattgtgttcttgtaaagaataaatttttgtttgcattataaaactaagttatattagtacattttaagtggtttacttgtatagcaaataagttacatgctctaccatgtcgagatattataggtgatgaaccggttataatcaccttgaggtatgcactagcacccttgacgagcactctactacctgcctacgctcgtgaaaatggtcattgaccaaatatgtggataaagatgacgtcttcttcatcatgcttgtatgaaaattttcataggtgctcctatttcaatccatgctggactgtgaaaagaaatactaccatctagtttgtttttcagctcgacataaccgaagttgatgagagatcgtgttaggagaactcgtaggctcctccttttttttttcttttttttgccaaatgccgtacaacgtattagagaaaaaataatttataggtaaattttttatgtatgtattcttagcgatttaaaattgaatgtaaaagataaacttagatgaaaaagaacctgaaagcaaaccttaaactttaaattttggaagcgggattcagtatagacaaacccatagagccatagagggtcctatttttgttttgggacagacaggcgccaacttctcagttctcagattcagagcgtaaccgtacccaagaagtgaaaaaagaaaaatcagagcgcgcttaattgtgtccaaaaaatgattgtgtggccctagtcgaggaacccccctctcttctcttatctacccctccccctccccccctcgactccgcgtcgactccactctcgcctcctcgcgactcggagttcaccgccgccaccgcctccgccgccgatctccccgtcccgccgcgccgccgccaccgtcctccctcctccggccgcatccccggtgagcatccatctgcgtgtcctcttcctcatctctccctccccacgcacgcacgcacgtactcgtagcttctgttcactgttctagatctggatacttttcgcttcattcgccttattaaaccttgatgctggtagcagtttgtttgtttgtgtttttttccccgcgcgcaaaaaatgtttgtggggggtggaactgaatcacatgctccacgtctagatccgccacctgagtttgccttgcatcacggtttagtgcttgattctttgtgcgcggttgattatcgcgtactctttttgctctacaagttctagatctcggtgtgtcggactatcgatatgtagttttgcatattctgttttgttttctgttcgctgcaagttttgatgtgccaaatattagcagttgatcttttgagattttgatttcctggagggtttgcgtctagtttctgttggaaaatggccatttcgtgacgtgttgcggcgcatgcctgttgttctgtttttgcgtcaggaattcagaaccagtaggaggaaatggctgacggcgaggacatccagccccttgtgtgtgacaatggaactggcatggtcaaggttcgtggtgctcattcgtagtatttctttgtagcagttatccccatgtttatgtgatttaatcgtatactttacttttcttgcgaattgctggcaggctgggtttgctggggacgatgcgcccagggctgttttccctagtatcgtggggcgcccccgtcacaccggtgtgatggttggtatggggcagaaggatgcctatgttggtgatgaggcgcagtccaagagaggtatcctcaccttgaagtacccgatcgagcatggtattgttagcaactgggatgacatggagaagatctggcatcacaccttctacaacgagctccgtgtcgcgcccgaggagcaccctgtgttgctgactgaggccccgctcaaccccaaggctaacagggagaagatgacccagatcatgtttgagactttcaatgtgccagctatgtatgtcgccat

SEQ ID NO: 1990 - DNA, 1000 bp, Oryza sativa
aggctgcaaagagcagctcatctgtggagaagagctatgagctgcctgatggacaggtgatcaccattggggcagagaggttccgatgccctgaggtcctcttccagccctctttcatcggtatggaagctcctggaatccatgagaccacttacaattccatcatgaagtgtgatgtggatatcaggaaggacttgtatggtaacattgttctcagtggtggatcaaccatgttccctggtattgctgaccgtatgagcaaggagatcactgccctcgcaccaagcagcatgaagatcaaggtggtggcaccgcctgagaggaaatacagtgtctggataggagggccatccttgcctcccttagcaccttccaacaggtaaaccttacgcatacactttatgaggtagcaagaatgcaggtatttctgctttctgttaacatcattcttttggcatctatgctacagatgtggatctcaaagggagagtatgatgagtcgggtccagcaattgttcaccggaagtgcttctaagctctggctttttaatcgcttatctacaaggcagtttcttttcagttttcacaagcccttgtcatgtaagctactctgtttgggattgttggtgtcctatcagaatgttgttggatttgtttcatggctgaatattatgcaccttctgaactcttggtatgcatttgtccggtggctgctgtattatacatggcatgcatggtccaacttttgtcatgctaagtttgtggttagtggtaggaccaaaagaaaaatgggagatgtacccactacctaggatcgtctattgtaatcgtacttgtgcgagtcatgttatcatttatcttgtacattcatctccaagataagtgatctggttctttgatcgtttgattgatggtttttggttattatttattgcaatctatggcatgataattctcctgtgggccacattactgatagttctcccattgctgctgatcc

SEQ ID NO: 1991 - DNA, 1349 bp, Oryza sativa
gtcactttggagttattgatattgctgaatgtgttgtgcctgatcttcaagatgggcggaaagagcgtgtaacatcccagcccagggcttaataggattcatagaataatcatataaacaagttgcaacttcttttccgaaagccgatctccaaagaactccagggttaagtgtgcttggcctggagcaatttgggatgggtgaccgaccgggaaattcttcccgggtgtgcatgagtgtgcttggcctaaagcaatttgggatgggtgactgaccgggaaattcttcccgggtgtgcatgagtgaggacaaagcgggcccgtcctgggggaaggcgggacgttacaaaatatcagatgtaagcgggcccggcctgagtgggcccgtcctggacaaaatggtatcgtcctgggggaaggcgggactctcacggtttcacgggcgtgtgtgtcgcagttgtgcaggcatggtgcgcatggctggtgtggacccgaagtggtcacacagcatggcacatgcgctggcactggacacacggacgaaggcgggactctcgcggtttcacgggcgcgtggacccggagtggtcacacagcatggcacatgcgctggcactggacacacgaacgaaggcgggactctcgcggtttcacgggcgtgtgtgtcgcagttgtgcaggcatggtgcgcattggctggtgtgggcccggagtggtcacacagcatggcacatgcgctggcactggacacacggacgtggccaagaggggacgttcctggcctggggttgatcgacgggggcgtcaatctctcttaaggggacgttcctggcctggggttgatcgacgggggcgtcaatctctcttaagggggtgagggtgtaacatccccgtcgatctctcttaagggggtgagggtgtaacatcctggcccagggcttaataggattaatagaatactcatataaacaatttgcaacttcttttccggaagacgatctccaaataactccagggttaagcgtgcttggcctggagcaatttaggatgggtgaccgtccgggaaattcttcccgggtgcgcatgagtgaggacaaagtgtggagggcagtctatgacctatgaaagctacgccgatgtaagcgggcccggcctaggggaaggcgggacgttatagagcgcagtatcattacatccttactgcggcaacatttgcatcgagctcgacaacgtatgaagcaccaagctgataagagacgttctgatcgtcaatttgctgtcgacgattgggtgttcctcaaagtgcagccgcatgctcagacgtctgttgctgttcgagttaatcacaaatt

SEQ ID NO: 1992 - DNA, 759 bp, Oryza sativa
gaaccccagagtccgcacatcctcaaatacaaagcacgttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccaccatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaa

SEQ ID NO: 1993 - DNA, 2362 bp, Oryza sativa
atgtccaaaaatcatgttttgctgctttttgaagttcttcattccggtgaaaaacatcgcacccacgtgtgccaacataggccaatattggcattaattaacaaaacttcgccgcttgagtcacggagtaatttttcgacacggacgcacccaattctctacagtatgtccaaaaacatgttttggtgctttctaaactttttcatttcggtgaaatatatcgcacccacgtgtgccaatataggctaatattggcattaattgacaaaagttcaccgcgcgagtcacggagtgatttttcgacacggactcattgtcacgcccagaaattcccgaatagaattccaagcagaatgtgcattaaaatccccgtccaggaccggccggggtacacaaacgacaaagttgacatacaaatctacgtcttacaaacattataaaagttttacataaatgcaacggaaaaataaaagataactagagctaaaccttgacttggactgcagcgggaacaccactccacaggcatcctcgacggcacgaacgaagcctattcctcggagaaaccaccatctgacgcatactcaaactctggggtttggggaaaatagagcaagactgagtacaaccaccgtactcagcaagtcataccggaacagggggtatgatgcaggatattaccaaaggatagctagagaggttcttttgcgtaaaacgagcatttataaacagtagttgaaagcaggaaatcaggtgtaataattaatcaatattagccatccactgtccaacgctacaccacgttgcaacaggcccaaccaaccacctgaactaatcagttccatcatattaaactagggtgagactaatcacggtgaatctggttgaccgcccataaccgcgggcaaggctattcaaatagttttactctgatcagaggtgtacaactgtacccacaaaacacagccccacgacacgtttccgtgcgccgacatgccaccacgacataccggaaagaggccgtgacaggactcttcgcataaccccctctagccaagcacaccacacctcaggtttcaccccgtccccagcgggcaacgggcagtcccctctcgtgcctaggtgaatccggaagcgacagaggccgtcacagggcccgccctgctccatcacgcccaccctttcctggatgcgtcaactagaggaaaactacactacaagcccagccgttgcacacgctggcttgtggtaagtatgataagttcttccagggcatcccgcgaaccggtccttaaatgccatgggcgcgaccaacaaaaccatgcacccacagcccaccatttgatatattttaattaaccaacaccggggcggtggcattaaccaacgtcattactagaatctgatatctatgcattaatgtgattttccccattgtgtgctagttgaactaagcatggctaagcaatccctagtccaatctctagtcatgtttatatcccaagctaacaaaggagcatggtacagaaatagcatggctgtaatagtaggtaaacatcccatagtatcattgtaaaataatgcaatatttgaaggaaaacaatagaacatttgcaatataggatcaacatgttcaagtgacaagcatgacttgccttgctctgctgctggaggaacctcggcgactatttcaaagtacaccggagcatcgggagagccggaatctaagcgacatacaaagcaaacaatacaaacaggctataagactaccgaaacagagaacaaaaccattttgaatggattctacacatttttcttgatttactaagacatgaatgggcttaaacggagctcggatgaattagatatgaattttagaagattcacagaaaaatccttaattgatttattgcacaataaataaaccctaggagagagggggcagcgccgacatgcgggccccacatggcagtgactccggtggcggtccgcggtggaccgagtccacggaccggggaagggggcggcgcaccacgtggcactgacgtggcgccgacgtggcgcacacgtggcggccacatggcacgccacgcgggcggccgaaccgacgtccccgatctacccgagagtagatcggacggcggcggggaccacgcggtcggcacgcacgagcggctcaagacggcccgacggccatggcgcacggtggcgctaccgcggggcagcggcggcagacggcggcgaccgacggcaagcggtggcagcgcgatggcgcgggtgtcgctagcggcggataaggggctaggcggcggtgcggcgactaagcggcgcgggagagagagggaggacggagaggaggtgt

SEQ ID NO: 1994 - DNA, 23905 bp, Oryza sativa
aaaaagagagaggggagagtggggatccttaaataggggagagggagctcggacgtagccgggagaggcgggaatcgaatccctgccgtctcgagtgcgggcgtgggcgggagagagagggagtgagcgcgggagacgcgggcgcacgcgcgggcgtggccgacgtggcccggaagacgcgggagcgagggcgcggcggcggttccggggcacggaggtggcggctggaggttgggggaggacccgacaggtgggccccacctgtcggcgaccccaggagagaggaggggctcgggcggccggctcagctgggcctcggccttcggccggcccagcgggaaggggagggaggagagaatgggccggcggcccatttcgaaaagaaaagagggaaaaagaaagaaaaagaaggaaaagaatttccagggaattaaatattgcttgtgctcatttttaattgattaaaattatttctagagctctgaaaattccactaaaaatcttgttagcgtatttcgacatgtagaactcaagaaaaatcgcacatgccagttccgattattatttgcattaattattttagggtttctctcttgcttttgcaccggtattttcttgagaccatttataaattcaatttaggcttgggagaagaacttcagggtgtgacaaacctaccccccttaaacggaatctcgaccccgagattcggaagagccggtgaagaggtgcggatgggcggccttcaactcatcttccctttcccaggttgcttcttcttctgagtggtggctccattgaacccggcagaacctagtgaccttgtttctggttcttctttcactggtctcaagaatacaaactggcttttccacataggttagatcttcttgaatgtcgatgtgctcctccgaatcggcttgttcttcgggtaccctcaaacacttctttaactgggacacatggaacacgtcatggatactgatcattttgggtggaagttctagctgataagcaacttctcctcttcgttccaagattttgtatggtcccacgaagcgtggtgccaacttgcctttcgtttggaaacggtgtactccccggagcggagtaacacgaaagtacacgtaatcccctgcttcaaaagtgagctcccttcggcggttgtccgcatagctcttctgtcgagactgggcaattctcagcctctctctgacggttctgactttctcttctgcttccgttaacacttctgttccgaacagttgactttcgcctatttgatcccagaagagaggtgtgcggcacttccggccatacaacgcttcgaacggtgccatttgtagactggcctgatagctgttgttgtaggagaactccgcatacggcaagcttttgtcccatgctccactaaaatcaagcgcacaagcccttaacatatcctccaatatttgattgacccgctcggtctgaccatcggtctgcggatggtaggctgtgctgaagttcagccgggttcccaattcctcttgcaatttctgccagaactttgaagtgaattggctccctcgatcagatactatctttttgggtactccatgcagacacatgattctcgagagatagagctctgccaaccttttgcctgtatatgtagtatgcacaggaatgaaatgagcaactttggtaagtcgatccacgaccacccagattgaatcgtggcccgatgatgtcctgggcagacctgttatgaaatctatcccaatttcttcccatttccattccgggatctgaagaggttgtaacaatcctgcgggcctctgatgttctgctttaactcgctgacaaacatcgcagagcgcgacgaattcagctatttccctcctcatgctggcccaccaaaaattttctttgagatcttggtacatcttggtactaccccgatgaatggagtattgagtttgatgagcctcagtgagtatcagatcttttagctctttgtcatcaggcacacacaatctttctcccatgcagattgtgccatgttcatcttcaaggaaatcccgggcttttccaacccacatattctttttcagttcagctatctcaggatcatttacttgagctgctctgacttgatccacgagcgtaggacgtgcctctagagcagctacgaacccgtgttctacgattcccatgttgagacgttcaagctcttgctgcaattccttacacatgccttcggtgcataaagcattgtagtagctcttcctgcttaatgcatctgccaccacattggctttgcctggatggtagtgaatgctcatgtcataatctttgattaactccaaccatcttcgctgtcggagatttagatcaggttgggtgaagatatatttcagactcttgtgatctatatatacttcgcagtggttgccaatcagatattgcctccagattttcaaagcatgaaccaccgctgccaattccaggtcatgtgttggatagttcccttcatgtggacgcaactgccgcgaggcataagcgaccactctgccgtcttgcattagaacacatccaagcccgtggcgggacgcgtcgcaatagacttggaagtcctttgtttggtcgggcagaatcagaactggagcagacactaatctcttcttgagctcctcaaaactcttgtcacactcggccgtccatttaaatttctcatctttcttaagcaactgagtcatgggtctagcgatcctggagaaattttcaatgaaccgacggtaataacctgcaagtcgaagaaaactccgaatctatgacacggtcttaggtggggtccatttggtaactgactccacattcggtggatcgactgccacgccctgagctgtaatgacgtgacccagaaatttgacttccgacaaccagaagtcacacttactgaacttggcatataactggtgctccttcaacttctcgagtactagaaggagatgttgctcatgttcttcttcagactttgaatagataagtatgtcgtcaatgaataccacaacaaacttatcgagaaattccatgaacactttgttcatcaggttcatgaagaatgcaggtgcattggtaagtccaaaagatataaccgtgcactcatacaacccataccaagtggtaaaggctgacttgggaatatcctcttcccaaatcctcaactggttgtagcctgatcgcaggtctattatggaaaacaccttggctcctttcagctgattgaacagatcatcaatccgcggcaacgggtatttgttcttgaaagtgacctcattgagtgtgcgataatcgacacacattctcttcgtcttgtccttcttctccacaaaaatgactggagcaccccaaagtgaagtactcggtcgaatgtaccctttctgcagctgctcatcaacctgcttcttgacctctgctagctcgttggctgccattctgtacggtcttatgtaaattggagcagttcccggtgccaaatcaatccggaattcaatctctctcttgggtggcatggtagtgaggtcctcggggaacacttctggatacttgcagactatggggatatcttccaacttcctcgaactcttctcctcggtgaccactggaatttccacctcaatctgattcaaggagaccccctgctttggtgagactggagatttgtacactactgtttctcccttctcattggtcaaggtgactgtgcgattcacacaatcaatgacacccttgaacttggttagccaatccatcccaagattgatatctaggtctttggattcgagaagaatgaggttggctagaaatggtgatctttggatttctattgttatagaagggctgaattgaaccgaagtggagctattccctagggtatgaacccgcattggtgtactaagttcttcccttattaacccatgtatcccaacaaacttctttccaatgaacgaatgcgttgcaccagaatcgaaaagtactgttgtagggattgagttaacaggaaacgtacccagtacgacctctggtgctacttgcgcctcttctgcggacgcgtggttgacacgagcctgggcaaaccttggcccggcacgccttggcttcgggcatttgtcagcaaagtggccatgctcgccacagttgaagcaggatcctggctttgctccagtctccttcttggcttgggctgatggagctgactgtgctggtgccaatggtgggcgtggagctgcactgcggttgggctgacctccctggtggttctggctgccactagcgccctggtggaagctgctcgagttgaaagggcgatgttggcggacgatcatggtggtaggtgtttacacccaaatttggcacctaggattaaaataggaaagattgccgaaaattggaagtctaccggtttcctccgagtgggccggtctgacagccatgtcttggccggtcagaccgccggttgagagccggtcagaccggcggtgtgtggccggtctgaccggcaggtctgagttcgactgtgtttcgtcaggtctcgaggtttgcttgctcgggaaggcatgttttgggtttcctttggtttctaacccgagttggatgtggaggagggcctgtagagggcaagtgatgtgaccatggctactatggatacaaccattgctcacatcatggatgaacaagataatatccagatcaagtcctccaagtgctggaatcagattcggccacctgctacactgctgacttcaaatggccgccgaatctgcatacgacctccttttcggcccatgagtacttgatggaaagctctcggagtcctctttccaacggatttggcatcatcgccaaattccatcgaagtcatccacagatgaagaaacaaggtgctgcgtcacctgtcatgaacctgtgggcttgtaacttcttcatttgggaccccggtccaggtggggcccatgtggggtgcgccccaagctggtggagtacgaccctaggcacccctaggtcgtcctcccacccctatatatagctagttaccccttcagggttttgatgcaagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttctatttgcttgcaggtatagggttgatctgcaccggcaagatcaacaacccacagagaggtgtatcgatcgctaaggcgcaacacaacgtctcgtacggttgtagtcggattgtcaacgtttctcccaaatcgtagttatcacaactcaccaaaagatcgggccaacaacagccttgagtgtcgagaggaactcagggttcatcagcaagaccaacccctatataagggacatggccggttcattgtaaaaaatcgatctacaatcaatcagttgaatcgtttttcatattgcttttaattttctcttagtttgtccatctttgtcggtttgcgccgtaaaccgtctgccgccgctgcgagtgtgcgacacctctttgtaggtttgtcctgaaacgcttccgttttgcccacgagacgggtagttatctagaaatcggctccgctagccggtttagttaccaaaacccatctaggtttagctctttgctagatcgaggtggttagcgactctaggatcaccgcaaggctttaggtgctgcgatcgtgcttgtcaacttgtcacaaaaagttgccaacacgatttttggcgactccactgggaaggagatccgttcatcgtcaactcaacttcgacttcaccatgacgaagccgccatccaagacggaggtggagccatctaatgtgataccggtcacattggaggattccgaaggagaggaccgcaaagctatggaggagtacatcaacgagctcacacgggaggcgttgatgagggcaagcactaggactcgtcaaggcgtgattattaagcccgggccacgtcctaagctcgcccccgacttggtaagtaatgatgaggtaacacaatctatccaacaacaagtagcatctacaatagattcatctatgattgcttttaaagataagttagatgcaacttttgagggtaaatttgatgagtttttaagggttaaattcggccctcttatggccgattacatgtcaaaggataaagcctctaccactgctaaccaacctcctatagatcaaacgggtagtaaaaccgatggagcggcgcacacggccggtctgaccgggcctgacggccggtcaaaccacgacttagccgtcggtctgaccggccaaacggccgatcagaacggcacaattataccgatacaggggatcgatccgatgactaatgctagttatttgtatcatcttagaacatttgatcctcctatatctactgctgcaaataatctccaagttcccccacatgttcctaatgcttataatgatgttgctagggggtatcctcccgatactagacaaggccaatataatcatattgcggaacaaacacaacctattaggccaccaaatccaccgccaaatcaacatgggcttaataatatggaggacataattagtgagattattaggaatagattcgggattgaaactgggtattgtgctagggtttacaaaaagccgtatcctgattattatgataatgtgccgtttccccgtaattatagagttcccgaatttaccaagtttagtggtgaggatagtaagaccacatgggagcatgtaggtcaattttttggtgcaatgtggtgaggctaatagtgatacttttaatctgcgcttgttttctttatctttgtccggtaatgcttttacatggtttacttctttaccagcaaattctattcatacttgggctcaattagaagaaaaatttcatgattatttctatactggagaaactgagcttaggttatgtgatttaacatcggttaagcaaaaatataatgaatctgtcattgattatattaagagatttagagatgttagaaaccgatgttataccttgaatataactaatagagatttggctgatcttgcttttaatggtttaattgctcctcttagagaaagactagatggccaacaatttcttgatgttagtcaactcatgcaaagggctctggctcaagaaagccgagttaaggataataaaaaacttgtcagatcttatgacaaaaagcctaatgttaatgtgattgattaccctgaggctagtgatagtgaggaggagggtgatcatgatatatatgttgctgaatggtcatggactaacaaaaacaagccttttgtttgctccaacctaatgccgactcctcgcaaagatcggcaaagtgaggttaaatatagttttgatgtggccaagtgtgataagatttttgattatcttttacaagaaaaacaaattagattacctaaaggccatgtcataccatctcaagaagagtttaaacgccgagcatattgtaaatggcatgattctcattctcattctactaatgattgcaatgtgtttcgacgacaggttcaatcggccatagatgaaggacgattgaagttcactgatggctccaagatgaagcttgatcatgatcctttttcggtgaatacaattaatttcaatgataaaaaggtgttaattcggccggagcaagcagaatctactaaaggaaaaggagtggtcattggcgagccaaggcctaagatgatagtgacaaagaaaccggaagttagtgtttggaaggagaataagagtggcgcttcaacttctaaagcccctaggaagaccaaagtgacttttggtatgcttttggagaagtatgagaagcaaggtggtgagagggttcacaacaaggggaaaagaccaagatcacctcctagggagcgatttggtcattcaccaagacggtcgcattcacctccatatcatcatccacaagacatgtcatggggttcttatcgaatgtcgccgccgggttatccttatccttacttcatgccatggggggcaacgccgcaaattttcaatcatatgcctccaatgcaatttaaccaaggatggggaggaccgaggaggccaattcatgagcgtttctcttcaccaaacaataggcggttttatggtaagaatcgggctaataatgaaaagagggaaggaaagcgcgtcaaggtggaggcaaggacttcagaagtaattaccatcaaagtggggtctcatgatgtgccaataccttctggagatggagttggagtatcctcaaacaaaaaatccgaagccaaaaccaactcctcgcagtcggccggtctgaccaggccttctggccggtctgaccgcagccatgcggccggtctgaccgggtcatcaggtcagtctgaccgccgacccgacagtggtccgaccgatgcctcgggccggtctgaccgtgcgtcaagtgtcggtctgaccggcatgtctggccggtctgaccggtggtctacgtccggtctgatcaggctccagcgccggtttgacaggggaattgcaaagggcgatatgaaggcttcatcgtcttcaaacaagattaataggggacattatttacctcctagaacagagccgaatcctaggtggatgcctaaggatttgacggctactcaaaagagaaggttgcaacgtcttcgggctcaagagataagagagaaaaaagctgaagaacaaagagataaaaggttcaatgagttgcgaccgccactggtatggaggcgtaaatccatagagaaggaaaagccagttgttgtagaggagagggaggagcaatcggttgataaaggtgaatcatctccaaaagaagacatggatatcaacatggtatgtatgttgcctatggagttttgtgctatggatgaagccgaggttgctcaattctcattaggtcctaaagacgcggtttttgagaagcccgatgagtcaaaccgtcacatgaagcctctctatctcaaaggccatgttggtgggaagccggtctctacgatgctagtggatagaggtgccgccgtgaacttgatgccgtattcattgttcaagaagttggggcgtgaggatgatgagttgaagaagaccaacatgattctcaatggcttcaatggtgaaccaacagaggcaaagggtatcttttcggcgaagttcaccgtgggaaacaagacgctaccaaccgctttcttcatcgtcgatgtgcaaggtaactacaatgttattttgggtcgttgtttgattcatgccaattgttgtgtgccttctaccttgcatcaatgtttaattcaatgggacggcgatgatgttgaaattgttcaagcggatacatcggccgaggttgcaatggccgatgctacttttgagtggcgtcatgggaatatccaatgcttatcagggagggaactttctagctatgattttattagtatctccgatggcaaatttgtacctatttctgtaaagccggctagtgtagcacggctaaaccatataaatttgtataatgagtaaagaggctaatttagagtggttacaaaagagggtgcaagaatatcggtctacaaagaacgatattggcgaaaccattgaagattttgatgaagtagaagaacttggacaagggtttacatcggccgatccattggaggaagtggacataggtgatggaaccaaaccaaggctgacttttgtaaacaaaaatatgagccgattataaggttaagataatcgagctacttaaagagtatgttgattgctttgcatgggaatatcatgagatgccaggtcttagccgtgagctcgttgagcatcggcttccaattaaaccaggttttaggccttataagcaaccacctcgtcgttttaatcctttgctatatgaccgagtcaaagaggagattgatcggttgttgaaggcagggtttattaggccatgtcgttatgtggagtgggtctctagcagagtcctagtggagaagaaggggagtggtaagattggagtttgcatatattttagagatctaaataaagctactcccaaagatgagtatcctatgcctatagccgacatgatgattaatgatgcctcgggtcataaggtgattagctttctagatggtaatgccggctacaatcaaatctttatggcggaagaggatatgtacaagatggcttttaggtgcccaggatttgttggtttatttgagtgggttgtcatgacttttgggttgaagaatgccggtgcaacatatcaaaggacaatgaatttaatctttcatgatttattaggtattatcctagagatctatattgatgatattgttgtcaaatcggatggtatggaaggacacatggccgatttgaggttagcttttgagaggatgcgccggtatggtttgaagatgaacccacttaaatgtgcttttggtgtgtcggcggggaagttcttaggattcatggtgtatgagagaggagttgagattgatcctaagaagatagagaagattcgtgatttcaaagcgccgacatgcaagaaggaggcccaaaagttgctaggtaaagtgaattatttgagaaggtttatttctaacctagcgggtaaaatcgatgcttttgttcctatacttcgcttgaaaaaagaagccgatgttacttgggggcaaaacaacaagaggcgtttgaagagttgaagagatatttgtctactccacccgttgtacgagcgcctaaagctggaaagccttttcggttatatattgcctccgaagacaaagttattggtgccgttttgacacaagaggaagatggcaaggaatatatcattacatatttgagccgccgtcttttagatgccaaaacgaggtatgtttttatagagagactttgtctatgcttatactatgcttgtaccaaattgaggcattatttgttatatagtacatgcatagttacttgtcaagccgatgttattaaacacatgttgcaaaggccaattctaagtgggagaattggcaagtgggcatatgttttgatagaatatgatttggcttatgaaccattgaaatctatgaaaggccaaattgtatgtggttttatagtagaccatcatacagatattgcttatgagggagaggtttgcttagttgaagttataccttggaagatttattttgatggttcttcttgcaaagaaggtcaaggcataggggtagttttcttttcacctaatggcatgtgttatgaagcatctgttcgtttggagtattattgtacaaataagcaagtcgaatacaatgctttattgtttggcttacaagttatggtgatggttggagctaaatacatggaagcttttggtgattcggaattggtggtgcaacaagtcaccggagtctacaaatgcttggacggatcactaaataggtacctcaattcatgtttagatattattgccaattttgataatttttctattagatatattgttaggcatgataattctagagcaaatgacttggcacaacaagcatctggctataatgtgaagaagggattatttctgatattagaagagccggtgcttgattttaaatctttgtgcgaaattggcaaaactggagaccagggatggtctgaccggcattgcactgccggtctgaccggtaaccaggggcggtctgaccggccgcatgctgccggtctgaccggcgacccagagcggtctgaccggccctgcgtggtcggtctgaccggttctgggcagaatgctggggggcacgtttcaatcaatttagaggctgaattaactgtgaattcagacatttgtgcccagggaacagaagaatattggagaattcctttgattcgatatttgaaagatcctacgcaaaattcgatatttgaaggttgatcgcaaaattcggcggcaagcattcaaatatacattgcttgatggagatttgtatcgccgaaatatagatggtgtcttgttgaagtgcttagatgaagatcaatctaaagtggctatgggagaggtacatgaaggaatttgtggaactcatcaatcggcccacaagatgaattggttgcttaggagagctgggttctattggccgaagatgattgataattgcttcaaatattatagaggacgcgaggcttgtcaacggttcggcaatgttcaattggcgcccgccgccgtgttgaatcccataatcaaaccatggtcattccgaggatgggctttggatttcattggtcaaatttatccttcgtcatcaaaggggcataggtttctgctagttgctacggattacttcaccaagtgggcttcgtgcctttgaagaatatgactcatacagaggtaattgactttattttgaagcatattatccatagattcggtattccacaaacattaactacggaccaaggtgcttcttctatgtctaaggaagtgaagagttttaccgaatcttatggtattaaattgttgagttcttctccttactacgctcaggctaatggacaagccgagtcgagtaataagacattgttgaagttagtgaagaagaagattgaggaacacccaaagaggtggcatgagatgctttccgaagcattgtgggcgcataggatttctaaacatggtgccactaaagtcactccttttgagttggtttatggtcaagaagccgttttaccggtggaggtaaatcttggttctcttcgttatatcaagcaagatgatttgtcaaatgaagattacaagacgttgatgggagacaatcttgatgaagtcatcgacaaccgcttgaaagcattggaataaatagagaaagagaagaagagagtggccaaggcgtaaaacaaaagggtgaaagcaaagttgtttcaagttggagacttggtttggaagacaattttgccattgggtactcgatccaaggagttcagttagtggtctcctagttgggagggtccttatcaagtatgcggcattgttcgagggaacgcatattttttggagacacttcaaggggagcgttttcagcgagcaatcaacgggaaatacttgaagaaatacttcccgagcgtttggcaagacgcttaggaggtactatggctggtaattgatttatcgtcctaagaccaaaacatgttctatgcttttagattcacgttgttcatcaaaaaggcaggggggcatatgtttacacccaaatttggcacctaggattaaaataggaaagattgccaaaatttggaagtctaccggtttcctccgagtgggccggtctgaccgccgtgtcttggccggtcagaccgccggttgagagccggtcagccggcggtgtgtggccggtctgaccggcaggttcgagtccgactgtgtttcgtcgggtctcaaggtttccttgctcgggaaggcatgttttgggtttcctttggtttctaccccgagttggacgtggaggagggcctgtagagggcaagaccaacacctatataagggacatggccggttcattgtaaaaaatcaatctacaatcaatcaatcgaatcgtttttcatattgcttttaattttctcttagtttgtccatctttgtcggtttgcgccgtaaaccgtccaccgccgctgcgagagtgcgacacctctttgtaggtttgtcctgaaaaccttccgttttgcccacaagatgggtagttatctagaaatcggctccgctagccggtttagttatcaaaacccatctaggtttagctctttgctagatcgaggtggttggcgactctaggatcaccgcaaggctttaggtgctgcgatcgtgcttgtcaacttgtcacaaaaagttgccaacagtaggtccaccctgctgtcctggagtgaagcgcgatcgctggtggtttccttggttggaccggaactacgctgcctttctgttcctgtccattttgttgcgctgatcctcctgacggattgccttgtcaacctagttctcaaagttggcgtagtctctagagatcaactggttggtcagctcgtcatccaggcctgctaggaacttctcctgcttctctacgtcagtgcggacatcctccggtgcatatcgcgctagatgattgaactcatggagatactcagacactgtcctgttgccctggtggagggctcggaattctctcttcttttgtgccacgatctaccatgagttcagcccaatgttcaattcacaaagactagggtgacaaggaatcatgggcaatcaataattatcaaaggtaggataataataacaattaggtcacgctacccatcgatggtttataaacaaaacaatgcatgtattcaaaacaaaacatttcacaaatgggttcaatatgttcaaagagtgcacttgccttgatcctagtactgtccttgcacagcgtcttctgaagcaaactgctcttccgctccaacgtctacacgattgcaaacgaaaaacaaataaacacaaagaaaaaataactaaataacatcaaatgaaataaccaattaaatcaggaggtaaagctcgattttagaagaatttaggaggaagaatggatcgaatcggagttcaaacggaaaagttatggcctcctgaagtttgaattcggggaaaatccgaggataaaagaaaaaggaatattccaagaatattctctggatatttaatttcggaaattgaattaattttggataggaaaaaatatatgtgggcccactgtcattggcatagtgtatgggtggactcggtgtatgtggactcgatgacgtggaacgacacgtggcgacacaaggcgatgaggtggcactgacatggatggatatagggctgacgtggcgaaagaagggattatgtagatccaactgctgggatttgatctagggatttggacggcttagatttatttgaggattttggatggcaggtcccacacgtcggtgtcacaggggagaaggcaagcagcagctgctccatcacacggcctgggcgtgctctggccatggcaggaccggcggctccagcgcggcggcatcggcggctttcgtcggcgatggcgcatggcggctgcagcaaatagtggtggaggcagaggaggtggaggccaacgcggtggcgtagcaccgagctccgggacggcgtggagatggcgcacggcgatgagaggcggacgccggagttgaggtggagagagaaacggcggctcgaaagggagagagggctcagcctcggggctttaccagcggcggcggcacgggaaggagatggtgacgacgacggcgcggctcccgacggcggcacgaagcaacggtggcggcggctgctcacggtggagatggcggcggctttggaaaaagggggaaaaaggggcggtggccgatggtatttataggggagggagtagctagggttagggcgcacggtgcaagctttggaaaagcggcggctccgaatttggtggcgcggcttgcgggatttggcgtcggccgtgtgggcttgcggcgcggccggcgcgggctcggtcggcggcggcttgggccggcgacatagagaggaggaggaggccgggccgcggcggcacgtgggctcggggcttggcctccccgggcctgcagctcaagaaggagagagagagctggaggtagaagaaggtgggggaaaaagaaaaagaaagaagaataagggcagaatagagaaacagagaggaaggaaaaagggaaaaagacagggacttctctggaaaattccaaatataaagtatttgaaatttttgggaaggatttaggatttgaaaaggaatattggatttggatggaatttgaattagggattgagctccacttccgaaatacaaattaaatccaactaactccaattaagaatcacaaagcgaacaacataattaattaattaatcactttaaaaccgtttgatttaacgaaattttcattaagctattttagacgaataaaccaaatgtgaaatttcgcaaataggcgagaagaacagaaagcgaaaaatcaggacgtgacagaatttaaactgcaattgttttgatctgaattaaaacacttaaaacagcaagcaaatccttattaagacagccatatcataggcacatgatatcgactgtcgactgacccacaagcgaacaatcctaaacacacaaactaacaggcaattactaaacagtcgataaactaagggaaaatgagcctaatgctcggaacggctcctgcagtcggtggagtcgaaggcgtcctcctgctcgtcgccaggcccctctgagcggctcctggagtctggcagatacgtctcaccgctgcccagctctgagccactggaactgctgctgctatggtcgcggctgccactaggagtagtaggcaaccaacctccgttgccactggctggacccctggcggctgacgctggagcgaaggagagagcggacgcgggagctgacactggcacaggagctggggctggagctggagctacgggtgctgcgggaggagctgcgggaagaggtgggttcttgggtgcaagctgaatgcgcacgggagcagtcgtagacttgcggggcgtggtgcggatccgaactcctcctggcgctggaagacccttcaattgagcgttctccttcttcaggcgtgctatctcatcctttagagctatgatcctcacaagcttcccatcattcaaggccttggatgccttgtgcaggtcaaagtgcatcctgtccattcccctcatcacggcgcacatgtggccgaaggtggtgttgttctcgccggctgtcgggcggaaggtgctggcgtcgtcgccacttgctcggcgagggtggaagcggtacgccgtgttgtagaagatgtagttgtggcgatcacgaagtctagccatcatcagatatgctgcctcctgacaagcgtgatctgcggagcctccagatgcctcaaccaccgtattagcgaggcaggtgcccacatagccatgaacctccagacgaaaatggtggggaagctcgccactgagtggaggaacggtcgagtactccggcacgttggggtagtgttgagagaaaacacgaggcctgggagatctgcttaactccagtgcaggtccaaagctcgccttcgggtgtactagcatgccagttgatttgatcctgtaattaacaagaaataaaggcaaagaaaccgcggttaaatctataaatgatagccgatcggctaggtgccgatgacatatcatttatctttgagccgatgtcatatgtgaattgatcggcagttgtaaatagacaataaagaaccaaatctattcgatcggctgtagatatttccaatatatagttcttatatcgatatatacttaaatcaagtgattgggatagatcggccgccatgccaagacattataaatcacttagatcgaagtatatattaataacagggctatatatgtttatagcatagccgatcagatagatctagcatgtatcggctaatactctgatactactctatatcaggatattaaaacaggtataatatatcaaacaaaggcctaagatacttagatacagcaatatcttgacataatgggcagatttaacatgtcaatgaagcatatagagcaaatatagttaaatcagataaggtcggctgaaactccgatgctaccctaatcggcaaccagaaggcaggctagagattgatattctaagcacgacttaatagatcaaactcaactgatgcagcattaagtatgaaaagaagaacaatatctagacaatcaagccgctagaagtttcatagagtggtagataccttatacaatctaagtcaacatcgatatctaacctaatcggctgccttctacagacagatgttagccgattgtagattagatagcagtattgccggagattatgtaagatatatgataactcgacgaattacataaacgagatcagagtatcataaagatggaagcactaatcccgagaacacaagtcgtcataacaagttttacctcttgttgaagatcgaaaccgatgcagctttatgatactctgaattacaagatatgtacataacggacacgactactatctctagcaaactctaagatagcataagtctttgtggcagacttttgcccaatcgtatctctaaggagattacataaaacaccctaattaatagatacaattgccttctcaggactctatccatgtgcggcaatcaccttgaagcacctcaatccaacccgatatcatacatcaagctgcattgtcggaatcagctgtatcggcttacctagtctgactcagacccagccgatcctaatcgtagccgatttggactccagcgattcctgccctgtttccgaactcgatctccgcctccaattttgcttcgatctaatcttctttcatgatgctgatgttaccaaattcggttgttaacaggtagcccaccaccagggtcatgcgagccaactctgccacaaaatcatccatgccttctccgtggtggttgggtgggtggtcggccatctagagaagacaaaggggtaggatcaatgcatgctcaaatccaatttaaataaagtagtaaaagactcaattaaaatgaacaattgagagcagagttttgtgcatagaccatttttgcatgagggcgaataaataagacggacttacatagcgataaaataatgagaaattagatacatactaataataataataagagcattaataccttgcaacccatattcctgagttaggacctaatgcattcctcccatcaaaccctagactgacctaatttgacaaatctcacttaaacgagcgaccaagatttttcccttgaaccacaagaacagatcccaattttcccggaacaaatccaattgcaaagaacatatgcaatgaaaaggattcagagggctcttaggttttttcccatttggcttgtcctacggtcaaggttggctctgataccaagttgtcacgcccagaaattcccgaatagaattccaagcagaatgtgcattaaaatccccatccaggaccggccggggggtacacaaacgacaaagttgacatacagatccacgtcttacaaaaattataaaagtcttacataaatgtagcggaaaaataaaagataactggagctaagccttgacttggactgcagcgggaacaccagtccacaggcatcctcgacggcacgaacgaagcctattcctcggagaaaccaccatctaacgcatactcaaactctggggtttggggaaaatagagcaagactgagtataaccaccacactcagcaagtcataccggaacagggggtatgatgcaggatattaccaaaggatagctagagaggttcttttgcgtaaaacgagcatttataacagtagttgaaagcaggaaatcaggtgtaataattaatcaatattagccatccactgtccaacgctacaccacgttgcaacaggcccaaccaaccacctgaactaatcagttccatcatattaaactagggtgagactaatcacggtgaatctggttgaccgcccataaccgcgagcacggctattcaaatagttttactctgatcagaggtgtacaactgtacccacaagacacagccccacgacacgtttccgtgcgccgacatgccaccacgacataccggaaagaggccgtgacaggactcttcgcataaccccctctagccaagcacaccacacctcaggtttcacccccgtccccagcgggcaacgggcagtcccctctcgtgcctaggtgaatccggaagcgacaaaggccgtcacagggcccgccctgctccatcacgcccaccctttcctggatgcgtcaactagaggaaaactacactacaagcccagccgttgcacacgctggcttgtggtaagtatgataagttcttccagggcatcccgcgaaccggtccttaaatgccatgggcgcgaccaacaaaaccatgcacccacagcccaccatttgatatattttaattaaccaacaccggagcggtggcattaaccaacgtcattactagaatctgatatctatgcattaatgtgatttcccccattgtgtgctagttgaactaagcatggctaagcaatccctagtccaatctctagtcatgtttatatcccaagctaacaaaggagcatggtacagaaatagcatggctgtaacagtaggtaaacatcccatagtatcattatgaaacaatgcaatatttgaaggaaaacaatagaacatttgcaatataggatcaacatcttcaagtgacaagcatgacttgccttgctctgctgctggaggaacctcggcgactatttcaaagtacaccggagcgtcgggagagccggaatctaagcgacatacaaagcaaacaatacaaacaggcaataagactactgaaacagagaacaaaaccatttttaatggattctactcatttttcttgatttactgagacttgaatgggcttaaacggagctcggatgaattagatatgaattttagaagattcactgtgcttttactataaacagaaaaatccttaattgatttattgcgcaataaatagaccctaggagagaggggcggcgccaacatgtgggccccacatggcagtgactcgggtggcggtccacagtggaccgagtccacggaccggagaagggggaggcacacgacgtggcgctgacgtggcgccgacgtggcgcacacgtggcggccacatggcacgccacgcgggtggccgaaccgacggccccgatctacccgagagtagatcggacggcggcggggagcacgcggccggcacacacgggcggcccaagccggcccgatggccacggtgcacagcggcgctaccgcagggcggcggcggcagacagcggtgaccgacggcaagcggcggcggcgcgacggcgcgggtgatgctagcggcggctaagcagctaggcggcagcgcggcgactaagcggcgtgggagagagagggaggaaggggaggaggtgtctcaccgacggcgattgatgacggcgagcgacggagggcgatgacggcaacgggacgagctctggaaccacctagcgaacacgatgaaaggggttagagagagagcaagatggaagagggcgaggacgccggccgaaggcggtggccatggcggtgctcaccggcgcaaggcgcggagtgggttccggaggcggaatccgacgggagaggggcggacggggtgacctgcacgacggcgaacgtgacggcgtcgacgacgcggctcggcgcagcggctagcggcggctagcagcgaccggagcggtggcggcggcggcggaaaggagggcgacagcgctagggcgatagagggcacgggagagctcgcgaaatggagaaaaagagagaggggagagtggggatgcttaaataggggagagggagctcgaacgtggctaggagaggcgggaatcgccagccgacgtggggtagtgggagaggagagagaggcgggatttgaaaatcgaatcctggccgtctcgagcgcgggcgcgggcgggagagagagggagtgggcgcgggagacgtgggcgcacgcgcgggcaaggccgacgtggcccggaagacgcgggagtgagggtgcggcggcggctggaggttgggggaggactcgacaggtgggccccacctatcggcgaccccgggagagaggaggggctcgggcggccagcccagcgggaaggggagggaggagagaatgggccggcggaccattccgaaaagaaaagagggaaaaagaaagaaaaataaggaaaagaatttctagggaattaaatattgcttgtggtcatttttaattgattaaaattatttctagagctcttaaaattccactaaaatcttgttagcgtatttcgacatgtagaactcaggaaaaaatcccacatgccagttccgattattatttgcatcaattattttagggtttctctcttgcttttgcagcggtattttgttgagaccatttataaattcaatttaggcttgggagaaaaatctcagggtgtgacactcacccaagatactccaatatgtccaaaaatcttgttttggtgctttttgaactttttcattccggtgaaaaacatcgcacccacgtgtgccaacataggccaatattggcattaatttacaaaagttcgccgcgcgattcacggagtgatttttcgacacggacacacccaattctctacaagtatgtccaaaaacatgttttggtgctttctgaacgttttcattccggtaaaatacatcgcacccacgtatgctaatataggccaatattggcattaagtgacaaaagttcgttgcgcgaatcacggagtgaattttcgacactgatgcacctagtaaactccaataagtcctaaaatcatgttttggtgctttttgaactttttcattccgggaaaaaacagcgcacccacgtgtgcgaatataggccaatattggcattaattgacaaaacttcaccgcgcgagtcacagagtgatttttcgagacggacgcaccctgtacactccaatatgtccaaaaatcatgtttttggtgctttttgaactttttcattccggtgaaaaacaactcacccacgtctggcaatataggccaatactggcattaattgacaaaagttcgccgcgcgagttacggagttatttttcgacacggactcacccaacatactccaatatgtccaaaaatcacgttttggtgctttttcaagtttttcattccggtgaaaaacatcacacccacgtgtgccaacataggccaattttggtattaattgacaaaacttcgccgcgtgagtcacggagtaatttttcgtcacggactaacccaacatactccaatttgcccaaaaatcatattttggtgctttttgaactttttcatttcggtgaaaaacatcgcacccacgtgtgccaatatgggccagtattggcattaattgacaaaagttcgccgcgcgagtcacgaattgatttttctacacggacgcacccaatatactccaatatgtccaaaaatcattttttggtgctttttgaagtttttcattccggtgaaaaacattgcacccacgtgtgccaatagatatctatattggcaataattgacaaaagttcgccgcgcgagttacggagtgatttttcgacacggactcacccaacatactccaatatgtccaaaaatcatgttttggtgcttttggaagtttttctttccggtgaaaaacattgcacccacgtgtgccaatataggccaatatcggtattaattgacaaaagttcgccgcgcgagtcacagagtgatttttcgacacggacgcaccctgtacactccaatatgtccaaaaatcatgttttggttttttttttaactttttcattccggtgaaaaagaactcacccacgtgtgccaatataggccaatagtggcactaattgacaaaagttcgccacgcgagtcacggagtgatttttcgacacggactaacccaacatactccaatatgtccaaaaaatcacgttttcgtgctttttcaagtttttcattccggtgaaaaacatcgcacccacgtgtccaacataggccaatattggtattagttgacaaaact

SEQ ID NO: 1995 - DNA, 6609 bp, Oryza sativa
aggccaatattggtattagttgacaaaacttcgccgcgtgagtcatggagtaatttttcgacacggacacacccaattatctacagtatgtccaaaaacatgtttgtgtgctttctgaactttttcattccggtgaaaaacatcgcacccacgtgtgccaatataggccaatattggcgttatttgacaaaagttcgtcgcgcgagtcacggagcgatttttcgacaccaactcacccaacatactcaaatatgtccaaagatattggcattagttgataaaagttcgccgcgcgagtcacaaattaatttttctacacggacgcacccaatatactccaataagtccaaaaatcatgttttggtgctttttgaagtttttcattccggtgaaaaacattgcacctacgtgtgccaatatatatctatattggcattaattgacaaaagttcgccgcgcgagtcacggagtgatttttcgacacggactcacccagcatattccaatatgtccaaaaatcatgttttggtgctttttgaagttattctttccggtgtaaaactccgcacccacgtgtgccaacataggccaatattggcattaattgacaaaactttgccgcgcgagtcacggagtgatttttcgacacggacgcacccaattctctacagtatgtccaaaaacatgttttggtgctttctgaacttttttattccgctaaaattcatcgcacccatgtatgctaatataggccaatattggcattaagtgacaaaagttcgctgcgcgaatcacagagtgaattttcgacacggacgcacccagtacactccatgtggagaatatggatatcccatatctacatgacagttataatttagtcggatatacggtaccaaatatagatagaatatctttatgaagactcgggtttgttttttacttgtatgtcaaggaaatacccgagatcttagtcggttaggattgtattttatctataatcccatattccgttaggatatggactgtattttgtaaagcggactccttcccctatataaggagggtccgtgtgcctctcggggcgcaattcttttttccaatatatacaatcaataacatactcggcggaatcatccccggacaggagtagggtattacttcttgaataagaaggcctgaacctgtataaaattccttgtctccaaacccatccactttcctagcttgatagccacccccttttattattgccgaaatcttgtttcgacagttggcgcgccaggtaggggcagcgtcaagtttttgccgactaagtgcgatgggttccatttctggcatcgacgacttcgccttccctcccgggcaggcgttccggttcggcagcctcaacttcatcaccaacgacttcagcaagatctctctccttgactcggattcgaaccagtcagggagagaccaggtccccgtgccgttcggtattccgaactcggccgaggcctactccaagatcatatcttccgagtcggcttcaaaccactcggacgagatccaatctactcctccgcgaccagatcaagacgacgggtcctatccttcaatcttgatgaaacttcctgatgacttggacgccgtcttcacagtcaaaacatctcccactcagagatctaggcgagctccggcatcggccctgatccagtctagatccagggaggttggcgttatactccaacttcttgggacagtctcgacggaagatttggatggctacctcagctcccccggcgtcagttctcgaccaaccgagatcctcgactacgacgaccacgacgacctcgacaacttcgacgacagctatgaggataactacacgcccctcttcttcggtgtattcatggctgacaacgaaacggaggaacagcgccgagcccgagaagcggaccaagatcgcgcacggcaagaagctgaacgtcgccgactggaggaagagcgacagcgacaggagcgagaacgactatagcgtgagcaacaagatcgcgaacggattgcaaaggaggctgaagatcgacggcaacgcaccttggaatccgggaggcgagcgagagagctcattgggcaacaagacgtcgacggaacagcggtctttcgcaccccccagcagaacgcggtgcagcaatcactctcctcgacaccctcctcaaggaagacgcactcaacccagctgatcatgttgtcaacatcttgaaccagacgaagaccatgatcgcttcctcgggtccagccaactccgcaagcacccgcaccttgactggtagccgagtccctcatcttcgatctcaagactatcaccagccatgcctcagcattgccagtgccggatctagtcacaggagcagaggacatgatgaacggtctgttcgttcacctcccgaacggtatagggagcgtcgagttgaacgaccacactccccacatcgaaggcgccccatcgatcttcgcgacaccatcaactagcgccgtccagcaagaggccaccattcaccagatcgttacgacaacgatgtggacggagttgctgccttcacaagcgatctgcgtcgagtggattggccagccggctttaagccgactggaattgagaaatatgatggcaccaccaaccctgagtcttggctcaccgtctatggtctcgcaatccgcgcagcaggaggagacagcaaggccatggcaaactatctgcctgtggctctagcggattccgcccgatcctggctccacggactaccccgtggcacaatcggatcatgggcagaacttcgtgatcacttcatcgccaacttccagggcacctttgaacgccccggcacacagtttgatctctacaacgtcgttcagaagtctagaggatcccttcaagattacatccggcgcttctccgagcaacgcaacaagatctccgacatcaccgacgacgtcatcattgctgcctttactaaaggcattcgccacgaggacctagtcggcaagttcggatgcaaacctcccaagacggtcaagcaaatgtttgaaaaagccaacgagtatgccaaagccgaagatgctattacagcgtccaagcagtcgggcaccacttggaagccaaagaaggacacgccgaccgcaggagggagtggaagtaacaaccgcaaggatcgcaagcgtaagcccgaagaacttgtggcaacaacctctccatcttcccgacaacgtccccgcgtcaacacattcgacaagataatgaactcccaatgtccgcatcatcctaactccaaccacgtggccaaagactgcttcgtctacaaacaatttgcggagcaatacgtcaagaatgcacgtaagccttcagacggagagcaaggcacatcaaagaagaaagacgatgaagacgatgcctcgactggttttcaagatcatcgcaaagaactcaatcacatcttcggcggacctctggcttatgaatctaagagaaagcagaagctaacagaacgggagatcaatgcggttcagcccaacacgccccaataccttcggtggtcagaaatagcaatcaagtttgaccgctcggatcatcccgaccgagtggtccacccggggcggtaccccctagtactatacctagtggttcgcaatgtcaagctccgaagaactctcattgatggtggcagtgcactcaacatccttttcgctaagaccctggacgatatgcagattcctcgcacggaattaaagccgagcaatgcacccttccacggtgttatccctggattatcagctacaccactcggctagatcactcttccggtcactttcggcactcgggagaattttcgcacagaaaatgtttgtttcgaagtcgctgatttcgagacagcataccatgctatacttggacgaccggccctagccaaattcatggccgtcccacactacacctacatgatgatgaagatgcttggtcctcgaggagtcatatcactacgaagcaacatcaagaaagccgtcacatgtgacaaagaaagttgcgagatggcccagacccgcgagattacactcgaccgagaagagatccgactggctgcgaccatggcaagcgaaggagaagtgcccgcaaccaagatgctcaaaagcggagaaagcaatggtaagacgaaaaagattcccttagatccctctgatcctgataagattgctgtaataggcgctgagttagattgtaaataggaaagcgcgctcatcacctttcttcaaaataataaagatatctttgcatggaaaccatccgatatgcctggtattcctagagaggtgattgagcactctttacatgttaaggaagacgccaaacccatcaagcaacgactccaccgttttgcacaggacaggaaggatgcaatcaaggaggaattaaccaagctgttagcagcgggcttcatcaaggaagtccttcatccagactggctggctaacccagtcctagttcggaaaaagacggggcaatggcacatgtgtgttgattacaccgacctcaacaagtcttgccccaaagacccttttgggttacctcgcattgaccaggtggttgactcaacggccggctgcgagttactcagtttcttggactgctactcgggatatcatcagatccgactgaaagaatccgactgcttgaagatctcgtttattacacccttcggggcctactgctacatcaccatgccctttggatggaagaacgcaggagtaacctatcaacgcatgattcagagatgtttctcgactcagatcggccgcaatgttgaagcttacgttgatgatgtagttgtcaagaccaagcagaaggatgacctgatcacagatttagaggaaacttttacaagcattcgtgctttcaggatgaaactaaaccctgaaaagtgcatcttcggagtaccgtcagggaagttgctcggatttatggtatctcaaagaggcatacaggccaacccggagaaaatcaacgccatcctcaacatgaaaccgccaagctcccaaaaagacgtccaaaagctgactggttgtatggcggcgctcagccggttcgtctcatgactcggcgagcgggggatgccctttttcaagctgctgaagaagactgacaattttcagtggggacccgaagcacaaaaagcctttgaagacttcaagagacttctcaccactccaccagttttggcctcgccgcatctacaagagccgctactgttatatatgacggcgacctcccaggttgtgagcacggtcctggttgttgagcgtgaagaggaaggccatattcaaaaagtccaacgaccaatttattttgtcagtgaggttttagccgactccaagacaaggtatcctcaggttcaaaagttattatatggtgtcttaattaccgtcatgaaattatctcactactttcaaagtcactcggtcacggtggtcacatcgtttccactcggggatatacatcataatcgcgaagcaaacggacggattgcgaagtgggccttagaattgatgtctttggacatatcgttcaaaccacgaacttcgatcaagtcacaagctttagctgatttccttgccgagtggaccgagtgccaagaagacatgccagaggaaaagagggaatattggactatgcattttgatgggtcgaagaggcttacaggcactggagctggggttgttttaatctcccgacttgagaaagattgagctacgtattgtggatacatttttctgcgtcccataacgtggcggaatacgaggcgctactccatggattaaggattgccatctctctaggcattcgccgattaattgtccgaggggactctcagttggttgttaatcaagtcatgaaagagtggtcctatctagatgatactatgactgcttatcgacaagaggtacgcatgttggaagacaaattcgatggactcgagctcacccatgttctccgacataacaatgaggcagccgacaggctggccaattttggttcaaaacaggaagctgctccttcagatgtgttcgttgaacatctttacgaaccaaccgtgcccagaaaagagacaattgaagccatggatactcaaggcgtaagcatgatcgaagccgactggagagaaccgttcataaaatttttgagcaaacaagaacttcctcaagacaaaaatgaagccgagcagatttcccggcgcagcagactttacattattcatgaaactgatatgtacaagaaaaatccatcaggaatactgcaacgctgtgtgtctttggaagaaggaagacaattgttgaaggatatacattctggtatttgtggtaaccatgccgctgcatggactattgtcggcaaagcttaccggcaaggttttttctggcctacagctgtatctgatgctgacaagattgtggggagtgcgagggttgtcaattttttgccagacaaattcacctaccagcccaagagttgcaaaccatcccgttgtcctggccgtttgcggtctgggggcttgacatggtcggcctgtttaaaagggc

SEQ ID NO: 1996 - DNA, 5132 bp, Oryza sativa
aatgttgccagtgaagtggaatttgaatcactacgatttcggaacttcaacgaggagcgttatgaagagggccaagtagacgacatcaatcgattagaagaagcccgtgaagcagctttaattcagtcgactcggtatttgcaagggttgcgccgttatcataatcggaatgttcgatcgtgagcctttttagtcggcgacctggttctgaggaaaattcaaaccacacaggatcggcataaattatctcccttatgggcaggaccgttcataattgctgaagtcacttggccaggttcttatcgactcaagcgcgaagatggtactctcatcaacaattcttggaatattgaacaccttcgtcgattttatgcttaggcgtttcgtttgtatctttcctctttgactgctaatctcaagtttttccttgaagttttcagtcgggggctactatgataataatggagtgtgatttttatcaattcaatttgcttacttgatttatcattgccctatttggtctttcgacttagtcgatgaggactgaaggtttttaatagcttttgcgggttttaggctcaataaggctagataaaggcttttaagaaatcaaaagctaagtatggaacaccaagcatagcataaattcatcagtattgtacaaattgagccttcatcatcattaattatcaaaatcattgttatatcaatcagtatcagttttttcatcatcagacttatcagacccagtcggccgaaggtcgacttcttggaatctttcaaccacatcagcagcaatcttgtcagcggctttctgcgcatcgttaatgaggtcaagagcagcttcttcgctcgtcccatctgcaaagccatcaatggcatccatatcaacccttggataaagggatttggtcatcgccaacgccagacttgctcccatacttccagcttctttgatgttcttgaaataagtatctggagcgactctcagcttgtcgaagattttggcagcatcaagtgtactcgaaccggcgttattgaagaacatggcccggatgagtggagtagcatcattagcgactttatccctggctccttcaagcttgttgatcttgtcaactaagacatcaaactgtgcttgagacttgatcttgcggtctgcatcaacagattcacattaatgaatcagcatatagaagataatggcttttgaggtattgattattggtaccttcaacctcctttaaagctgaatccctctatcttgccagctctgccttgtcattttccatagtttggatcttcttctctagttcagatatcttggcagcttgcagtacattaacttcggttaatcaagattacagagataacagcccaaatcagttgggcagagtttgcgcgaacctttggatgagccactcagtttataattggattcctggagctcagcaatccaatccctcaaatcgtgttcattctttctggcaagttctctggcctcgtgcagttgactcctggtggtttcgagggttccaagatgaggaactagtttctcaagggttgcggttttcgcctcgttcctaagatgaatcctctgcagagcagtttaatcagcgctcgagccagacggcaaacaagatggctgaggtcaggcatcaaggaacttacatttacaatgcgagtcgcttggttgagtgccttcttcattaggcagacctcttcgtcttctttttgccggtttattataattccttgaggttgcaagttgtcatcccaccacttgaccagaatgggagggcacgaatcttcggctgcttgtatacggggaatttcttcttcatcaccaatcattggtcctaatgtatctactgacaaaggttagacgattgatcagagttatttgggtcgacatggtttcagacaaagtgtttacccgtaatgatttctggacgaggacgagtggattcagatgcctttaaagtagatccagatctccggtcattgctggcgtcttgtccgcgagggttgtctgcttgggtttcaacttctggaatctcttggcttggccctgcgtccgacaggtttccagtcgggggctcctgattaactccagcttcggcttcggccgactggtttccagtcaggggttcgtcgctgggttctacattgtcgctggcctgcagattatcactcgggagatcttttgcagtcggcccggtttcttttgaggaacccgcctccatgttggtcgggtcagagtcttttctagatagatctatatcagatggtttcctgcaagtttgattgtcagtactattatcgcaatgggtgcgcatcaatgcaacggagatcgtaatatgagttgcacctagagttcttcctgatttttggcacaggacgactggatgttttcttccttggagtagcctgcttcggcagtttattggttgcctctcggtctccaagctttctaggagtgtcgcctttgtcgtcacttagaaccagcttcacataaagctagagattatcttccgtcacatcggagggcgcctactggctctcgaagctttctctctcttccgccatgaatgtggactggatggtttgatttggtctgagatacggctggaaaggaatggggaattggagtggtggatgccggcagaaattttgtggagtgtttgaggatggattggagcggattgctgaaccctagcttggccggcgcagtttgtactgtagcaggaaatggggaaaatggcgagagtctcggcggggatgacgaagagacgtttttcacttcggtgatattagggtatcgggagtgctagcaggcctgggccggcacagtacttcagcccaattttatttccagcgtggcccattgtgatccttagggacttaggcactttttgctttggcaatttgtgctcacaatgatgtggtccaatgctgttaaaaccctttttaatgcggtttgataattctttggaattaaaacgatgcaaacaaaaggtgcccgacagaaaggtgttataccgtttttgtaagccttattaggctgcaaaagctgtttgggttgatttgagatgactggtttactaatagtcattcttttagcatgttatatgcttattttggttatggtaagggtcacagcctaggctattagactcattaattaccgtgattttttatcatgtttggtgaatcattttaagagtttcttactcggattcctatcaaatatgtctatttttggatcttttgagtgtttatcacttggccctttcatgttttttatccttgatatgttcaaggagtgttgataaaaccactcggttcttgactacgtgtttagtttttcaactaatcacatagtcgggcgctacacctaattaggtgcatctactcgatgcaccatgttttattttcgcccttcgcagtctttgattttagcactcggcaaactggagcaagttgaattgaagcactcggattgctgttttttgtttcgagaaggctattttgtcaactgcgaaggtctcgggactactgtggagaatatggatatcccatatctacatgacagttataatttagtcggatatatggtaccaaatatagatagaatatctttatgaagactcgagttagttttttacttgtatgtcaaggaaatacccgagatcttagtcggttaggattgtattttatctataatcccatattccgttaggatatggactgtattttgtaaagcggactccttcccctatataaggagggtccgtgtgcctctcggggcgcaattcttttctccaatatatataatcaataacatactcggtggaatcatccccggacaggagtagggtattacttcttgaataagaagacctgaacctgtataaaattccttgtctccaaacccatccactttgctagcttgatagccacccccttttattattgccgaaatcttgtttcgacactccaatatgtctaaaaatcatgttttggtgctttttgaactttttcattccggtgaaaaacaacacacccacgtgtgccaatataggccaatattggcattaattgacaaaacttcaccgcgcgagtcacgagtgatttttcgacacggacgaacccaattctctatagtatgtccaaaaacatgtttgtgtgctttctgaactttttcattccggtgaaaaacatcgcacccacgtgtgccaatataggccaatattggcattatttgacaaaagttcgttgcgcgagtcacggagtgatttttcgacatgaacacacccaacatagttcaataagtccaaaaatcatgttttcgagctttttgaaatttttcattccggtgaaaaacatcgcacccacgtgtcgcaatatatgccaatattggcatcaatagacaaaagttcgtcgtgcgagtcatggagttatttttcgacacggatgcacacaatacactccaatatgtccaaaaatcatgttttagtgctttttgaactttttcattcctatgaaaaacatcgcacagtttgcttcttccttcatccgggctaggcacgtactccgagcacgcacgtgggccaatataagccaactttggcattaattgaaaaaagctggctgcgcgagtcacggagtgatttttcgacacggacgcacacaatacactccaatatgtccaaaaatcatgtttcgatgctttttgaactttttccttccggtgaaaaacatcgcacccacatgtgccaatataggccaatattggcattaattgacaaaagttcgccgcgcgagtcacggagtgattttccgacacggactcacccaacatactccaataagtccaaaaatcatgttttggtgctttttgaagttttttattccggtgaaaaatatcgcacccacgtgtgccaacacgggccaatattgacattacttgacaaaagttcgccgcgcgagtcacggagtgatttttcgacacggaatcacccaacaaactccaatatgtccaaaaatcatgttttggtgctttttgaagtttttcattccggtgaaaaacattgcacccacgtgtgccaatatatatgcaatattggcat

SEQ ID NO: 1997 - DNA, 3131 bp, Oryza sativa
gaacttttccattgcggtgaaaaacatcgcacccacgtgtgccaatataggccaatattggtattaattgacaaaagttcgtcacgcgagtcacggagtgattttttgacacgaactcacccaacatacttcaataagtccaaaaatcatgttttggtgctttctgaagtttttcattccggtgaaaaacatcgcacctacgtgtgccaatataggccaatattggcattaattgacaaaacttcgccgcggaatcacgaagttattttttgccacgaacgcacccaatacactccaatatgcaaaaatcatgttttgatgctttttgaagttttttatttcggtaaaaaacatcgcacccacgtgtgccaatataggccaactttggcattaattaagaaaagctccccgcgcgagtcacggagtgattttttccacacggacgcacccaatacactccaatatatccaaaaatcattttttcatgcttgtgaactctttcattcgggtaaaaaacatcgcacccacgtgggccaatattggccaacattggcatcaatggataaaagctcgccgcgtgagacacggggtgaattttcgacatggatgcacccaatacactccaataagtcctagaatcatgttttggtgctttttgatgttttttattccggtgaaaaacatcgcacccacgtgtgccaatataggccaatattggcattaattgacaaaaattcaccgcgaaagtcacagagtgatttttcaacacggatgcatacaatactctatagtatgtccaaaaaccatgttttggtgccttctgaagtttttcattccggtgaaaaacatcgcacccacgtgtgccaatatgggccaatattggcattaattgacaaaagttcgctgcgtgattcacggagtgattttttgacacggactcacccaatactctacagaatgtccaaaaaacatgttttggtgctttcttaactttttcattccggtgaaagacatcgcacccacgtgtgccaatacaggacaatattggcattaattgacaaaattccccacgcaagtcacgaagtaatttttcgacatggtctctcccaagatactataatatgtccaaaaatcatgttttggtgctttttgaagtttttcattccggtgaaaaacatcgcacccacgtgtgccaatatgggccaatattagcattaattgacaaaagttcaccgtgcgagtcacggagtgatttttgaatacggacgctcccaatactctacagtatgttcaaaaaccatgttttggtgcattctgagctttttggttccggtgaaaaacatcgcacccacgtgtgacaatataggccaatattcgcattaatttacaaaagttcatcgcgcgagttacggagtgatttttcaacacagacgcaccatatccactccaatatatccaaaaatcatgttttggtgctttttgaactttttcattccggtgaaaaacatatccactccaatataggccaactttggcattgattgacaaaagctcgccgcgcgagtcacggagtgaattttccatatggacgcacccaatacactccaatatatcaaaaaatcatgttttggtgcttttgaactctttcattctggtgaaaaacattgcacccacgtgggccaatattggccaactttggcatcaatggacaaaagctcgccgcgcgagacacggggtgatttttcgacacagatgcacccaacacactccaataggtcctaaaatcatgttttggtgctttttgatgttttttattctcgtgaaaaacatcgcacccacgtatgccaatataggccaatatttgcattaattgacaaaaattcaccgcgaaagtcacggagtgattttttgacacggacggatccaatactctacagtatgtccaaaaccatgtttcggtgctttctgaagcttttcattccggtgaaaaacatcgcacccacgtgtgccaatatgggccaatattggcattaattgataaaagttcgctgcgccagtcacggagtgatttttcgacacagactcacccaacagactccaatatgtccaaaaatcatgttttggtgatttttgaggtttttcattccggtgaaaaacatcgcacctacgtgcgccaacataggccaatattggaattaattgacaaaagtttgctacgcaagtcacggagttattttttgacacggacgcacccaatacactccagtatgtccaaaaatcatgttttggtgctttttgaaatttttcattccggtgaaaaacatcgcacccacgtgggccaatataagccaactttggcattaattgacaaaagctggctgcgcgagtcacggagtgatttttcgacacggacgcacccaatacacttctatatgtccaaaaatcatgtttcggtgctttttggactctttcattctagtgaaaaacatcacacccacgtgtggcaatatatgccaactttggcattaaatgacaaaagctggctgcgcgagttacggagtgttttttcgacacggactcatccaattctctacagtatgtccaaaaacatgtttcggtgctttctaaactttttcattccggtgaaatacatcgcacccacgtgtgctaatataggccaatattggcattaattgacaaaagttcgatgcgcgagtcacggagtgatttttcgacacggatgcaccgaatacactccagtttgtccaaaaatcatttttttgggtgctttttcaactttttcattccggtgaaaaatatcgcacccacttgtgccaatataggccaatattggcattaaatgacaaaagttcaccgcgcgaggcacggagtgatttttcgacacggacgcacccaatacactccaatatgttcaaaaattatgttttggtgcattttgaactttttcattcaagtgaaaaacatcgcacccacgtgtgccaatataggccaatattggcattaattgacaaaagttcccgcgcgagtcacggtgtgagttttcgacacggattcacccaacatactccaatatgtccaaaaatcaagttttggtgatttttgaacttttt

SEQ ID NO: 1998 - DNA, 13304 bp, Oryza sativa
  unsure (1)..(13304): unsure at all n locations
ttaattgacaaaagttcgctgcacgagtatcagagtgatttttcgacacggacgcacccaatacactccattatgtccaaaaatcattttttggtgctttttgaactttttcattctagtgaaaaacatcgcacccacgtgtgccaatatagactaatattggaattaattgacaaaactttgccgcgtgagtcacggagtgatttttcgacacggactcatccaatacactccaatatgttcaaaaattatgttttggtgctttttgaactttttcattcctatgaaaaacaacgcacccatgtgtggcaatacatgccaatattggcattaattgataaatgttcgccacgcgagtcacgcagtgacttttcgagatggacgcacccaatactctacagtatgtcgaaaaatcatgttttgatgctttttaatctttttcattctggtgaaaaacatcgcacccacgtgtgccaatataggcctggcattaattgacaaaagttcaccgcatgagtcacagagtgatttttcgacacagacgtatccaatatactccaatgtgtccaaaaatcatgttttggtggtttttgaactttttcattccggtgagaaaaattgcacccacgtgtggtaatataagccaatattggcactaattgtcaaaagttcgccgcgcgtgtcacaaactgatttttcgacacagacgcacccaatacactccaatatatctaaaaattatgttttgttgctttttggtctttttcattccggtgaataacattaaaacattatatttgtaatattttttaaagaaaagacacttactgatctctatttcatgaaccatgcagacgactgaccacacttcacctacacttttatgcaaactccgactactcactgactcactctatccttactagactcactggaccactcgacctcacaaaaggaaagagcagatgagaaaatcatagggctcttagtgtttccacttggcttatcctacgatcaaggccggctctaataccaacttgtcacgcccagaaattcgttaacccgaattttaagtagaatgtgtattaaatctccgtccaggaccagccagagtacacaaacaacaatttgatagacagatccacgtcttacaaaaataacaaaataaaactaacatacgcagcggaaaaacaaataaactagacttaatcttcacgaccaacgtgaagcttcctccatgttggcggctgttaaacaccgattctataccaccaacatctgcataaagttcagacaataaaacatccaacatagtgataggtgcttaatgtcacatattccacaagtgttggtgtatatttgtatgcaggtgtcaaaccccgaagttggagggaaatctagactaaagtgaggggaaaatttatctatacaaggatgggttgtgaacttcatcaaaatatcaaagacttagcccaaaactccgagaaatggataaaggaggacaaggggaggagatgggccgaaggccaggccaggtgggcccagcacaggtttgcccgaaccccttggttcggccgaaccaaaatctcagccattcaggctggggtttggcgtggacagtcctgatcatctcctgatgatggttgcggggcatttccgacaattcgcattgtgtaaccatcatacctacctctatataaggagcttcactccttcactctcacacacacttccaagcttgagctgaattataagaggctctattgtactatattgtatactagaataggaagagagtagagtagaagaagtcggaagaattctggagttgtcactaatcttctctcatttcttgtattctgttcattactctgatttcaatataatattcttcttgagtaacttagatttatcttataagaattaacctaaatagcatacgggattattgttcactataatcaactgaaatatagtgattgctttggtgagttataaacactgaagtagatattaattgcttagacgtggtgtttaggtaattgttatccagtaattgctgcgtatcccattgtacgtttgaggtaggtgtagaggtggtgacagccctcgagatcacttaagtcctccctgttcgggtacgtaatagagcgacatctgggaacagtgagttaccagtgcctgaagtattgctttaggattaaacttaagctttccctagacactgtttcttaccagtgaatcctctctatcctagcctatcctttgcttggtgtccttggatgaaccggaagaagaactgaccacacatgttcccttggatttgataccctttggaatactccgtaggggaagtgctacatcggtatatccgtgtgcttgcggattttatctgtgatcgtaagaattaccaacactccataaaacacaggcaatcctcgacgcccagaacaagctcggtcctcaaagaactcaccacccgaaccaatctctgcttcgaagggggtggggaggaaataaagcaagactgagtaccaaccaccataaaaatagcattggatatttgcggtaaaagcagcatttataaatcatattttgaaatagtaaaaacaatatataattaagcagtattaaatcatcactatctaacgctaaatccacggtgcaacacgcccaaccaaaaccacctaaacaactccagttctataagtcaaattattattgtgggactaatcacaatgagctggttgaccgcccaataactgcgggcatggctattccaatagttggggggcatgtgttaacgaccaaatttggtaatgccatgagccggattcaaagctagagtcaaagccgatttggcgagattccatttgagaaggtagaatacgcattggctaagaacagcatcagctgccacatgatcggctacaggcaatattggctgcgcatattggctagcgccaaatccgcggaatcaagccgatgcaaccagtctcgaaaatgatggtcccacgttggtcatcagggttagccaaagcacttcatagccattgccacacaaggattggagtcctaaaaaggggcaattgtatctattaattaggatattttttcagtttccttagagatatgtttggtaagagcccacctaggggactcattcgtattttaaattatattagagacaagaggcgtgtccggcaaggacacattatgtacttcgggtattaatatgacctgacaccatgtaatcaagggacgacagttcaataatactttggtgcatcaccacccttttctatttttattgtttcgacgagtttttgctttcaagttgggctacatcaggttcgatcttcgacgaaaaggtaaagcttgttatgacagtttgcgttgttgggattagtgcttacatcgctatgacactctaatcctgtctacgtgaatcgctgaattatcatatataccgcataatctagattgatctcgtcatctaaccccatcggccagcctctatcatcgaaaacggccgataggtttagatgtcgatgtcagcctagattatgcggtgtatctaccatcttgaatgagttttcatctatttgcttagatcttatgtttcttttcacgcttaacacggcatcggttaggttcgacctgttaagtattgtcttgaaatgtgttatctagctctttctttgaatgctaatatagatagcatcagggtttcagccgatcttacctgatttagccgtcttgttcccctacttggttctggatcgtctaaatctgccctttatatcaagatctcatccgtttaaagtatattaagcttcctatcagtctgctagtttccctgcttggtagattgatctcggttttgtatatttcacctgtgctaatatctaggtataaggtggtatcggactactagctgatacatgttaggtttgccctatcggctatgctgcgagcatacataatccctactgtggggcacatttagatactgagtgatttatactgtctcggcataatgtccgatctatcccaatcactcgatctaagcacgttccattggatggattacgtatcatctacagccgatcgagtaggcctaataatctctaagttttatctacctttgctgatctgatgcaagttatatcagcttgcctttgctgatctatcgttgatggatttaactctttgtcttttttctatcttgttggttgcaggatcaaaccagctggcacgctcagaacccaaaggcaatctctttggacctgcactagagttaagcagatctcttaggccagtgcgtgttttttgcgtcaacagaggtgtacaactttacccacaagacacgattccacacatgttaccatgccctgaagtaccgccacgatactacaaaggtggaaatcgtgacaaaacccgccgtacaaccctccctaaccaaacatacccacctcaggtttcaccccctccttgtgccaagttgggcagtcccttctcgcgcctaggtaaatccagctacagcagagaccaatatcaaggtccgaactgcaccatcgcctctacctttgccatggtatgtcagctaggttaagttatactgtagatttagcctggagtcaacatatggtaacggtcggaaaacgtcaagtgcgattttcactcggagtcgacatatggcaaatccgaaacattaccaaatatttcagaattggggggcatatgttaacaaccaaatttggtaatatcagtgttgggaaataagattagatcaaagcggaatccaagacgaagatcgttacggaaacagagcaagaatcggctatgatccaaattggctacagacaggattggcagagttcgagtcgaacagggttagccgatacagccgattctaacaatatggctcggtatacgtcatcaggttgaattaatgtgcttcatatggattgccacacgtggattgagtcctaagaaggcaattgtatctattaattaggatattttatgtaatttccttagagataagtgtgggcaaaagtctgccgcaaagacttatggtatcttagagtttgttagagatgagagtcgtgtccgacaaggacatattttgtaatctcgggtataaatagaccccgagccctatgtaatcaattaacacacgttcaaatacaatctcggcgcatcgccaccttttactttcgttttgtttcgacgagttcttgctttcgagttgagctgcatcggtttcgatcttcaactagaggtacgacttgttatggcggcttgcgttcttgggattagtgcttgcatcattatgacactctaatcctgtgcatgtaagttgtcgagttatcatatattctatataatctccggcaacattgttacctaacctctaataggctaacatctgttactgggaggcagccgatcaggttaattaccgatgttgatctagattatatagaatatccaccactctacgaaacttccaatggcttgattgtctagatattgtgtttcttttcatacttatggctgcatcagttaggtttgacctcataagtcgtgcttagaactataatctctagcctgcttcttggttgtcgattagagtagtatcggggttttagccgatcttacctgatttagccttatatttcatgtgcttaattgatatgctaaatctgccctttatattgagatcttattgctttttttagatatgttaagctttttgtttgatatattttactcgctttaatatcttaatatagagtggtatcggtgtattagccgatacgcgctagatctatctaatcggttatgctgtgaacatctataatctcattgttaatatatatttcgatctaagtgatttatactgtctcggcatggcgaccgatctatcccaatcacttgatttaagtatatatcgacataaaaattatgcattgttaacgtctatacccgatcgagtagatttagttttaattacttatttataactgccgatcgattcacatatgacatcggctcgaagataaatgatatgtcatcggcggctggctaatcggctatcattatggatttaactactgtttctttgtctttatttcttgttcagccgaactggcccctagtattattgttccaatcacattggataaattgacgactgagcaaagggatgagctcgagcagatgatgagcaatgtaaaggatcagttcatgaattctttccaagaaacccgcagaggaaccatcgtccagaagtacaagctgaaggtagttgcagccgatgaagctggttcgggttcatctcaaggtgacaaaggtgatgttcctcaagatggcactgtgaagattttggtgcagatggcaaccaagagccgttgcagtttaacaattttcaggataggatcgactatgccgtgcaacatgccttgattaaccaatctggagtgttagttaataccttaaccaacatggtgaagactgttgtcgatggttcgatagccgagcactagcctcaggaccagtttatctaccaggaggtatttttccaaattatagacctttggtcacagctaatcagctgaacgcctccaatgcactgccagctcagcccacggctccagtctcaactactgtacaagctacatcatcaccaccaagacagatggttaaccccagattgttgaccagagaacagccacaacatcctgggcaaaatgtcaatcggctgactcaggagcaagttgctgcgatgtttttgccaaatccgacaatagccgatccaacacagccccaaccgactcagcaagtacaaccgaggcagtagacagttcagccgactcagcaacagaacgtgcagcatccgtcgacaaggttgagaacacctgacaatcggctagtgcaacatacggtgcaccaagtaattcctaaacacttggttcatcacgcacaggccgatcaatcagttatgcctcagattatccctgaacatttggtgcataatatccagccgaatatctagaattatcaaggaggaaatctaggttatcaatatcagcctccgtcacctcatgttcagtatcagcagacaggatcgcctcagcctcagcacgctcctcaatttaatcagtttgagccgatgcagcaacaaatgcaaggagtaccttagcaaacgtcatgggctgatatgctcgcagatgtaatgagggaaccatttgtatcggcatccttatcctgagtggtttgagaggtttccattgcctagccgatacaaagtacccgacttctcaaaattctcagggcaggatgatgtttcaacttatgaacatgttagccgattcttggctcagtatggtgaggcatcggctgctgacgccttgagagttaggttgtttcctttgtcttcgtcaggatcagcatttacatggttttcttccttgccatataattctgttaatagttgagctgatttggagaagcaatttcatagctatttttatagtggaattcatgagatgaaaatgtttgatttaacagcaattagacaaaggcatgatgagtccgtacaagattacattcaaagattcagggagatgtgaaactgatgctatagtttatctttgacagattctcagctagccgatttagcttttcaggggttgatagcaccgatcaaagaaaagttttcggctcaagattttgagagtttatcacatctcacacaaaaggtgactcttcatgagcagaggtttgctaaggccaagaagaacttcaaaaagattaatcatgtatatccttacatgtatggttctgatgatgaagacgatgattccgaggtggcggcagccgaatgggtcaagagcaagaaagtaataccatgccaatgggtgaaaagttctggaaaagaggaaaaatttgacttcgacatcaccaaggatgacaagattttcgacctattgcttcgagaaaaacaaattcagcttccggctggtcatgtgatcccatcagccgaagagctgggcaaaagaaggtattgcaagtggcataattctagttcctattcaactaataattgcaaggtttttaggcagcaaatccaggcagccattgaagggggaaagatcaaatttgatgattcaaagaagcagatgaaggttgatggtaatcctttccctattaataaggtgcatacatctagaaggacagccgatggggggatgaatagaaattttcacatgaattcgactaggattatcaacaaataccaaagaaagtatgataaacagcatgagaaatatcatgaaaaagatgatggttttgaccctcattgggattgtgagtttttcagattttgctggaatgaaggtatgaggttgccatcgattgagaattgccctggatgcagtgaagatacagggagttcaagccgatcctataatagaggtaatcggccaaatcagaagagagtacctgttcatcaaaggctgggcctggtaaatcaagatcattatcaagataaagatgaaaataggaatacacagtggtgtacctacaggcattttcaccaagaatcaaaagagaagggttcaaaggttgaggaacagggagcaatttcagagggtgcatcaagagattaatcatcggctgaggaaaacaaagactaagcaagaatggcgtgttaaaagtacagttgtatcagccgatgaggtcgaagccgaaaaggcaaaaagggtgctcaaaggcaaggctcttgcatcggcatcagtaaatatggtttttatgctaccggccgaatttgaagctaggcaagccgatgttgatgatgttgaggaagcttcagctaagttagttttgtcaccagagcaggcggtctttgagaagccagaagggatagaaaattggcatctcaagccattgtatatcaatgggtttgtcaatgggaagcccatttctaaaatgatggtcgatggaggaggtgctgtgaatttgatgccatatgccacactcaggaagttgggcagaaatccagatgatctcatcaagactaatttgattctcaaggattttggtggcaatccatcggaaaccaaaggagttttaaatgtggagctgacagtcggcagtaaaactgttcatacaacattttttgtcatcgatgggaagggtttctataacctgttgctcggaaaggattagattcatgctaattgttgtattccttcaaccatgcattagtgtttgattgaatggcaaggtgacaaaattaaaattgtaccagctgacaggtcagttaatgttgctaatgccgatttagctctttgggatatggacggtattgattgcttgtctggataagtttgggatggagattttctaaaagtgtccgattctgatatacagccgattgaagatgcagagcccaaattgttattttgagggcgtcgtggagggttcaaatgtctacaccaaggatgcagtagatgatctcgatgacaaacaagggcaaggttttatgtcggctgatgatttggaggaaattgacataggtccaggagatcgaccaaggccaacatttatcagtaagaatttatcttccggatttagaaccaagttaatagaacttttgaaagaatacagagatttctttgcttgggaatatcatgagatgccaagactcagccgatcgattgttgaacatcggctacctataaagctcggggttaggccatatcagcagccaccaaggagatgtaaagccgatatgcttgtggctgttaaggctgaagttgcacgcttgtatgatgctgggtttattcgtccatgtcgatatgctgagtggatttctaatatagttccagtcatcaagaaaaacgacaaagttagggtgtgcattgatttccgggatttaaataaagctaccccaaaggatgagtacccgatgccagtagccgatcagttggttgatgccgcttcaggacacaagattttgagttttatggatggcaatgcaggttacaatcggatcttcattaccgaagaagacattcataagacagccttccgatgtcctggtgcaatcggcttgtttgagtgggttgtgatgactttcggcttgaagagtgctggagctacgtatcagcgagctatgaattacatattccatgatctgatcggctggttagttgaggtttatattgatgacgtggttgtcaagtcacgggaagtagagaaccacatagccgatttgaggaaggtttttgagaggactagaaagtatggcttaaaaatgaacccgacaaagtgtgcctttggcatatcggctggtcagtttttgggatttcttgttcatgagagggggattgtggtgactcaaatgagtattaatgcgatcaagaatattcagcctctggaagataagacaaagttgcaggagctgatcggcaaaaataaattttgttagaaggtttatttctaacctatcagggagattagagccttttacgcctttgttgagattaaaagtcgatcagaagttcacttggggtgtagaacaacagaaagctttggatagtatcaaggaatatcttagttctccaccagttcttattcctccacaaaagggggtgcctttcagattatatctattggctggtgataagtagattggttcagttttgattcaggagtttgaagggaaagagagagttgttttttatttaagtcgacggctcttggatgcagaaacgaggtattctcctgtggaaaagttgtgcttgtgtttatatttctcttgtaccaagttaaggcactatctattgtcaaatgaatgcattgtgatatgtaaggccgatgtggtgaaatacatgctatcggctctgattttcaaaggaagggttggcaagtggatatttgctttgacaaaatttgatctttcattttaatcacccaaaggcaattaaggaacaagctatagccgattttattgtggatcatcgagatgactcgatcgactcggtagaaattgtgccatggactttattctttgatggattggtatgcactcatggttgtggtattggcttggtcataatttctcctcgaggggcaagttttgagtttgcctgcactattaaaccttatgcgactaacaatcaggctgagtatgaagctgttctcaaaggattgcaattgcttaaggaagttgaagccgacgctatcgaaatcatgggtgattccttattggtaatcagtcaattggcaggagaatatgaatccaagaatgatacattgatggtttacaatgagaagtgccgagaattaatgagtggatttcggctggtaactttgaaacatgtgtcaagagagcaaaacattgaagctaatgatttggctcaaggggcatcgggatataagccgatgttgagagatgttgagatagaggttgctacgattacagccgatgattggagatatgatgtatttcagtatttgcgaaatccgtctcaattggcttcaagaaaattacgaaataaagctttgaaatacaccctgttggatgatgagttgtattaccggatgattgatggggtgttactcaagtgtttgagtgccgatcaagccaaggctgcaatcggcgaagtacatgaaggaatctgtggaactcatcaatcagctcacaagatgaagtggttacttcggcgtgtggggtatttttggccaacaatgttggaagattatttcagatattataaaaggtgtcaagattgtcaaaagtttagggcaattcagagggcaccagcatcagctatgaatcctattattaagccatggccatttagaggatggggtatggatatgatcggccaaatcaatccaccttcaagcaaggggcataagttcatactcgttgcgaccgattatttcaccaagtgggtagaggctattccattgaagaaagttgattcaggggatgctattcagtttgttaaggaacatatcatctaccgatttggcattcctcagacgattacaactgatcaaggttcgatatttgtgtctgatgagtttgttcggtttgccgatagcatgggtatcaagttttcttctccatattatgcacaagccaatgggcaagccgaagcatctaacaaaagtttgatcaagttgattaaaagaaagattctgattatcctcggcaatggcatactctgattgagctgaangcattatgggcttatcggatggcttgtcatggatcgattcaagtttctccctataagcttgtttatgggcatgaagctgttttaccatgggaagtgagaatcggctcaagaagaacagatttacaggatggattgacagtcgatgagtattacaatctcatggtcgatgaacgggaggacctggttcaatcaagattgcgggctcttgaaaaagttacttaggataaagagagggttgctcgacattataacaagaaggtggtgcctaaatatttttcagaaggagagcttgtttggaagttgatcttgccgataggaacttgtgataataaattcggcaagtggtcgccaaattgggaaggactgtttcaaatccacaatgttgtgtccaagggagcttatatgttgcaaagacttgatggggaagtttatggacgggcccttaatggcaaatacttgaagaaatattacccaagtgtatgggttaattcatgatcggctgaatttgccgatgcatgtagagccgatgtgtttgcatcgccttgagatggccgatatagtaatatcgcccttagctgttttatcttcataatcggctgtgttttgccggtgtatgatggccgatatggttatatcgcccacagactaatttataattttatcaatgtcttcgtcattacaaaattagggggggcatatatatatacaaagttggatatttttgaaatttttgaggcaaattcagaagttatgttaatcggcataaaggattatcaaagcagttacttagttggtgaagtaccaaaatatcttagccaattacaagaattttctaagccctattacatggatagtcattgagacaaatattactgaatagccgatatagccctttgcctaatttgctttacttcttctatggcttgggcgtcttgagcatcggttccagggatgactttgagggacttagtcatatcggcaatattcctgatagccgatttcagcctcaacttctgctcttcaatagcctttggtaggtta

SEQ ID NO: 1999 - DNA, 14106 bp, Oryza sativa
aagcttctttcaatgatttctttatattcgggttttccaacggccattttctgcccagggtgatgccacttcatgatcatctcagcaaggtcgcaactgacaccagtatcatgattaatggcactggacttgtccttgatttctcgaaattccttcagccaaatgaactgatagataaacgaaagagaagaatgttaaggggcaaaaaataaataaatccagtaaataatcatgcaatgtctcccaatcatgacgcatgcaattcagtaggtacaccgcaatcagtggttcaaaaacagtggacgctaagcagctagttccaccaagcaaacctaggcatgattaggcacatgtaaattttactacatagagtatgtactatcatattacatagagcaaacctggcatattaaatcatagaaactggcatatcatacatccatgacatcaatgatgtaaaatcttcatctctaatttgccccacttctctgtgcagacccgaaacaacactaggcaggaaaacaactagatgcaatcctaggtgctatgaaagaggggcagctgggcccagttactagttagcccagttactaattttgaattttgaaaagcggtacttctcaagatgtgctgccaagaacagctggaatatttaatcacaatcgaaagatctagcctttttcaattccttaagttcttgcaatgtgattgagaataagttgttgtgctaaggtaatatacaacgcattttaaaaacaaacaaagtgatgttctttcggttaggctgtggtgttcattatcccggtaaccctggctttcggagcatgttagagctcaatcatccctatcccacagttagaaaataaaattggttgtatagcaaaggttttagcctgcaacaatccattctttaaactataacgaacaactttcaacagagcattatggaaaaaatgcattttcaatcagttgatcagcaaacaaaaaaatgaatactgagcttgtgcttgcatttcttctctcaatgcaaataaaaaggaaaatgtaaagtaaatgtggtggtcaatacccaattcaaactggcaaccaacaacgcaaaaaaaaaaggaataacaataagaagaaatgactaactttggataccctatagtccacgccaaagtttgcccagatttcctgtagttggtagagaaaacagaaaagttaggtcgatgacaaagagagaggcaatcaagcacataagtaaacagggaaggaataaaagcatgcacctgcagggcatttggttgaatgagtctgtccccactcataccgaacattgcgaagccagagggcgtctcaaacagaactaagactattagacaatggtacgtattgtgatctgcgaacacacaagccaagcaaacttaagcaacagcaagcacgaaggactgcaagaggcaacgagaggagatcaatcgcccattcagtcagcacgcgtgaagcaaagatgtggatcttaggctgaaaagccctcatctctgcgaaataaccgctacatctgccacgcggagtcaaactgccatgaacagggtgttcacagtatgcgagatcgacaacaaacgggttccgtgcatacaggaatcgcctccccagatctatctgctcttcccatgcgatgcatgtgctaccataagttaaggatccgctaggggtttgctttctcatcctcacacgccagttttccttccgacgtgggagggatcaagagagggttggtggctcacctacaccggcgattgaccccgccgtcgccgtacgagtagcactgcatcctcgcttactcgaggtcgaggtcgaggtcgaggtcgaggtcgatctctttcctgtcatggtgtgtgagattgggaccgaaggaagacgtctcaacgttggcttcctaataccggcaacagacgccgctgccggacgagaagcacctccgccgcacagattgcgagatgtgggggttggggggagggggggagtattttaccttttaggccttgttcttttaggctgggtttgggggggaatgggccaacatccccgtgtgccatcccggccgggtcgaattttcttccgtggcccatgtatgcgttcgcctgggccggggtgggagtaattctccacccaatccacaccaatcccacggggagagaaaaatcgcctcggagacgatttttttttccaagccagccgcagcgctcggcctcctcgactcctcgttgcgctagggtttggaggcggcgtgaggtccgggaggcggcgcgaggtccgggaggcggctctagggtggagatccaggagcagcatatctccagccgctgccgctctccatcccgccctcggacgccgacgatctccatccagcttcagccgccgccggtctccatcccgtcctcagccgccgccggtctccatcccgcttcagccgccgccggtctccatcccgcttcagccgtcgccgccgctctccttcccgctctccatcccagccagtcgccggcgctcgccatctctccttcctcgcttcggattcaccggttgcgggagagggcaaggtcgagggcaacagccccggacaccaagaagcaggtctgattcttgatctcctcttttcccactcagaaaagattttgtgacttatctagtggatgaatttgttgctagttgatgtattgagtggctgtatggattgaagtatcagtcatgttctgcttagaaggaggggtgatgtggtttgtagtagtagaacctgaaaccacagaaaattccatgcacatctctgtgtgtgtgtgtgcaaatcttgcctatcagttgctctgtaatcaaggaaatatatatttgaattggcagatcctatatttctgaacatgggctctcttctttcttttctttttttttgtgagggagaaacctggtttgttgattctccaggaattattgtagatgcagtgggagcacacctaaaaaataaaaactagtgcactctgttgttgctgtctagaatgcatcactttgcttttggccaaggtcatttgagcttcagattgaacgaccaatactatatgccaattgaatgagcaagaagatacaaaaatttgagcaagaagatacaaaaatttttaaagtcatgctatgaggtggtcaggtggacactgtagtatacattctagttttggtaattttttccatggctttttgtttagcaaaatgcccttgttaaaacttgagaaatgtagctgtccatcttttgttcgaatacctattttactcttagcaatcaatttagcatatttatctattctgaactgctactatgttcacaactagtttcaggaaactgggtgatcagatatattactagaggtcataccatacaaagctatataaattgctattgaatgacaaaaatataatctgttgtgctgaattaaatttcaggagaggcacaggcgtgtggggttggcaaaagtaaagctgaaggagttgatattactcaaggtatttgagaaaaaactaaatacagttgtacttacatttgcctgatatgaagcatttaatcttgcccctgcatatttactagagtaacagaagtaatttgaagttggagagagagagagattgtaggtacaatgttatgtgatcttgctcaggtggcagatggtctcagttttttttgctagtgaacaggaggttgttattttcaagtaaacatcctaccctagaaggatatcctcactttattaaagttgctatctctgaggtttaaacaaaactaagtacacaaagtattaaaatctgaacacattattgatccccctcctcccattgcagactgtttatttgctgaaagtattaaaagtatttatgcatgtagccaccttgaatgcctctaatttcatgtttaataatcttgtaatacatatgcatattattatgttctcacacatagtttaaagtatagtaattctatatctcttttagtgataaaatcagttcgagaatggcggatgaaattaaaaggaggagagaagaggacgatgatatgatgctttttatttttcctgcgatgtatatgctgtgcggtacgacaaatagtgagaaaatacctagacatatctcaagactatccggtaaagagcggcttcaagaaatccttgaaggacatgtaatggattgtaaagttgcattccgcatggagcctcatgttttcaagacaatagcgaattatcttagagaggaaaagttgttaaaggatagtagaggcttgaggattgaggagaaacttgggatatttatgttcatgctcgctcacaatgcaagctttcaagatctacagtatgaattcaagcatagtgggtctacacttcatcggcatattaagtctattttcaagataatcccagctctcacctatagatttctcaagcttcctcatgccaaccaaacgcattggaagattagaacaaatcctcgcttctttccttacttcaaggtgaatctggcactcaaaatagaaatgaatatctattccttctccaattaaataactcatgcatattctgtccttttcttccctttttgctgcagaattgcataggggctattgatggcactcacattcctataactatagatggagagaaggcagctccttataggaacagaaaagggactttgagccaaaatgtgatggttgcttgtgatttcgacctaaatttcacttttatctcatgtggttgggaggggtctgcaaccgatgctagggtccttagatcagcaatgaatagtggctttcaagtcccaaatggtaaattttttctagtagatggtggttatgccaacacaccacagttcattgctccttatcgtggtgttcggtaccatctaaaggagtttggacgtggtcatcgtcgacctagagactacaaggagttattcaatcatcgccatgccattctgagaaaccatgtagagagagctctaggggttctaaagaagcgatttcccatcctgaaagtaggcactttccatcggataaagaaccaagtgcggattccagcagctgctgcagtgttccacaacatgatccggttgcttaatggtgatgagggctggttggacaaccaacctgataatatagaacctactaattttgtcgatctaccagaaggtgacagtgaataccaaaatgatgtgccatctcttagcaatcaaatgatcagtgggaataatattagagatatgattgctaagaagatgtgggaagattatgttcgtaactagcaagaatagtatagataatattttggttttgcatgatttgtatttatttatgcaatcaacatttatgatatggacaaattaatagtaagcaacgtagtttgtattttctcattcaataaaatattgcaatatagttatgatgtttggaagactatctccgaaagcaagcctattgcagcagcaacaaaggcatccacaaaagaaggcatcaccaaagagctgtagcatacagaagaagaaggcttctccaaaaggtagtatctaacttgtttttttgtgaagtattttcctttcatattaatgattacaaattttacttactataatctaattttgtctaatagctcaacaatcaagagcttcatggaacccgggactagaaaaggctttagttgatttacttcatgagcacaataacccacattaccggtgccaaaacgggtggacaagtgaagcatggaacaaggtcgtcaaagaatttcgtgacagacatccctatgtcgccatgaataagcaacagatccaagataaggagaaggagttaaaacgagattataggttgcttaaggaggcaaggaaacagagtggagcttcttgggataatcaacggtgcatgattgttgccgatgatgctgtttgggcaaacataattacggtatgatattttgagcataattgttttgtcctcattcaaatcactattatttgtattcatgccataattatctgtttttgtatcttgtgcagtcaaatgagaaagtaaggaagttcagcaaaaacaaatcctttcctctctttgaatccttgggtgaactttatgatggtaaatttacttgatgccataattctttgattccttgtgcttacgttcagtgcagccaaccttgttatttgttttcttctctcgttgtttggcactgctaccttctttctttggcttcttcacatatcctgcacctgtactatgttccttttgtatgctgtagtcctcttaggaaacaacaggaacatagctgattagttatgcatagtgacatttctcatatccgcatattggaaatcaatgccaaattatttggttgctcatgatgtttactaagattgaggctttaaatggctgattctgtttgctagtgaacacattcttttttggtgcagtatgatcaatgttccattagttatgcatctcccttctcggatctagtattttccctaataggtatatactgaaacttttgtatgggtagtgaattgcaacctttttttttaggccaaactgctgagggcaacatgaatttcacttctattgagccattccaacatgctactctcacacaagtgaatgaatatcttgagagaagtgactcttttcctgatgtaaattgggttgctgatgatgatgagaccactgaagttcaagatgaagataatgcagtggagcatgaaaatcagggaagccacattactatcacctcaagagctaatggagaaaagaatgtcaagaagaccaaatctactgagagagagagagtagaaaagacaccgaagaggaataagaggaatgatgttgttgatatgatgggaagttacttggagatgagaaaaagacaatctgaggaggaggaagcaaagaagagggaggaggaagcaaagaagagggaggaggcaagcaaggttgatgattgctcaataaggaactgcatcactgttgtggaatcgatggaggagctctcaaatgaagaaaaggtcaaatcttttggagtattcaaggacgcgcagaatagggagatcttcatgagtgcagggcctatgactcgtcttatatggttaagaacgatgctggtaagtttgaattactattgttactagcataatcttaatttgtgcaattctgaaattcaattcttctacacttaaataggtacatttttttagccacgttgcactttgtttatgatgcgattgtgtaacaatgcagaccatgcaagaatgacctttggaccaaaaggatattgtctttccaggtacccgttcatacttttataattttgacatgattttcatgttatatttatgtcaggtttaggctgaagttagcataattttgacataattcttgttagtatgcctctgaacttttataattttgattcttgtcagcatgccccctctcttctgtcatgcagccatgctagtgtgtgtgcgcgcgcgccactactactagtacatatctacatcgatctacatctacctatatacattcatccacttacattccttgcctaccaccttactacttcctaaaatcaatctatctatctatttatctatcgatctatcatgcgtgcttgctgtaactgattaactggcagtgtgatcatctctctctactgctgctacatatatgcagtgctatgctgcaggtataatgtgctatgtctgcctaccacaaatctaagctaattgtgacatggtaataaagcaggtgctagagtgattctctgtgtgtatgtgtgtgtgtatgtgagtgtgtttgatgtgtaattgtatcattgcttgtgctcaacaaaaacttgagtacaagtaaccatcttctgcatatttatctaatttgattcaagttcattttacctgttgtttagtttacatattagcaatcaccattgtctagtgtctaagacttgtttctttttggttgtgtagtttacagggttccatggcccatttgctagttgtgcccattggaaggaatcttttgcaagatagttcatagagaccacttgaattgtgaaatgcgatggatgaaggacaatttttcctaactgcttcttaattcatgtagctgtgatggttgcaggaaccttttttttctacaggattaacacttgcttgatcagacatagatatattatttagtttgatcggatagagatatattacgttcaaagaacctattttgtagcttgctttgcacaatggcaattggatgtttactgcttgtagaatttaatctatccaaaattataatttttaatattctcgactatttttagaatccatctgtggtaaatccatgattttctatctttacgctttttagaattattttgcacgttgaatttctgttccattttcatgatcgttttttatcttgtcatttctgaattattttgactttcgtgaccttccagctttttaaattttatccgaattttccatgatagtttctcacgctgaatttgaatggtagtaatcccttctaatctcacctgtaatcccaccttctactccaaactgctagccaacagggaaatcccagctagcaaacaggggaatagaggccaggagattgggggaacaaggggattggggggaagggattgagtgtggggagcggggacaacccaaaccccacgtgggttggttttcctttggattatttcccacagctagcgaacaaggccttacgcgtgcggctgttgtgcttctggaaccgcctacaagccaatcgatcccactgtttgggcctgattcgagataaagggccgttttgcattgctacaggaacttattagccgtaccaatattttagtagtttagatagtacatgtgcttgtttggattgtgaccaatctatatctatatctatatctatactaactagcaaaatgctcgtgcttcgctacggttaaaatgaacgtttaaatgttataaatatttcaagaacggatataaaacactgtcgcattttgatatactcatatagtcataacgtgctctctatcaactctcacatggcaagcgcatgatatcatttacaaaattgagatggtgctcggactctaatatgtcatgtcacagaaagaaaataattacttacttaaaattattgatttttgaattatctgttgtttttcgtatattgtccgcattatgcaccacacacaatatacgtggatccacatagttgccgcgtgttgcaataggtaaacactaaattaaattaaagtgttgcaacaggtaaaaattaaattaacaaacacaaacttttctcagcatttttcatgtgatcgaatattatccgtatggttaatataataaagttaatgttaggaagagcagccagccaaccacgacacgccactcctcgcccttgcctcacgtggctcctataggaacgaagctcgggtcacggcggtatcgacgaagaatctcggggcggtggggaggtttgaggttagtcatggactgtgttttgtgggtccaaagctcggggcgatgtgtcaagtcttttggaatttttttacaattattattttttttatctcaaataaatattgaagtagaagtttcgattttttttgatgtgaagaataaaagatcttaataaaataatttattttttagctgaattaaatccatggattagcacaatctagaacacagtggcacctgtccacagctaaggttttgttcagcagcctggttaggaacccatgtctacagcacgggaaaacggaacagtacattagctcgtgattaattaagtataagctattttttttttcataaaatggatcaatataattttttaagcaactttggtatataaactttttataaaaaaaggaccgttcaggagtttgaaaagcgggcgcgcagaaatcaggagcgatgagttgggaaaactggggaagaacacagccaagtgcagccagaagctcctattttttcataaaaaataaaaataaaagaagattatttcttgtacagtactactgactactgagtagataaaattgtgtggtatggtaaattggtaatccttatcctctcactctctcactgtttcgttctctctctcccattctgtctctccctgtccctctctctttactctccaagcgttgctcctcagtgctcaactgctcacgctcttgttcaaccgggagaagatgccgttcaacgcatcggcagcggcgacggctcctccggccaagcacctggtcggcgttcggctcaacgcgatggcgtcaaggttgaggagctgatccgccgtcgacggcgacgggtgctcactctgtcgttctctctctcccatccggcgcgacgccaagggcggctactgggcggcactcaactgggagaagatgcagttcaacgcgccggcggcggcgacggctcctccgaccaagctcctggtcggcgttcggctcaacggcgatggcgtcaaggttgaggagctgatccgccgtcgacagcgacgggagcagtcgatccggcgacctcttcccctccttcacggatcccatggtctctccgctccctcttgcgcggatccgtcgtcggctgcgatgggaggggttagatccggcgacctcttcctctcccgctcggatcccgtcgtctctcagcgccccgctcacgctgatccgtggccggcgacgacgggagggtccagatccggtggtgtccactgtggtcgcggcttccctgccaccgccgcttctgcacgcgcggcccatacaccgcaccctgccgtctccttcttccccgtgttagtatgcctttcatatgtttttaatgtatttgtgctgttcttataatgtagttttgcacttatgatagcatgttacttgtgcttgcaaggttgggtgggttgtcactgtggttggagctggttgttgagctgattggagtcagagatggtggccaagatggagaggagatgtcacccgaagttgtctcggaagccgcaatgaaggttcaaatctaatatgagttttgggctatcttgggttcctttataaaaaagaaaagtgatataaaaaatattgttgagattataaaaaattgaatgattgccattatggttccattttctttttgtcaccctcttttcgatctgttaacataaacttagggtaagaattaactaaatttgttcatttttaggtatcaactgaatatagtctcatttggcagtttgaagaattttgaagcagtttcaatagcaccatccatgactgattgactgatcccatgacttataacctgcaaaatggcaggattagtagagacttgggtgcacaaattagctctttgttcccttactgcctgctagttagtgatgatgtaggaaaagaatactttggtacttgtgttatgaagtagcaacttaatcaggaaaaaataacatttgaatggtcctaatctatatacacaaattgcacttttatatacacggtccgttttgtcattactgaaaggtttataaaacaccccagtgataatgctggcagccttgatatgtcctcatggacggaaaatgaaaaaaattgcagtagtttagaacccaaacctaaaatatcaattaggtgcggtcttgtagcttagccattgccctgtgatatggacatatgttaccatgaaaggaatgaagcagttcttagataaattatattgagtgttagcttcaagcatacatggcagatgcattcctatcttaaatacattagaattggcctagattatttatcttcagaattaatctcatcctatcattatgacgatcttggtcgagtggctgactcattgctggatgatggttttcttgcaggcggagatggaggcggcaaggtggggctgctggcgttggatgttgcactcgcgttcccgcaggccacgacgtcccagttcccgcccgccggtgagacctcctctcttgctttcccggtgttctcaggttctcggtttcccattattttaaataatgagatattatgattgggtgaaactgtcttggccatctaattggagtatttgagagaggtgtgtgcactgtgcagtcggcctttgttgattcgtagttatcttcagtcttgggcagcttaatctggctccaagttggcagcaagcagtccctgttctgaaaactgctctcttacttaagtttgctgaagggatactccttacatcgaagttcattagctacacttctttggttagaaattgctctgttgctgttcaatatgtaccagcaaaataaatatgagaaatcactctagtgcttctaatagggagtcatctttcagcttctattaaacacggaacatttaagaattaccttccatcgtcgtataaatgtagtaaacgcagatgtgtcatgcccaacagggaattgagtagcgtcaagcgggagattgagtatccacaccaattattaggtgtatatatgagtcttgtttgtattttcagtttttttatataggttgagaagatgtttgcatcctacttagccatgtaattcttattcttggattctgtatgtaattcctgggttgtaattattgagccatgtaattgtatatgactctatttgggattcaatcttggtgggaaaaaaccgggcccgcgtaaaaaactaatcgcgacccaccaagaaaaaatcgaacgaaaaaaagggcaaaaaaaaccaatcggacagaaattgggaaaaaaaccgtgtgcggaaaaaaaccgggcaaaagaaaaaaccaatcggacggaaaaaatccgggccaaaaaaaccgcagccttacttattttttaagtaggtatactagcaaaaatgcctgtgcgttgcaacgggtgaaaaatttctaatgataatacacactttccatgtataatgtataatggttgtatctatcgttgttgctaagacatatcataaagaaaacctcgacgtataatgtataatggttgtatctatcgttgttgctaagacatatcataaagaaaacctcgacgatggcaatctcccaatgatctttcaatctcattcttgcaactaataataggatcaatcaaattctacactatctcatgtggtcaagtctagataaaatagagtcatcatgactcttctcttaataataattaaaaatttatttatttttttatatgatacgcaatcaagaatattagctatacttatcaaagtagtctgataattatataaagtagtctgataattatatacagaatcatgcagagtcttcaataaggggcaacataagctatgtaggagatggaaaacattaagtatcctattcgactcaagccttaagaacattcacagaacgctttagaaaaaccaaaccaatgtggtagacgatggatgatacgaacctttctcgtggaatatgaaattttttctaaaattggacaatttttttgcattgcacggtgcgaaccagattttttttataaacgcagatattttctcacgttgggtcggataaacaccggcaattttttataataaacggatgctagctcccggaagcagtatttttttataataaacggagttttttctcgggaagagtcggacaatttttttcggtttgaattttctcgcgtggattcagacagtttgttccgattcgcttttttataaacaacattttttttggacggttttatttcggagtggttttttatttcgcattgagtcgaacgtttttcaaaccgttttttttataaaaagatgttttatgtttttctcggttttttatttttttactggagtcggactttttttttacgtaggtgactttgttttccctttattacgggagtcggtcgtgagaagttttatttctctttctttattaagggagtcagatttctttatttctctttctttattaagggagtcagatttcttttacggacggaatttttttccctttttatcagagtcgggcgtgggaagtttttttttgagtcggacgttttttttttgacgga

SEQ ID NO: 2000 - DNA, 8274 bp, Oryza sativa
ggcacccctccctctcgccccttcctcctcaaccacggcccacggcggcgagcagcaccctcgctcggcggcggcgccctccctctgcaggcgacgccctcccctcagccggcggcgccctctcctcggcagcatcattgtcttctccggcacagtggaggcaaccccttcccgttagtgcctcggcgataacatcctccttgcggcgcacggtggggcgctcgccaagccgccacgacctcggggcagcggcgtgcttgctctgatgtgagcagtggcgccggtttttttgtgattttgtgattctcttgtttctttgcgtaattcttggatcggatcggatttgatctcttgttcaataatctgtattgcccgtacgggacgggtgcgagctggtcggagtgagatgcaatcttgcagactaatacggatgaaaaaattcctaggaaaataaaaaaaatggatggaagcggactttcctccttttgttttaattttttcgtcctttttggttattattacggacgaatttttttggaatccgacagatcttttttttttccacccgattgaatcggatcgatttttttcccttttgttaccgcgtcgactttttttttcgcccccgattttttttcacacggacgacggaaacatctcatactttttaagtagtagtatagtaagtatatatttttaattttcgaattaaaaactaattcattataagataagatttcataataaataaaaatctgttgaaaaaagagaaaaaaaatcgaaggcaaatataatttgacatgagggaagcaaactgtgcaagtaataaaaggtgtacaaatgagagaaaagtgggagtcgaacccgggtggccgaaatgaaaactttcatacctcaccaagtgggaagactactacatgtgggaagtgattacatggaaagtacatataccgtatcaaacgtgattttggagtagataaaaaaatatccgatcgggctgttaaccggattaaatccggatttagcgaagcgcgtggtaatgacggacgaaaaaaacatccggaaaatatatatatatatatatatatatatatatatatatatatatatatagagagagagagagagagttggacccatccaatcctactggtgaaatcaggtcagatgtaatccgaaccgtccacccatctccaccgcacgatttcaccctctccacgcgtgaagaccgagcgaagattacgggtctgtttggttgttgcctaacattgccataactcagtttgccataggtgtggcatggcaaacaaagtgtggccaacaatttgttggccacaagtgtggcaatgtttggctagaaaatgagtatatgacatgtagacccatgaaataagaaagtgtggcttgccacaactgaaacaagcaaccaaacgctaagctaacaatctgtagcatgcctaacatgtggtgtggcaatgtgtggcaccaaaccaaacagcccctacgcctcatcagtcatcaccctctcaacgcgcgactcactcctggcgttgtcgtccccttccgccgccggcgcgcactgaacgagaggcgaggtcttcccaccgctggagcttccccatccaccgcggccggccgcaggtccccatccgtcgcccggagccgacgtcgtccccaaccgccgccgccggagacaaggtcttcccgatgcgccgccgccgccgcagtccaccgctgcccatgaggtcgttcccttccgccgccgctgccgccgtcaccgcgcactgaaccggaggcgaggtcttccccagcccctgtcttcatcgtgcgcatccttgccgtgcgccatgtttagttgtcttcaccctcgacgcctcggagccggacgcccgctgcccaccaccacaccaccggacaacctctatccctgccgccctcctctccatcgtgtgcttgccttctttagcccgaggagagaggattcctaccacgtctttctgttgtgccagtatcctcatcgatgaatgattttaccacagcagcaaagcggttgccatctgctggtattatcccaggtttgcttttccgtctcctctccttctcaattcctttatgtgcccttgttcagattgcatttactttctctttctcctttctgctatcaaataggatcaatgaattgttccgtgaatgctaattatattatgagaatttttccccggcaaaaaaaaaaaacaaatgaaatctgtagcaatatgctatatattaatcttgaatttgtgagaatgtcaacattcaacctttcgactatgaccctatgtcacactgattcattgtcatatctgttgatttccaaatttgcttaatcgatacatgttaaaatgcaattccaatatatatgaaaaataacaaaattgataaaatgtttgattatgctctggaaattatacaaaatgaaaagctcaatctatatgtaaatcattgattctgggtacttattcaactacaaaaggcattgccccagatcccaactttcataactttattagtttgtcatttttgtttttgatccttgcacatgatgacagtacctctgaggtattgtttcactttcaccctaaatttacatgaaaaatcctaaatgcaatttgttttacctatgtaaatgatgcaagatgcaagtgtaggagctgaaaatttctctttcagggaccaagaagaatacaaacttaacagttaggtataatcataagattatatattgtgtttcattttgttatcattaaactgatccacatgatgttcaagtgattacacaagtgcatagattgttttaaaagttgggttcgatagatatgtagaattccatgccgccatcagtgatacctcgcaagcaagccacaatgtctgcacctaggccttcagcggctccagctactgcgtgctgcagatggtacccttccattacggtgagggggtcttctagattagctatcacggttttttttttcatgtttgtgcatgattggagtatctcttttttttcggctgtactgaaatttggtttgtgattaacctgtgaaagtatctgtttgcactgctcgatatcctttattttgaaagcgacatcccgaggaggaaggctcttgtgctaaagaaaatctttagttcctctccttccaattttttcggttcttctttttgttttgattaatgaaaccagaaattcttgaactgaaggaaaaacaggtagctctactgtgtttatggtctttcctgttgaagtaggaattcataggtgtgtggcaatgctcagcgattgcacaaggttgattctccacttctctgcatcagatcggatatatttcaattggttcgattttgatctatactgactcccttttagctaaaaccctgattactgataatatatatgttctactcagtgaaggggatgcaattagacttggaaatggagttagaaggcttaaaggttgctaatgtgatctgcatgatattatctcatgaaaaccaaacattgttttgccccttttatatattttgcccttaggattgaatcaatatttcagaatggacgaaggcatatatcctcttcaaagaatgaggtctcaagggatttggttgtcaatgtaaaatcacagatgaaacaatctttgttggtaagtaaatgcactttttgctgcattgactgggataatctcgatgaacaatgatgttgtttgctactttgattttaatgtagatcactgaattgccattctactatatatgaagcaatatttttaatgtgtaaaataccctaggtcatgtgcatgtttttttcctaagttcatgaataaaatctcacttctatgttagggtggctactagatccaatcctttggttttgtgtttcttatacacccaatgatattttttattttttttaggcttgggtacatgtacatgtttaatttttcttaatgtcaattagatatcatttgccaattaaaattcatgtagaaatacacctacctgaaccaacatattcaatcttccaatgcatgttacttcacaattttcggagctaggaatcttttagagctggacaaatccatttacattgagtgtttattataaaagaaatatattttcaatcactaagataatgataaaattctattatgtgtttgccgataagcccaggtggctgcccggggttgccaagcggtgtctccacctctgactccattcatgtaatcatgttcatggtctgctccattgagtttatttttactggatgcacatccttccattagtagttcttgcaagaaactgaaataagtaacagtcgtatagcattatgctgctagtatcttcagtaaagaatgtattgtcatttgcttacctcttttgtgttttcttcttctgatgcttagagacacaaaaacaagcgtgtacaaacgatggaaagagaataaactgtaattagtgatcaagattgcaccactcatcttttgccacaaacactgcaagagagattgatttacatatagtgaatgaatcaattctacagtcttgaagatttagctctaggttttctttagatggaatgtgcctcagatttagatttatgtacattttaagttgccaaaataaacaactaaatgaatctttacgcaaccacgccaaaggattcacctagatgcttcagtcaacatactatgacaagcagaacaacgtttattcttatcttttttatatagtaatatgcccttgctatataaaaataaaagcagaactacaatgtcttaaaagaaaaaaaaaaccatgttttttagccttggtctattgtcaatcatttgaatatgctttgcttataaatagatgattcatattcatacaatatttgctaatacgtgcattgcacgtgcacgattactagaacttattagccgtaccaatattttggtagtttagatagtacatgtgcttgtttggattgtgaccaatttattggtactgtccatgttagatttagcatcaatctagagcaacttcactataattcatatgttgactttatattggtagcaaaccaaatacaatcttgtcctacaaagaaattggtagtactaaaatttatctaagttttagcactaccaaaaaattggcatgtagcaatccaaataggcccctagttacttaaaaaattcattttagagtaaaatacactagcgttgcttaaacttgtaacgaggtctcacttaggtccacgaacttacaaaacgcgcattgaaatatctaaacttggtttaatatatcatcccagtccaaaaccttgtttgatcgtggtcttgcttacgtggcatgccgcgtggatgatgacatgatttttttttctcccttcttcctttttttttgtgggtagataaggagaacctacaaaacgacggaacacgtccatattcacatagtgaaacacgatcagactatcttaggcggaaggatgagtatgaacgctgaattgatgcagaagctttagaatgcaaggtaaatcctctgggactcgtgtcgtgaacatccagagtgtcattgtggtgaccgttgtcaggtaataaggtatgtaaggcaacgaacttgaggacaaagatgcttcgtgtgtcctaacattgtcgatgatgatttcatcataagtatcaattctttcggtaccactaatcactactatcatgcacttacccgtccctataaaattgtaccaataggaggatgtaaggaattgtcaattcatacaatggatcgatacggtcagagttacttccaatggtcaaaccataacgcaacatgagacgaccactgttggtaattcttacggttacagataaaatccgcaagcgcacggatataccgatgtagcacttcccctacggagtattccaaagggtatcgaatccaagagaacgtgtgtggtcagatcttcctccggttcatccaaggacaccaagctaaagataggccaggatagagaggatatactggtgagaaacagtgtctagggaaagcttaagtttattcctaatgcaatacttcaggcactggcaacccgctcttcccaaatgtcgctctactacatacccggatagggaggacttaagtgatctcgagggctgtcaccacctctacacctacctcaaacgtattgtgggatacgcaacaattattggataataattacctaaacaccacgtctaagaaattaatatctacttcagtgtttataactcactaaagcaatcactatattttagttgattatagtgaacaataatcccgtatgctatttaggaactaaccaagaaataattctcacaagataaatctaaattactcaggaagaatattatattaaaatcagagtaataaatagaataaaagaaatgagagaagattaccaacaactccggaattcttccgacttcttctactctactctcttcctattctagtatacaatatagtacaatggagcctcttataattcagctcaagcttggaagtgtgtgtgaaagtgaaggagtgaagctccttttatagggcagttatgacggttgtgagaaggggaaatgtccgaactgccccgcaaccgtcatgaggagagcatctggagcgtccacgccaaaccctaggatcaacggtgatcagaggagtttggccgaaccagggagtttagccgaaccagatcaacggtgatcagaggagcgaacctgggctgggccatccggggctggccttcggcttgtggactcccctgactctccatttctcggagttttggggtgagtctttgatattttgatgaagttcacaacccatcctcgtatggatacatgtttcttttcacttctagatttcctcccaacttcggggtttaacacctgcatacaaatatacactaacacttgtgaaatatgtgagattaaacacctatctctatgttggatgttttattatctggtagatgttggtggtatagaatcgacatttaatagccgccaacaaccacacatttcatttaggcttggatagagtacgaacatcgggtacaaattgcaagcttagactgtaggaacaatccattagatttacctaaatggtatgagtatccaaagtgtggttgtagagatcgctgctaggtggctaccgcctttgatattgtggatccacaaagtgaatccgcacctccttgtattgccctgagcaataaatatagttgtcatggcgaaaagataattgattttgaaatagaagtagagtaccaacgattgaaggagaatgaaaatgcaatatggactgacgaacgatggtgaggaccttcttttgcggaggcgattgtgaggcggcctaatggcgatctggcctccatgggggatctctccttcgcggacaagtgggatttctcactgggattggattttgcctcccagatttggtctcgtctccgatcaccggttaatttttcccgctctccctcatccgctttccatttggtggtttgtttttcacatttctccttccggctttctatggattctatggctattgccctcaattgctgtcttcggggaaatccaatgattttcgggttcgacatctccaaaattcctgttatagtttttggtgtcagataggaaggtaggtctctggatgtactccttgaaatctttccaaaataagttcttcaagcttcattttcacttatggaggaatggaggtcctgattggtaccgtgagtacacactatgggttcttgaagaggaaaattcttggactaaagttggtagaaaatcaaaacccatctcaaatggtgtcattcgacctggggtctcgtttgctaatgtgttttcctctgaacctactcggtctagagcagctgtactgattaaaaaagtttttgacaccatcaaggattccattcttgatcctaatcggccttccgttcttcctgtgaggaaattagtttttgactgtctggattttcctagacgaaatgttgttcaagtttctggcagtaatttgcttcacgatggatcttcgtccaaggcgggatctttgggctctttcaaatgttcaaagtgtcttgctaccggtcattctaggtctgattgtcacttccgtgtttgtttcaaagcctgctttgcttatgggcataaggcccgttactgtttggcccagagtaagaagaaggccttgacgaagtgggtagttaagggg

SEQ ID NO: 2001 - DNA, 1066 bp, Oryza sativa
tcaggaataagtgctggccccaaccaaaatttggccatgtctattttggagaatgaagcttcccctgtgttctttgtgatagattctgttcagggcaaaatccaagaagtagtctttaggaatcaggttataaggcaactgtcaaattgaattcaggggcctccaactgttctgttggttcatgcccctttcattagcttggtgctcccaagaagaaatgtggcttttgattctttgccgatagtttatcactcttcacagttgcccctggtggtcgttcaacctttgggccatgatgaggatatggaccatgacatgggctctcccctgggccatgatgagatctttgatgttcaacccttggcaatttcagagccactagaccaggcccagcccaagagcccaccaagaatcggaccagtgcctctcctgttagaacccccaagagcatcagttaagaagagagatggcaagactgtcatgtttgatcctgacaggaggcagagttctcggttgagatcttcaagtcaagagctcactcaacctgaccctagaatgggcatagggaagccgaggggaaagtctgccaaaaaactgaaagagctggtaggtatctcaaacattttaactggcaatagttctttatcggcttctgattttcattctgatttagatgaagaatgtttctctacatctgattcctctccttctgactgttcaatatctttactcgtgtcattagtaccatttccctggatcaagtagtctggtactcacgattacattgctgaaatatcaagtgcgcatacaaagattgtctagcacgaattattacatcataggcccgcaggcatagtctagaacataggaccgaacggtccggaatacattcaaaagcagaaatagataaggcagcggaatttaggcagcggccacaccattgccacaagcaatgaccgtaactaagacctacggagcgttgtcatcctccgcatcctcctgaagataagcatagggatcctcctcgacttcattgccatccactgattaaattttgtaacagcaa

SEQ ID NO: 2002 - DNA, 2529 bp, Oryza sativa
  unsure (1)..(2529): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcaaaagcagaaatagataaggcagcggaatttaggcagcggccacaccattgccacaagcaatgaccgtaactaagacctacggagcgttgtcatcctccgcatcctcctgaagataagcatagggatcctcctcgacttcattgccatccactgattaaattttgtaacagcaagagtgagtaccaaccgtacccagcaagccaccacaacaacaatgcatatgatagaggtattcaaagtatggctattggtttatttgcgtaaagctaatttctcaatccttttcacaagtctaagacctagcattgactagtcaagttttaattccagtatttattacacagcaacggttctgttcaccatccattgtcttccgaaagatggcttcccgctactggccgtcatggttttctgggttttatcccttctcgcctctcgagaagttgctccaccagtataaaatcatcatgcatcatctcacccaatcagtttaagaatttagagtctagccaagtgtagtacatgtcccggtgctcaataaccgcgagcacggctattctaatagatttggtttactcacactaagtggatgtacactttatccatacttcgtgacttgcccaacacatgagccgaagtcccaacgaatgagacgcgtcacggcaaagcatttcaataacctcactttggcagtacccactccatgaactttagtccttattcactctaggcgtccaaagtttcaagcagtgagaggagttctggcgctcccgagggggaaggactcacacattcattaagttatagttaagtttagatttgcacatggcagtcctaccgatggcgacaccactgtaggcccccgcccctcgtggtcctaccaatggctgcctcaccgtaggcccctgcctcctatacacatcaagaactccactacagcttgggtaccgcctccgctcggttatttactccgctaggtctatacccaaacgagaagtacagttgtacttgggtcgtttcatgcttaacttcatggcactagcctttatcggactccacccaagtcatccagccgccctagtcgaaaacatttattcattataatttttctttcacaaatcatttcatccatgtcatggtaatgtggcgcgcatgtctccacataccgaatctcaactaccttccctaaggtagttgcccaagcatataacatttgataaatatgagaatgcatgattctgatttagcatgactaagcatttgtcaaatattgactaaagacacacgatagcatggtttacaatggtcatacaattattcaatatcaaggcatggcatatagcaaataggacattcttattcatacatagcatgcaaattttattatttaaatcaacataattttcgcaataggttcaacatgctcaaagattagtgatgacttgcctggatcacagtcttgttgtccctgctcctcaatcgactcaacacaattccctcggaatctaaatttacgtgcgaaagatcggatttgaattcaattagaattcaaataaaatcaacaaaaattcaaacagtacaaagtaaattgagaaagtggtcccatcagatagatcttgattttagatgaatttaggttcaagtttcattcaaatccgagttaaaatgagtgagttatgagggtttaaagattcaaatttgaattaattcaagaaattatgaaaagttactgttcctaattcatttatttttattctaactcaaatcaataagccacagaggctgacacgtaggccattcaccaatttctttgctcggttttattttcctaaagaaaatgcggtgtcactgataggagggtccgaccccttgtaaacaaaggtgtagccctgccctttaatcaccggtgtgacccgcatgtcattgagacaatcactaaaaactccatttaattagatttctaagcatccgggcccacatgtcattgattcataataataccattagttagggattactgtgcactaatgaagtgggttccacatgtcataatctctctgtctcgttctttctccctcccccatcgtcttcttcctctcgctcgcgacggagcagaggagcggcgcccgtgctgcgcgacggcccgagccgggacgactcggcacgcggtgggcgagcggcgacgcaccaccggatacccgcttgcggcggcgcaccaccggatacccgcttgcggcggcggcgaagcgcggcgatcgcccgacacgcgacacgatggcgcgcggcggcgccaagatcccaaaaatggcggcggcacaatggggaccgattcgagcgctggcgacctcgatt

SEQ ID NO: 2003 - DNA, 6720 bp, Oryza sativa
gggagggagggcgattccttaatggataaggataatcgatcacgtagctttgtttcgatctcttccaggtttcggttcaatgcactggcgcggccctgattacctattcggtagggtcgcaggaaaggggggaagctaactgtgggatatggcgccacattacccagtagtctcatccgggggtgacagaatggcaacgcaacagtgatacgatggcgacaagagcgacggcgacggccagtggtaacggccgcggtagggaggcgcagggctacgccttatggtgacgcgggggtgtcgtggcggccgttaaccctcaattcccgatggcgactcgcgaggagacgttatgacgcgggcgttcgtggcggcgcagccttggcgcgagttttcagcggctcggtcggcggcgggcccacgcggcgtggcgcgacgcggtgcggcacacgggcacgaccagtgcagtgcacgagtcggaaaggcaggtgcgcggcatggcagtggttggagagggcgacgtcgggtgttcggtcgggttaggcccagatcgagcacctggcgcgcaatgaacagtgtcgacccaagaaaaatcaaaattagggctttccttagactttttgtgtgattaatttttagatgattcaatctgtatacttcttttgggtatttaccttatttcaacacttccaattttgtgatttattgcatcctatgttaataattaatattctaatttcaacatatgtttcttttgtcccgcattttctaggttttagtatttgtctttccatatcaacatattttttcttctcatattcatcaatggaaacaatatgttttgcaacagagaaacgaataacaccagcatgatgcaaaagttttaaaatgttcgaaattttagtgatttttattatcagagattttcaggatgttacactggtctcttttgttcaatccaggtttaaatggagaatagttatattttatagtaaaaagtacgaattaccccgctgatctattgtgtgagtatgaattacccccctaaacccgaaaaccagttattttgcaccctcaactatcgataccgtatgaaaaaccccccccgaacagctttgcaagcggttttggtgtacgtggcagtccagtcagcaagtttttattaaaaaaatatagggcccacctgtcagatatcgaagtagccgataaatgatatgttcttcaatcttgtggaaagttgaatccttgtatggttgtatgaaatgatcgatttttgatgcccagtgcacaatcaatttgatgtaattattttccgttaaagaaaagttagtagtttgctgtaacagagtgtcaccgtcaccgcctctgccgacttcgccgccgccaccgctaccgccattgccgactttgccgccgctactgccgccatcgccgactccgctagcgccgccactgctgcgaccatagccacacgatataagcaattatgtggacatcgatgtcgaaacaagatttcggcaattctaaaaaggggtggctatcaagctggaaaagtggatgggtttggagacaagaaatttttatacaggttcaggccttcttattcaagaagtaataccctactcctgtccggggatgattccgccgagtgtattattgatcgtatgatctgggagaaaatcgtgtcccaagaaagacccggacccctccttatataggggaaggggtccgtattacaaaatacagtccatatccctaacagaatacgggattacagataaaatacaatcgtaaccgactaagaccccgggtactttcttgacgtacaagttaagaaacaaacccgagttcccataaagatattctatctatattcgataccttgtatcctacctaactataactgtcatgtagatatggggtatccataatctccacagtagcccccgagacctttgcagtcgacgaaattgtcttcttaaagcaaaaaacaataatccgagtgttttaattcttcctgctccagcctgccgagttttaaaatcaaagactgtaaagggcgaaaataaaacatggtgcatcgaatagatgcacctaattaggtgtagcccccgactatgtggttagttaaaaaactaaacatgtagtcaagaaccaagtggtttcacaaccaaacatcatatagcaaagcatacgcggcgttcaataaaatatccagccgactgctttttagctttaatatatcaagaatgataatatgaaaaagcccgagtgataaacactcaaaaggttcatgaataaacatatttgacgagaatccgagtaaaaacgcttaagatcatccatcaaatatgataagaatcatggcagttaacaagtctaatagcctaggctatgaccctcaccataaaaatgagcatataacatgccaagagaatgaccattagaaaactagtcatctcgaatcaacccaaacagcttttgcagcttaaaaaagcttacaaaaatagtataacacttttctgtcgggtgcctttttatttgcatcgtagtaattccaaagaattaaaaggattttaacagcatcgggtcactccattgtgagcacaaattgccaaagcaataatgcccaagtccctaggatcacaacgggccacgctgataataatattgggctgaagtactatgtaggcccaggcccattagcactcccgataccctagcgaaataaacgccgaagtcaaagcgtcgtttcgtcttccccgccgagaccctcgccactttccccatttcttgctacagtgcagaacttcaccggcgaaactagggttcaccaatccgcttcaatccatcctcaaaaactccacgaaatcctttctacgcaacccaccacaccgattccccacctctttccagccatatcccgaactaaattaagccatccagttcatatccatggcggaaaaagagagaaagtttcgagagccaatgggcgcccttccgatgtaacggaggaaaatctgatggagatggtggcgcacggcgttcttccagcaaaagagatcattgggtggcgaccggcatttggcgaagcattcccgacccccaacacgcatgaagtcgtggtattttctcatttcttctatggcggattttctcttccaacctcaagattctttcggggaattctgaatttctatgggattagcctgcatcacttgaacccaaactccatagtcgacattgccaactttattcatgcatgtgaagcttttttgggcattagaccacattttgccttgttccgccgcatcttcttactcaagccccaaccgaacaagagtaaaccatgtgttgttgggggcgccggtttccaactcaggggaactttgagccaaaaatacttttccatgcccttcaagacttcaaacaaaggctggcatgcaaattggttctatgttcaaaatcctgagcctgcactccccgagtactcctgtcttccttcggtctaccaggacacatggaattcattgcctatgggagatgaagctgctcaggccgtggaactgatggaacgtatgctgaagctcaaggagcaaggtttgcagggtgaacagatcactcgacacttcatcaaaagtcggttagctccaatcaaagagagatcccgcacggcttatgagtttgatggcaaacatgatccaaatcgcgaagatccggactccctggactttaaggtcatgaaagaaaggatgtacaagatcttttcaaatgccatcgtcgtcagttattcacatctactgccagttgtgccatataatgcattcaaccctcctccaccggtatgtgttaaaattcttcaactttcctcaaaatataattttgtcttcttgttgaatcagttaacagttgaagatattacgtctaggaattcgctttgatgaagtcagacccgccaatcgtccagcgccgatcacctcaccgtcaaactgttcaggggagcgggggaccaaagatctggtccgaatcccagcccaacacttctaatctagctggccagtcagattcccgcaagaggaagctagtgctgagtgacgacgaaggcgacgacggcaaaaaatctggagataaagaaacacccagaaaactgcgaagcaggctattccgaagaagaaaacatccagtcgccctatgccaaagatcagaaaatcttccaggtacaaatcatataacaatctcccctgttttgatgcgctcccagtatggaaataatactgataacaaaaacttgtaggaaaccgtctgatatagatccatctggaaaggactctgatccggctaacatggaaatgagttcttccaaagaaaccgggccgactgccaaaggtcatccgagtgacagccagccggcaaccgacaatgtagactctggtgatcaacctccgactggaaaccagtcagctgaagctgaaaccggagccagtcaggagcccccgactggaaaccagtcggaaacagggccaagccaagagattccagaggttgatgccagccctcgcagacaagatgccagcaatgactcgaagcctggatctccggctaaagcacaaggatcgactcgccctcgcccgggaatcatcacaggtaaacaccttgcctgagatcatgttgatccaaatgtccttaattgattggctgatctttatccatggatgcatcaggaccaatgattggtgacaaagaagaaattctctggatacgagcggctgaaaactcacgccctcccattctggtcaaatggtgggacgatgacttgcaacctcagggcattgtaataaaccgacaaaaggaggacgaagaggtgtgccaactgaaaaaggcactcggtcaagcaactcgtatcgtaaacgtaagttatttgactcaggacctctgctatcttgttcgcttcttagtgtgagcgctaataaagccattatgtagaggatccatcttaggaacgaggcgaagaccgcaaccctggagaagctagttcctcatcttggaacccttgaagctgtcagggatcaactgtacgaggcgaaagaacacgccaagaaaaccgagcacgatctaagagatcggatcgcccagctccaggaatctaacttcgaactgagtggctcgtcaaaaggtaaatacaaagtctgtccaactaactggtgcagtcatctccgtaatcttcaattaaccggagtcaatatagtgcaagccgccaagatgtctcaattggagaaacaaattcaaactctggagagcgataaagcagagctggcaagacagagggactcggccttgaaggacgttgaaggtaccatcaattgactcatttgagctatttaagctatccccttaaatgtttgcgtgttccaatggagaaagcagatcctgaacgtatagagcttcaagaagtttaacctatgtcgagaagccagtcagaatcttggaagtgagcgagaggaatacaggaaatcacgttatacggttctgtaaggttcagtggagcaatcattcagaagaagaagccacttgggagcgagaagatgaattgaagtcagctcatcctcatctcttcgccagttcttctgaatctcgaggacgagattccgtttaaggggggtaggtttgtcacgccctaaaaatcgcctaaattaaaaatgcatattttaaatcatttttagaaattattttaaaagcctacaagttaaactctaataatctaggaaaattttcaacataaaatcgagctagataaaattttattaaatactttgcttgttcctctattttctagatttttctgggaattatttgagcaagggaaatatttttaataaatgaaacaacatttcacaaattattttaattgaaaaagtataaaaaaaccctcccttaggttgttgggccgaattcggcccaacatcttctctctccgcgtgggcgagccggcccaagccggcccagccgacgccgcccgcccgctgctccagtcgctgacaggtggggcccacctgtcgggcccttcttcaacctccggccgagccggccgagctcgtccgagccgccgccttcctccaccaattccgccccacttcgctctccccgtgtccgattgattgaggggttttgatcccctcattctcctctatctttacccccaagattcggagcaaatcgttgtgtattttaaccgaatcgaattcgttttcaagtttatccccaaaaccaaccctagtttttcccggctcgattcctcgcggtaggagtccaatctctccaattcaaggctataaatagcatcccctagtcgccctctttcgtttgccccctttcccgagctctctagtgctccatagagtcgccgccgcgccgccctagccgccgccgtcgccggccgaccaccagccgcgccgtgccgtcgccttagccgtcgccgctgcctcctcgcgccgccgtcgggtgcgcgagactgaggggaagcccagccgccccttcgccgtcgtcgccgatcgccgtagcgccatcgccgccgtcaaccgatccaccgccgccgcacaagctcgccgccggctgtcatccgtcgtcgtttgtcgcttcggtgagcaccgttgagatcgcatcgttgccctctacgcgtaggtaccctgcaaaggcctggccgagcctcctagcgccggcgaggtc

SEQ ID NO: 2004 - DNA, 26268 bp, Oryza sativa
tttgtcacagttcctttccaaggtaccgtggtggtactgaggcgcatggtgacatgttgtgggattgtgtcttgtgggtacagtggtacacctctgattagagtaaaactattcgaatagctgtgcccgcggttatgggtgagttgagcaatgttttttgtgattagtcccacattattcattaatggtaattgtgctaatcaatttgactcctggtttggaatggtatattcctggtatggaggttggattagtacaaccggggttggttgttcagatgaggttgggcctatgcaacacgggtgtgttgtatggtgtttatctaatactgattaattattcaactgttgaactattctcttaaatatttattaaatgctgtttacacaaatgagctttattatgccatcctttgttattctgtgcacttgcatatttgctgtgtggcttgttaaatatgtcatatgctcattcttgcaatattcattcatcagaagaggagttcttcagtgaaggtgatgatctggaggactaggcttggtccgggttaagttgcctgtggagtggaatcgccatagctgttccgtagtttgctttagtttatttttccgctgcgtagaatgttattgtttgagaggaactatctacctctgtaatgatttattaattgcgaatattaaatagttgtttatttgtactctattatcaatttgttattgtgtgcctcggctgattcctggacgagggtttaacacacatgtaagcgtttggaattttggatagaaattccgggcgtgacaattctgttgatgtagaccgcaagatcaaatcacaagctctgttcgacgtcctggtcggcaaaatcaaaatgcttgaaggggccagggacgaagttgccaacgccgctactccactcgtccaagcaatgttctttaataacaacggtccgagtagattcgacgcttccgagatcttcgacaagctaagagtcgctccggatacatacttcaagaacatcaaggaagccgggagtatgtgagcaagtctggcgctggcgatgaccaaatccctgtacccaaagatcgatattgacgccattgatggctttgcagacgggacgagcaaagaagccactctcgatctcatcaacgatgcgcagaaagccgctgacaaaatagcagttgatgtagtagagagattccaggacaccgatcttcgaccgactggtcctgacagttctgatgatgaaaagactgacactgattgatgtatcaatgattttgatgatgagtgatggaggcacaatttgtacaatactgataaatttatgccgtgctcagtgtttcatacttagcttctgatttcttaaaagcctttgtcaagccttattgagcctaaaacccacaaaagctattaaaaactttcagtcctcatggactaagtcaaaaaatcaagcaaggcaataataaaccaaataagcaaattgaattgataaaaatcacactccattattattatagtagcccccgactgataacttcaaggggaagcttgatgttgtcagtaaacaaacttaagcataaaaacaacgaagatgttcgatattccaagagttgtcgataggtgtaccgtcttcgcgcttgagccgataggaacctggccgagtgacttcagatattataaatggcccttcccataaaggggataatttgtgccgatcccgtgtagttcgaattttcctcaaaaccaggtcgccgactaagaaagctcgcgatcggacgttacgattatgacaacgacgcaacccttgcaagtatcgggccgactgaattaaggctgcttcgcgggtctcttccagtcggtgtaggtcatccactcggtcttctccgtagcgctcttcacgaaaattgcgaaaacgcaaagattcaaactctacctcactaggcaacattgcttctgctccataaactaggaagaatggcgattggcccgtagcccgactgggggtggtgcgcaaggaccaaagtacggatggaagctgttccacccatttgccggcatagggatttagtcggtcaaaaactcgtgcctttattccttggagtaccatgccgttggcttgttcaacttgcccattgctcgtgggatgcgctacggaggcatagcagattttgataccgaagtcttcacaaaaatctttaaatactccgtcggtgagttgagtgccattatcagtgatgatctgattaggtaccccaaaccgatgcacaatattgatgaaaaagtctctggctttatctgccgtgattgtgatgaccggtttagcttcaatccacttggagaatttgtcgatagccacaaagaggtgtgtgtaaccgccgactgcctttttgaacgggccgaccatgtcaagcccccaaaccgcgaacggccaggacaacgggatggtttgtaactcttgggctggtagatgagtttgtctggcgaaaaattgacaaccttcgcatgtccgcacgatcttgtcggcatcggacacagcagtgggccagaaaaaaccttgccggtaagccttgccaccaatggtgcgtgtggcagcgtggttgccacagataccagaatgtatgtctttcagtaattgtctcccttcctctagggatactgttgacagaaaacacgaggcctgggagatctgcttaactccagtgcaggtccaaaactcaccttcggatgtgtgagcgtgccagttgatttgatcctgtaatcatcaagaaataaagacaaaggaaccgtggttaaatctataaatgatagccgatcggccagatgccgatgacatatcatttatattcgagccgatgtcatctgtgtatcgatcggcaatcgtagataagtaaggaaaaactaaatttacttgatcggctgtaaatattaacggtatataatccttatattgatgtttacttaaatcaagtgattgggatagatcggttatcacaccgagacagtataaatcacttagatcgaaatatacatccataacaggactatatatgtttatagcatagccgatcagatagatctagcatgtatcggctaatactccgatactactttgtattaagacgttgcaacaataatgatatgttgaacaatagtttaacacatttgaatatagcaataaagggcatatttaacatatcagcgaagcaaatagaataagtatggttaaatcagatacgatcggctgaaactccgatgctattctaattgacaactagatggcaggctagagatcaatattctaagcacgacttaatagatcaaactcaattgatgcagcattaagtatgaaaagaagaacaatatctagacaatcaagccgctagaagattcatagaatggtacatatcttatataatctaaatcaacgtcgagatctaacctaatcagctgtcttttgcatacaaatattagccgataatagattagataaagatattgttgaagattatgtaagatatatgataactcagcgaattatataaacgagattagagtgtcatgaagatgtaagcactaatccctaagaacataattcgtcataacgaattttacctcttgttgaagattgaaaccgatgcagctcaacccgaaagcaagaactcgtcgaaataaaacaaaagcaaaaggtggcgatgcgccggaattgtattgaatgtgtgtcttaaaattacatagggctcggggtctatttatactcgaggattacaagatatgcccataccggacataaccattatctctaacaaactctaaaatatcacaagtctctgcggcagacttttgcccatacttatctataaggaatttacataaatcatcctaattaatagatacaattgccttcccaggactctatccatgcgtggcaatcatcttgaagcacatcaacctgagcccgacgtcgcgcacaagttgtattgtcagaatcagctatatcagcttatttagcttaactcaaccttagccgatcctagccgtagccgatcctagccgtagccgatcctaactatagccgatctagactccagccgattcttgctctgttccagaactcgatctccgcctccaactcttctttgaccaaatcccctttcctgatacgaatacttaccaaattcggttgttaacagatacgcagcgttgcagaattcttgatggacttttcttgtacaaattggcctcatgaatgatgtaaagcctgctgcgcctggaaatccgctcagcttcgtctttatcttgagggagttcttgggaggtctgaaaccgtatgaggggctctctccagtcagcttcgaccatagctatgtcttgagtgtccgcggcttcagctgtttctctcttgggtacggttggctcataaagatgttcgacgaatacatcagaaggggccgcttcgtgtttggatccaaaattcgctagtctgtcggttgcttcgttattgtgccgaaaaacatgggtgagttcgagtccatcgaatttgtcctccaatttgcgtacctcttgtcgataagccatcatgttgtcatcgaggcaggaccactctttcataacttggttaacaaactaactgtgaatctccgcgaactatcagacgtctgatgcccaaagagattgcgatccgtagcccgtggaggagcgcctcgtactccgcgacattgtgagatgcagaaaaatgtatccatagcacatagctcaatctttctccagttggggaaattaaaacaactccggccccagtgcccgaaagtctctttgacccgtcaaaatgcatagtccagtactccatcttttcctcgggggtgtcctcttggcactcggtccacttggcaacaaagtcggctaaagcttgggacttcatcgaagttcgtggcttgaacgatatgtccaaggacatcagttctaaggcccattttgcaatccgtccgtttgcttcgcggttgataaaattcttattgattattatatatatattgtacgcactatatttgagataatacatcaatttataatttaacaaattatatttaggacacgagcgaaaatccgtgtaaacaaatgccccttcgagctgcggttgccaaaattttgcttttgcatccggagctcgaagcataattttggatctgcagggacgtggtgtgagctttatgctcacaactatgtgcccgctatttgaaagattgttgagaaaattaaggagcatctccccgattatttggtcacgttccctatcaccaggagcagtgaggcagttcgtttgctcttttaatcactaacccatccactactccagtctccagaggctagactccttcctcttcctcttcttctgtgtgaaggctttgaggaaagacatcaccggtggcagaatcaagggtaagaccctgctttgatcttgtgaactgaactggcgacccctttttcttactattttttttatttttcttattggctttcgtccctctgttctatttaggtttgtgctatgcacacacacctgaagatcctcgagttgatttcattgggtgcttggtgattcaggtgtggcaagtgaaaggtacgcatgaatcttcttaccatccttcaatccattcatttttttaatagatatgtcgatctctctgcacaacgttcatatttgatacgcctctgccaatataacttcctttaaccacattgtattgaattagttgttcgtatgatcggggttcccggacattttgtaatgttacacagccaatccacgttgttagatttgcatgtactccttcccatcacgattatttgatccaaagtactgaagtatcccgcgccaaataatatgactcggggggcaacaaatgaaacatgcacaacagttcaggaccttgagcatagaagaaataaatgatacaacctatgtcacttattatctacaacacattgacctctgtaataacagaatgacattatcaccatagatggtgaaacttccttgaaaacaagaattaatcgttatatctattcaggcaattttaagcattacgaattctcatcagatctacaacggtgcataacaaaaataaatgctacattattccactgtatgtaaacaaattagtgaaatgagtgaaataacagggggcagatccaacttgggacatgggggttcagttgaacccccccaaacttttgggggaacaacaaacaaactcaaactgttacttttattaaggttaaaggctctggaactaagagaagagcttcctccagatctacaagagaagctagggtttaggcaagcaaattccaagacagaagcatccccggtgagagagagagagagagagatgaatcatcagaaagaggatgcggatgctcaccaggatccccttgctcgccggatggagatcggcgaccctccccctcccctcccctgttcagccgcgaatggcgcaagaagcggatgagacgacgagacgggagatttttttttctcttttacgcgaagggaagggggaagagatactcgagtactccacctttagctcagatttactatgttacccattatgagtagcaggccaaatgggcggcccggcccagcatagctcggacccgctgatggcacggcaactgtaatgggccgggccgtgccgtgccaggtcttgggcagaacggcccaaggaagtgttgggccgtgtcgggccggcacggctactgttgcatggaccggtggcccacccacctgcaagagaacgttattcgtgtgaaactacagtcgcaagttttctatagtaggtaacacaattaggcaaaattgtgtttatatgggtatttttcattgtcaatattgtgctattatagccgtgttaaaaatttccataatttcctttggcacaactaagagaggtttaaccttacgtcccgacccaagcattcgttgtagatatcctgaaacacgaggttcggacttcggacctgttttaaacttttcgaccgttagacacattttaaacttatcggccattagttataaatatatggtcttatatcacgttactccctcaaatattgaaaatatgttgatttggatacattttaaacttctcaacctttggacacattttgaacttctcgaccgttagttataaatatctggtatgtacgagagcaatggttttaatttttaaaacacaccgttttgcacaagttccaaactcccaaacggcctatcaaagtgctccatccggtcttaaaaacaaaggtcatgtttcctgcacaaaaatgttacaccctatcacatcgaacgtttgaagtattaaatataagctaaaaaaataactaattacacagattgcgactaatttgcgagacgaatcttttaagcctaattgctccatgattttgacaatgtggtgctataataaacatctgttaatgacggattaattaggtttaataaattagtctcgcggtttactgacggatactacaattagtttttttattagtgcccgaacaccccatgcgacaccctatataatacccgatgtgaaacgcaaaaactttacactcctggatctaaacacccccaaagttattttggatactacattccaagttcaaatataaaaatctaatagcatgtacaataatagactataagtcggctacaagcttatgtggtgaacataaagagaggagatagaaaagaagcaggctgcagatttgtagctagctgtagcacggactcctaaatgctacgtgtgtatgacaagtgggagcagtaattaatgatgtactatatatttgtagttaactattgtataatttggctattagattatctataaataatttggagctagtagttggctatatactattaaaattcctctaagcggcaaaggccgtgttcgattattagtgttagaaactaaccctttgagcacgtaaaacgaaacggttcattaatgcataattaattaagtattagttatttcttaaaaatgagttaacatgattattcaaataactttcatacatacatacgttttaaaaaaaaacgcaccgtttaaccgtttgaaaagcacacatgtgaaaaatgagatagataagtaggaaaatacgataaagaatacttcctccatatcaaaatataagccttttttttttgtttttgacttcgacacggttttaaagatgctacattgataaacgatattcataaaagtaaaatattttaaataaaaagagttacatactgtgatagtttgtttaatgctaaatctagtaatatcattttttttagattgatcttttttaatttattttttcttattaataatcaaaggacttgacactatacttaaaaaatacttatattttttatattttagtacggagggaatacaaagttaaaatccgtcatcttctatgacagaagtagtaacacgaaattaatttagctctacatccgttctgtttatgaataacggtcgaaaacgtaataacccaaccacgacgacatgaaaaaaagaaagacagataaaacggtcgaataactaaaacaacttgctactactatttgaaatttgaacaactgtaacggcccaaaaactggggagtggattctaatccctcgagggatatcccctcgtatacctttttcttccaaattcgatacaaatagttatgaaaaattctgaaaaaaattaacaatgtagagtataatgatacctactagtccaccaaaattcatgttcaaattcgatctacacatcgagaaacaaaagaagacaaatttagatataaacagtacgctactattcatacgctgaatttgtctttttatatctcgacgtgtgagttgagtttggaattaagattttgtagagttgtatatatgtgttgtatgaatgttgtcaaattttttcagtatttttcataaccgtttagatggtttttgagcaaacgagggaacatcctcgagggattagaatagtttccccaaaaactggaaataatcgaaagagtcgtcgccattttctctcttctcctcctccgctcctctgagtcctctcctctccggctctcccctcctctgtcgggaagggaaggatccaagccctcgccctgctccgcctctgatccccgccggccgccgccgccctcgcaaccctcgcagcagcagcaggaggaggagggttcaggtggtggttgccgtcggccgatgtcgagcagcctagcctcccgccgctcgtcgtcgtcgtcggcggcgaagcggcccgcggcgggggagggaggagggaaggcggccgcgggcgccgcggcggccaagaagcgcgtcgcgctcggtaacatcaccaacgttgccgccgccgccaacaatgcggtacgtgaaggatcgcttgctgctgcttcttcttcttcttttttcctttttttttctctccaagatttgttctttgctttgcgcggtttgggtggagatcttttggtgtgtgaggtggttggaatggtttgggggtggctttttttttttttttttttgcttcttggttcctcttggggcacaagtgagtcgctgttgatgcggaaatggccgaagcgatctgtgtatgatttttttcttttttggtttttttccatcttgtttgtggaggacatacgcctcgatctgttggtttcaagcaaatataaatagtgtttcttgaattcgtcttcttgagttctttctttcagccaacaacaagattttcatttcttcaatttctccttggttagcctacaaacgattctcctcttccaatccccaatatattcttgccttttggtttttcagtgctcttcacattcaaatttggacctctgccacattcttccttgctgattttgaggattctcctattccaatccacaagatttttcttgctgattttctggtttcttttcatggttaattgattgattgatttcttggggagcatccaggtcaacaggctaaattcacttgagggtttattggcaccttcagaagttcaaaataaaagctttcttggtattcgctaagtgttttgtatgtttgcttgctttggaatcttctattggtaatatgatacttgcgtgctgctaatgtttctaataaatatttgttccttttcatgcttgtggtctggaatcccaaatgaacagattgaaatataagttctaaattgatttcttgtcttcaatcctcctgcagaaatttaattcagctacctgggctgcacctgtgaagaagggatctttggccagtggccgcaatgtgggcacgaatcgggtctcggcggtgaaatcagcttccaccaagccagcttcggccatatcccgccatgagagcgccccacagaaggagtcagttcttcctcctaaagtgcttagaattgttccaactgctgcacctgcacctgtcactgtaccctgcagcagcttcgtctcccctatgcattcaggagattcaggtggtgtttacttccagggacttaacttaagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcctcagtttcggttgatgagacgatgtcgacgtgcgactcaatgaaaagcccagactttgagtatattgataatggggattcctcctcagttctaggttccttgcagcgaagagcaaacgagaacctgcgtatctcagaggatagagatgttgaaggtgtgttttggttgctgaaatgcacagttatagctagaaaaatttgtgctatatggtgcattctattggaatggttgattgatcttttcccttgtttgtttcgcagaaactaagtggaagaaggatgctccttccccaatggaaatcgaccaaatttgtgatgttgacaataactacgaggatccgcagttgtgtgctactcttgcttctgatatctacatgcacttgcgcgaggccgaggtaatacattcttgactaaaccttatttctctgaaaacatttcccttgagcaccttattgtagtatgttttcataggaaggctttgttttgcttcctcatgatttgagacttgattgcatccatatgaaacacaagtaaaaaaagtttactttgatgagaccataaattaagaagagaataagtgcacatcactgatataaggcattattccaatgtaatttatcaggatatttttcacatttcaccacaatccgttcttttctgcttttcgctttgttggtgcaccttatcatctaccagacatgctttgtgaccatcaattttcagtagttttgttctgcatattatgtaaacaccttacataaaacattcttgaatacttttttttttctgaatagtgggttccatttaatggccatcatattgaaattccctatagaaccagtagaagcacagtataatatggagaaattgtaatggagttatcttcttaaagcattgactgaaccgatgaattgatacatttcaattgttgtaatcaatgctcttgaagtatttttcaattgctcattatttttgctgtgacatggactgcactactgcagtcagtttgatcaaatgacaattaatctgacctgagcacagtggtttcaaatctaggttgaatttcatatttacattgtgattttctatttgacttgaagcagaccaggaaacatccatcaaccgattttatggaaacactccaaaaggatgtaaacccaagcatgagagcgatcctgatagactggcttgtggaagtaagcttttataccgaacaaatttttttagttgattggagcctaaagaccacaatcgttacttaccactctatttgtgcttttcctttgtgcaggtcgctgaagaatatcgtcttgttcctgatacattatacctgacagttaactacattgaccgttatctttctggcaatgagatcaatcgtcaaagactgcaattacttggagttgcttgtatgcttattgctgcgtaagatctgattagcaatttttttaaatgtgtttctcagtttgcatctgagttttgtgtactgattttggcttgttcctatatcagaaaatacaaggagatatgtgcacctcaagtagaagaattctgctatataactgacaacacatacttcagagatgaggtttgttttgcatatctgtgaacatttctatgtttatctccatgactaacacatagattgtcaggttttggaaatggaagcttctgtcctgaattacctgaagtttgaaatgactgcacctacagcaaaatgctttttgaggttctattctctttcatctcatcgatgtctataatgctggaatgaatcgaactctaataactatcttcttgcctacaacaggagatttgtccgtgttgcacaagtatctgatgaggtgctgctctcttaatcatctcctgcttgctgcaatttcatactatttatatgctgcattgcattaacagcttttcatcgtgcaggatccagcattgcatcttgagttcctagccaattatgttgctgagctatcactgctggagtacaatctactttcttaccctccttcactagtagcggcatcagctattttcctggccaaattcatactgcagccagcaaagcacccttgggtacgtggtggcatcatcatattgaactttccatacatcttttatatcaacattcaaataaaaaaattacaagagctaacatatgcttctcattgtaaattggaagcagaattccacccttgctcactacacacaatacaagtcgtcagagttaagcgactgcgttaaggcattgcaccgccttttctgtgttggtcctgggagtaaccttcctgcaatcagggagaagtatacccaacataaggtataaactgcatatcctccccatttcttcagttatctgtactgttcctaatgctgcctcctgtacctttgtttctgcagtacaaatttgtggcgaagaagccctgcccaccctcaataccgaccgaattctttcgcgactcaacatgctgaactagaaaaataaaccaaggattagttacagttgctgactgaattcttcctccagaggcacctatgccaggttgtgccgtagaccgttcagataagcttgatgcaaggcatgctgcttgccccccctgttctttcaggtggtttggctgagtgtagatagatcgatgcttctgctgtgtgtggtaacttttatggtactgatgtgctttcttctatcttcttttccctgtacctagatgatccatggttttcagtactttgtacatcggagtcctgcagcaaagctttaaacatcttgtttgatattagctgccaacctgggcgtctcctaggttgatgtatgatagagtctctgttcgtgttgctcttgtgaaattctcaataagagcaccacattttcaacagtgctcattctgaataagtgctactagtgttcttgatgtttctagtaaaaaatactctctccgattctaaatatttgacgctgttgacttttttaaatatgtttgaccgttcgtcttattcaaaaaatttaagtaattattagtttttttcattcattgttaaatatacttatatgtatatatatagttttaaatatttcataaaagtttttgaataagacgaacggtcaaacatatgctaaaacgttaacggtgtcaaatatttagaaacggaggtagtatcaacttcagctttttttttttcaacctgttctgttcttctgttgacagatatatgcagctgatgtgatcgacttaaacatgatgattcagcgagattcttagataaaagcttctgacatcttttccacgaaagatgttttcatggacaaatgcatttaagattctgaaaatgaaaaatactacgtccatcctaaagtgtccaatgtttgaccgtccgttttatttgaaaaatttatgaattattttttaaaagtagtcacacataaagtactattcatgttttatcatctaataacaataaaaatagtaatcataattttttttaaataagacgaaaaatcaaacataatcaaacattgaagataaatagtgcaaaactgcacttattttgggacggagggagtatttgtcaatgcaacctgttgaagaagtgatgctcaagctatttccatacttgaagctaagcacagctgtttagacatgcatgcctgcgtgttgcatcatcatattgtacttagagctaattaatcacctatactaatataaaaagcattacttgtagtctttgctagctacactaaaaaaaagtgtacacaaattaacctcaggcaccctgcaatctaattgttgagattacaagttccagcttgtcttgcaatgcaacaggtgaactcacagattcaactccaccttggccctggcaaacgcggcggtgtgctagcaactacacgttccaaaatataaaaacctataatcggatgagacatttttttctggtactaagaatcggccaatccagattctcgtctcgctggagtctcatcctcgtctcactggagtctggaatctatagcaacgttgtttacagtagagttaacagaaattatcaccgtctaattaacttgctactgctttacaaaacgggagacaatcagacaacgccggggtgggttgaaaaggaagaaaatgcaagcacaggcaaatgccgacgataagatgactagatgagcaaggctactccctggggaaaaggctttgcttgccatggattgcaacacaagattaaaaaaaaattacaatacagaaagaatgattcgaagcatgagtctagcaaggttaaatcatcactgagctaggcctacaacatgtcgagttagaagtcctcttcgtcgtccagatctggatcatttgatggccgtattctcttgccgtctctccctccagggcgacctcccttctttggttttcctctgtccaaacacacgaggggtcagaactaggcaattctactaagggtgtgtttagttcacgctaaaattggaagtttggttgaaattggaacaatgtgacggaaaagttggaagtttgtgcgtgtaggaaagttttgatgtgatggaaaagttggaagtttgaagaaaaagtttggaactaaacaagggctaaaagggttgttcctagaaacactgttttttttaatataaagaagtgttagacaaacactgccccttgcaaggatgtatgtaaagctgataaggatagcacattttttgccacaaaggtaatctgagcacttactgcccgtttgcaggagtggttgcacctttcgaacgacctgatccatattctcttccatctgccaggatgcagctagtattgagcccagagtctcaattgttcctggtttcagcttaatgaaaacaagaaagagaacttaccatctcgtccagccatatgttcatcgacctggaatgaatagaaaataatggtatgtattagcaaactcacaaatatcagtatagcacagggggaataacaatcatcaatcaaagcaaaccaaaagattaaaaaaggggcacgggcttttcagtgcattaggatttaggatcattagtcataccgctggagatgtaaccgatgacagggagaacagcctctcatcagcctggaacttcctggagcgcttgagactgaaaataataagatagaaactgtcataactaattctgtgtgatctattagcagaacagaaatgataaaacatttgcttgtgcagaataatgaacacgcaacattatgccaatggtaatcataaatccaaccctcccttggtgatgctagatagtgcatatagagcacccctgcaattggccaataaactgacataacactatcatagcatattttgggttatgaatctgttgtataatacctgccactgccactatagtgatcagaggatcttttgttcatctgatcattagtaaattatatgtgatcagaggatcttttgttcaacatcattcatctgatcattagtaaattatatgtgatcagaggatcttttgttcaatatctataactataaattattcatccgaatattagctaaattatatgtgatcagaggctggtagaaagttcaagggaaggacagtaggtcattcaatcaacagttgaaagtaagcaaagaatgtggcatgaattctgaaggtttcgaactggtaagtatacagtgggatgtcaaaagaaaatgaatgaagacctccaaatagtaaagggcgtagcagtctaagaaaataaagatttcttacttggaagtgttctttgacgatgataagaatgattcaaaaccctttagcacacttccgaattgattagactcttgtaggtaggttgtctccatttcataaacctgcaacatatggacataaacatcatttgcaggttgtataagaacaattctgttaaaagcatgaatagatattttgttaaattatgagtgtttaatatcatatacaaaacttccccttaaagtcaagcaaagatggttgacattatagatcatgtgttgttcctggtattaaagagcgactgttttgttctttctaaaaaaaacacacatatcagtgccattaaaatacttgatatgagagcaatagcactttcctccctttttaggattatggtttctactaaaccaaacgctcctcttatttaatgattttggatgacacaccaagattcaccatcacaaacatatattggaatttggaccacatagtgtaactttgaaatactatgaatagaagtagctcatttgatacttgctgcgaataatttctgactaagacacagtagaaactccacattttaactcgaggatagaagaacagatggaattttcaggttgtagctaactgattttcttttttaccttagaataacaaagtgttctcaggcacaaagaacaacatacaagaaatagaatggtcatattcgacaagaatatcaaattgatactttcttcccttcctcctaattctatccaaattgttcgtcacaactgatcctctctgtgaaatgacaatcagtggtcactggtccagcatattggttccaaataggttcatatttctatcattcccaaggcattaagaaagattgaacaataaattcaggctactacaggtatccacaactccaattttacaaccatccgcagcaatgtaaattcgcaccactcattcgcatgttgagcaatggcaagcccttgccatctgaacatatatgcaacaaatccatggtctcctatacaaaaccctaattccaagagagagagagagagaggcgcaaaagagacagggaacagtgtgtaagacctaacctggcgctctatggagcggagctcctcctggagcttggcgcgcttgctcatcagggcggagagcatcgccgtggggttcgcggccgccgcccccgagggtgcggagcccgacgctgccttgtgcgatgcccctcctccgcctcccgagtccatggtcagggtttctagggttcgagttcgtggtttgcctgtttgggcgttcgttctgttttggctcggagacagttcactgttgtggagacgacttagcccctcctctccaatagtccgatcggtcctcttagccaaggtaaccagtatcaagatactatgtaggatcctttctcttcttggtttgatccttctcgatcggtttgattccttctaatggagaaagcttcctgtttgctgccacctgagctgtcaaatgcacatgtgaaaatgtttagcaatcaatgcatacatacccatgagtatcacacagaaaaggttaatagagtatttagcagaaatttgtgtttcacaatttttttctgttgagggatgaatttcactccaaataacattattggaatacatttctgcctataatctaagatgcacatgttttatgagcgatttgatcatgaccacaaacatgagataatgtccataccctagttaggtgcccgtgcattacaatgggaaaagagcatttggctatgtactccttcccatcacgattatttgatccaaagtactaaagtatcccgcgccaaataatatgactcggggggcaacaaatgaaacatgcacaacagttcaggaccttgagcatagaagaaataaatgatacaacctatgtcacttattatctaaaacacattgacctctgtaataacataatgacattatcaccatagatggtgaaacttccttgaaaacaagaattaatcgttatatctattcaggcaattttaagcattacgaattctcatcagatctacaacggtgcataacaaaaataaatgctacattattccactgtatgtaaacaaattagtgaaatgagtgaaataacagggggcagatccaacttgggacatgggggttcagttgaaccccccaaacttttgggggaacaacaaacaaactcaaactgttacttgtattaaggttaaaggctctggaactaagagaagagcttcttccagatctacaagagaagctagggtttaggcaagcaaattccaagacagaagcatccccggtgagagagagagagatgaatcatcagaaagaggatgcggatgctcaccaggatccccttgctcgccggatggagatcggcgaccctccccctcccctcccctgttcagccgcgaatggcgcaagaagcggatgagacgacgagacgggagatttttttttctcttttacgcgaagggaagggggaagagatactcgagtactccacctttagctcagatttactatgttacccattatgagtagcaggccaaatgggcggcccggcccagcatagctcgggcccgctgatggcacggcaactgtaatgggccgggccgtgccgtgccaggtcttgggcagaacggcccaaggaagtgttgggccgtgtcgggccggcacggctactgttgcatggaccggtggcccacccacctgcacgagaacgttattcgtgtgaaactacagtcgcaagttttctatagtaggtaacacaattaggcaaaattgtgtttatatgggtatttttcattgtcaatattgtgccattatagccgtgttaaaaatttccataatttcctttggcacaactaagagaggtttaggggctgtttggttgatgccctgagaagaacttgcctgagtgaagacaagcctgaggttagtttgaaccttgttttggttgctatcctgagatcaactaccccttgcctggcctgattccttctgacttgcggttagcctgagccaggtgacccattttggtcgccagaactccaggccgcaacagccaccgataattagcgctgctaatccatcctgctggcctgcgcagccgagtagccgacaccccagatgccgcaccaaccccttgcccaatcctccgttcaattgttgctgctcgaagcttcaatgtcaactagatgcaagcgatacttgtgatcatcgtgcaattagatggactgctagtgtatatagatgagagattacttttgtaaaatgaatacgtattatatttttacgctttgttcacataataaacgtcattcaatggttgtgttttcagctcaggcacgcttgacctcagacctgcaaccaaacagagtaatctcaggcttgcctgatcaggccgaacacatcaagatctcagggagatttcaagcagcactttttcttcaggcatgcagctgagggcaccaaccaaacaagcccttaaccttacgtcccgacccaagcattcgttgtagatatcctgaaacacgaggttcggacttcggacctgttttaaacttttcgaccgttggacacattttaaacttatcggccattagttataaatatatggtcttatatcacgttactccctcaaatattgaaaatatgttgatttggatacattttaaacttctcaacctttggacacattttgaacttctcgaccgttagttataaatatctggtatgtacgagagcaatggttttaatttttaaaacacaccgttttgcacaagttccaaactcccaaaccgcctaacaaagtgctccatccggtcttaaaaacaaaggtcatgtttcctgcacaaaaatgttacaccctatcacatctgtcggagatataggcccgggggtatgtggagtaaaggagagctacttccctttccagccacacggctccgcgagctggtcccacccacatacctcgtgagtcactaaggcgaaggggagagcctcgggggtcgacgacatcccctcgggggtgacgtcaccccctcgggctctcccgtcgttttaccccgaggccctctctcggggggaagtgtgagaggggagtccaggctgggcggccataaatgtgcagcgccccaaccgtccctcgctgcattcaatgcggcgggggcagacgtgcggtgcgcccgaccgacccctgtcagtcggatgcgaccggtctgtgaccagtctattgccggtcacggccgattggacgggcggtcgtgcccccacgtcgcctctgtctccgcggagtggcggtaggtacgccccatcacatccggacggcgtttgatgcagggcttgccgcaagtcttccctcgtttatgagggaatgacagggctgccccccgtgtcaggcgggagacggcgctgggccccactcaaggaccgaccgatgcttagcttccaacaaaaggcacgggttgaaacccggtcgcagtagggagaaaggccccctcccctccctccgatggagggggagggtagagacggcgcatatggtatccccttaagctataaaaggaggaccttgcccaccaaaaagagggggagcgagggaaaccttttaaaattcactgataatcccaaacgtaggagtagggtattacgctccagagcggcctgaacctaggtaatccatttgtgtgctagctaatcggggatcggagggacgaacacgcgacttcggagagacgagtctctgcccccggccgaactcacgaaaggggggtcacgcgactccccgcgatcgggggtcttccctcgacagctggcacgccaagtagggggcagttgcgcgtttgagaagaagtcgcttccttccgtcccaggtcggaccaggccctagaccgccatggtcgaggtcctggaagcagaggaagcggtggcgcctacccccaccccgtctgggagtggggattcgggcgaaaaccgtgaccctcgtcaccatcgccatggctctcaaagtcctccccgccgcgagccttcgcggagggaggatccaacccgttcaagcggtacggccctctccccgcccccaggaggagggaggtcgcgacgcgtcggagcacgtcgccgtctcgactacggagacggtggttcgccccaaggcgcgcttcaggtggtgggcgcccttctgcggcatccccaggtgaacccggagccggagacccccgtgcggcgctggctggacgacgtggccaacttggtcaccgctgcccagcggcagttggccacgggtggccaatccaccgccacaggtacatcgagtaccccggctaccctttcctcgtcggcgaggagaagggcccgtcgatcggccacaaccttgaggcgatccacggctccaacgacatcggaggtctcgggaaggcggaggcgtcatgatgacctctacggggcgcaggatgctcgggtcaacatcgagcgacgcctggacgagcgccgggctacccgcatgggggaaggtgcctcctcatctggagtgccgcgctcttcttcgcgaggcggccctccccccacgctcacccctgggaggggcaggttgtagggctttcgttgcgagtctccagaatgtctggtggcccccgaagtttcgccccaatctcacggagaagtatgatggcagcatcaacccctccgagttcctccaaatctacaccacgatcatcgtggcggcagggggtgacgaccgggttatggcgaactactttcccatggcccttaagggtcaggcgcgtggctggttgatggcccagctccccgactccattcactcctgggaggatctatgccagcagttcgtcacaaacctctaggggacatatccctgcccgggggaagaagcggacctgcatgctgtgcggcggaaggacgacgagtccctccgttcgtatatacagcgcttctgccaggtccgccacaccataccgtgcattccagcccacgcagtagtgtatgcattccggaacggcgtgcggcataaccgcatgctggagaagatcgcctccaaggagcccaagaccaccgccgagctcttcgagctggcggacaaggtggcccggaaggaggaggcgtgggcctggaactctcctggcaccggtgcggcggctgcggctgcccccgagtctgcccctcgctctaagcggcgagataggagaggcaagaggaaaccggcccgttccgatgacgagggccatgtccttgcggcagagggcccacgtgggccccgcgcaaaggaaagattaccggcgataagccgagctccaccaccccctccggcggaggccggtcggcggacaagtggtgttcggggcacaacacttaccgccacagtctcaccgactgccgctcgtcaagaacttggccgagtggttccgaaaggccgatgaggaaaagcggcagggtcgacgggagggcaaggctcccatgacctcaaccagtgaccagcgagaggaggccaagaacaaggcccccgctgacgatggcggaggtggtgaggatctggatttctagataccccaagggaccgtcgccacattcgatgggggggcttgcgctcgcacttctcgtcgagggttcaaggctatgaggcgggaacttctggccgctgttcccacccatgaggcgatccggaaggcgtgctggtcggaggtaaagctcacctttgaccagagcgaccatccgacggtactcgctcggggagggaagttggccctggtggtctccccgactatccacaacgtcaagatgaagcgtgtgctggtggacggcggggccagtctgaacatcatctccccggctgcctttgacgcgctcaaggccccggggatgaagctccaaccgtcgctgccaatcattggcgttactccgggacacacgtggccgcttggtcacgtcgagctcctagtaaccttcggcgactccaccaatttccgcaccgagcggatcgacttcgatgtggcggatctcaatctgccctacaacgcggtcctgggcagacccgcgttggtaaagttcatggccgccacccattacgcctacctccagatgaagatgccgggtcctgccggtcccatcaccatctttagtgatgtcaaagtcgccctcgcctgtgcagaacagcgcgcggacaacctggcggcggccacggggccgcaggccccggaggcccccgcgtcccgcgcccccaagaagcgcctcaccttggccgacgaggtgcccgtcaaggagattccccttggcgacgatccgtccaaaaccgctaagattggcgaaaccttggacgccaaataggaaggcgcgctcatctccttcctgcgggcgaattctgacgttttcgcatggaagccgtcggatatgcccggggtccctagggaggtgattgagcaccgccttgccgtgcgaccggatgcgcgacctgtccggcaaaaagtgcggcgtcaagccccggagcgacaaaccttcatcagggaggaggtggcgcggctcctggaggctgatttcatccgcgaggtgattcatccggagtggctggcgaacccggtggtcgtcccgaaggccaacagcaagctgcggatgtgcatcgactacacagacctcaataaggtatgccctaaagatcccttccctctaccacgtatagatcagatagtcgactccactgcggggtgcgaccttttgtgtttcctagatgcatactctgggtaccatcagattcgcatggctagggaagatgaagaaaaaactgccttcattactcctgtaggcaccttttgttatacaactatgccttttgggttaaaaaatgccggccctacctttcagcgcatgactcgaattactttaagtaatcagatagggcgcaatgtagaggcgtatgtcgatgacctagtggtaaaaacgcgccgccaggacacgttgctgcaacacctggccgagactttcgatagtcttaggtccacacgtgtaaagctgaaccccgataagtgtgtgttcggcgtgccggcgggcaagcttctcggttttctagtctcttcccgaggcatagaagcaaatcccgagaaaatacgcgtgatagagaggatgcgccccccagcaagctcagggatgtgcaatgtgtcgctggatgcatggccgccctgagtcgatttatatcaagattgggcgagagagcgctgcccctattcaagctcctcaagcgccccaggccgtttgtatggacggaggaagctgagcaagccctcaatcagctgaaagcttacctcacttctccccctatcctggtggccccggggccggaggagccattgctactctacttggctgcgaccccccacgtggtgagtgccaccctagtagttgaacgcgaggagaccgagcaggaggtccctccggctcgtgatggcccctcgtcccccaaagcccccagcccccgggaggaccccgaggcccccggaggagaaggcgaggctttggcaggaggccccgagccctgtgatcccaagataatccggaatcccccgggggcccccgagcaggcgcgctccggatcatccgcccctgacaacacgaaccggcccgcccgaacggtgcagcggcccatctactttgtcagcgaggcgcttcgggatgtgaaaacccggtacccgcaggcccagaaaatgctttacgccgtattgatggcctcgaggaagttgcgccattacttccaagcacatcgggtttccgtggtaacatcgtaccctctcggccaaatcttgcacaaccgagagggcaccggacgggtggtaaaatgggccatcgagctggctgagttcgacctgcacttcgaaccgcggcacgcgatcaaaagtcaagtcctggctgacttcatcgcggaatgggccccagtggacgaccctgttccgtccgaaccccctccctcccccgaagagaaagaggacccaaacgccgacattcgtggcggacactggattatgcatctcgacggctccctcacccttcaaggcgcgggtgctggagtcacactaacctcgccaagcggagacgtcctcaaatacgtcgttcggctcgacttccgagccacgaacaacatggcagaatacgaagggctcctcgcaggattgagggcggcagccggaatgggcatccgccgtctcctggtcctaggtgactcccagctggtcgtaaatcaagtatccaaagagtaccaatgcaccgaccctcaaatggatgcatatgtccgcgaagtacggcgcatggaacgccacttcgacggaatcgagctccggcacgtgccccggcgcgacaacacactcgctgatgagctgccgcgtgttgcgtcggcgcgagccccacttcccccggggacctttgaagaaaggcttgtccaaccatcagcacgaccgaacccctcgaggggctccaacgacatgccctccgccccgattccttccaactcgcgccccttggagccggagggggtcgaccccgacccccctccgcgcccccggggcccgagggggtcgaccccgacccccctcgccaagtcgcatgatgaataatgtccgggcgtatctcgacgacaa

SEQ ID NO: 2005 - DNA, 18690 bp, Oryza sativa
  unsure (1)..(18690): unsure at all n locations
ggggggggggggggttttccccgaggccccttcccggccggttccaaccaacctgggttacagcgagaccaaccaggatgaccttcgccgcgatgatctcgattatctcgaagaacggagaaggcgagcggccttgcgtgccgcccgctaccagcagagcctgcgacgctaccatcagcgccacgtccgggcccgatcactgcaagttggcgacctcgtcctacgccgcgttcagtcgcgcctagggctgagcaagctctcgccaacgtgggaaggaccatacaaagtgatctgcgtgccccggccaggctccgttcggttaaccatggaggacggcacagaattgcctaacccctggaatatcgaacacctccgtcgcttctatccataatatcgagacttttttgctttcttggagctcgggccagcccccgcacaacccctcggtttgtgcgcgcctggccgggggctaccactgtgtatccttttttcctcttacaagcaatgaattcttgtgtacttttacccaaagaccgtttttttcccttcctctggcttgtcctggtttaaggggtaatctgcgtttgctctgaatcctaagtgctgtgaggcggcctggaaaccccgaaagggagcacgaacgcgggccatgccccgggttgcgtcgaaccccggaggatcggaagggcctacacacggccgtccccgacccccggtcgacgcggcctcggtctggccagtcccgctaggcggctccctcggagcagtgggtttgcccatcaccacttaggtgccctggaccaaacgcggattcaccatctcgctagaacaagcccgagggggggatggggtcaaagcggcatctcgatcacggactgattatcccgttttcccctggttttttgttctctctgtttcaaagacattcagtggaaggagcaatgaatagaagaagcgaaaggggaaaaggagctaaggaagtttcaattgcaaaacaaggcaggatggcgcgacggcttaaatacaagaagtgcccgctacgggcgcacaacaagagggaattgaaggcgcggatagtcacggggtgcccggccctccgaggccggcgccgctgacgatgttgtcccagtcttcatcgctatcgtcacccccgctcccgctttcttcgtccaaggccttgcgttcagcctcgagtgccgcagtccgggccggcaacgaggcgtcggcctccgctgctcgccgctcgtgggcagcggctgcgtcgagggtgccacgtgcattcctgaccctctccgccaggtcctcgacatgggcctcgtactgaaggcggatatcgcccagcgcttcgtccagggcgctcgaggcgatcagcgccgcatgccgctcctcctccgtctcccgcatgacagagtccagcacctcctcgcgcgcctggattttggctaggtgggcttggtgctttttgcgccccaccctcaccatgtcctccacggcacggcacccctcatcgactcgcgcgcggtccgccacaagctgagcccattcggcatccagggccgtccgttcttccgccagggcttgaacttgggtattgagcccctcccggacagtggagtcggtggcggcgagcacctgcagaagtggctccatgctcaccagggatggggaagaaaagcccgcggttcgcccccgggacgacggagtgctgctggaccccccgcgagacggggggctgctctcggccccccttctgcgaggccagccccgagggcgccccaaacgcaagggggagcggctgttcttttcgtcccccgcttccagtcctcgggtggattcggcctcggcctcgagctcaggaccgcccccagcctcgacctcaacctcgggctcgcgaccgtccgcaccaaccgatcctgggcggcgctccgcacggaccccagtctcggagctgcccccgggaggggcgtcgacgccaccgccacccacggtaggtcgagtcccggctaagggtcgctcgggatcaggcccggtacgtgtcctgtggaccccaccgcgaggttgcgaagaccccgcggccttggattggccaggcccggactgctccggttgtgcggatttcgtcctccgcgaggggtccgaccccgaggtcccctgagaaggaatatcgctacaagggaacccagatcgcgttaacaaaagaaaaagaaagggagggaacaagaggccgagctaggtaagagcaccgaagtgggcgccagcgtttgtacctgcggggaggacggttgaaggtccacttcgggggctcgatgtagctccctcggcacggctccgtttgccctatcttccggagccgtttcttcttccgaccggcctcgggcccggcaggtcgcttgtgacccgccggtggaaggtctgtcgcgcgctcggcgcctcctccacgcgggggagagggcggccaagattcggccgccttccgcttccccttcgggtcacttgccgggtcgtctccgggtttgcggcccgagccgggcgcccgtgagtcgccaccaccgctagcgccccctcggccaggccggcccctgccggcgccgacgaccgacattacggccaagatgctctcccggtcgcggtcgcagcagagggggaggatcccatccgggatcagtgtttgctcggcggagtccaggcccagcacccgccgaatcaccatcttggcgtcctcctcgccccagtcccagcgctcgcccgcatgcgtgcgcatggggtcgttggggccggtgtactcccacgcgccacgggatcgttcctggagaggggcgatacggcggcgaaagtagtcgccgaagaccattgcccctgtgaggccccagcttcgcaggcccctgagacgatcccacaccgcgtcatattcctcgcccagctccgaagccgccagccatgcggcggatctctcgggaggaccggcgggaactcgaagtcgtgggtgatccggcagcgcggtgtagaaccagtctttcttccagtcctcccatttcttgcggaggtggctctcgatgtactgccccgccgtgcctggtcggggctggaagtaacatccccccaccaccgcaccctgtagcagctgcgggacgaagaaggcctggaacaaccgcattgtcgatcgcaccccgatgaacatctcgcacaggtgcgcaaagatgctcagtgtcatcacggcgttgggcgcgagatgcaaggcatggatttcgtagaaatccagaacctcgtggaaaaatcgggagaaaggcggaatcaatcccgccatggcgaaggacaagaggtgcacggaccgctccggatatcgcggccgcggccatgactcccccgccctcacgacggcgccgtccggcatgattttgcgggggaggctaaggtgtctgtctgccgagatgcgggaagaaggcagcactgtgtcgcttttgtcttgagccatggtggccggcggggcagtggcggaaggcgtggcgcgcaaagctgcgtggagtggcgagagtgttagggttcgagaagcgagaggacgagtcggcggttggcgaaaggaaggaggagaggtccctgcctccactcccttttaatcctcgcctcatccgcgctcgcctcctcgtttcgtgccctcaaaattgcccccacgtccgcagttgtctctccgtttcccgcgcccgttcaccatgtcgcccgtcgtgtccgcgtcccacctttagtgcgcctatcagcagcgcactcgaggtggaatgcgcaacggttatgagcacaagctgagtgaaccgtcaccacaaccgccgtaggaatagcgggcgaagtaatcgaggcgtggtctaaccaattccccgattatcgcgtcccaagcatcctcgtctttagcgcgatcaaaggcgaccgaaccgccgctatggctagcccgccaatctggccgctcggcaatactcctttaaactccccgccgggtccacaatcccagctggggaggtcgtgaggcaccatgtcagaccggtcccaggaagcccgcgtctgacatggcgccgggggctactgtcggagatatgggcctgggggtatgtggagtaaaggagagctacttccctttcgagccacacggctccgcgagctggtcccacccacatacctcgtgagtcactagggcganagggggaagagcnctcggcgggtgcgaccgaacatccccctcggggggtgaaccgtcaccccctcgggctctcccgtcgttttaccccgaggccctcccttcggggggaagtgtgagaggggagtccaggctggccggccataaatgtgcagcgccccaaccgtccctcgctgcattcaatgcggcgggggcagacgtgcggcgcgcccgaccgacccctatcagtcggatgcgaccggtctgtgaccagtctattgccggtcacggccgattggacgggcggtcgtgcccccacgtcgcctctgtctccgcggagtggcggtaggtacgccccatcacatccggacggcgttcgatgcagggctgccgcaagtcctccctcgtttatgagggaatgacagggctgccccccgtgtcaggcgggagacggcgctgggccccactcaaggaccgaccgatgcttagcttccagcaaaaggcacgggttgaaacccggtcgcagtagggagaagggccccctcccctccctccgatggagggggagggtagagacggcgtatgtggtatccccttaagctataaaaggaggaccttgcccaccaaaaagagggggagcgagggaaaccttttaaaattcactgatatagggtattacgctccagagcagcctgaacctgggtaatccatttgtgtgctagctaaccggggatcggagggacggacacgcgacttcggagagacgagtctctgcccccggccgaactcacgaaaggggggtcacgcgactccgcgcgatcgagggtcttccctcgacaacatcgaacgtttgaagtattaaatataagctaaaaaaataactaattgcacagattgcgactaatttgcgagacgaatcttttaagcctaattgctccatgattttgataatgtggtgctacaataaacatctgttaatgacggattaattaggtttaataaattagtctcgcggtttactgacggatactacaattagtttttttattagtgcccgaacaccccatgcgacaccctatataatacccgatgtggaacgcaaaaactttacactcctggatctacacacccccaaagttattttggatactacattccaagttcaaatataaaaagctaatagcatgtacaataatagactataagtcggctacaacctttcttcggtgtgcgtgatgtcgatcccacctcatacactcattgaccatggcttgatgaggacataggtacccactgtatcttgctgcacgtggagcttgctcgtgatgtgtcacatcctgattttcgtttcaggatttataaattatttaataaattattattagaatttatattaaatgttcattaatttacaagagaagttaaatgtgggaaataaaatttccttaatataaagcatggaaggatttaatttttattaaattctccgtggttaattatactctcgggaattaggagctcaattcttaattttaatcatacaaagaatatttcagtaattatccacatattaaattaatcattaaatggtcttattataatcttgttaaatacttatagtgtccaagtattttcaggatttttcttgaaattatttgagcattggaagtatttttaacaaatcaaagatcatttcagtgattaatttaattggaaaagtaattaaaattccccttttgcttttcgggctgaaactggaaaagtctatctgtcatcgtcagcccatctccctctctttcccaaagtccatttcatgaccctctttcaatcgggctagagaaaagaagcgcagtcaaagtctaattcgcgtccctgctacagtgtcgtcttcaaacttggacagagcccgagctgccgtcctgtgccctttagccgacgccgcttcctccaccaaatccaccgcatcccgtgctccgtttgcaaaattagttgaggggaaatcatctccaccttatcctctccctttcccttaaattctcggagattaattttgcccggataaaccgaatcaaattcgttttcgagtttatctctccaaactaaccctcggattttccggctcaaatcctctcgtatggagtcggatctctctagtccaagcctatataaagcatccccttgacgtcctcttccgtttgccccaagtcccgagctccctcgtggcccgtcgcgccgccgccgcgtcgccctagccgccgctgtcgcgtcgacgttccagccgcgtcgcgccgccgcggtagccgtcgccgttgccgtccgtcgccgccgtcgggtgcgcgcggaggaggagtacctcggccgccccttcgcagccgccgaagaccactggagcaccgtcgccgtcgttgagcagagccgagccgccgtcgaacctcgtcgccggccgtcgttcgtcgtcgtccgtcgttgttctttgcaccggtgagttcgcgttgtcgtcctcttcgcgttggtgtcctcggttagcccaatcgagccctcttttgccggtggtcgcgtggaagccgtgccatggccggcgatgatgtcagcgatgacgtcattaatccttttttcttagttttctctattagttgaaaatcgattaaacttcggaaattcataactaaatcatcgtaactcggattcgagtggttcaagttgctaaatttttctaaaatcaagatatacatgttaaaaatatccacatgtactgtttatgcttgtttttgtactgttttgttgattttgttcttttactttagttttcgacgttccggaggagagcgttttcgttgagaaacgttcggaagcctttgcggaagctcaaggcaagtcacacagatcccaaacaaccctttgagcatgttgaacccttttaaagctaatgttttatttcaacttatgcattattttcgaatgtcatcgggtggtgagcctttcccaattaattaatggccgaagatgactttattttcctatgggttataatttgattagcgtggaccttattattggattggttcagctagatgctatatgtataattgcttagccatgcttagaaacattagctcattaaggggatgaatcacactacattattatttatgattatattcaatggtagctcacgatggttaatcgtgttaagataattaattgataattaaaacctgattaaaggtgggttgtgagcatatggttttgatggttgtgctcatgacaattaaggaccgatttgcgagctactgttgtgagacattaaccatgccaaccactagccagcgtgggcaacggctttaccttttgtatagcatggttcattacggggtgccagactgagaagcggtgagaagtccgtgggggtcgctggggagtccattgcctctggttttgaggggggagattatgatccaggaatggtgcactgtggtgagttgtgttgtgcgaagggtattgtcacgattttccccttagcagtgccgtggtggtacttcggggcatggcaatatgtgtggaatcgtgtcttgtgggtacaatggtacacctctggccagagtaaaactattcgaatagccgtgcccgcggttatgggcgggttgagcaatgtttttcgtgattagtctcacacctctcacaataattattgatgctataactggtaataatttgtttagctcgtagtttggagttagatctgtacagccgggtatggttgttcaggatggttgggcctgagcagcatgggtgtgctattcagtgttgattaaaatttctgattaattactctactgttttacttctcttaaatgtttgctaaatgctgcttttgcaaatgagcctatattatgccatcctttggtatccttgtgcaattgcacatttgctgtgtggcttgcggagtatgtcatatgctcaccttacaataatcaatcaacctcagttgaagaaaaaagatccagaaggagaagacgtttggcttataccccagttgagctgcctatgggagtggagctgaagccatcgctagaccgttaattccgctgctgttttcttttcttctgtaagtatgtttatgatggatttatatattaaattgtcagtttgtgtacctcggctgattcctggatgagggttttatgcataaataagttcggaaattactagtgaatttccgggcgtgacatgctgccaattctccctgcttatgcgctgctcgcttagcacacacgcgcttagcatggttgacataggtttgtcgccacagctcttgatcaacaagcctttgatactctggccatctggccagtgcctcggcgcgcctcataatggcgccgcccatgccattgtcggacgttgaaacgcccggcaacatttctttcatggtatggcagatggttgcttccataaatgtagcccaatcttcaaacctttcagcttgacctctgcggctttctctgatccttttgttcatcatgtcattgtacactttctcacgctgatgccttgtctccttggcttcagttgcaactgggaagtcaacccaagtgcgacaagcattgcgtcgccgacgtcggttcttggatggtgaaaaagatccttgcatggaagggcgttgagtgggagtaacagtcgataccgtgtcagaaggcaccacggttgggtcgacatgacccatcctgacgtcaccaagtgaaacgtacactccttcccattggagcgtacgcttcttcttcgccctgcgccgggatgcccttgattttttgattgatgatgggatgaactctggggcatcagctcggagcttgcttgatgacggcgacgagctttgctgttgtgtagggacactttgcagaactactacacccttcttcttgcttgagggcagctcatggtgcgtttcatcctccatcacagccgtccctttatcaagtgggtgcaggcggtgagggcggttcagcgcgacacctgttgatgcagatgatggtgccgctgctgtggacattgaaggtgcagcccctaatatgcttagggaattcttgggagacactacccctagcatctcaggggcaatgttgagtggcactgccacgggagtcgatgaagaccccgccacgcaggccggggatgcattagcccccagtgcactcttctttggcatagaagaagcaatcccttttggctcaggggacgctcggcgacgcggcgctgccttggacggacccgtccgtatctcacgaacagtccactcgcccgagtgttgtgcgacggaaccttggatatgcttcgtagctcctggtcttgacgggtgccaccctggtcatggctggtgcagccctggtaaacccaggaggcatcgagtcgttggaagcggcctcacgcaccttgatgaagtgctcttgtgaggcagcctgtcttgccttaactgctgccctcctcctcttggcagctttggatagaacaggaatgtacccgccctgtggcgccgagctcacttcctgttcatagtccgccggagctggcgatgcagcagtggtctgaagggagctgccactgttggcgacctggaatggacctatgggaacgtccacccacagtgagccaaagcgcagcgtgacgaatggttgaacttgtttagacatccttgcaaaataaagaaaaccatatgttagttttctcgaccatatatataaacagacgtttcatctggtcctgtaagaccatagcatgcatatattaatttcatagagcgctttggatgaagcacttgaatacgtgaatttttccactaaggatatgtgcatttatctcctttttttttcatattcgcggtctacatgttggaactcagagaggaggggagaagtaggtcccactgggcgtgccagaatctgacgccgggaaaaccgggatggttgtaatagtaggttcgttatccgcaaatcgttagagacaatttaatttaaatgcaataaataaataaaaatcagaaattgcgagtccattacttccagaattcatacatttatatagaaattctgttaattacatctccgtagagaaaacccctgattagggattccaacatgaaagaaaataaaattacatgactgctaaaaggctaaaaagaaaaatctatcctaaagctccagatgtcgcagccgtagaatcttctgtagatttccatttatatgtttatttcattttgggcgtattatagatgcccactaatttgttggttttaatatcactgcgtgtatggtagcaaatttatacatagcttctttttttggcattgtgactttatttttttatacgtagcgcacatatagaaattgcagaattttcttgagcattcgcgaggcatagccaggcgagtatttgctttagcgccaatattatcgacgcggcatgggattttggtacggcgaatttgcattgcctattttaatttccaccccacctgtattactactagcgcggcactataccatcaagtgtaatcgaagtgggcatttgtttgatttatggtcgattatcatgatgttgtcgcttgctatgcatatatggattaatttgctattgggaagaaactatacgtgatagcgaatgcacagccagagtatatggatgcatgcatgtgcgtatatcagatttttttatactgcactttatatatggtgtagcgagtatacattgttttaagcaaatatatgtatgcggatgattttgagattataattttcactccacttgtattactactagcatggctcgaagccgtgaagcgtaaccgaagtgagtgttggttaattttatggccgaccatcataactcggcgcagttcatgatttatccatcattttgtagatgaacagatggaaggagaaaatatatgcatgcgtacatctatttcctagctctgaccacggaaagaaaatgaacgccattttattttaattcttgttagagaaatatggctgaacatatgtcaaaactagcaaataagtgtgctaattagtatgctcaattaattttatttatcactatgcctttatcactactagcacggcttgaagccatgaagcgtgaccaaagcaagtgcttgtttaatttatggtgaattatgcaaaatttgtgtttgtatccgtgatttgtatccgctcgtagaggactgaacctgagagcgagaatctcgcctgggcttgtatccgctaacgggaccaaatcagagggtatggtaggatgacatgaaaagagtttgcatggaaaccactcctaggcccgtactcatctggccggaccatagaaaaaagtgtgaaatcatgttaaaagccatcaaatgaaacgaacttccttgtctcatacgcgctggctgagacaaaggacacaacaaagaggaaaaattcctttggcttgtactcatgatggccaagcctaggaacatggcaagaacatgattccatggttcgtactcattggccgaaccgaaggacacagcaaaagaatccattaacatgagtagaggaagatgaattgagagatttttcgaattgacaaaagaatccattaattgacaaaagttcgccgcacgaatcacgaagtgattttttgccacgaatgcacccaaaacactcaaatatgtccaaaaatcatgttttggtgctttttgaacattttcattccagtctgaaacatcgcaccgacatgtgccaatatatgccaatactagcattaattgacaaaagttcgccgcgcgaatcacgaagtgattttttgccacgaaagcacccaaaacactcagatatgtccaaaaatcatgttttggtgctttttgaactttttcattccggtgaaaaacatcgcacccacctgtgccaatattgacattaattgacaaaacttcgccgcgcgaatcacgaagtgattttttgccacgaatgcacccaacacactacactatgtccaaaaatcatgttttggtgctttttgaactttttcgttccggtctaaaacatcgcacccacgtgtgccaatatatgcaaatattggcattaaatgacaaaagttcgccgcgcaaatcatgaagtgatttttagccacgaatgcacccaacacactccaatatgtccaaaaatcatgttttggtgctttttaaactttttcaatctggtctaaaacatcgcacccacctgtgccaatattggcagaaattgacaaaagttcgctgcgcgaatcacgaagtgattttttcccacgaacactcccaacacactccaatacgtccaaatatcatgttttggtgatttttgaactttttcattccggtgaaaaacatcgcacacatctgtgcaattatatgccaatagtggcattagttgacaaaagttcgccgcacgaatcacgaaaagattttttgccacgaaagcacccaaaacactcaaatatgtccaaaaatcatgttttggtgctttttgagctttttcattccggtgaaaaacatcgcacccacctgtgccaatattggcattaatttacaatagttcgccgcgcgaaacacgaagtgattttttgccacgaatgcacccaacacactccaatatgtccaaaaatcatgttttggtgctttttgaactttttcattgcggtgtaaaacatcgcatccacgtgtgccaatatatgccaatattggcatcaattgacaaaagttcgccgcgcgaatcacgaagtgatttttagccgcgaatgcacccaacacactccaatatgttcaaaaatcatgttttggtgatttttgaactttttcatttttgtcaaaaacatcgcacccacctgtgcaaatatacgccaatactggcattaattgacaaaagtgccaaacgaatcacgaagtgactttttgccacgaaagcacccaaaacactcaaatatgtccaaaaatcatgttttggtgctttttcaactttttaatttcggtgaaaaacatcgcacccacctgtgccaatattgacattaattgacaaaagttcgccgcgcaaatcacgaagtgattatttgccacgaatgcacccaacacactccactatgtccaaaaatcatgttttggtgctttttgaactttttcattccggtgtaatacatcacacccacgtgtgccaatatatgcaaatattggcattaaatgacaaaagttcgccgcggaaatcacgaagtgatttttagccacgaataaacccaacacagtccaatatgtccaaaaatcatttttttcgtgctttttgaactttttcattctggtctaaaacatcgcacccacctgtgccaatattggcagaaattgacaaaagttcgccgcgtgaatcacgaagtcattttttcccacgaacactaccaacacactccaatacgtccaaaaatcatgttttggtgatttttgaactttttcattcttgtcaaaaacatcgcacacatctgtgcaattatatgccaatagtggcattagttgacaaaagtttgccgcacgaatcacgaaatgattttttgccactaaagcacccaaaacactcaaatatgtccaaaaatcatgttttggtgctttttgaactttttcattccggtgaaaaacatcgcacccacctgtgccaatattggcagaaattgacaaaagttcgccgcgtgaatcacgaagtgattttttgccacgaatgcacccaacacactccaatatgtccaaaaatcatgttttggtgctttttgaactttttaattccggtctaaaacattgcacccacgtgtgccaatattggcagtaattgataaaagttcgccgcgtgaatcacgaagtgaagttttgccacgaatgcacccaacacactccaatatgtccaaaaatcatgttttggtgctttttgaactttttaattccggtctaaaacattgcacccacgtgtgccaatattagcagtaattgataaaagttcgtagcgtgaatcacgaagttattttttgccacgaaaacacccaaaacactcaaatatgtccaaaaatcatgttttggtgctttttgaactttttgattacggtgaaaaatatcgcacccacctgtgccaatattggcattaattgacaaaagttcgccacgcgaatcacgaaatgatttttagccgcgaatgcacccaacacactccaatatgttcaaaaatcatgttttggtgctttttgaactttttcattctggtctaaaacatcggacccacgtgagccaatattggcagtaattgataaaagttcgccgcgtgaatcacgaagtgatgtttagccacgaatgcacccaacacactccaatatgtccaaaaatcatgttttggtgctttttgaactttttaattccggtctaaaacattgcacccacgtgtgccaatattggcagtaattgataaaagttcgccgcgtgaatcacgaagtgaagttttgccacgaatgcacccaacacactccaatatgtccaaaaatcatgttttgctgctttttgaactttttaattccggtctaaaacattgcacccacgtgtgccaatattggcattcattgcggtgtaaaacatcgcacccacgtgtgccaatatatgccaatgttggcatcaattgacaaaagttcgccgcgcgaatcacgaagtgatttttagctgcgaatgcacccaacacactccaatatgttcaaaaatcatgttttggtgatttttgaactttttcattcttgtcaaaaacatcgcacccatctgtgcaattatatgccaatagtggcattagttgacaaaagttcgccgcacgaatcacgaagtgattttttgccacgaaaacaccaaaaacactcaaatatgtccaacaatcatgttgtggtgcttttagaactttttgattacggtgaaaaacatcgcacccaccagtgccaatattggcattaatttacaaagtatcgccgcgcgaatcacgaagtgattttttgccacgaatgcacccaacacactccaatatatccaaaaatcttgttttggtgctttttgaactttatcattccggtgtaaaacatagcacccacgtgtgccaatatatgccaatattggcattaattgacaaaagttcgccgcgcgaatcacgaaatgatttttagccacgaatgcacccaacacactccaatatgttcaaaaatcatgttttggtgctttttgaactttttcattgcggtctaaaacatcggacccacgtgagccaatattggcagtaattgataaaagttcgccgcgtgaatcacgaagtgatgttttgccacgaatgcacccaacacactccaatatatccaaaaatcatgttttggtgctttttgaactttttaattccggtctaaaacattgcacccacgtgtgccaatattggtagtaattgataaaagttcgtcgcgtgaatcacgaagtgattttttcccacgaatgcacccaaaacactcaaatatgtccaaaattcatgttttggtgctttttgaacattttcattccggtgaaaaacatcgcaccaacctgtgcccatataggacaatattggcattaactgacaaaagtttgccgcgcgagtcatggagtgatttttcgatacggatgcacccaatacactccaatatgtcaaaaaaaatcattttttgctgctttttgaactttttaattccggtgaaaaacatcacacccacgtgtacaaattatggcattaattggcaaaagttcgccgcgcgaatcaggaagttttttttttttgccacgaacgcatccaatacactccaatatgtcgaaaaatcttgttttggtgatttttgaacgttttcattccggtgaaaacatcgcacgcatgtgtgccaatataggacaatattggcgtttattgactaaagttcgtcgcgcgagtcacggagcgatttttgtacacggactcacccaatacaatccaatatatccaaaaatcatgttttgctgctttttgaacattttcattacggtgaaaaacatcgcaccaacgtgtgccaatatacgccaactttggcaagacaaaagttcgccgcgcaagtcacgcagtgatttttcgatacggacgcacccaatacactccttctgtccaaagtcgtgttttggtaatttttgaactctttcattccggtgaaaaacatcgcacccacgttggccaatataggccaactttggtattaattgacaaaatttcgcagcgcgagtcacggagtgattttttgacacgggcgcacccatacactccaatatatctaaaaatcatgtcttggtgctttttgaactttttcattccggtgaaaaacatcgcacccacgtgtgccaatataggccaatttggcattaattgacaaaagttttcgcctctcgagtcacgaagtgatttttcgacacgaactcacccaacatacgccaatatgtccaaaaatcatgttttgctgctttgtgaagattttcatttcggtgaaaacacccacgtgtgccaatataggccaatatttggattaattgacaaaagttcgccgtgcgagtcacagagtgatttttggatacggacgctcccaatgctctacagtacgtacaaaaaccatgttttggtgctttttcgttccggtgaaatacatcgcacccacgtgtggcaatatatgccaatattggcattcatttttgacagttcgtcgcgcgagtcacggagtgattttttgacacggactgacccaacatactccaatatgtccaaaaatcacgttttggtgctttttgaagtttttcattccggtgaaaaacatcgcacccacgtgtgctaatatatgccaatattggcattaattgacaaaacttcgccgcgtgagtcactgaggaatttttcgacatagacgcacccaattctcttcagtatgtccaaaaacatgttttggtgctttctaaacattttcattccgatgaaatacatcgcacccacgtctgctaatataggccaatattggcattaagtgacaaaacttcgccgcgtgagtcacggagtgatttttcgacacggacgcacccagtacactccaatatgtccaaaaatcaatgctttatgaaatttttcattccggtgaaaaacaactcacccacgtatgccaatataggccaatgttggcattaattgacaaaagttcgccgtgcgagtcacggagtgatttttcgacacggactcacccaacatactccaatatgtccaaaaacatgttttgctgctttttgaagtttttcattccggtgaaaaacatcgcacccatgtgtgccaatatatcccaatactggcagtaattgacaaaagttcgccgcgtgaatcacgaagtgattttttgccacgaacgcacccaatacactccaatatgtccaaaaatcatgttttggtgctttttgaactttttaattccggtctaaaacattgcacccacgtgtgccaatattggcagtaattgataaaagttcgtcgcgcgaatcacgaagttattttttcccacgaatgcacccaaaacactcaaatatgtccaaaattcatgttttggtgctttttgaacattttcattccggtctaaaacatcgcacaaacctgtgccaatataagccaatattagcattaattgacaaaagttcgccgcgtgaatcacgaagttatttttggccacgaacgcacccaatacactccaatatgtccaaaaatcatgttttggtgcattttgagctttttcattcttgtctaaaacatcgcacccacatgtgccaatattggcagtaattgataaaagttcgccgcgcgaatcacgatgtgattttttgccacgaatgcacccaacacactccaatatgtccaaaaatcatgttttagtacttttagaactttttaattccggtgaaaaatatcgcacccacctgtgccaatattggcagtaattgacaaaatttcgccgtgcgaataacgaactgattttttgtcacgaacgcacctaatacactccaatatgtccaaaaatcatgttttggttctttttgaactttttcattccggtctaaaacatcgcacccacgtgtgccaatattggcagaaattgatgaaagttcgtcgcgcgaatcacgaagtaattttttcccacgaatgcacccaaaacactcaaatatgtccaaaaatcatgttttggtggtttttgaactttttcattccggtgaaaaacatcgcacccacctgtgccaatattggcattaattgacaaaagttcgccgcgcgaatcacgaagtgattttttaccacaaacgcacccagtaaactccaatatgtccaaaaatcatgttttggtgctttttgaactttttcattgcggtgtaaaaaatcgcacccacgtgtgccaatatatgccaatattggcattaattg

SEQ ID NO: 2006 - DNA, 15790 bp, Oryza sativa
aatatatgccaatattagcattagttgacaaaagttcgctgcgcgaatcacgaagttattttttgccacgaacgcacccaatacactccaatatgtccaaaaatcatgttttggtgcattttgaactttttcattctggtctaaaacatcgcacccacgtgtgccaattggcagtaaatgataaaagttcgccgcgcgaatcacgatgtgattttttgccacgaatgcacccaacacactccaatatgtccaaaaatcatgttttagtgccttttgaactttttaatttcggtgaaaaacatcgcacccacctgtgccaatattggcagtaattgacaaaatttcgccgtgcgaatcacgaagtgattttttgccatgaacgcacccaatacactccaatatgtccaaaaatcttgttttggtgctttttaaactttttcattccggtctaaaacatcgcacccacgtgtgccaatatatgccaatgttggcatcaattgacaaaagttcgccgcgcgaatcacgaagtgatttttagccgcgaaagcacccaacgcactccaatatgttcaaaaatcatgttttggtgatttttgaactttttcattcttgtcaaaaacttcgcacccatctgtgcaattatatgccaatagtggcattagttgacaaaagttcgccgcacgaatcacgaagtgattttttgccacgaaagcaaccaaaacactgaaatatgtccaaaaatcatgttttggtactttttgaactttttcattcttgtcaaaaacatcgcacccacctgtgcaattatatgccaatagtggcattagttgacaaaagttcgccgcacgaatcacgatgtgattttttgccacgaaaacacccaaaacactcaaatatgtccaaaattcatgttttagtgctttttgaactttttcattccggtgaaaaacatcgcacccacctgttccaatatatgccaatattggcagtaattgacaaaatttcgccgtgcgaatcacgaagtgattttttgccatgaacgcacccaatacactccaatatgtccaaaaatcttgttttggtgctttttgaactttttcattccggtctaaaacatcgcacccacgtgtgccaatattggcagtaattgatgaaagttcgtcgcgcgaatcgcgaagtgatcttttcccacgaatgcacccaaaacactcaaatatgtccaaaaatcatgttttggtgctttttgaactttttcattccggtgtaaaacatcgcacccacgtgtgccaatatatgcaaatattagcattaattgacagaagttcgccgcgcgaatcacgtagtgattttttgccacgaacacagccaatacactccaatatgtccgaaaatcatgttttgttgctttttgaactttttcattccggtctaaaacatcgcatccacctgtgccaaacacttggataatatttcttcaagtatattccattaagcggtaatatttcttcaagtatattccattaagcggtcgtccataaacttctccatcaagtccttggaacatataagctcctttggacacaacgttatgtatttgaaatggtccttccctagttggtgaccatttgccgaatttattataacgagtcccaatcggcaagatcaacttccaaacaagctctccttcataaaaagatttaggcaccaccttgttgttataatgccgagcaaccctttccttatccttagtaacttgtgcaagagctcgcagccttgactgaaccagatcttctctttcatcggccatgagattgtaatattcatcggctgtcaattcattctgcaaatttgttcttctcgagccgattctaacttcccatggtaaaactgcctcatgcccataaacaagcttgtagggaggaacttgaatcgacccatgacaagccatccgataagaccacaatgcttcggctaacctaatgtgccattgccgaggataatcagaaatctatctcttaatcaacttgatcaaactcttgttagaagcctcggcttgtccattggcttgtgcatagtaaggagaggaattcaacaacctgataccgatgctatcggcaaattgaacaaattcatcagatacaaatatagagccttgatcggttgtaatggtctgcggaataccaaatcgattgattatgtgttccttaacaaattggatagcatctcctgaatcaacctttttcaaaggaatagcctctacccacttggtgaaataatcagtcgcaaccaatataaacgtatgtcccttacttgaagatggattaatctggccgatcatgtccataccccatcctctaaacagccatggcttgataataggattcatagccgatgctggtgctctctgaattgccccaaacttttgacaatcttggcatcctttatagtatttgaagcaatcttccaacattgtcggccaaaaatatcctgcacgccgaagcaaccacttcatcttgtgagccgattgatgagtaccataaatcccttcatgtacttcacctatcgcaacttttgcttgatcaacgctcaaacacttaagcaacaccccatcgatcgtccaataatatagttcattatccaaccaggtgtattgtaaggccttataacgtactttccgcgaagccgactgagatggattgtgcaaatattgaaacaaatcatatctccaatcatcggctgtgatcgtagcaactccgatctcaacatccttccacatcggcttatatcctgatgccccttgagccaaatcattagcttctatattcttctcgtgaggaacatgcttcaaagttattagccgaaatccttccattaaccttcggcacttctcattatagaccatcaacgtagcgttcttgcattcatattctcctgccaattgactaataaccagtaaggaatcacccataatttcgatagcatcggcttcaacttctctcaacaattgcaaccccttgagaactgcctcatattcagcttgattattagttgcatagggcttaatagtataggcaaactcgaaacttggcccccgaggtgaaatgataaccaagcggataccacaatcatgagtgcacactgatccatcaaaaaataaagtccacggcacaatatcaactgaaccgattgagtcatcacgatgatccacaataaaatcagctatagcttgtcccttaatcagctatagaaaaaatccactttccaacccttcctttcaaaattggagccgacaacatgtatttgactatatcggctttacatatcacagtgcattcattggacaatagataatgccttaacttggtgcaagaaaaatacaaacataagcacaacttttccactggagaataccttgtctctgcatccaatagtctgtgacttaagtaaaatatagccctttcttttccttcaagctcctgaatcaacactgagccgatcgacttatcaccagccgataggtacaatctgaaaggtattcctttttgtggagaaattaaaactggtggggaactaaaatatttcttaatattatccaaagctttctgttgttctgccccccaagtgaactcctgatcagctttcaatctcaacaaaggtgtaaaaggctctaatcttccaaacaaattagatataaatctcctaacaaaatttaccttgccgatcagctcctgcaactttgtcttgtcctctagaggttgaatcttctgaattgcattaatgcccctttgagtcacttcaatccccctctcatgaacaagaaatcccaaaaactggccagccgatacgccaaaagcacattttgtcgggttcatcttcaagccatactttcgagttctcttaaaacttttctcaaatcggctatgtggtcttctatttcctttgacttgacaaccacatcatcaatataaacttcaaccaaccagccgattcatggctctttgatatgtggccctagcacttttcaagcggaaagtcatcacaacccactcaaacaagccgattgcaccaggacatctaaaagctgtcttatgaatgtcttcttcggccataaaaatttgattgtaacctgcattgccatccataaaactcaaaatcttatatcctgaagcagcatcaaccaactgatcgactattggcattgggtactcgtcctttggcgtagccttgtttagatttcgaaaatcaatgcacaccctaactttgctattcttcttgatgactggaactatatttgaaacccattcagcatatcggcatggacgaataaaaccagcatcatacaaatgctttacctcagccttaatagcttcaagcatatcggctttacacctccttggtggctgctagtatggccgaatcccaggcttaataggaagctgatgttcaacaatcgatcgactgagtcctggcatctcataatattcccaagcaaagcaatccctgtactcttttaaaagctctatcaacttggttctaaattctgaagataagtttttactgataaatgtcggccatggtcgatctcctggacctatgtcaatttcttccaaatcatcggccgacatgaaaccttgtccttgtttgtcatcgagatcatctaccgtgtccttgttgtagacgtttgaaccctccacaacgccctcaaaataataatttgggctctcgatcttcaatcgactgttcccaaacttttccagacaagcaatcaataccatccatctcccaaatagctaaatcagcactagcaacgttaactgacctgtcagctggcacgatctcaatcttgtcaccctgccattgaatcaagcaccgatgcatggttgaaggaatacaacaagtagcatgaatccaatcccttccgagcaacaagctataggaacccttcccatcgatgacaaaaaacgttgtaggaacagttttactgccgactgttagctctacattcaaaactcctttggtctctgatggattgccaccaaaatccttgagaaccatgttggtcttgattagatcatgtggatttctgcccaacttcctgaatgtagcatatggcatcaaattcacagcagctcctccatcaacaatcatcttagacatcagcttcccattgacaaacccattgatatacaatggcttgagatgccgattttgtgtcccttccggtttctcaaagattgcttgctctggtgacaaaactaacttagccgaagcctcttcaacgtcaataacttcgacttgcttggcttcaaattcggctggcagcatgaaaaccatgttcaccgatgcagatgcaacagccttacccttgagcaccctttttgctttgtcggcctcaacttcatcggctgttgtaattatgcgcttaacacgccattcttgcctggtttttgttttccctagccgatgattaatttcttgctgcacctcctgaaaacgctccctgttcctcaacctttgcacccttctcttctgattcttggtgaaaatgcctgtaggacaccattgtgtcttcctatcttcatcttcatcataatcaccatcttgattgaccgggcccaacctctgatgaacagatactctcttctggctcagccgattacctctattattggatcggcttgaattccctgcatcttcattgcatccagggcaatcctcaatcgatggtagcctcataccttcattccaacagaatcttaaaaattcacaattccaatgaggatcaaaaccaccatctctttcatgatatttctcctactgtttatcatactttctttggtacttgttgataatcctagccgaattcatctgaaaatttctgttcttcccaccatcggctgtccttccagacgtatgcaccatattaacagggaacggattaccatcaaccttcatcagcttctttgaatcatcaaatttgatctttccccccttgatggccgcctggatctgctgccgaaacactttgcaatcgttggtagaatgagaaccagaattatgccacttgcaataccttcttttgcctaactcttcggctgatgaccagcaggaagttgaatctgtttttcccgaagtaataaatcaaaaatcttgtcagccttagtgatgtcgaagtcaaatctttcctcttttccagagctcctcacccattggcatggtatgactttcttgctcttgacccattcggttgctgctacttcggaatcatcatcctcatcatcagaatcatacatgtaaggatatacatgattgattttcttgaagttcttcttggcctcaataaacctttgctcatgtagagtcaccttttgtgcaagatgtgacaaactctcaaaatcttgagccgaaaacttttctttgattggtgctatcaacccctgaaaagccaaatcggctagctgagaatctgtcaaagataaactgtaacacatgtttctcatctccctaaatctttgaatgtaatcttgcacagactcatcgtgcctttgtttaattgctgtcaaatcggacagtttcatctcgtgaactccactgtaaaaataactatgaaactgcttttccaaatcggcccaactattaacagaattatatgtcaaggaagaaaaccatgtaaatgctgatcctgacagagataaaggaaacaatctaactctcaaggcatttgtagccgatgccacaccacattgagctatgaatcggctgacatgttcataagttgaaacattatcctgccctgagaatttggagaagtcaggtactttgtattggctaggcaattgaaccctctcaaaccactcaggataaggatgccgatacaaatttccattgtcttttggtttgagcccaaactgttcactcattacatctgcgatcatatcagccaatgacgcatgctgaggtactccttgcatttgttgttgcatcggctcaaactgattgaattgaggagcgtactgaggctggggcgaccctgtctgctgatactgaacatgaggtgacggaggctgatattgataacctagatttcctccttgatagttctgaagattcggctaaatattatgcaccaaatgttcaggtataatttgaggcacaactgattgatcggcctatacgtgatggaccaagtgttcaggaatcacttggtttactgtatgctgtactggccgattgtcaggtgttcttaaccttgccgatgcatgctgcaaattctgatgctgagtcggctgaaccgtctgctgtctcggttgtgcttgctgggtcggcaacggctgtgttggatcggctatcgatggatttggcaaaaacgttgcagcaacttgctcctgagtcagccgattggcatttttcccaagatgttgtggttgttccctggtcaacaatctggtgttaaccatctgtcttggtgctgacgatgtagcttgtgcagtagctggagccgtcggccgagccggcagtgtattagaggtattctgctgatttgccgtaaccacagatctataatttggcaaaaacacctcctggtagatagactggacctgaggcttggtgctcggctatcgaaccatcaacaacagttttcaccatgttggttaaggtattaactaatactccagattgattcatcaaggcatgttgcacggcatagtcgatcctatcttgaaaattattgaactgcaacggctcttggttgccatctataccaaggtcttcaactgcaccatcttgaggaacgccacttttatcacctgagccagttgtagtacctttgtcaccctgagatgaactcaagccgacctcatcggctgcaaccaccttcagcttgtacttctgtacaatggttcctctgcgatcctgaaaagaatccatgaacttgctcttcacgttgctcatcatctgttcaagttcatccctctactcagccgtcagcctatccaatatgattggaacaatgttggttgggtccacttcagctgatggatttttggctcctgttttatttacaggaggtttgactcctgtccccggtgacggtggtggtttttcagccatcgtgatgaagtcgttgaaaactcgggtcccaccgggcgtgccaagagcgtgttgacgaaaaaatcgaacacaccggcctgggagatctgcttaactccagtgaaggtccaaaatctcacctttttaggttcgtgagtgtgccagttgatttgatcctgtaatcaacaagaaataaagacaaagaaaccgtagttaatccataaatgatagccgatcggccaatcgccgatgacgtatcatttatctttgggcccatgtcatctttgcatcgatcgacagtcatgaataaataaggaaggtctaaatctattcgatcggctgtagtcattaacaatatataatccttatgtcaatatatacttaaatcaagtgattgggatagatcggtcgccatgccgagatagtataaatcacttagatctaaacttatattaataatgagattatatatgttcacagcatagccgataagatagatctagcatgtatcagctaatactccgataccactctaaactaagatattaaagcgagtaaaatatatcaaacaagaagcttaacatatctaaaagcaataagatcttaatataaagggcagatctatcgtttcacttgagcacatgaaataaatatagagctaaatcagttaagatcggctgaaaccccgatactactctaatcgacaaccaagaagcaggctcgagattatagttctaagcatgactcatcagatcaaactcaactgatgcagccataagtacgaaaagaaatacaatatctagacaatcaagctattgggagcttcatagagtggtgaatatcttatataatctaagccaacatcgatatttaacctaatcggctgctccctagcgatagatattagccaattggaggttagaaagcgatattgtcagagattatataggatatatgataactcgacaacttacatagacaagattagagtatcataatgatggaagcactaatcccgagaacgcaagctgccatagcaagtcatacctctagttgaagatcgaaaccgatgcagctcaactcgaaagcaagaactcgtcgaaataaaacgaaagcaaaagggtggcgatgggcgatgcgccgagattgtatttgaacgtctgtcttccttattacatggggctcggggtctagttatacccaagattacaaaatatgtccttgtcggacacgactcttatctctaacaaattctaagataccataagtctttgcggcagacttttgcccacacttatctctaaggaaattacataaaatatcctaattaatagatacaattgccttcttaggactctatccatgtgtggcaatccacacgaagcacattaactcagcctgatgatgtaaaccaagtcatattgccggaatcggctgtatcggctaaccctatctgattcggactcagccgatctggtcatagccgatttggactccatccgattcttgctctgtttccgaaatgatactcgtatttgattctgtttcgatccaatcttcatttccgatactgaggttaccaaatttggttgttaacaattagggccaagtaggccaacaaatatcagagaacaacaacggaagacaaaataatataagggcccggttaacatgctacaggtagtcgactggggaacgagacctagaacaagaccgcactccaatcatcttgttggatacgcaagcgtaccgacaagggcttctctttaacactctcctaaaagatatataaatagcaagggtgagtaccaaccgtactcagcaagccaccacagcaacaatgcatatgatagagggtatttcaaggaacggcttcaggttcttttgcgtaaagcaagttttgcaaatcttttcacaagcctaagatctagcatagactgatcaaattttagtaccaatgttctcattaaacaacgacggttctgtctaccatccattgtgatcccaaggatagcttcccgccattgagtcgtcatggttttctgaggacgaccaccttcactcttctcaggaagtggctccatcagcataaaaatcattatgcaatatcccatcccacacaagttaagaatttagagtctagccaagtgtaatacacgtcccggtgctcaataaccgcgagcacggctattcgaatagatttggtttactcacactgcagtggatgtacactttacccgcactcagcgactgcccaacacatgagcctcgtcccaacacatgagacgcgtcacggcaaagcctttcgataacctcgcattggcagtacccgctccacgaacttacttcctcatgcactcaggcatccatgtttctagcagtgagaggagttctggcgctcccggggaagaagtctcacacacacattaagttctctctcacactctcatggtagtcctacaaatggcgacactgatgtagggcacgccttgcggccctacctcaacggctgccccaccgtaccgcacctgcctcactcaggggtgaaccatctatgaagggatactgcctccactcggctatctaatccgctaggtctatacccattcgagaagtacggttgtacgggggtcgtttcaagcttaacttcatggctcagtccttaattgacaggggacggtactagccttttcaagataccacccaaatcctccgtccgccccagtcgaaaactgttgtttagttttatttctcctttcacaaatcatgtcatcaatatcatggcaatgtggtgctcatgtctccacatgccgcatctcaattaccttcccaaaggtaattgcccaagcatatagcatttgataaatatgagtatgcatgattctagaatagcatttctaagcaattgtcataattgactagggactcatacgtaatcgtggttacaaggattttaagggtaaacaataatcaaggcatggcgtaatcacaagtaggatgtttatcattgcttgcaattttatttgtaaacaaaacaattttgcaattgggatcaacatgttcaaggaatagtgatgacttgcctgctcaggatagtccttattcttgatacaatcttgatcaaccttcacctcctagaagttgcatacattgcctcacgactaaccgatatacaatgtctacattacacgagaaaaaccaatattcaaacaacaatcaaatatgcacaacaaaatgtacttgttggtcgtacctagggttgctcgtactattattgtttgctaggggattccaatcatgctaagggctaaagtttcttaatctttctgttgtcatggtggtttatggggagctagccgacatagtataaatgagatacacatttggctaatatgtggtttagtctagctaatggctatggaaggattatggctacacatgcatctatctaaataaaatggtcatatatatactagaggttctgttgtcgtcggatggatttgggatcaagcaattaatcacagggaaccatttgtattattattttattgatggaggcttttctttaattatgaaaatattttacttgtcacaataaattataaaaggttaataattatccatgctttgtatgttagagttgtttaggataatcatattatggttacagattatcccatcacataattttacaatgaataatcctaatttacaattgaactataattatatgaggtcaagatttataactagtatttatctaatattcatgtttgtcatatagtccctctaatttaatatatgcaacaagcaaattaatattataccgtatagctataatgggatgtacagtataggtgtgtgcacaatatcttaatattgaatcatttatttgaatagttgctatttactacaagctacacagtacatgtgattttaagtggatttatgagtgagttaccgtctatacaacttaagggtcgatttccaacctaaacatatactactgtataggaaatgccgttaattaatttcgtgcgggtgattttagtcacactagctctgttattatctctcataaataagttaaagactcatctacgtgtgttaaaattttagtcacaaagtatgaggctaaacattatttatacaatttggacgtcatgagtataattatatattgacatatattaacaaatggcactagtatttcctatgctttaattaatttgaaacaatgctcctcattagtttacataggttttacagtgagaaagcgtgttaaagacaattatttgacatctactttacagtacaatatcaattttatttattggcacatttttaagttaactattatgcatcatcttgatattaattatttaataattataaatatattttatcaaatagtgaattatataccattggaaagcttatgaatttagatgaatttagattcaagtttcactcaaatcggagctaaaatgaataagttatgctagtgtaaagattcaaatttgaattaaatctaataattgcgaaattgtactgttcctaattcatttatttttaatacaaccttatccacaagctatagtgcctgacaggtgcggtcttcctattttcttttcttttattttatttttctttctaaaggaatccatatgggcaaatgacaggtgggcccgactcctttgactagggtcaaaccggccattaaacctggtagggcccgcttgtcatagactcaaaattataaaccctccataactagatttttaaccactcggacccacatgtaatagacttaacttataaagattaagaaggggattactatttactaatcacgtggggcccactctaacctctctcctctcctttctcttctctctctctgcgcaacctctttgcttcctctctctctcgcggctcggctggaaccggcgggcggcgcggcgcgacgtcaagcggtgggggaggggaaggctcaccggactgacggcggggtcaacggagacgcagcggaggggtcgacgttggagcacggcgtggcgacgaggcacagcgcggcggcggggcatgtcggctcagcggcggcggtggcttccaaagaggcggcgatgccggggacgggaaagagaggggaaagggaggggaggtggtgagggtggtgtgggaagcaatgggcgcccgggggggtttatataggcggaggggttgggcggtgcctaatgatgacagcgacagtgcgcagcgcgtgtgggtctcgaggcgctgatggcgatggcgcgcggtgcggcagtggagccgacgcaacggcgacagcgacggcgcgtggcgcgacgggacgcgagggggcgcggcaacggatgcacggcgacgggatgggcgatgcggtggtgcgcagtcgcgagggcgacaggcggcgatgcatcggcgcgatggcgatggcagcacgacaaccacggtgacgcgacgttcgtgcggcgcacgcgcatgactcggtggtatgggggcgcggggctcaagggcgacgcgacgggcgacgacgacggcgcggcagcggcgcggggctcggcgcggcacgggcgacggcgacacgagcggcgcggggctcgaggtgatggcgacacgcgacgatgatgatgacgcgacggtgaaggcacgcgcggaggagtggggctcgagacgatgcgaccaacgacggcgacggcgcgcggcacgacgggacgcgagggggcacggcagcggcgcgcgcagtgcgaaccgatggcgcacagcgcgtcggggcgacggcgacatgacggcgtgcggcggcgcggggcacaaggcagtggcgcagcagggctaggcgtggcgcggcagagtaggggcagggctaggcgcggcgatgggacagggtcaagcacctagggggcaatgaacagtgttaactgatttattggattttattagatgtttttctaatttagaaaatggactattgccacctattttgtcacaatgtgtttcacacaaaatctaagttattcaaatgtaaatttgtattcaaacttaatattgcccacattttatttttattatgtatttttctaatttttcctgttttcctatatttgggattttggtatttatccgttttcacacatattggtttatctttttgattggtttttaccaccacatggatttctataatttagcattcgtgattcaattcaaattatataatatcagattaatttttcccagtaaatctattctatagatagagttccattgatctgaacgattataatttcctaagtgtttatatttcatggcacgcatcacatggttcggtatttaatatttgatccataagttaaattagtaattaaccttccttttgtctgactttgctttcttgtgcgtaaatatttatagggttcatgataaatatcttattgttataattattactcagttgtataactttagttaaattttccattgtgacaatttatagctcggcaagtaaaagcaaccacaacatccaacatgatgcaaaagttttaaaaagttcaaaattttagtgatttttcttgtcttgaattttcagggtgttacagctaatgcaggacaatattggcattagttgacaaaagatcgccgtgtgagtcccggagtggtttttcgacacgcacgcacccaacacactccaatatgtccaaaactcatgtttgggtgcttttttaactttttcattccagtgaaaaacatcacacccacatgtgccaattttggcattaattgacaaaagttcgccacgcgaatcacgaagttttttttcgccaccaacgcacccaatacactccaatatgtccaaaaatcttgattcggtgattttcgaactttgtctttcggtcgaaaacatcgcacccacgtgtgccaatataggcgaatattgacattaattgacaaaagttcgtcgcgcgagtcacagagtgattttatgcaacgaacgcacccaatacgctccaatatttcctaaaatcatattttggtgctttttgaatttttcattccggtcaaaaacatcgcacccacgtgggccaatctaggacaatattggcattaattgacaaaagttcgccgcacgagtcacagagtgatttttcgaatatttcccaaaatcacgcaaccaatacactcaaatatgtcccaaaatcatgttttgatgatttttgaactttttattctggtcaaaaacatcgcacccacgtgtgccaatattggtgcgcgaatcacgaagtgatgtttttgccacgaacgcacccgatatactccaatatgtccaaaaatcatgttttggtgctttatgaactttttcattctggtcaaaaacatcgcacccaagtttgccaatattggcgcgcgaatcacgaagtgattgttttgccacgaacgcacccaatacactccaatatatccaaaaatcatgttttggtgctttttgaacattttcattcccgtcaaaaacatcacacccacctgcgccaatacaggacaatattggcattaattgacaaaagttcgccgcgcgaatcacggagtgatttatcgacacggacgcacccaatacactcaaatatgtccaaaatcatgttttggtgcttttgaacttattcattccggtcaaaaacaacgcatc

SEQ ID NO: 2007 - DNA, 1093 bp, Oryza sativa
tgtgtttctcgagagcagggcatcgagctcatagccgacacccatcagggcgagtgcggggcccattcggcctcgcgaactttagtcgggaaagcctttcggcaaggcttttattggccgactgcattacaagatgcccaagaatgggtccggcggtgtaaagcgtgccagttccacgccaagcagaaccaccagccggcccaagccttgcaggtcatccccctctcttggccttttgcggtctgggggctagacatccttggacctttcaaagcggctcgaggcgggtatcagcacctgtacgtcgccatcgacaagttcaccaagtggcccgaggcttaccctgtcgtcaagatcgacaagcattctgccctcaaattcatcaggggcatcacctctcggttcggagtgcccaaccgcattatcacagacaacggcacccagttcaccagtgagctgttcggcgattactgtgacgacatgggcatcaagttatgctttgcctcgcccgcccaccccaagagcaacggccaagtcgagcgagccaatgccgaaatcctcaaaggcctaaaaaccaagacatacaacgtcttgaagaggcacggggactcatggctcgaggagttgcccgccgtgttgtgggcaaatcggaccaccccaagccgcgccaccggggaaacgccgttttttctggtgtacggcgccgaagcggtcctaccctccgagctctccctggggtcgcctcgcgtcacactgtacagcgagaccaaccaggatgaccttcgccgcgatgatctcgattatctcgaagaacggagaaggcgagcggccttgcgtgccgcccgctaccagcagagcctgcgacgctaccatcagcgccacgtccgggcccgatcactgcaagttggcgacctcgtcctacgccgcgttcagtcgcgcctagggctgagcaagctctcgccaacgtgggaaggaccatacaaagtgatctgcgtgccccggccagctccgttcggttaaccatggaggacggcacagaattgcctaacccctggaatatcgaacacctcggtcgcttctatccataatatcg

SEQ ID NO: 2008 - DNA, 1109 bp, Oryza sativa
agaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaa

SEQ ID NO: 2009 - DNA, 749 bp, Oryza sativa
gccactaggaagtggagaggatagctctgacatttcggaagctggtggctggacacacagtggggaggtaaagatgagctgagctcagctaggcaacagcatgtgttgctagtggccactagccatctatccctgtctactgttgttaaagagaaagagggagacagttccatgtctaccatttgctcaatgttggcaacaacctgatgtgtaatgtaatctgaaggttaccttggcatgattgatcagttgatctaaagtgataagaaaatgtttagccaattatggcatgaaaatatcagttgccatacagtatactactcagtgatggtacaagttactgattatagatgatattcgttgagcaaagcagacataggtcgatgagccacatgagcccatatcaacctgagacaggataaacttatcgtgagtttaacaaagtttggatcaggtcaggataatatgcgttgcgcaagagaagaataaaaatgtttgcttacactttgcccaaggttggtactaatactatacaaattacatgttgcaccatttcaaaaataataataataaaaagctgttgcacctgtagttgctaacaatgaaatgaactcttggcacagcaggtcttaacaggacagatcaagtgctactgtattatttgcatcttcgatacatgaaatcaaagagtacagatgaagcttagtgcatttaggtgtaactcggtcgagttactgggtcgaggaaat

SEQ ID NO: 2010 - DNA, 46674 bp, Oryza sativa
  unsure (1)..(46674): unsure at all n locations
ttctctgaactacattaccttggtcaggttgaacccttgttttctaatgtattactggttagttgcagttcttaacacaaactggatcacactccagtgtgccctctttcttttgctagttggattcaatattagagaattctgcactagtatctttttgccatactgttcaaataattcgtacccactccattttattactgtccaaataattcgtacattaacccactcctttttatttcagctctcgcgttgttgacctgatccgtcacatgtacaacacccagtagaagatggtcactctttcggaagaaatggagtagagtgctactgaaaataagtcggaccttttgcgagctactccagtagagcttcattagctgtatgctgccttttgtttttgctggcttttcgcatgatgttttattaaaactcgatgtaatgttaatttgtgtacttcatctccggcactttataaatcgtggtttttgaatttgaaagttcaagtggcattagacgaataatttcttgaggattagttggctgcgctgttgattgtagatgcttggttcatatccatagttgttgatattcacggcacgggtttgctgaaaaaatgtcgcctttttttctgcttgatttcagtcggattctttcgtctgatcgctcaagtgctcgcttgctctctgctccgactacattggcccgccgccatgtactcggttgctctttttttacagccaaacgtgcgaagtgttttcatctccttttttagaaaggagcctggggccctgcttttttatagaaggcaaatcctttttatagaaagcaaatagagtaaccaatttatcgctggggactccagctgaaggacactcgcagctagcgcccaaaacagagaacttggctatcggaaacaacactaaccagtcccgactcttgctggacgagggtcgttgaataacttcacgaatgttgtctaccaaagactgggtcggaatttcttcagctttcaaaagtggcgatgagtttgcagcgaaaaatcatatcatttctgacacggcggacacgcgggccgcgcctagcttaacgcactcgacgtgcaggcgcgtgaggcccgcgaacacgcggggatacttgtcgcggtaggacgcgaggcgcgccccttgcctagcgacgtccctgcccgcgcacagaagctccggcttctccgacgagacggtgaaccacaggtcgtggatcctgcggccgcgggccatggcgtcgtcgaccgcgcggacgatgccgaccgacttgtccctcgagaagaagctcaggcccaggcggcggatggcgtgccggctctcgtgcgctgccaggatgctctgcaccgcgcgcaccatcgcgtggttgctcctcgcggactcggatagggtggatgtgaagccgtcgtcggggtcgtcgtcggggtcgggtgcgaaggagtcgacgtccagctcgatgttggcgagcatgccggggacgcggctccaccgcctcgagaggaggctgcatcgcacggcgtcccgtgtgtccagcttgtccaggatgaggagcaggacgtcgtcgggcagatcgctcagcagcgtcgtcatcgtgtttttgtcgcggtctggcgttcgttacctgtggcgcgcgcgcgagaccgagagcaagcgccggcccgcgcctatatctttctcgtttatatgtccgcgagacgccgagaccgcgacgtttggtcgtctgccgctgcaatgctgcatgctttagtcgtcttgactcgtttccgattccatattttcgccaccagaatcccgacgaccgacgtgggaggtggcaggaggcgactggttggttgacagacccagattggaatatgggctggattcactcgttccaagttcggcccatgccaaaacagcccacttcatcgaattggatcacaattcctgatttccaagcccaatatacctataatccatacgggttattactttgagatattctgtctacaaaaacaaaccggcatacagccttgagccttctgtttggaaaggtttaggcccctttaaatcaaaggaaaaaccataggaattctaaaggattttatcctataggaaatgggaccacctatacatttgtcgataaattttctcctaaaattttgacagatgtaattatagtacaattatagtgtaattacactgaaatttatatgtaattacactgtaacttgcatgtaattacaatgtaacttgtatataagtttcacgtaattttgaattgttaaatctattacaagatttgttttggtgaggaaaaacaatcatagcacacacatatgtgtaaggatttattctcacaacctctattttaccgaaataacatattatagagagatttttgaaagttacatacgagttacactatagttacagtgtaatcacactactgtcaaatttttgggagaaaatttgtcaacaaatatatagcaaaatcgatgggaagggacataatcctatagagtcctttgaaacaaatgattgtttcctattaattcctttgaaattcctatggagtgaaccttactaaagcaattttggaggaaaacaagcatgaggtcgagacctcatgttttcctcttcatgtgtctaaggttcctgcgtttttcctgtgtgctaatcaaacgacagttcgaggccccctttgaattggaggaaaaatggaggaaaacaaaggaattgaaatcctactctattcatgcctttgattcgtaggaatgagaaaagaaaaaacgtaggaaactttcctattcctacaattctaaaggaaaaacgtagaaaatttaacatccactcaaacctcttggaaaactttccttaaatctatctctctcatctgattcttgcgtttttcctacggtccaatcaaacgatcattcctgtgtttctcctgtgttctgcaatcctctatttttacacttgcatttctatcagaatcctatgtttttcctattcaccgttttttcaatcctgcgattcaaatgggccctcagggatctaataagtgtggcattcaattcctacgtttttcctattcctctgttttctcaatcttgcgattcaaaggtgcccttaattgtgcatacaatgaagtacttgaatatcgtgattatcttgtgtacttggggggatgatttgatactatttataagaaaacacgtgaaacttctcttggtatcaccttttgtgaataagggaataacatgtctcctcgctatgctatggaaatagatgttacattcgtacttcttatatgtactaaaacacttttttatcatataaattttattctaaatataaccttccacccaccctttcatcttaaccatcttccatttgattctttcactaaggccctgttcttttctccaacaaaacttggataaaaataaagatttttgtggcacacatttcaaactgttaagccgtgcgtttcgtgcttctatatgaaagttgctctaaaatatcagataatatgttttccaaatttataacaattaaaactcaatcgatcatacgttaataccacctcgttttgtgtaaaaaacttaatcttcatcttcattttcagaagaaaagaaacaccacctaagtctctcatctataagtcataaccatctctcacttaatttctctacctattttctcacatcaatcaattatttaaattttaccttaaacttatttttttccaaagatagatatgttgaacatgtgttgggctattgtctattcacagctccattgtttgtttgttggtttattagctacaaccaaaatttaacttttgaaacttaataaattagagttaattttgagattttttcatcgtatttgtttttttacttttaaattattaagacacgattttaaaaatattatttgtaaattattttttattgcttccattattttttttttgaaagcttagagatctagagcaaagcgaggccgatcttcagtgctcaaccgccgcagcttagcgcgccaaaaatattgctatcttctcaaatttccctccaattcccctactcccccttccgtctctctcctccctcgtcggccccgcgccggcgccacaatctctgcctccgcagccgcgcccgccgcctccggagatgtactccccgccccacgccgccgactcggactccgagggatccctcctctccgacgtctccgcctccccgccacgccgccgctcgcctcctcgcccggcgccgcctcctcctcctcctcctcctccgcccaagcaccgtactaggcccgccgcccccaccaaacccaagctcaagcccacgccgcccgctgcctccgcgcccgcgcccgccccgccgcctccgcctacgctccgcgccgccgcgctctccgatccgcacggcctcgccgcgcgcatcgccgccggctctgctctcaccgcggcctccggcactgcctcgtcgtcctccttccgccgtctcgtccagtcgcgcaacccttccttcgatccagccaccgccttcacggctcccgcttcgtccgctccttccgaggttccgagcgccgctccgcggccgcccccgaccgccgccaccgacgcgccgccgcagaccaggcccaagcgggtgcaccccaactccgtgtcggaggtagcggccgcgtcggcggcggcggagcagccgaagcgggcaagagggggatccgagggcaacttcgtgcggctgaacatcaacgggtacggcaggaggaggacgttcaagaattcgcaggccaagcgctcgacgaaatgtcgatcctggcggcggcagcgcgccgccggtgcaacaccccgttctcagggcgacgaggaaggggatctcgtggcggaggccctgctggagcgggagaagcaggcagctagcgatagtgttctggaggctgtcgagagtgtgagggaggacccatcggagcaaaatctcaagagcttgctgaatgcagcatatgggcacgattcgttccgccaggggcagcttgaggcgatccagcaaattgttgcaggggagtcaacaatgcttgtgctgcccaccggtgcgggcaagtcgctatgctaccaggtatgcttcaaaatttgagctattaagtttatattggtcggtgctgaaaagttgatgatgctattttctcaggtgcctgctatgattttgcctggactgacactggtggtgagtccactgctttccttgatggttgatcaattgaggaagctccctgcatttctgccaggtggccttcttgcgagcagtcaggtaaaggcaaaatgttgcagttgctgctagttccatccattcttgttttgactattgtgtaacattacctcatttatccagacatcggatgagtttcatgatacactacaaaggctgcgtgcaggggaaataaaggtacaattttcttaatgtcgacatctgatcagtttaagcattctccagtgactacagccttgatgctgccttatctagagaacatttccttactatctttatcaattcttccagtgcagcatttttcttggagtaactagaacatgaatcattaagaagcacaaatgtattttttttttgcacttcaatgttttgctaggttatgctgagattctttatttttgggatcaggtgctttttgtttcccctgagagattcttgaacgaagaattcctcctgatatttagggacacactaccaatatctcttgtggcgattgatgaagctcattgcatttctgaatggtgagctgacattgttcttagttcagttgagaagacatgatacttctttacagttggtactgtgttattacttttgtgttcacatcatttttgtgatacatcttattaattttaccgttgttttgttttcctagtttattattcacttgttgtgtagtgttagacagttagtacaactgtcttgctaagtttataacttattcctgactgaatgtacaggtctcataattttagaccttcatatctgagactccgagcgtcactacttaggagaaagctcaatgttcaatgtattcttgcaatgactgcaactgcaacgacccaaaccttggaggagataatgaatgccttagaaataccatctgataatctcattcaaacatctcaaataagagaaaatctacagctgtctatcagcacaagtgataacaggtaggccacttctctttgcacccatgaatgcaaccagagtcagtttaatacgtatttacatgtgaaagaaggtatgctatctggttttcaagagcatttgcacgtatgcagactgaaagatttgatgttattattgaagtctcccccttttgttgacatgagaagtattatcgtctactgcaagtttcaggtatgttttttttttttaaaaaaaatcctaaagatgttccaaagaccacgcatctgtctatataccctaaatgtgtatgcactatatgaagatttgacccctttttaattattgcgaacaggcagaaactgacttcgtctctaagtacttgtgtgataacaacattactgccaaggttgacattaatctttagcttgatattaatttgctgcgccaactttaattacatattctattgttttatagagctaccatagtggacttctgattaagaacaggagccgtgtacaggagctattttgctctaacaaaataagagtggtatgtggtttcttctttagttctttggcatgaccttttctcgtcaaatgcattatgtaagacgtggtgtctaacatttgttttctccatccttgagcaaaggttgttgcaactgtggcatttggcatgggtcttgataagagtgatgtcgaaggggtatggatatacatacattatgatgctcaaactgtatgatagaattgcatttgctccttgtttttaagtgaacttcatttctacactatctcaaattttgtgtatctcataacgttaagcataactaaattatgttaatggtctgactcgagcattccacccttaaaggtgattcactatagcttgccagaaagcttagaagaatacatccaggaaactgggcgtgctggaagggatggacggttatcacactgtcatctacttcttgactcagcaacattctataagatccgtagtctttcacacaggtgaatctttttttcctaatcaacatgctctgcctgccacagttttcctataatttcaccgagcaaccttttcttggcagtgatggtgttgatggatatgcaatgagcaaatttctttaccagatattttcctctgagaacacaactgggtgcatttgttcattggctaaagagttgacctcacgcaagtttgatataaaagaagaggtttgcaccttcggaccttcctcttcaggccagcatgcacctagtttcttatgtcatgcactcatcctactacctacataggcctagtttgctcgcactatgttatactgaacgggtcaaatggatatcaatttttggggcacgtgtgtttgatggctatttgctgtgctctgtaagaatttgcaatgtcactaaattttatttcttagcttaaatgatgtcttagtggatgagctgtctagcattcaattgttcagaacatcatagagaaaattatcggtatgatgccccaagaagattccagtgtttagtttacggaagttgtttccacattctattaatctcttaatgttactcttccagtcaaaaccacattgccattccatgcaattggaatcagctataatgcatttaggttccaggaatactacaaggaatagcatttatagactttttctctgaagccgttagacagtttcttcccctaatattttacatggaatccacctttcccaccaatatcttcatgcacttctttataatactcttatcctaaagccttttagttcctgaatgaccgaaaatattaaatggtccagcaaatttttagattcaatgatcttatcttcttatttttctaacaatgcaggtgcttttgacaattctcacacagctggaaattggtgatcaacaatacatccgtttacttcctcagttcagtgttacctgcacactgtattttcacaaggtatgccacaggcttctccagtgatctggaccttttttgatttgcgtgtcaagatgctcagtgacgatcttcttgtctgtcatgtaacaatgagtgatcttaattgttcaccgcctagacacttaattaacatggcttgcctttacttaaaaaaaattcatggatttaccatgttcattgttattttgtcaagcaatattcatttttctttcatatcttgatcattggattaaattgatgcagacatcaccacaactgcttgctgacaaggatatactaattagatcggttttgaataggtaacacactatcaacttttgttccaaaattttttctgaatgtgctacacatttctaagatgtcgattctgaattcgtggagaaagcagatcagagatgaaggatggacattatgtctttgacataccaagaatagctaatgatctgaagatcactatgaatgaagtatttgatcacctacataaactaaaggtttgcccttctcttctaaattagctagaatgttaaacatatttgtttgggctgcatcatctgttgcaacttttttgaaagaaaggataggagctctgcctagtgtatgaactgagtagaaactcattcttgctagttgcttggagtcatgctattttaacctttagtttagcctatcattatctacttatttacttcatgttgcttacatatgttctggcaaactctaccattatcggtcttgcgctaatggttatcttagaatggttattgctgttattatccagattccagaagatatgatcacgtagtataggcttatagtctggttgtggtgactgttgaaccactgcccgtttttcttttctatgatcatctatattccttttaaaagactctagtgatgccaccaccgctgatgtatggggctatcaggctatgagaccagtatacacatgattgctatgctcactgtatatttgttgtttctaatggtttgcttctttttcaccttgattaaagtgaaaaactcacaaacatgttagttttatttgtagttttaaattggtcacactgcacgatttattattaatacgtgttttattgtcacgtgaaaatgcatttaagggtttatgtctcactttggaaaactacaatcctataagcatgtcccttttctttttgtttcataaagatgaagcattttgtttcaaccaaacagaaacaatttttttttcagaaaatggactcaatttttttatttctataatccgctgcaacgcacaggtatttagcaagtattgcaaatatgtatatgttgaagccttaaactttctttgttcctctgttatttagttttcaggagaaatatcatttgaattgaaagatcctgcttactgttatgtgatcttgtggaggccagatgacttcaatgctctttcagcaaatctcacaaaatggctttctgaagtagaaagctcaaaggtgcttcttaaattgcctctcttgaatattcattttgcttcatattgtaaattgccaatctttactacataagttctgttttcttttgtaaggatttaagttgtggtactaatacaagtttggtcttatgactactaaaaaagggtcttatttattttgagcaagaaagcggattcaatgaaattagagtaaaaatagaagttagatatactgattcatggaatctgctgttcaaacagatcagtaagttagatgctatgtttgctcttgcaaactttgctgtcaaagggtgtaaaaggacgggaggatgctctggttcccagcacactccgtgcattcagaagaagattatggagtacttcagcaaggacgatggcacctcagagaatgattgccgcactcagctgcagaagagcaggtttctgtactctttttctagatcgaacttaacagagcattacttgccatttgtttcttgtgatgttccaatctaaaatttatccgactgaagcatttcatcttactttttttgcagcccattcttgcaagccgatataaaggtaagcactgatgatgtgatacatttcccttgtgattctgtataatgcaataattccaattgtatctccaccatacttctaggtgttcattcaaagcaactcattcgcaaagttcaccccgagggctgttgcgaggattatgcacggcatctcgagccctgcttttccatctgtcacttggtccaaaaatcacttctggtctgcctctctggctgccttttctcattattttcctctgtcacctatttacctgaacctgaatctttgctgacaggggacgttatgtggaggttgattttccactggtcatggaagcagccaaagctgaactggttaaacttgtcggaaaaggggaacagtgctagcagttggcgatcaagaacagttcttgcccccagctacctgtacatacatactcgtatgcttgcaagccaccgcggccacccaatcagataggcatctaaaggaggtctgcgcccactggccactgccctgattgtttcctttacttaaaactactctgattgtcttgtcgtacgcttgacactgactgcaatttgtccttcaccttgtatatatataggcacgtaaagaaggcgttgcagtgagcatcctcctgcagaggaaacttctgctaggtatgcgtgtgtctaccccaggaacgctttcccgtcgagctggctaagaggcttttctgccatatgattgaggggtgccagctcagtaattctgcttgggtgaagagaatgatgccgctcgcacgactggagtatatcggaagcaagagtcagaagcagaacccattcttcttgtacagacaacactgctccatatctaattatcgttctccttttcctttccaaatgagaatcaactcttcgacgggcgggtaaagtgtgaagtgtcacagtaaagcaccggaaacctggttgccactgcagtatctcctctcttcaccatgggccatccttgcgtagacccaattctgttacgtttccactgcaaaaaatctccccaagtcccaggtggccaggtacatatctatttccccgccctcctattctcatttgcttactcccttcgacccaaagttaacatgacacatgatgtatggtgtgatatattttaatactacgaatacgaatttaaatattatgtgttatatcttgtactagattaatttatttcggatcgaaagggtattataccctgaggtggatgcgtgctagtgtaccgtagcatttgccatggggcgccccatgtgctttccttctgtctcttggcccattcttgcgcggcttcacttcacgtggagcgagagcgagccattcttcacggggcatgcggcttcacgaaaccagattcatttgacgtgcgtgcggtgattgctcgtcgcttcgctggatctgagtgacaaagggtcctgcacttgattgcgtattttcaatcagtatagctggtgtatgtacgcctgtacgggggcggctgtagccggggacaccgtgtctaacctaatctatgtgcgacgaaggagaaccgtgggctgctcaagacgatgtttgtgaggttgcatcaaaagatgttacccgcacggttgccgcagtttaccaggctgacacgacacggcaaatgtatttttagcgttaagccatgtgttagcaggtttaatgttgggattaaaaccgctgaaaacgaaggtggttgttgccttcagaattagattagaaagatgctccacatcaatttactaaagtacagcgacgtgtaaggggagcgaagaggcatattcggcggctccaacctggcgacccgaagcatattcagcctcctgcccaacaaggcatttagcaccgaagtcctacgtgccaacgtgcagggaaggtcctcgtgctgtgcacagtgcacattgtttttttgccgttgaagattatacagtacattctttttgcaacacgtacatattatgctatgtagcccctttggaacacataacttcattaagaaaaagaaataattatctttcagggtacaatacactaccatatttaagataactcgagattttaagaatcaattatctttcagtgtacaatacactaccatgtttaagataagttctacttgagttatgtaatgaatcacaatgccttcatttaaaaaagaaacaattatctttcagtgtacaataccatatttaagattactcgagattttaagaaacaatcgataggctgagtagtcaactggcgataatatgaaaaaaactaggtcttctagcttcgggtttattttttctaaattttataattatttttagctataaatttaaataaaagtgagggattatatctataatctttagaggaactaaagattactcaatagaagaaatcgtatttaccataagctcttaaattagaagcattattgtttagagtactcagaggtgcatgggtcttaaaataacagctgcgcctacaatttaatacacaacactacataccttcgttacagagaatattcgctcctaaattatgaaaacttggaggcgagaaaagaagaagagaaaaaagaaaacgagcaagcaaagaagaacctaggaaaagagctcgcaaacaaagaccgaaccgttccaaaaaggaaaaaaaaatcaataaaccccagaagaagcctctcctcctctcgactcctctcctcgccgctctcgttgcttcctcgcggggagttggaaccccctcccctctccctctccctctcgctgactcgctcttcgaggagaaggcgaaggctcccgcgccgcggagtcggagatggccgccgccgccgccgtggtgaactacccgctcgtcgcggcgctcgtggcgttcgcgctcgcgcagtcctccaaattcttcaccacctggtgagtcgagttgccctacctctccctctgcgcccccgctcggcggccgctcccctccacgcgctgcgtttgtgggtgacggtttggctccatgacagtggccgttctcgatcgctggagacgtgtggttcggtgtttttgcattgcgtaatcggtgggaatcgtgggggcgaggtctcgttggcttcgatgttgcgtttcgtggtttgcgcgttggtagaaacaaggagctgacttggagaattgagatttgaggcctacgaggagctgaggcgtcctagatttgttttttttttttggttcgctggcatggtttggattgtagctagcccgtagatcctcacggaggttagagagatccttttcctatttctgtattttgcttggctttgacagtgtgatctgcagcaactgcttctgtagggggtagaactgcttttcttgggatacttttgtctagaagagacaaacaggatttctaaatccagcgtgatgtgagagttggacggctactgtagtgcgcttgcacgatttcgtttacatttttggtacgttttgtcgtgaactactggttgagagcattacttgagaggcactaataacagggtgttttgctacttagtgccttattactatagcctgagggcattttagtgccctgtgaaatttttactgggcaatttgatatatttttctgactcacgttggttctactttatagtacttttaggcaagagttgtgcagattgcttgcaaataatgagtgtagtaaaattattaattaaagtaagcttggtcttccttgatatttctggaagatttaagacaatagttggtatctgttatgggcgtatcagacatgaaatagtcgtaattgttgtatttaagtatcaagtgtctcacatttttgtgttgcacagtataatatgctttgttgtgcaggttatttttgaaatcactaggacaatagttggtatctgtattctgttatgggtttatcagacataaaataggcactattgtagtatttaagtatcaagtgtgtcacatttttgtgctgcacagtacaatatgctttgttgtacaggttattttttaaatcaccaaaaatcactaggtgatttcaaaaataaatacacattgaattggcatcaggacaggatcttttgttttcaaactggaaaacatctatctttctaatttcattaagtaaggaaaggaaaaaaatgttatacaaaattagtagataaaggactagaccaggaacagtatatacaaggactacatatggccctcgtgaaagcttgccagctagaaatttagataatacttcatgtatagtctgtcaggaattcgatcactcctgttgtcttgttctgatctaatgtgtatgaggtgttttgccttttctctaattgtattgctatcttcaatctgaatgtgaaaggggggcgatgaaaatcttgaacaccagtaatctatatatatgaataacaaattttcccaaaaaaaaaaacaatatactttctgcaatttaacctgtcagaaaatcataggtggcgccggaaataattccctattgtgctaatgtttatcaattacctattgtactaatgttttattgttttattgaaaaccctaaataactattctatcattgattaactgatttgatgcaggtttaaagagaagcgttgggatgccaggcaacttatagcttctggggggatgccatcatcccactcagccacagtgacagcgcttgcagtggccataggaatccaagaaggctatcgtagcgccacctttgcaacttcagtaattattgcatgtgtggtgagtagatgttcttgattcttatttgtatctttaggtcttagctgcttctgtaacttctgttgcatgagtatgatactatagaggaaaatatgagagaattttgcattcatttcattggttccacacaaacagatgcccttctgcatatatgaaatactttgctcagtgttagttagataagacatttatgttttttttcccactaactagttctatcatctcatttttgccatttgatatggtctaagcctacatgtaaatgagtgagtttagtgtcatggatggaattacaaatgaaaaattaaatctcatatacaacactgatctatatttgtgtttgctcttgtacaatgcaaagcttctgtttcaagtgcatcttcatgacaatatccattgcctctgcctcgttgaacagtactacctagttgggaaatacaactatcttgtttgatctaaatgcttatgtctatattatttgattttctttttttctttaacttgtgtttgtaggtgatgcatgatgcttttggagttcgcttacatgctgggaagcaggcagaggtttgtctttctcatcctgaaaggtttcagccttctgtttgaacaggatataatagaatgaaagggttttccatggcagcttctgattgtatcttcatggactaataaacagaattcgattatctatagctggcatttaaatttttgacatgcagtgttgtttgttgggctaatatgtcagctttaatattcttgtccttcaacttctgtttcttgggctcataaaatttgatatccttattggttcaacacttttggcctgaattcatggacctatccacttttatgccagcaagaaaatttagataatggcaactgtatgtttaacttctgcttggcctgaactctttaccttttcacttttatgtggagaataaatttagacaatgccaactgtatgttgtagtttgaactttgaagtgacatttccttgtgagaaaacgttcttgttcttctggtcactccgccatcagttaatgttgaattgtagatttggatggtccagtaaatatgtgctatctgatatgctctattttattttaaatgactaaagtcagagcatactaatattgttgatgcaaatctttcaggtattgaatcaaattgtgtacgagctaccagaagagcatccattatcagagacaaagccattgcgtgaaattcttggacacacagttcctcaggttagcttagtttgcatgattctgtcgaattttagctatttctgtggccttgtaaatactgatattcaaagcagaaagaaccgtaggaagattctctaagcataaaggcagatactagatacaccttgtagcaccctaatataatgcaactgtcgaaagttcatgggtatgatacaaacacaatatcgttaacaaacacttaaaacttctctgaagaaataaacagtaggttaagtcataggacatcttacagatacattatctactctgttttttttttggggggggtggggggtgcgaatatgcagttctcattgtttcaagaagaggaggttttgcatgtgcctcagcatttttacactcttctactaccatgctcacatcggctattgggcatttcttatgcttgtcagaatcatcaccagatatacattatatgctcgtaatctaaatgtaatttcgttctcttttttatgtcaggttgtggccggttgcatcattggaatccttatagctgttgttatgcgcttagctctatggagttcttagacacgcattactcgtaggtatttgcttgatcacctcatatcgcatcgctgatgagttgtgaagcatgaaaactcaaatctcctcttggatgtgatttgtacaaatgctcagttttatgactatactataaggttcctaaccggtgtaggtctgcgttgtaggaggtagattgtagttcagttggtgctgtacatcgtagaaatttactgtgaattggaagctcatgtgatcaacctttgttatacaactggcaatgatcatgctgtcaacttttctttctggcacgcagtgatattttaagttctgcatcactgtccttagtttattattttactgtgctgtgcttgttagacctagaatgttactaccatacaaatgtcccaaaatttggtcctgggcagtactcagtagtgtgtgtgcctatgctgttttactgtcattcatagttcagactaatctgttttcctctgaatcctgaaatgcaagaactttttgttatttcctctcggtgaacctgatatatttgatatttcagaatttctagtgcaaacaaacaggaattgttctctgtttctctcttacacagatcacagatcaaacaaaaatattttcttaataagtatgagcaaagtactcggagaagttacacggagagaattattaccaccttgtatatatatgtaagtattctaagagtaaagtttgaagcctcgtccttattatatgtagctacaacgatgaggtatacatgtgctcaggctctcagagcttgcacggcgacgatgctccggggtggtgcaccacgatgaggttgtacgcgtcgagcgtgaggaagtcgtccagctccggcgcggtgcactgccggctgaagatcctgccggcctccgcgtaccggccgcgccggaacctctcggcgcccacctcggcctccaccctcgccatctccacctccacgacgcgcgccagcagctcgggcgtggcccggacctccacgccgccggcgtccagcaccgcgccgtgccggagccactgccagttctgcacccggctgatctccgcggtggcggcgtcctccatcaggttgtacagcggcacggagcccgacccggatagccacgccgcgacgtactgcacgccgacgcgcgtgttgtggcgcaggccctccaccgtgcgcgccccgcgcggcggctggagcaggtcctcctccgtgacggcgacgccggcacgggcggcgtcgccagccgccgcgtcgatctggttcggcctccctccgaggtgtccctcgaacacctcccggatcgccgggatgagccccgggtgcgccgcccacgtcccgtcgtgcccggcgcgcacctcccgcagcttgtccttgcgcaccagctccagcgccgcctcgttcgccgccgcgtcgtccttgatcgggatctgcgccgcctgcaccacatcagcaaccgtttggttaatcaactagctcgaggagctctccaacgggcgagtggatcgatcttttttcgatgactgaccatgccgcccatggcgtggacgccgcggcggtggcaggtctggatgaggaggtgggagtaggagcgcatgaagtgctgggccatgccgacgagggcgcggtcggggaggaggcggtcggggcgggcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccccctccctatccccgcctccttctccgccctctcgaacacccccttccatatcctcgcctccctgcattaaaaaaaaaagttacatacatcgatcagttcaacccaaaaacgtatgttggtgataaaaatcaggtaattcactccatattctaagcactctccctcacgcaaggttccttaagtatcaaacgtggaatgaaagcggggctatttttttttattaattgcgtaccagccagaatttgaacttagatatgcccatgtcttgatcatcacaagctttgtgccagtgcgccatggatggatgtgtttgtgcgtgcttacctagagtgctccatcttggggaggtagaagaaggggccgaagtcggcgccctggccggagcggaaggcggcgtggctgtggaagaagtagaggccgaagtcgacgaggcagccgatggccggctcgccgtcgacgaggacgtgcgcctcggggaggtgccagccgcgcggcctcacgaagagcgtcgcggggcggtcgccgagcctgtactcccgccctcgcgccgcgtcgcggtaggtgatcgtgccggcaaccgcgtcgcgcaggttcacctgcccgcgcatcaggttctcccacgtcggcgacagcgcgtcctcgaagtcagccttgcacccacaataaccacgacgtcacgctcacgccacgtcaagatcctcaccgatggcgcgccggagttgtgtgctgcttaccatgaagaccttggcgccggagtggaaggcgttgatgaccatcttgcgcggctcggcggggccggtgatctcgacggtgcggtcggcgatggccggcggcacgggggcgcacgcccagccgcctgcctcgcggacgggcctcgtggccgggtcgaaccgggggagctcgccggcgtcgtaccgccgctgcgcctcccgcctgcgctccatggcgtaccggacggcgccgcggaactcgcgctgcaggccggccacgaaggccagcgagtcgcgggtgaggatggccgcgaactccgggtcgtaccggccgaggatgtccacgccctccggcgtgtcgtagcacgggcacggcggcgctgcggcgttggtggccatggagtcagtcgagtggaattcgttcgagcaccgatcccaagtgtgagtagaaaatgggagtgtgcagagagcgtgcttccttccgttgtataactccaaatatatacgcgagaggtagtgtaaaatttgaagactatcgtctttgatgatgtggcaaggatgaaattttgtcatttttctccaaagagatcaagattgcactagtttgtaatgctgaagcggactctggaaattatcatgatgctaggttttgcagagccactacaatttgaaaaataagtgtcatatgcacaacaacaaacatagcaaccataatccatgcataaactgccttatatagcaatgcagtctaattgtaaaaagaaggaaccacagttcaaagtacttaatttgtaggtgtggccgaccgttgattgctggggattttgttttacttaccagttaccaacctacatagatgtcaaaagctcctggcttattttcagagagtaaccatacacagttcgtttcttttgtgagagaggaatttatggatggactaatgaagaggtgctccaggtttctaatacaaagttaagtaattaagccctttcagaaaatctgagtactgaagcctcaccaaaatgactaattaaggccaagtttcgttgtctatgcgcaaagcagctagctggtgttgtacaagccaattcaagctgaattaatcgcgcatacatccaaattcatcacccaattaagttctgtagtttgcagtttctgagctaacataaccgtgtttgttcactggcgatggtcgtgttaagcgcgggaagctcactgtgtcccatcagctaaaactgtatatatgttattccaaataaattgcattagcttgtctaacaaatgacactcaactcacgccactaacctttgctgctttgcccggcgtgtgtttatataaggcgttggatgagatggatgacgatgcggcatgcatcagcgtgcatatggagacggatcagtagacgtggtggttacgataaggcagacggggagcaagtgcggtgcgcatcaatcagctcgatcgcgtgcgtgcatgggcacttacgtacagcacaggccagcagcaggaggaggtaataagcgtggcttgtttcgttggcgcaccgagagaggcgagtggctccaaaccgcagcctttggctgcttgtgcggtttctctccttatccgcatgaactgcccaatttggcccatttggggaagggagagccgtgccgtcacgcccccaacctccattcgccgccgccggcagccgactatacggccagcctagatgaaaaatctcttcgggcctttccgaacaaattaacctcacggcagcggatcgctgcgggttgcgcaggtacactgggctctcgcgttttgcacgcaacgcaggcgttggacgggttcgatcggccggcggcgaaacgtggcggttggagaacaggagaagcagaaattaagcgtctttcacgatggcgttcttgtgaggtttttcttgtttcgttcctcttatcgtcaggtgagcgccgaggaggcaggtggtgtggccggctgcaaaagaagcggattccgcgcgtgctggcacgggtctcgtgcggcacggccgcacggtgattcgtggcgccgtgtgtgcccgtgaggttcgattctatatcggggggcgaattagactgtcgtaggagcaagagcaagtttgatagtatagtcaactattaactccaaatcatctataatcaatttaatagctaattcatacaatagttatatactacactattaatatctagtctcacatatcatacacactatgtcttgaagtccatgttatagccggttataaatctgtagtccactgctcttctcttatttttttatctttttaaaatatgtttatagttggtttatagcttgctactgtacctgctctaagagcaaggataataataaaaccaattgcttacttatagcctatctatcagctcactcatacagtgcttaactcttcactataaatatatggtccacctatctgtctcacagatatttttatttatatacctaagccgactgtaaacttacagcccgcttctcatctctctcctttcctgtctcattcatctcagctgtctgttatacttgctctaacgtgagtgcgtgacggcggtgttgatgggcgatagaggcgtggcccgcactgtggttggccattcggcctactcagcctcggccttggcggcctggcttgaccaggagccgcagcccgcagccctcgcggggctctcggccggttcgccagaaggctgggcgggtacgctatgccgatgggctgtttttcacttgtttcgccgggcctttccggggacaatgtccgcatgtgtgcgtcgtgccctttctcagccagaggctaatatacttttcctccgcagccactctcaaacatgttaaaaagtagtactgtgtcattttattatgccccattaatacggctccagatttcagatttagagtttgtatgttaaaatgtatgttaatatgcccgtgctaacactacgatgacgatatatgataatacagatcatacaatttaaaatgcatcacacgtgttctttaatcttcatacaaaatttaaagaatggcataaaataaataccgtttcttgttttccttcacaatactgaagttttaatcctaaaaagtatgataatttacagagaaatttgagcactcgatacaaaactcactttatgagcttctctcatcctaggtggcttgttgccatgtggtaaagaaaaatcctgcctagcttcaaaatagaattgctccacctcctacttccctgatttgctcatgtagtgaagcaaatgacatgcgatttaacgggaaaaaaacactaatattttaacactgcttgtgacatagctagaatgagtatctctgaacaaatatattttttaaggaaattcgagttcaataattaggtatagctatcagtcaaagagcatcctcagtagctcaagcagtaactacttaatttactgattcagtttgaaggagccgaacaatctactacagactctggtgcattagggcctgtttggcgtagagctggagctcagccaaacagtttcagctccactaaaactgggagtggagttgggtggagctctctcacaaaatgaactggagttgtggagctggnnnnaggcngntncacaactccactccagacccaacttctgggttaaatttaggagttggagctataacaaacaggcccttaatcacgaaaaaatgtggatcagcaacaattatcgaagcaagaattactgaatcatgagtactaaataaaaatgataagcaccaaacctagatcggcatgagtaccaaatggaaattgataatcataagtactatcgcgacattgaaggtgaaatacagttccatgaccaaaatgaactattctagtctaatgatgtctcgccagagctcattctgtcaactattgccaaacaaataatgtgcatataaagtcacacaaataccaggttattgtgtatgctagactaatgagaagtaatttaaatgagaggcaccttagcacttagcagctagacatttatttctccatatatatttctacaatcatatattgacatataccacttgtataggaagcagaaaagactaacaaatttgtacctgcgttcacatgatacaatcattctctgtgataccaagaactacactgataacaaatttggttcttacatcatttggctttttctaattgtagaagccattaactcagaaggttcaacctccatttttctattcttcatcgcattagcaatcttaaaaatcatgaaatatgcatgtacacccgttggttactttcaaataccaggattcaaagtcatggcaggatttacatccatatctatactacaaatgcatcaagatacatggtgtaaaggtcatagaaataagtgattgtcctgccaaaaaaggtgtatttggttgagattggctttgttagaaatgaaaagacaaataagataggcaagatgatcttaattttagctgctagaattaaggccatgtaataacaaataggagaatttcaaaaaattaaatgattttcctattcaatctaatagtgttttgactttgtgattccttcatatggaagggcagccaatttgtaacaaaggcggaaactgggactatcagatcgtaaaaaatttctaaacaaatgcataatctcggaagtgaagcctaacctattttccttaacagctgaacacatttagaacaaagtcagaagctgagacacctgaacaggacaatttgttaagctatttctaaaatctagatctcatgttagtccatctaaatgttgtgcctatttacattctgagctttaaacttattatacatattttgaaatatataccatatgctgaatctgaataacacaatttgctttctataggtattcataaaaaaaatgcagcaatcctgtataacgtattaacgtatacccaaacaagatgatcttggttatatctactggaaattatgcttggaattgattcagtaaaatgaacttggccaacaagcagaaaaacaacagccgtgcagcagtcttagatctatgtacaccgaataccttgttttatctcaaagggaatatccgcgacagacgttaatatgttcatggcaaatcacaatcgaaaataattaagtgatgacatatgcatttcagcatatggcatcactttattattatgcatttcacactaaaaattatcaaaaatccagtgttaattaagtgatgccaacaacaaagaagattgaaataaaagtgcttgtgatagcacctcgcaacataataatcacgtagagtggatagcaagcacaaaaacaaaatagtgcagaggagcacaaaaaggagcaagaaatagtgcagaagaggataactggcattaccttaaatgcagaggatgttgagcagtagtgacctggagcagatatgctacaagaaaatgtaagctgttaaaacaataatattcagttagaaaccaaactatttgtttccattgaagattgtttaacagagtaaaaaaaaatccatgtgagagactacactaaaccgaccactgcagccggcagctgtataccgagccaaccaaatgaaatcaaatcagaaccttggagctgcattagtttgactacaaataagcgtgagaccctggggtgcagcggcgattgaacctgagatctacttctctctttttttctgcaatgtgcccctgtgccggcatgaagtatgaacacatgtgccgtcgttcacctatacagctccagcaatcatgtgccatcgtttttattgatggaagagtagaaaaaaaatctaataccatgggagattgatttattgcaaggagcagggtaatctgtgaccagctgaatttccagccactataggagcatctccaaacctccaattctgatattttggctatgattataggtctcgagcaagcaaactgatgttgcaatgattttagcttcaataggaaaaaaatgggtacaaatcagctgcatgctaaagatgccatcaataacaaagtaacttaacgggatttacaaaatgatcagagagccatgatctgactctatccctcccaaggttgcgctcctacagaacaaaaacgagacaataagcaagtttcaccagcaaaatgcgtgaaacaaatagtaactcattgcacagatttcagttggcaactaaacatcgaagtttgtgggataaaattttggggagaacttactgctagcatatgggaatttgcctgcgcaatctgccagttagcgagccgcagcttctggcccatttccgctcaactctatgattttgctgcatgcaccaaaacaaagcaaaaatagagtcaaaccaagagcacatagcatcaaaatccccagccactcaaagcctcaacagaagggatgaactgatgcaaggaatcatgtggtttcagggacgtactccctctcctcaaggagccccagaggttccgagttctcctggaattgacacaaaatttagaaaaaatatcaccgttaaattagtagcaatctcatgaggagatcgagattaacagagagagatgggatcttgccttaccagctgcacaattccctccttgcccgcatccgctgcacacaccggtccgtcatggtccatgggtgtacctcctcattacagccccgcccttggatatcgagctcacgccattcgcggccatcctccccggtgcagcagcggcggccgcctccgcctccaccgctggcagtgccaggatggcgatctggtgggggagcaaagacgacagcctccatggtggctcgtctcaatggaggaggtgcagtggcatccataacgcgaggcggagatcggggatccgcagtgccggggcggggtagggtttggggatttggagtggcggcacgacggcagcggcggggtaggatttagggattgggtgtggcggcgattggcgagtggcaagaatcgcggaggcgatgggtgaagggaacgggcgaaaatagcggtgcgagagagaagggggcgcgtgagaacgggagttacgctgtcacaccattaagatctttcccaaacctaaattgaatttataatccatcagagaaaatatcggtgtaagagcaaaataaaaccctaataaattaatgtaaataataatcggatttgttatgtggaatttttattgagttctacatgtagaaattcgctaacaagatttttagtggaattctcagagctctagaaataattttaaccaattaaaattgagcacaagcaatatttaatcctagaaaaatccatttccttctttttcccttttttttcttttctctttttctttcaattgggccgccggcccattctctcttccccccccccctctttccgctgggccggccgacaggccgaggcccagccgagccggccgcctcccttctctcccccggggtcaccgacaggtggggcccacctgtcgggcctgtccccttcctccagccggcgccgccgcgctccgcaaccgccgccgcgcccacgttcccgcctcctccgggccacgtcggccacgcccgcgcatgcgccggtctcccgcacccactccccctccctttggcccgcggcgcgttggagacggccgggattcgaaatttgaatcccgcctctttttcctcctccacctccccaaaatgggcggggaattccgcctttaccgggcaaggtcggggttccccttctctatttaagcaccaccgccaccccctctctctttttccccatctcgccgagccctcccgagcccgataaggccctanagccgtttccctccccttcgccgccgttagccggcgagcctacgacgccgcgcgttcgccatcgtgcgggccaccgcgtccacccctcttccgttgccgcggaacccactccgcgccgttcgccggtgagcaccgccatggccgccgccttcggcggcgtcctcgccctcttccaattccctctgcctctctaaccccttccaccgtgttcgctacggggttccagagatcgtcccgctgtctccgccgccctccgtagatagccgtcgtctggcgtcgtcggtgaggtccctcctccccttcctctatgtctcccgcgccaggcgcttatacgcttcgccgcccgtcgttccgcgacaacgttggcctccgccgccggccggtcgccgtctcgcgccgccgcgcgccatgggcgccgggccggcttgagccgtgcccgcgcacgccggcgcgagccacacccgccgtccgatctacccaggtagatcggggccgtccgttcggccgcccacgtggctgccgcgtggccgctgcgtcggcgccacgtcagcgccacgtggtgcgccgtcctttcccggtccgtggactcggtccaccgcggaccgccctcctcgagtcactgccatgtggggcccgcatgtcggcgccgccccatctctctcccgggatttatttattgcgcaataattcaattaaggatttttctgtttatagtaaaaacacagtgaatcttctaaaattcatatctaattcacccgagctccatttaagcccattcaagtatcagtaaatcaagaaaaatgtgtagaatccattgaaaatggttttgttctctgtttcagtagtattatagcctatttgtattgtttgctttgtatgtcgcttagattttggctctcccgacgctccggtgtaccttaaaatagtcgccgaagttcctccagctgcagagcaaggcaagtcatgcttgccacttgaacatgttgatcctatattgcaaatgctccattgtttttcttcaaatactgcattgttttataatatcaccatgggatgtttacctactgtcatagccatactatcttgtaccatgttcctttgttagcttgggatataacatgactagagattggactagggaatgcttagctttgcttagttcaactagcacacaatggggaactacattaaatgcatagatatcagattctaggattgatgttggttaatgctcaccactccggtgttggttaattaattaatattaaatggtgggccgtgggtgcatggttttgatggtcgcgcacagggcaattaaggaccggttcgcgggaaaccctggaagaattcctcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcatgagaggggactgcccgctgccttgcgaggagtgggggtgaaacctgaggtgtggtgtacttggttagagggggttatgcgaagggtcctgtcacggcctctttccggtatgtcgtggtggcatgtcggcgcgcggaaacgtgtcgtggggctgtgtcttgtgggtatagttgtacacctctgatcagagtaaaactattcgaatagccgtgcccgcggttatgggcggtcaaccaaattcaccgtgattagactcaccctagactagtctaatggaattgaatagtataggtggatggttgggcctgttgcaacggggtatagcgttggacagtggatgattaatattgattaattattacaactgttttactgctttcaacttctgtttataaatgcccgctttatgcaaatgaaccattatagctatcccttgataattccctgcatcatacccctattccggtatgacttgctgagtacagtgggtagtactcagtcttgctctattttccccaaaccccagaatttgagtatgcgtcagatggtggtttctctgaggagtaggcttcgtccgtgccgtcgaggatgcctgtggagtggtgttcccgctgcagtccaagtcaaggcttagctccagttatcctttaagttttccgctgcatttatgtaagacttttataatatttgtaagacgtggatctgtatgtcaactttgtcgtttgtgtaccccggccggtcctggacggggactttaatgcacattctgcttggaattctattcgggaatttctgggcgtgacaagcgcggagggaagggggtctcatctggcacgttcgattagagttagatgaatatgagccattggatttgatgaatgagtaatgtaggtgtaagagtgagttagtgaattatagggtagaagatagatgggaacttattaattcatccaattgttgtaacataatcgcaaatcaaaatctatatatttatggagctagaaaacctatctccatgcaatctttagtccaaaaatgtgctaaacaggatccaaatatatggcatagttgccttctttttatcagacttagataaacaatatctatttaattacaaagtaaagtgaaaggagtatctctaagttgtcatcgaaccttatttgcacaaatattactagagaatataaatagtcaaacaaaatttaaaattcaacttcgttatatgtttagaaatagtaatagcatattagaaataaggatttgtagaatatttaaagattgatacgcttatatttttatcgtatccttcattacatctttatccttaagaagcatcagaacgtcacaattttataaccagtgatatagtgtcgggatacaaaaggaaggtgagaggctaagaataaaacgagaagctcatctacatcaattgtatgaagtagtatgagatagaggagtggcaacaaggacgatattgtgcatcttacgcaagatttaaagtgcaacccgaaagaaaatcgaggttagtgaatggacctactagcgatggtgatgatctattgatggtgttgtttggggtttgttggtggctatattttagggcatattacacgcttgcttgaaagtgaagaagcatggccagcttcacatattgaccgcacatacaagtctaaggcaaaagacaactatattccgcgctctaccttgtttttctagggctcaaaccgtaaacacaagttgctatgggtttagggaaaccactccagttttcatcctaatcgacatctttaacacaaatgagaacttgatcgattcctcgtattgttcaactcacaatcatacaacatgagagagtgtgaaagtcatttggaatagatatatgggatgttgagaaagacagtataaaaatgatgtaataggtataatcatcatttttatcatgatttgccgacattctaagataccaaacaatcagcctcatcggatgagcatatgaaaaaaaaaaacgccaactgacgtattagccaaaaaaaatatataatttgtgattagaacttttacaatttcgtggcagggggaggatggtaaggccccgtttagttccccaaaattttttccccaaaaacatcacatcgaatctttagatgcatgcatgaatcattaaatatatataaatgaaaaaactaattgcacagttagggagaaaatcgcgagatgaatcttttgagcctatttagtccatgattagctataagtgctacagtaacccacatgtgctagtaacggattaattaggctcaaaagattcgtctcgcggtttccaggcgagttatgaaattattttttttattcgtgtccgaaaagcccttccgatatccggtcaaacatccgatgtgacatccaaaatttttttttcacgataaatgaaaaaaaaaaaggccatactgcccggctccaattatccatgaccgtctcgttctcctttcctcactccgatgcacctgccctcgccgactcgccgttaaatgccaccgacacactccactcctcgctgccgccgccgccgcatctgaccacccggcgatggcgagaccggcggcgacggcggcggcgccgaaggcgccccctccgaagcacctgattgcgctcgccgtcgtcgccatcctcggcctcgtccttgtcgccgacttcctctgggcctcctcctcccccgccgcccccgcctggtcctccaggatcgatctccccggccgcccggccgccctcgtgccaccctcggggaagaaggtgatgctcctagttcccatctcgcagcgcgcacacacactcttcgattgctgcctccggtgccttctagtgttctgtgtggtagtacggagtcgcgcgcgattagtgagatctggttggaattaggtatgcctctgtggtttggttggactagtagaacacatctgggttgattggtatcttcccctcgacaccaaatgccttgctctctagttgcacttatgagctatagtttaggcatcacctttgatagtactagcaggttgattgcttcctgaagggtcttgatgtgccggttgtgaaatttgcaacagtatttttgcttcttaggagaggaagaaattaatcatgcattcatgcctgcaacttctggttgagatttcagagtgaagagctgtttgcgaacagtaatctttaggagaacccgcaaaatctatactcatgctaatgtttatgaactgtaatctctgtgtttttgaattaacataggcatggaagcagcaaacacatgctaaatcatgtccgtttcaccatttgtttgagctagaagcagcaaaaagccatctgattttcattccgatcccatgccggattaaattaagactacttattttgctgtaactgccagtttttgtttatctaggcatatacagtcctaccatctaatctaatatcttggtcctacacatcagagtaaacacttaattatgtttgatatcttatttctgtgtatactgcatgaatttggcaagtgttgtaaaaaatgtaaaaactcatgtatctcacttcgatatttcttccccttcccattagttttattatataatgacttatgctatgaggactgttggcgtgatctataattttgtatggcattttcaagttgacttgttttttaagtagtcgtttttttttaattttcttgtgcagcaaacaaaggaaaaaatatctataggttccacggacataaatgcaacctttgcagatttgccagcaccagaactacaatgggaggagatggctgaagcacctgtgccacgtttggatggtgctgctatgcaaattaagaatctcttatatgtgtttgctggatatggtaccattaaccatgtgaggaagcttccctgttatctctcgcatccagtcatactttgtgctctttttcttgtatttataaaatctcttgctgaagaacaacatatagcatgcaacatatttaattggtgagttggggttacagcaacacattatacttgttccctttcagcaatcaatgacctagatgtgtaattggacttatcgttttggatcactcaagttggctacctgcaccattgtttttaatgaaatataaattcacataatattgtcaagttgtatagatgacctgtgttccctagcttgtttaaacatgatcttccttactaaaacacaattgaaaggtacttgtgcttttggttagcgtgatcccattataatcatttttggctgaaagtttaatattaatggtgtgtgtatatatggcttagtattgccagattgtgaattaacccagtaattccttgccctgctgattttgttggtacttttaagtttaccataagttaattcaagatgccatcaagttatttaaccttttctaatgttttccatgtataggtgcattctcatgtggatatttacaatttctcagataatacatggggtgggaggtttgatatgccaaaggaaatggctcattcacatttggggatggttacagatggaagatatgtttatgtggtaacaggacagtatggtccgcaatgtagggggcccacagcacgaaattttgtgctggacactgaaacaaaagaatggcacgatttgcctccattgccagttcctaggtacaaacagtgttgtatttaggcattattgtacttgtatggtcatgcactcccgttaatcttaatactacttttgaagtttggatatttggtctgttgtatgctgtcaaggaaaaacaaatattgttttgagcccttatttgtttctttctttatcccaaatctattgttcagatatgctccagccacacaactttggagaggcaggcttcatgtgatgggtggcagcaaggaggataggcatgaacctgggcttgaacattggagcattgcagtaaaggatgggaaagccctggaaaacgagtggaggagtgaggtaccaatcccacgtggaggccctcataggtctataactccccctccacatgatttctattgttgccatttttgttggaaagtaatgttgctatacacctgaatggtcttgatgtttagcatctgttgtattcagatttttatgatgccgcccacaatatgtatgcttctaggctatttctttgatcaagtatctaaattaaaattagttctgggccagaaatatgtttgtacgccatacaaagttcttatgtggcatataagtatataacctgtttccgagaatggtcctgttgttagcttagcagcttaatcatgatttttctcttttgataccagggcttgtgttgttgctaatgataagctacttgttattggtggccaagaaggagattttatggcgaaacctggatcacctatatttaaatgtgttagaagaagtgaggtatgctgatctgtagctcaatcactatatatgctaatttctgcatattgtataggaatttgttttgtacattttgaagttcgacatggatcacttttgacaatgaatagtggaaagtctggttccactgaaggcacaaaatgtataatgtgttacccagtagatggtgatttaacttttgagctgtccgcttaacctgttttagcactttgtgaaattttacacctcctagagacctatgttcattgttttcttgtaataacttttagattttgttctatagtcattttgatcttctgcctatgcaggtggtctacagcaatgtctacatgcttgatgatggaatgaagtggaaagaatttccacctatgccaaagccagattcacatatagagtttgcttgggtgaatgttaacaattctctcattattgctggaggaaccacagaaaagcacccaataaccaaaaaaatggttttagttggtgaagtgtttcggttcaacttgaacacactggtacatgcctttccttgctccatattttagataaaacacttaaagtgataagaaatgatggatataacatgaaacatcacctatcaactgcctgttgtttgtttgtcgtgtggtggtttagatacttcttgttttgcatcattcttctgtttataagcacataaacccagtacaactcatcatcataaaatctatccacagaacaatatgaagccaagaaaaaatgtaaatcagtaaatggcaaacactacgaaaggaaactttggaaagtgcactgcatgtcagtaatttcctcagcttgtcaactttgtattgctactaaaactattttggcatacaggaatggactgtgattgggcggttacctttccgaatcaagaccactctggtaggatactgggatggctggctgtatttcacttctgggcaacgagacaaaggaccgaaagacccttctcctaagaaggttgtcggatgcatgtggagaactaagttgcacctgtgagatttttagaaggaaaactgatatgaccattgactaagcccattctttatgcattcttttgggtacataactgttccattcccctatggtgggcgagttgtttattatcatacgaattgttggctttgttgtgcattgtcacatcatgccactaatctgttgtatgcttacctttttggttatatcatagaatgaccgacttttacgcaattttgtacagagaatcagagataattgatcttctgttcagtgattggagtgtgacagatacatttgcacttgagttactctaggttagcaatactggtatccagtgggtaagcattcttactgttacttataaactgcttacatagttcaacataaataaccaccatcaggagactctgcagtaacttctcaactggatttgagcccatattcagtatcctaaaaacatcaacttggtatttgactcttgagttattctggcagttgacttcagctctatcaacttaacacctgtcacatgctctctgtggatgtaagtgcatgttctctgatacctggtactttatacccgtgttaagctttattaaagtacgctggatggttcgctcattatgatttatgacctaatgtttctgttagattccacgtcttggtgttctccaagacttggtttgtgccacagattgttttcaacttgttactgttgatgaccacaaaaccccattcccatgaatatttttgcacaggaccatggtcattggcaaagcaggccatatcgggaggaaagctattgctgatcgtgtagcgctttctggcttcctgccttttgccaatcttttcatctcttattaattcccctttgttttgatgtgcatcaacattttttaggctctcatcgaactgcactcctgctgcatccagcttttcctgatgtttcagcttttcacaaggccacacacaatggcgctattagcgtgtaaaacaaccatatatccctatactaagtagtgtctgtatagtgctttcgttatctatccaaaatgtagtctaaatcatgcaacgaagtgtcgttgttgggatcacaaatagtctattgtttatatagtcctttcatcatccagcctaatgtaagtcataatcattcaacaaagtgtcattgttgggctcactttttcttctctataaaaagccctaggcatacacaaagcttatatacagttaatcacagcatcacacacatcaattggcaatagtctcctccagaaaaaaaaatcaatgggtaatagtttcatggtaattactacttagtcccttgccgtgccatttggggtccccttctcttccggtctaatgaagctgcaattagcacatgtgggagactttgcactttgccggtcatctactggcgctgtaggccatccaaaagcaacatctcagtcggacggagaaaaaatccccatcaaatcgcagagatttcacgtgaccagtccattgcaggatggtgatatctctttcctcggccgcatgctcatgatagacgcatggcacatcgctggtgcctggatttctaaacctgattagatatttgaagtgaagaagcttctttaatctttagtttggccctcttcctcgcttataagctgtataagaattggtccttggactctgattagggggctaggggccaaaggtaggataccggccgtgttcttgttcagctgttctccttttctcggtagaatagtcgacatgtcttagacaatgaacaccctttagtaaataactgggtctttttgtttgagctgcggcttacaagctacaataaatttgaattttccggtgtcaattagtctcaaatattgaaatatcaagactagaggtgtaaaagtctaaccataaaattattttctgtttagtcacgtgtctacggtttaaaagtaatactctgtgtccaaagatacacaagatttttactataccggtatccatatacatataagggattttagctatataccagcggagggagtaacagataaaaaaaaacattgcctcagcaaaagtctctagtagttaagctaaactgctagtaccatttttataccaaaggaagctaaactagaacggtagaacctataaaccactgctgctccaactttggtgaacacccacggagttgtgccaaaaaagttagtgggggcgaagggcccaatttggccattttcctagtctagttgcaaggcttggagagagtagtcaccgccttcaccagccgaaaaatcgtgtagtacaggagaggtcgccgcggacgacgcgtgcgtggacgggcgcagcagcgagtttgcatcggcggcatcgcacgcacccactctcccttggcccttggatacatggggcaatcgggcacgcagccacgcaccacgcgcattttgggattcgattgcaaaaaaaaaaaaggagtccaccgaaatggacgaatttcggaaaatttggatgaattttaatcaaatttaaaccaaatttgataaaaattggtaaaaatgaaccatatttaggtgaaatagaagtgaattgttgtcttggaccttaccgaaatgggtgaaattcaccgacattcggacctttcggaccgaatcccagaatcttgaattggtgaacgggacatcagccgctgtcgtctagcttggttttcccgttaccagctcgtcggcttgattcagctattgcgtttgcatcatctaaaacgaggcggtcgagaggatggggaatcgggatagtagcgtaggttggtggcttcaattttattttcctcctccgcgtgttgtgggtgactgggtgatgggctcggtagacttggcccgatacgatggcaagcacgtggctgggcgggggatcgaacggggcagatttttgggcgacatggccgcgcgggtgagtgagcagtaacagcgtgaggattataatattttatatgataagctattgcatttgcattattgcatagtatctggcttgcccacaaataaatcacgctgttaagaggggttagtcgctgtaaccaaaaacatggtttatactactctataggttggcaaagtttggtttgtgaaggttttttttttttttgcaagattttttaaggattttagctcggttgtgcaagggcgtggagctcagtggctgcatttacttaaacaaattatttacatcctcagtttactatgtaaaggatcacataaataagaaattaagtttttgaaaaataataaatgaaaccaattgagaataataatatatatggaccctcttcctcctatgtcgtctctttcgagaatgacggcaatcagaaattaattcaaacgaatatcagttggtgttatcgataaacgaatgtctctatggcaatctgcatttggatcgagggttatgcttaattggcacctgcaacgagcgtatttcaattattgctatctcacgtagagcacacaaccaatgattcctaagaattgaggtgacggtgcactcctatatgtccctcaaatatgggacaagaaaaaatcaagtagagaaaaattagtcctcaattgtactagtgatagagcaagttgaaaccgtgcagtatgccatgtggttagagctcacaaaacttaaaccgtggtaatccatagatgagcacacaaaatgaccatccaatccaatgagttgattcactctcacaacggcttctatttggatagcatatattttatagattttccacatgaaatagttccatttctctaaatttttcagaaaattcctcctatttaaataggctcttaagcttaggcttacgtgccacagctatagttataattttcaaacttaattttagaacatattttatttttacacacttggatttaaactgctaaaatagaagtgtaaaatctgtactgtaaaattatttttgttgcatcaatcatcttttttcctctcacaagacacaacccaaacaatatcttatgaaccatcacaaattcatgatgaagatatatcttacattaatgacatttataaacggctagagacagattttcacccagcccccgaactcaattcaatggcacaacaaccggactacaggagacgaatccacgacgatatgtaagctacgcaactcctaaaactctctttaaaagacggtagtcctacattgaaaacactccttaaactccttaacaccgtacaccacagttacaaaagcacacgtgtcgtggagcccgaaaatcgaccgagagggaaggaaccaggccaaaaaaaccgcaccactccgcgcgcactgtcactgacgaccacggggacagtagtcaccaccaccaccaccactgtggctcggtcacttcttcccaatctcattctcatctccctcttttttttccaccaaaaaccaacccctccccctccccgtcgcagcgcggcgcagcccaacccaaccccaccaaaacccgcaccaccccccatcatccgctccaaccccccgcagtttggtctccccacctggttaaancactcccccccacccccaccaccatgcctcccttgccgcctcccctcctcctcctccttgcggtcctccttgcaaccgcgccggcggcggcgcagtcggcgacgccccgggaggacgacgtgcggtgcctcaaggaggtgaaggccgagctccgggacccggacgggcgcctctcggcgtggagcttcggcaacacctcggcgggagccctgtcctgctgtcgggggtgtcgtgctggaacccgcaggagtcgcgcatcatcggcctctcgctctccgggttcggcctccagggcgggatcccctccgcgctgcagttttgcagcgccgccaccacgctcgacctctccaacaacgcgctggtgggggttatcccgcccgcgctctgcgactggatcccgttcgtcgtcaacctcgacctctccgggaaccaactctccggccagctccccagcgagctcgccaactggcggttcctcactcgctcaagctctccggcaactccttctccggccagatccccgactcccttggccggctcgaccgcctcaagtcgctcgacctctccgacaacaggctcgacggccagatcccgccccagctcgccacgttcgggaaggactccttcgccggtaacaagggcctgtgcggccgccccgtgtcctcgcgatgcggccgcgcgctgagcggcgcgggcctcggcatcgtcatcgccgcgggggtgttcggagccgccgcgtcgctgctcctcgccttcttcttctggcgttgcaccgggaagagcaagggcggtcgccgccgccgccgcggagggagcgagtccggcggcggctccgcggaggacgggagctggtgggcggagcggctgcgggcggcgcacaaccggctggcgcccgtctcgctgttccagaagccgatcgtcaaggtcaagctcgccgacctgatggcggccacccaggacttcagcacgagccacatcgtggtggccgggagctcgcgggcggggacggcgtaccgagccgtgctgcgcgacggctccgctctgacggtgaagcggctccactcgtgcccgttgtcggagaaggcgttccgggcagagatgggacgggttgggcagctgcggcaccctaacatcgtgccgctgctggggttctgtgtcgttgaggatgagcggctgcttgtgtacaagcatatggagagtggagctctttcttcggtgatgaaggagccaggggaggcaccgctggattgggcgacacggcttcggattgctgtcggggcggcacgcggtcttgcttggctgcaccatgggttccaagttccgcaaattcaccagaatttgagctcaagtgcagtgcttctggatgaggactatgaagctcggttcacagatgttgggcttacaaggctggtccgaatggcaccaggcgagggtggagatacaagccccttcctgaatggggacttcggggagtatgggtatgtcgccccagagtgtgctagcaatccagttgctaccatgaagggtgatgtgtatgcatttggtgtgatactgctcgagctcgtgagtgggcaggaggctgccactgtaacgggtgatgcggcaggtgaaggattcaaggggacattggtggattgggtaaatcagcttaaggcctccggccggatcggtgatgctgttcataaatcattgcgtgggaatggccatgattcagagattgatgagtttgtgaagatagcttttgcgtgtatcatggttcacccgagggagaggttctcaatgtaccgggtttaccactctctgaagagcattggacagggtcgtgatgtctcagagcaatttgatgagttcccgctggcctataacaaggatgaatcagataccatgtaactaatggtggtggtcttgcttgggattgtgaaccgccctcggtcaggctcaatggatgcttctttgtgtagtcctgctacttgaattgatgaagagcatgctgaggcaaccatattggcatgataattattgctggatgatcaattcgatgcttgcctcatctcctgtcgagataatcgtgtaagctgtaagattttagtctgtattgtctttttacattattgctagcgcttgtagtatctcgctttatgcctaaattctgatatgaccttccttcttggaacaacttgcctccttccccaatctcctaagaacaatattggcagtgaacaaaattaatcttgaccaatttatctaaagtttacaggaatgtttcgctctgtcatgtactcatgtccttgaaacctttttcaagtagcatgttatatcatttgccatcttctctttgtgaattttcttgatgataccatgtaccttattcacatccacttaaacaatgctgtataaacatgatttatcatagttactattaagtgcgcccttatcagttcataatttttcagttttgatgtcaaaatctgtatagctataaactgggtgttatacttgtcaaccttggaccatctacctgtggtcactgctctatattctgaccatacatttgaagcatcacgattggaaaatgtcaccttcagcctcgcttttagccattgttttctaatttggttgtgtaccggtatcttgagtgttatctagttgtcttacttgatgtattgtatgctttctttgatttcaaagtcagctcttggtggcaaagaacaattatcaattccctttgcacatgccgttccacaataattgtcaccatcattgaacaatcgtaaatttgacttacctgcggtagcgaatgttacctttagactacttcctgttaagattttcttcacagttaacaagatgatgcgtgaagtgactctacatagataagtataaatcgagaggtgaaaaaacgggccgtaccttttgcaaccctgttcgaatcatgtgcttagctggtgcctgcagttattgtactatactgctagtggctgctttgtccagatttgcatgagcatatgctgcacagagaaaatgcggtgagatcaagacaaaaaaaaaaacgcggctgcaccatataaatcttttctactactcccaatgttgcttccaccaatcaagcgaacatgtcttagcctaattacccaactccctcccaatccagttcgacttactcactgtcagtctctggatcaattgacagcgctcatttaccgcggttacatttcgcaaaagtttggtctgtgtgttgctgtgtgcttcggagttacagcatcgatttgctggatgtgggctcaatggacaacggttggcatctgcagatcggctgatgctgggatgatgatcggggccttgtctctgaatgataatgatagtcaaggacgaggggacaacggagatttttcctcaattatccgtgcgactgtgcgagtacaaacggtgaacgcggccgtggattatctcgtttttccccccctccaacccctcggcttcgtttccacggcgaccagtcgcgtgccgtgtaattatcgcctcatttttccggcggtttagctgtttttccccccggcggatgttcggaccaacgacgttgaacacccctcggcacgatatgcctttggcggcttggcctcgggctggcacgatgtggtaagctggcagcgcgaagcagcagcagctctcgttgcgatctgtacacgcggatagtctccgcgccagatcggaggttggaagttttgcggggaaggggtggattgcagatttggaggctttggacgacgcgagtggtgtggtgctcggcaacaacggccgtgaccggtccaagtcgctgggcgcatgtcgccgtcgcacgctcaggttcccatcgttgaccgacttggccgagctgcgagcgagtcagtaggattttacggcctcatcaacagccacaaggtgacaaggggggaagagtccttccaattcttgacgtgcggtgcccgcaaccaaacagaactgcagaaatgttaaaatgctgtagatttccatgtactcccatcagagatgactttgagaaggctgaaactttcatatcactcttttctccgcaggtaggatgcagcttaagctactggtctcgaatacagatgcgatgacgatggcaactcccttgggagttgaaactttgcgggcattggcctaactagttcgcctgatgcaataaggttgaaggctgaaacacagattgctcagcttgatgttagccatctaaaatccgtccacccgacaagaaatccacactacagatgtgtgcacatcccatgttccctcgtgcttttatctcagctgccctgttgcacatgactacatgaggcaaacgatggtcccggaaggcattcttatgccattttcaatcaaacaaacatcatacaggcaggcacgaaagatgaaatagacccacccaatcaaacacatttctgatagccacaaatgatttggtagggtgaaatggaacacggatacagaaacctacgtctagtgctaacaccgctatgccaaacaagctcaacaaagagaaacaaggcaccccagcacttctgttacttgctgacgagtgtttctactacaggaaatgaattagcaacagagtgattttcactggtaatattcgtcgcataggccaagcgtgaaatgtagtgaagatcacaccacataacggtacgtcacatatcttccagcggtctcactagcacggatgatctttacaacttgcccacgcttcatgccgtaatatcttgctattgggtccgtaatttgaatccgggggagctgcattcataatacaaattcaatgtcatcagaacagaatgtgctactgcagtaaagtttacagaaacatctgcatgtggagtccattcaattagttatctaataaggtttgaagttatcttgataattgcgaagacacttatattttagaatgaggtgtcaaaattgggggatgtaaaaaacgtaaaaaggaaacagaggtgactggtactcattgaatttcttctattcccttcagaaattatgtatcaaactaaacagattgcaaattaacaaagaaatagaatgttagaacatgaaaacaaagagcttctcagatcaacatccccagcacatcgggtgccttatattcttcccattatccaacatgacacatgccatagtaaagaatcacatgcaactgagtaagtcaatgccattagagtatttatcatggtaactttgtaacaagacaagctcgtcagcgttaagatctgaaagtgtcgcattcgaagcatataaataaacagaaccttgatatcctattgtattaggttatgctgctaccacctcatataacattaaaactgcattatcacattgctcaactagcagctttgactctaaaacaagaaccagattgtcatttatcgtgattgtctactgaagtgatatagaaaccttgacaccttgttctgttaaactatgacctaacacattttatagaaccagttatcttaaaactaacatgaacaatgcaagttcgcattgtaaacaggacataataaacaacaataagttaaaagttcacaaaacaagattactttttttaaaaaaaactcgaccaacctaggaggaactaggtggcatttttaaataagaacttgggtggtctgggcttacattcacacacttgaccaactgagttaggctcagtatctaaaacaagatgacttaaaacaacaacaacattatgaacagccctggtttccactgccagacaaagttcaacagcacataaacctgaatttacttctcttaacaattagaaaaaaaagatcgataaaaagagcattcagggaatgtggttaaaacttaaaatgtatgcccccactactatcaattatattcattctaacaaattttattcatttgcagcactgaatgtcagagagaactgttgatttattagtttattagatggtttacagcaaggagttaggttacctgagctgcgatgtgttaactagagtgcagcagataccaaacttcgaatgcagtacaggtaatgaaggggagtttatgtaaacaagccacaatgtctcgaaaagtatcaaggctatgaggctatttcctcatagcctcatactttcctatgaggctactagtaattactagtcactagtctatttcctatgaggctatgataagtatcaggaaatatgtgacatgtttaatggcgacacaaacaatacgtatgtatgcaagcctcctggaaaattgtcatgattcaccaatagttgtccaaaaatgctgcccacaaaaccttttactgttgtgcagatatcaacacatgaatgaaacatcgatgacattatgctcaaatcaattcaaatactacacctatgagaaaataaaaaatgtctatttccagacctgagtctctttcacggtataccgctccagcagcgtcttcttctgctcaggcgtcaggagctcgtgctctggcacaagggtatgatccttaatgttcacaagcagttccgcttcctgcacaaacaagtgctacctcaaaccactgctctccacggtgccagtaataaatggggagtacacgagtacagaggcgaatggatgtggcaagagggcggacctggaagacctcgaggtggaacttctgggagacctcctgcacggcgctgcgggcgaacgcgctgagcgcctgctgcacgacgaggatgccgttgaacacgctctcctgcttcatcctctccacgtagctcctgatcgtcttcaccccgggcttcgcgtccttggggaagaagacgtagatctgcgaagaggggaagaagaggaaaaaaaacaaattcgcggcgaccgctcgtcacaactcacacggtgtgcggcgcccgcccagtcggaaaacaaaggcgggggcggcggcgcgcgcgcgcgagaaagacccgtacctggtcggcgccgttgtccttcttgtggcggctgaagacgagatggtcgcggtcgacgggatccccgaagcgtgcgacgaagtcgcccctcgggaggtcgatgtccaactccgtcacgaggtagccccctgtcccgcagcatct

SEQ ID NO: 2011 - DNA, 4225 bp, Oryza sativa
cggaaaagccggctcgtttcctcctccaacgccatttatctcctctcccttccgccgccgccgcggggtttcgctagggttttgtggggggagcgtccgcgccgacaagggggaaggcgggagcgggaggaggatggcggcaggtagggtttcgattgttttgggggagaaaaggctaagctcgccggcgccgaggtaagtttgggttaagtcggtcggtcggactcgcacccgagttgggttcggtggatttgggccgagcaaagcattggtgctgggccgaattcagggaggcaaccaaacgagagagagcaaacccccgatcacaggtgaagtaaaagagaaacagatgcaggttttggcacagccttgttttattcgtgaaaagaaaacttttaggagttacattagacgtttgattagatgttaaaagaggttttcagacacgaatgaaaaaactaattttataactctcttagaaaccgcgaggcaaatttattaagcctaattaatccgtcattagcacatgtagatgtagattattgtaacacttatgactaatcatggattaattaggctcaaaagattcgtctcatgatttccatgtaaaatgtgtaattagttttttattttatctatatttaatattctatgcatgtatcaaaagattcgatgtgatatttttgggaaagaaattttgggaactaaacaagcctaaaatggtcgaggttttactgtaacttactgtaaaatttctcgcagaacaatcatcacaaaaaaaaatctaaaaagcagaacggctgcagttaatattgcagcaattttcagacacaggatgcaacatccaacgatagcttcaataattcaccaaaagcaatcatctctgcttgaaatgtttcaggtttttactccatcaaaatccgagcgaactaaacaagcactgaccatagatcattccaagtaatgctgcaagaaattactgcaacctaaagaacttacaggatcacagcaacatggcagaaaatgagtcaatgacttattcagagtagttcatcgatagtcaagcactgactcgaaaatgacttatactcatctcattccgaacttattcagagtagttcatcgatagtcaagcaactcgagtcacaaattctgacggaaaggcaaagaggatgaacgcgatactacgaccgcctaacgaactgaacagaaatctccaaggaacccgagttacaatttctcccgggaagaaaggcggacgaatgcgatactactgcaaccacctaaagaatcgaattgaaatcttcgaggaacatatctgacaccgatcaactcgaagaagactggaccaagaacacacaacactagaaagagaactgccatcaaaaacagaaaacgacgaaaccaaacaacctacgcctgcacatcgtcgatggccttgacccctccgagctccgtgatgagtgatgaccaccgccgccgccgccacccgccgccaccgccgcgtagatcagccgcgatcagccgtgtcggcggcgccctccggttttccagggcagcacgcagctagcggtacggcggcaaagtcggcaggccatgccgtgctcgcggagccacacgtcgatgcacgccttgtggaagacgtggtcgcaggagagcgtgcggacgacggctccggcatccttgtcgtactggcacatcgagcagtcgtcgccgcccagctcccggtccagcgtggtgacgccggggagcatccacacccgcgcagccggtacggaggcgttcacggcgacgacgacccccacgatgcctccccaggagacaccggaggtgacgaagagaaactggaggaggtcggcctcgccctcgtccatgggttccgcgctcgtcgccgaactcgacgccgtcttgtggcgcctcgcgcagcccttgtcgttccgggcagaacccggcggcgcgcggtggaggaacccgcgcaagccgccgccgactccgctcaccggaaagtgagcaggacgtggtacgtagccaagacggcggcggcaatcagaacgcgaggtatggcgtcctccccctcgccgaagacgacgacgaaggcccccaactgggtgagggtcaagacaaagaccgaaacccagagcagaagccgacaactccatcgaaccatgtcgcggactctgtctctcgccttggactgcttctgcttttggaatgtggcggtggcgatggcgcggtggcaatggtgatggcgaggtaggcctcgctggctggcctacctggctgcttatcaaacgtgggtggtgagcaccgccgccgtcgatcacagatcggacggtggaagacggtggttctggaagatgccaaccagttagttccatgtagtttggaggtggaagaagagggatgccttgccttgccttgcgttgcgggatgaaacggtattgcactggaccccacttggaaggccaccggcgagcttagcgtggtccccgcgcgcgcaccgatgccgttgatcgcagatcggaaggcggggagtgttcggctagttcgttaacgagttcttgttcttagtgagcaatatgatttggccgagcaagaaacaggaggcttatgcggctgcctgtgacggattgggtatttgggttttggaatggtaattgtggttttcagtttcctgcgaagctaagcaatgccaagcaaaaacatgcagtaggctatagtacaaccacttcagtacttcactactgtattgcatccttgaacttgttcagttcagttcagttagtttctgctgtagcaagttatctctgaaaatgaactaacacactactgcatgttgcatctgtgataaactttctaaatttctaatcaaatgaacttgcaaagtgcactccatagctacgggatacaaactagtgttagaactaagaaccaagatggcaaacccacacaaaattcagatagttcagatagcattgcagaattttagaccctcaatggcatgccgtctctctccactgaatttagctggtcatttctgttaaactgtatgatcaaaaaaagacttacagagttaacagtgtactgatcaattactgtaaaaatcggcaatgccgccgaacgatttctgaaccaatatgtagttctcaacacaagacaacatatcgattaatcagtactaattcaggactagttattggcttctgccttcttgcatcgacaaattcaagaattggcatccccaaaaacttcagatgttcatattccatatccagatattcagacttcaccttgttacaggggaagcaacatgggacacagttctggccaaagtgaatcagaaggaactaaggcaatactactaccgaagaaatctaacataaatcctaagaagaatctaacaaaaatcctaagaagcgcctcaaaaatcatgtggcgagtggcggcgacagcaaaaaaaactaccagcagcagagggaactatccaaggaccagccatccaggtcagacatgatcacacacatcagagtggagaagaaagcgttagaatcctaagaaccgccctcgaagatcagatcggtggtggcggcgccggcgatagggtctcgtcgttgtctccgctctccaggcctcgaagcagcgatggtggtatgtctccccgcagcaggacatggtgatgacctcctcgcggcgcttcatgccctcgcggcaactggtctccttccgcagccacgggaggcagccctctcgtctcgtgcgttctgtgtcgattcgaacttcgaactttcgaaggacggcagtggcgcggaggagtaggaagcacgaggttaaggtggggcccagtacaaccgccggcttatctagaccgttgatcggagaacaaacgttagatcacttgccgtgacgaagtagagctcctaactaattcgcaggggttaacggaagtgcattaggattcgtgcttcttttgttctcggagatgacttctcgtcgcgagatcatacacagctctacgtcgactcggcacgcgagtcctaaaccgaaccgacttccgatgcatgccgactctctgtttcttctaccagtataagtatcgcccccgtcgacgaccggctgcaacaaagatagtaccacacaatcgtcgcttgccacacaatgacagaatccacaaagatcaagtattgtcgcgcagattccggctccggctccaagcccttgtcagcag

SEQ ID NO: 2012 - DNA, 24692 bp, Oryza sativa
gggtgcctagccgttttgatggctttgttccaataatatcgttagtgtaagctatacctttttagtatgtcccttcttctgaatttaaagctttactgtaatgaatatttctcatatttatatatatattgtttcatccgatagtactgttaatgcacctttgtattgttttccattgggaagtctatctattttagattttcgttatgctttgtgcggttgtcctttcctgtactatcatcgtggaagatttacataattgcacaggctgttccgttactgaacaatgagatgggttggaacaattggctagggtctagttaggggattagggttttttttttgggtggggtaaacacaagttcggtacgggcgaggagagcgcaagaacaagatgatgatgatgggtgagggcgcgcatgaacatgtggcggcggtgagcggcgtggagggaggaggaagcggtagcgacagtgagatggccgcgcgccatataccaccagctcgacgcgacgcggcattacctgccgtcgaacgaggcggcggcggtggacgcgtacgcgtgtgatgggcttaggatgtaacgagttcaaggtgcgacggtgcgcgcgcgggcggagccaggactggacggagtgccctttcacgcgtccgagggagaaggcgcggaggagggacaccggacacgaggccgtactgcgactctggcacggcgtgcctggacttccgcaagggcgggtgcaatcacggcgacgcgtgcgagttcgcgcacggggtgttcgacaattcgagtgctgatctcgcgtaactgccaggatgagaaggcctcggcctttttctccttcccatcaggccgaacaggcataaatccttccatccaatggatttaggaaaaagtatacttcgactccctcactatgacccgagtatgatttatatcctccaaccacaaaaccagatatatcgatccaactatcaaaaccggtgcaaacaatgcctctgtgtggttttagaggtggttttggctgacatggcgcctacgtggcggtcttgaccgggtctttgtcctacatgacgcttatgtggcattagaataaaaaacattaaaaaaatatgggacccgttgacatcctccctctccttcccttcttcctcctccctccctctctcccttatctccctttctctcccccggcctggtggcgtcgtggtcgtcgttgcccatggccaccggacgccggcgccgaccgccgccgctcccgaccaccggcgagctccagatcctcccccgtgcgcggacggacggcgagctcctccccgcacgcgcacccccaccgcaccgccgctgctcctgaccaccggcgagctccagctcctcccccgcgcgaggacggcatgcgagctcctccccgcgcatggacggccggcgagctcctccccgtgcgcggatggcctgtgagctcctccccgcacgcggacagctgtcgccgtcgccgtcgttagctccctccgccatccacggctagctgtacgtcgaagcaaaatcaaaggctagctcgccgacgccctgggaagcagcatttgactgcagcacggcggcggcgcagccggggggatggaccctatcctcacctttaccagcacgacgccctcactgggtggacgagctccctttgccgcctcccgccatccgcaatcctgcttccgccacccaaacccgtggccggcctccacaacgcttggactcaactgtcgccgaggggacgggacccacggaagccggcggcgcaccgatggccttcgtcggccttccgcctccgtcggcttgtcccaccgggcaccggcgcacgagatgacatgtggggcccacatgacagtgggtcccactattttctgtgtgaatgacatgtcggtcccacgtatttttttttgtttttactctaaaatgccacataagcgacacgttaacgacacgtgggacgaagattgggtcaacagtgccacgtaggcgccacgtcagccaaaatcgcttccaaaactactcagggatatattttacaccggttttgatagttggaggagtcaatatacctggttttatggttggaggttatgaatcatactcggaccatagttgagggagtcaaagtatactttttccatggatttaaggcttgttttatttccctcccgggcctcattcccatttgtgctaaagcccagattccctggtcctttttcacccctccctaaaaccaaaatctattgatctcccctccctccctcagcccaaggaatgtttccttcttgggaaatattctatgtttagctgctaatttgctgtgatgcatctcggttgaccggaggtaacagcaattgtgtcccaggactggtactgagttccgcaacgtgaaattgacatatgctgacatgcctaaaagaacagcatcatagattcagagagaagcaaggtgacactgacaaaacatatcccactgaaagaaactgcattacaaaaacaccatttacaggtaatactaatactgaagctccaatcacagtctccaactgctgaagctctagccacactaccggaaacatcacatattcagatagtagcaaggcggagattaaactgtgaatctaagtatctgacagaacaggtactgtgaaagactacagtgagatacacatatcagcctaagcaccgtgtccgttatggcataaaaatccaatgagagctcataggatccagtacactgaaggagctcaacgtttgtcaaattaatcatcaacacctcgaacaccacctcaaactaaagattagcattcaacttattagtaggccgaatgaacaaataatccatcatcaaatttgtcagccatctgaacggctgcagataccatcttaaagatcttcaggaatacactaacacgcaactatccaaaatatactgaggaacttacacaaactaaccatcttcattcaggtctctagtccatcagaccccaaatcacacgagagatacatcattgaacatcataacaatagtacaaatagcacaacggcctgccctaaatagatcacaggaatcacagctaacaagaatgagtaactgttattgatcatttattcagatattcagatagcaaaaaaaaagaaagatattcagatagcagcatcaaaaagccaagcagatgatggaaagaagaagcggttgaatgcaacactatatatgacaacttaaagaacaaactagaatcaaagtgagtgacaaactttaattctttatttaagtcattgacgtgatcagtacaaaatcagactgagtggatgtccagtgttcagtctacctcccctatgtgttaaactaataaggattctaagaaaagcgtgacaataaatcaaaaatatgctccaagcttccatctgttgagactatcgtatgataaaagaagcatttcgaagagcgagatggtatacttcagttcagattggcttatatcaaaaacagaaggacatatatcaaagatcatcagctagtcatcaaggcattcaacaccacatcaaactggagataattccatcagcaaccaagttacaaactctgacagaatgagcatgactccaaaggccgtactgacatcgatcggcttctagaacctaacgagaagagccccatgaatcttgcgtggctgctaagaaatctaccaacagaaacagagagagaacctggccaggaactgatccaaactaaactcgaggtgtcggacgtgccccgttccgtgattccgtctaaccctgatcatggcgacgcagatggccgcagaagtggctcctccaaactcgaggtgtcggcggagctcgacgacgtcgccgccgccggccgcggtgggtgctgctcctccgggcccttgggcgaacctgtcgccgggggcggtagcagctggtcctgagcctccaggtcgaggtcgcccggctcctccggagcaatcctgacgtgtgtcgatgacgacgacgacgacgacgcagacgtctcctgtggcggcgggttctgctcctccggcaacggctgctgcggccgcgctctccacggcagcacgcgaacgctgcgagccttcttgcggcattccgggcaggacaggccgtgctcgcggagccatttgtcgacgctgtagtcgcagtccttgtggaagacgtggccgcaggagagcgtgcggacgacgtcgccggccaccatgccgtaccggcacatcgagcagtcgcccagcgcgcggtccagcgtggtgacgccgccgagcatccacaccaaccaccccggcgccctctcgtacaagtgcaagccgaggttgatgagcccaaaggcgacgaatattgcgatgaatccccccttctccatgcctctccttccccgatcctctcctctccccccctcgcgctctcctcgctttgcgtttcgtagagtttggaggtggaagaagaggccggagccttgcgggatgaaacggtattgcactggaccccacttggaaggccggcttatatagcgtggaccgcgcgcaccgatgccgttgatcgcagatcggagggcgggtagtgatcggctagttcgttaacgaattcttgttcttggtgggcgtatgatttggccgagcaggacacacgaggcgtatatgcggctgcctgtatcagattgggttttggaatggtaatcgtggttttcaggtttctgcagagctaggcaaaaacatgcagtagtacaactcgatctgtacaagtgcacaaccacttttgaaaagagaagtgtacgaccacttcactactgcacattgctttgcatccttgaagttgttaagttcagtaaagtcagcttctgctgtagcaagttatttctgaaaaatgagctaacatactactacatattgcaggtttgataaactttctaatcagatgaacttacataatgcactccgtgggatacaaattggtgttagaattaagggaggacaaagatggcaagcccacacaaagttcaggtagttcagataacattgcagaattagacccacaatagtatgccggacattaatacgattctctgtacactgaatatttagcaggcgatttcagctaagctgtatgataaaaaaaaaagacttagagaattcctgcagtatacataacaaacaacattgtacttgtcaagatcaatagttcagtatgcagttatcatcgcaaaatagcatatcgcttagtcagtactaattcaggaccacttcttggcttatgccttctttcattgacaaattgaagaattgacatctcccaaaatcttcagatcttcatattccatatccaaatattcagacttcagtttgttacatgggaagcaacaagggcaacaattctggccgaaaagaatcagaattcagaaggaactctaacagaaatcagaaatcctaagaactctaacataaatcctaagaagcgccccaataatcatgtggcgagtagcggcgacaagaaaactaccagcagaggaaactattgaagaaccagacatccaggccagacacaatcacatgacgcatcagagtggagaagaaagcgttagaatcctaagaaccctaaacccgaagatcacatcggcggcggcggcggcggcgacagggggtccaggtcgtagcagcccgggcacgggcagacttgaaatctcgttgttgtctccgctctccaagcctcgaagcagcgttggtggcacgtcttcccgcagcaggacatggtgacggcctcctcgcggcccttcatcccctcgcggcagatgatgcaggccgcgcagccggtctccttccgcaaccacagccacgggaggcagccgtgtaggagctccctccacggaacgcagatggggcgcgaggacccgagccggcggcgtgctacgtccctttccgccattgctgccccgcccacccttctcctctctggtccttccttgcttctccctcccctcctctttcgtttcgtgagttctctgtgtcgattcgaaggatggcaatggtgcggaggaggagggagcccaagatttaaggtggagtcggtggagtcagcaccgcgccggcttatctagaccgctgatcagagatccgacggtagatcacttgccgtgacgaagtagaactcctaactaattcgccctaattcgcaggagttagttagcaagtggtgatgattagtgctaatcgtctgtaccctcgccgtccgatctgcgatcgacggcacgggtgctcgcggccgacgctttataactagccaagtgggccatccagccttccaatttgcaaaccagccactgcgccaccgccaccttctcttccaaggcagagcagagcaagagagcgaggaggcgatcagcgcagcaaccatggacctcgtcggcgccatggcctcgctcgtcttccttcaccttctgtgtgcggggtggcggatgctgaggatgtggacggcggcggggtggccgtggccgtacctggcggcggggtgagagacgctgagtatgtggtataggcggcggatttggacgctcggcggtgtcaggaccctggatcaggcgctgcgaccacagtgcaagctgtgtaaacagaagatgatggccggcgccgtggtccgcgcgctttcctgcgaccacgttttccacaaggcctgggtcgacgagggcctccgcaaccgcaagccggcatgagatgcagaatatgcaaccgtgtcgcccgctgcatgctgccgtggaaggcgtcgccggcgaacctgatagaccccaacgctcagaggtttcagcacatccgtgctcgcggcggcgtcaggacactggaccgggcgctgaacgacgcatgcccgatctgcagcacaggatggtggcccgcgacgatgtccgcacgctctccggtgggcatgacttccatgaggattgcgacatcgcgaagtggctccgcgacaacaagaaggcctgacaggatgaggccctcgatcgacgatgtggaggcgcaggttctctgtttcatcgttaagttttttgtttctgatggcagttttctgttactagtctcgcgtgttcttaggcattttcttgcataggtttctcgtttattggagccgatcagtgttagttaggtacttaggttcctcggagatttctgttcaattcttagggtggtcatagactcatagtagtatcacattcatccgcctttctatccgtcagaaatcgtaactcgggttccattgaagagttctgttcagttctttaggtggtcgtagtatcacattcatctgttttgtgttaccatcagaaattgtaactcaagacttttgatgaacaactctgaatatatacttttctgctatgttgttgcggttctgtaagttctttaggatggagtaaaaacttgaacatttcaagcagagatgattgctttcggagttttggtgaattcctgaacttattgttggatgctgcatcatgatttctgaaattgcaatgagaaatgaatattcctgcaatattaactgcatccgttctgttgttttagacttttggtgatgattgatctgctcttgtcaatgccaataaggctcattgcactggcataattctgcttgtaatattcagtttgatgtggtgttgaatacttcattgactaattgacgagctttgagatactgatgtttattggatcttgtgactgtcccaatgtattcattatttagtaatggttcaagtaaaaaaaaatggtgcatagtgctgaactactagtagtatcattgtgttgaccatgccagtgttgtgcattttttgtgtgcaactgtgatggagtgagatgagtccaggcaatttgaatcgaaacatgtcatcttgctcctgcatcataaaacaggttattttgcttctgaaagagtgaaactgataaatctgataacctggtcacatgagattttgcactttcggagttttgcccatatggaaattgccattcagtcagagctgtaattcaggatttgttttatgaaacatctgacagaatttgaaatatcaatattctagcgctctgaatcatcggtacatggctcctttcctttgctcatatgggagtagctaagagctcaattgccactgaatcgagtttttttttttcagtcataggacaatgtctactgatgcgggcttagaacattttgattcactctttgctgcagagtccctggtctactggcgcgtttatgataaagcatttacaatgtctgaaaactgaactagtctatcaatgaagtgaaccttaggataacacttgttacatgcaaagcttgtaaactactccgttcagtaaagcatctgttagtccattcagttcgactatcaagtagcaattctgaatttcacagtagtctttgacagtatgtactttgttcgatactcgcttactcagattcacagttaaatcttcacactgctgctctctgaatacgtgatgcatcttgctgtatggttagagcttgcagttgaagattaactgtcaatagagctttattattacctggaaaatgcttttctttttttttttgaacgaaaacaatttggaatactaagaagtaacttaggctgtgtttgcaaccccatgttcccaacctctctccctcgttttccgcacgcacgtttttcaaactactaaacagtgtgttttttgcaaaaaaaattatatacgaaagttgcttaaaaaatcaggagacgatgccaaggcacttcaggagatgatgccggaaaagatggatgctgacaagtgggatgagatgaaggcgcaggcagctgcaacaatacgcttgagtctcttggattctgtcatgtaccaggtcatggatgaaaaaacgccgaaggaaatttgggacaagttggcaagcctgtatatgtccaagtcgctgacgagtaagttgtatctcaaacaacagtcgtatggtttgcaaatgcaagaggagtcagatcttaggaagcacgtggacatcttcaatcagttggttgtggatctaagaaagttagatgtgaaactggatgatgaagacaaggccataattcttctgtgctcgcttccaccgtcttatgaacgtgactaccctgacgcacggcaaggataatgtcaaaactgaggagataatttcgtcgttgcttgcacgagacttgagaagatcaaagaaaaatgaggcaacggaggcttctcaggctgagagtttgctggtcaaggcaaagcatgattatgaagcgggggtgtcgaagagcaaggagaagggggcacggtgctataagtgtcatgagtttggacatataaggaggatttgcccgttactaaagaagaggaaaggtggcattgcaagtttagcagctcgtggtgatgattcagatagcagcagtcatgagattctcacagtgtctaacgagaagtctggagaagcgtggatgttagactcagctagttcctatcatgtgacatcgaagcgggagtggttctcttcatacaaatctggtgattttggtgttgtttacttgggcgatgacacgagttatcgtgttgttggagtgggcgatgtcaagttcaagatgtatgatggaaacgaggtgctactttcggatgtgagacacatgccgggactaaggaagagtttgatttcgcttgggagcctacatgagacgggttggttgtatcaggtggattctgataggaagaccatgaatatcatgaaggacggcaagactgttatgacttgtgagatgacgagctcatgtttgtacaagttacaagggagtgttgttgcaggtggagtcatggaagatgggtatgttggtgttgcggtacacgatcctgaaggcggcgagcctggcgtaggctcgtcgggcggctcggcatgagctgcggcagaaccaactcaagtcctggtacacggagattcgagcaagtaacaaatttaggttggcgtggcatattcgccaaggtggagtttgttagagtttgtgtcgaatatgtgtacgtagtcggttacagtttaggacttggagttgtaataggtattaggactagagtaagagtgtagcgcccgttccgtcgtggcgcctagcgggaaaactatttcttaaaaatcctaattgcgaaatctgtttctttgcttgttgtctagtgtccgtgccatctcagatctcgaatccccgatctatcgtcaagttcaatcccgaatccaaatccttcccaaatcaaatccctccgcaaaagtctatttagcctccctcgagttcgatgggccgaactcctctcggcccatctccccctccctcctcggctctctctctctctctctctccccgctctgcccgtgagccgcgtcgagctctccctctccactctcgtggccgttcccgccgatgccgcccaaatcgccgcgccgcccgcgcacgcgcgcgccgtggtggccgaccggccagtcgccgccgccgtcagcgcctgccgcgcctgccccgcgtctgccgcccgtgtcgccgctccactccaaaccgccccgccgtcatcgccgtcgtcatcgactcggccccgcctctccccgcgcgtgcctccaagggacggaggcagagctccccccctctgccgcgtcgccctctctccctcctccttttccccaaagcggcaaggaggcaagccccctttcttcctccctttttcctttttcccttcctccgccggcgtcattcccctcctccctgtcgccgatttggccgctagccggagcgccagctcgctggcttgaccgtcaaaagtcggttcccctctcccaaaccgacattgtcgcccatataaacccaaccttcccccctttcctttcctctcccattcgcctccactccattgtcgccgcctcccgtgctttgttcgctgtcgccgttcgccgtcgcgcgtgtcggaggagccggcacgagcgattcaaaggcggcgtattttgtggcatatggctgaacaaagcctagggcgaatagaccggcatccagtagcggttcaaccttggagaggctttggttcaacctgtttttccctctagcagacaggaagaaaacgccataggagatacaaaacaatgacgacactgagacacgatatttggtaacggagttcagccgtagcctacatctccggggcactgattacgtgtgctcctccccgatccatcatatacagcgtatcagagttacaacgactcacggccacttaattaatcatgtgttaaaaggtcgcaccgttttacgtgcaggagggatgggttcccatcctgcacttgcgaacacacccttagcattcaatattgatagagaagaaattggcgagagaacctgcgttcgaagggattcgaacccaggccagcatgttgctcctggcagctccctgccagccaagctaggtgccgttcttgaaaatgcttttctcaatgcagtctttttctgttgagggtgtgtttagttcacgccaaaattagaagtttggttgaaattggaatgatgtgatggaaaagttgaaagtttatgtgtgtagaaaagttttgatgtgatggaaaagttgaaagtttgaaaaaaaagtttggaactaaactcggccagagtgggatatgttttttcagtttcacagtcaaatcatcacaatgctcctgtctgattctgttacatgtcttgcttggccagagcttcatcagttggggattagctgcgattagagcttcagtagtacctggtaaatgctgtacctgccaaggtagagagacggctagcttagactttagagtacctgtaatctgtgagattcttgccttcgataggcccaggggtgtcctaagttaaaatggcccagcccaactctgccgcctcacacagccgcaagcatgtgattaccagagttgctggcacgatgggcccacccgtcatccacacgagggccacgccttgctaggagcgcgcggatttcccggctcgacaagaagggaaaggcagaagccgactcgaaacaacgcgaagcggcgcctctgactcgcttccgttcccatctcttcctctccctacctcgctccgccgccgccgctcccctcccgacccgcctcgcttcctccctccgccgccgccgccgccgccacggcccggccggatcccacccggccgctcgattcgaggtcagatccaaaccccagccctcccaggtccgaatcgcgccgaatttttttctaggttttggtacggatctagggtttggcttgccgtgggaaattttcgtggggggaattctgtcgaatttctctcggcttccacggtctggttggattcctgctcatggccgctgggcgccacggaggatacagggactacgaggcaagggagcgggagctcgacgcggaggcttccaggaggagcaaggagcagcagcaccaccaccacccgagcggccgacaccaacgcggcgactccgacccccgctgcgaagctgaccggcgccgtgacggcggtcgcagcaggggcggcagggagttgtcgaacgggtacggccaccgccgctttccgcctcccaggagtcgcctctcagcgaggctcggggatcgcgagcctggcgaagttctgagcggtagtgcgtcagatgactctggtgggaggccgcatagagcgagggagaatggtgtatcaagttctagtagggatggtgaatcggtggtggctgcatcggcctcatcacctagcaagaaaaggaaattctcaccgataatatgggatagggatagcccaaagccaatgcattctgatgtggcgaagggcaagaaggcggtggactctgtgcctaccgagcttcctctccctccccctccccctctgcctccgcaggatcacatccctgagaggttggctgtggagaagtcgccgatggatgtggagcctgctgttgcttccgagagtcctgagcagttacaggagcatgcggagagtagagtgatggaggaggaagaagagtactcaacaatgaggaacatatcaacttcaaggtgggctggtgctaatgatgacgaggaagagggggcaccacacaggaagaagaaaagtgcatcgcctgcagactctgctgagttggggcagaggaagaaggctcttagcccagaacttggtgaggttgtggccagtgatatctctggagggaggaccatgtcaaggtcgtctgattcagggaggttgggtgctgatgagaatgaggatttggaagttgataaagatgattatatggacgttgacagagatgatgatggtaacagtgatattgcaaatcatcagtcaggtatggactcagagtatgaagtgcgccggtctgaaacaccagaaccagtgaagccaccgcacagatgtataaatatgcttcaaggttgcagaagtgttgatgaatttgagaggctcaacaagattaatgaaggcacctatggtgttgtatacagggcaagggataagaagactggtgagattgttgcgttgaagaaggtcaagatggagaaggagagagaaggtttcccattaacatctcttagggagataaacatccttttgtcttttcaccatccctcaattgttgatgttaaggaagtagtggttggtagtagcctagatagtatttttatggtgatggagtacatggaacatgatcttaaaggtgtcatggaggcaatgaagcagccatatagccaaagtgaggtcaaatgcctgatgctccagctgttggagggtgtgaagtatcttcatgataattgggtacttcataggtaactgttgatttgacgctctatttttgtttgccaagtatcctcaaacctatcctgatgcctgtatactgatatgcattttccatataccagggatctgaagacctcaaatcttttgctgaataaccgtggtgagttgaaaatatgtgattttggactatctcgtcaatatggaagcccgctaaaaccttacactcaattggttgtgactttgtggtacaggtaggtctttggtcaacatcagattcatccccagtgttttggcttgccattaatttttccattgtgagctctgtttatcaatctgacctgcctttttgctccttctcagggcgccagaactattattaggaacgaaggaatattctaccgccattgatatgtggtctgtgggctgcataatggcagagcttttggccaaagaaccattatttaatgggaaaactgagtttgaacagctagataaggtatttcgtttgacttgtgattttgcatccttgcaattactatatttttttcagaggtctcatgttggatttcctttcctgttgcagatacctataaaccttgatatatattatatttgatcatatctcatggtgaagctacttttattgcagatatttagaacacttggcacacctaacgagaagatatggcctggctatgccaaattgccgggtgtaaaagtcaattttgtcaaacaaccgtaagtgtctcctggataatgcatacctaatcgtgttggtctgatgagtgtctatatgccattgtgatgaaatttctgttcttttatcttgtcaggtacaaccgattaagagataagttcccagctgcatctttttctggtcgtccaattctgtctgaagcaggttttgatctgttaaataatcttctaacatacgatcctgagaaggtaatgtgctactgctattttttttttcatgatttatatcatgcattcatatttaaatacttcaatctgagcacacctgttttggctttacagcggttatcagcagatgctgctttgcagcatgagtggttccgtgaagttcctctacctaaatcaaaggatttcatgccaacattccctgctctaaatgaattagacaggtacttcttcgcaaccatttaatctacttgtagtgttgcttaaatatctttgtttcatgtagtgaaatttattttcctaaaattccacaggcgtaccaaacggtatttgaagagtcctgatcctctagaagagcaacgattgaaagaactacaagggaacattggcaaccgtggtctttttggctgagctattagcaacttgtttgggctctattgatcctgactgtcatgcatcattctgaatctatgaggtcagatacactctgaggtgagatgtgccatggacatgaagtatcacgcatcttggtgtctaccagcaactgatagtgttctttagcaggcatggtgctggtttaagttgataggtacctggcccatcatagaaattttgttgcaggattaactccaaccagattgatcataaaagcagtctaatctgcctgcatcgtaaggtgtggcatgttggcttttattggttaacagcagtttcacctttggaacttctgtatgtaaaatattccagattggtacgttgtaaacaatgttcagtgcgttggatttaaaataagaatattccatcattttttttctatattctcctagtgccttttcttttgatctttccattttgtttgcaagagacaagagaagcgaaggggaaggatgccttttgcttttcaccaggaaatcaatggacagtaatacaacttgaaaggtaaatatattcaaaaaccatttacctcaagtgatgtattgctgactaaaactgatgagtgcacgtgcaaaagatcatttgtgatgaaaggtcgtggttgaaggttatctgtgttttcataggtctttttaaatgttgtctggaatctggacagacacatgttcccatatatctaaaaaagaaatgaaaaaaaggggttactgattaaaggaaaatggaacagaaaaatgaaaaacggaggatactgttctgtaggtattctccttggcatcttaacaatttgtgcaaaacaatgcttgtaagtaacagtaactgatgtttctgtatccaccactcaacagtgctgttcagcactatattttcactcccatcccatctggctatgcaccaatcaactgtaggatgcaatgagggaagaatgaaatgtttctttgtagttactgttcataagctatctaattgtgaatttggaagtgaatgtttggtcttttttttttctttcctgttcggcagccaactttcattttcacttatataaataaatctttaaaagagagaaacttcagtatcttgttactcattatacgtggtggactcttccatgtatttgatcgcttgctcccttgatgttctatttcatggactatttatctattcagggataatgttcaccaaccgtttacaaataatatttggttcttctgttgtatccttctaatctgaatggttttcaactcactgggaaacaagtttgtcttgcatcgattgatgctttcgttctctgtataccacatttttaggatattattagtaactgtctaatgtattgtgactcttgcaacctggaaaaaggtctttttcctttatctaaatgataatgaggttgaattaatcagctaagcatatctgtaaatattaaccattagctaagttatagtcatgcgaggtagaagtggtgagatcaaaagtcaagatgtctttatttttatgcaacatgttgactacttcgaagatatgctagttaactccttttatgcgacaagtgttttgcgtaaactgcctttatgctttgtgaactggtggaagaccatatgctcagtcattttgtgctttgcattttggtggtaacttaaatgctgcttaagtgcttggagagttatttgaactcactacagctgttgtctgtgacacgtctgcagcttaagctgtggctgcttcaagataggaagcttgatggccctcagcttgttgtacctaagtgactaaattttgtggaaggtcttcaagagagttcacctgttactttagtgaaccatagtggtcactggtcagtctacttatcctatcctgtctattaatatacatcatacttctgactgattgtggggaccgctcgtccatttctttgggatggttgaggtgtaacgccttctcttaaatgacattatcttcatgaacaacattttagttttctccctacaactttttccctcttgacattacctgtaaactttgaaaactagtacatggacacctgaaatggtactgcgaactttaaactactagtggagcgggttactcacaaaactactttaatctgattagttttagatgggatcacacaacttgaaaggcaagacttctactgttttagcttgctctgcatagttttagcagcttgtgctgcaatagggtgagggttgctcaactgcgcaaatcctcccctgatgcaagaccacattaacttggacaagaatatgctttaaaattttaatcatatatgatgcttgcatgacccgcttgagtgatatttgggtctctttttgtaatcgtgcttctctctaacttgtcttcccatgccttgccgatatgagttttgggatatatcgatatctgttcattggtttgattattcgttgtcgttattttgttctaacgtggcctcgaagagcctctataattcagccggcattgcctgttcgaatggccatccgaggcctgtctgcattgctatgggggtggcagctgattctatgtacgaaagaggaagcacacgcatgtatcattttgtcaagtactgttgtgtagtgcattgttcgctatgtgtactttgtgtttttctctcccccttttgtactttcctatatcaatgcttgtaaacatggaggactattgctttacagtagtaggtactgagctagtattacatgtaagtctgtctcatttacaagagaggagaagttgccgtgtgtgcaaatgctcaaattcggctccaggaaaccaagagcgttcgcgaatccgcagaccgggcaccgttgctgaggtgagtgagctggtcatgtccgtagcctacgtgtaaaccaagtgatggtccttgctggaaggtgacgggcggtaataaataaactataccccctggtcactttgatcggtcggtacgaggaatggttatccttcgggaaagcacgactgcattcagtagcggcctcgggtgagcatcggtgtccgagttctcttcctcgtcgatttcatcctcatccgcgaggtgaaattaccttccagggttcggttgcaaaatgtacatacgcaaacggctgggatttaatttattattaagaaaatagattcactagatgattagaggttataatacccgctgttcaaactatgtgtgtatgttcaacaacaatcggaaagggcatgtgaactagtggtggaataagtggattgggaacttgatttgtaatacaaattatttgtttagttgctataaataaagagaggggagggaattcatgctatttgtttcgtatgtggattttgaggtagggtgtgtttagttcacgctaaaattggaagtttgattgaaatttgaacgatgtgatgaaaaagtttataagtttgtgtgtgtagggaagttttgatgtgatagaaaagttgaaagtttgaagaaaaagtttagaactaaacttggccgtactagaaaattattatctcaatagttagtcactagggctaagctcgagcattcccttcttccgtaggaactgatcggactcatgtttccttctcaccaattaccctcaatcttgtgttactaaaatattacgtggatttctaatctctctgtctatctacagtagttaatacctccgttctagaatataagcatttttagagttggacacggttattaagaagttagaagtaaatgatggatggttgtgattgaatgaatagtggaggtaggtgggaaaagtgaatagtatagggttatgattggttgggaagagaatgttggtgtagaaattgttatattttaggataaatcttgagggctacaagttgttatattttaggatagagggagtagtcaacatgtctagctcgaccgctccttttatttgcgatattgattcgcatcttaatatgctaaatccatattatgttgttttaatccaccaacatttatgttgataaaaccaactacacctaccatataagtagaaaaccaagtaaaagaataataaatgcagctttactacctgataagaaataccgtggaagttgataataaatgcagtaagcaaataaattatattatttatacatttgcaagaggttgtaggaggcagggggttagccactttgtaggtggattttaccttatttttgtctgtacaaatcacacattgtgatatctctggtaaatactatcttgtgatcctataatccactatgcttataaaaaagtgtgaagtttgtaatggcagagacgtattaacttgattttttttgaagtggtgtattaagatgacaacaatcttatctctcaacagtagagatttaatcaactttttgcttattatgccgttgtcacgggatattttccatcatataattctctcattgtcattcaaaaaggagaaaggagtaacagaaataaatccaaaacaaatcagaaaaaggcaaatttccaacttaggctatacaaattaaacggcaacctccatttttgcaagatattgttcacaatcacttacctcccttttatagtatatagtctcccacaacggtataaatttatcccttctagaaaaaccaacagcacaaatccaaaacaaatcaccaaaaaagaagcaaattcccatccttacacacgcctgcaacctccacacaaaaacggaaacttttttcaaacacgcgaaaccaccggaggaggagttgtgaaaatactctcaaaacgagcaaattaccaacgttcaattctcaaaacgcgagggcatctccgccatttcgcccatcgccccaaccgtttctccttctcctccttccccttgaagcctctcctcttcttcctcctcctcctttggctctcccttggcctcgcctggcctctcctccaagagcgcaaccgtaaaaaaagaaaaagaaaaaaaaaacccgaggcggcgagctctcgggctgcttccggctccgtccgtagcggcgaggagggggcggagggccattggcgcaccggcccgcgcgaggcgcgcttgcattgttggtgacggaggcggggggtcgacggggtggagggcgtgtttttttgttggcttggggtggaggcgggggatgtcttgctcgaaggtgcttctgtcgaaacagggggtgctggggacggtgtgggtggcggcggtcagcggcgtggcggcgctcagccgggaccaggtggttcgcaccaacgtcgtcgcctgcgtcggtaagcgatgcgatgcccactcctcggcctcagcgcgcgcgcgcgagagagagaaaaaagtgcgtatttttcgtgggtttttatgtcgaatttgcggtctaggtgggaggcagtggaacagtgtgggaggcggtgtgcggaagaggggtttatccggggctttaggttatagaaatgaagcgaatcatgtgatgagaatctggtaaaaaaagaagaagaaagggaatggaatttgagaggagttgtttgctgtcatggcctcggtacccttctatactgtattgtggtaatcgttgtggcaatttgattttccatgtgaaatctcgaggtgaaaggaaaaggtagcaccttgggtgtaataacatggacctgtgggtatgggtttttggatggtgaagagttttgtactttgtagatggcatcggtttggggtttggggtttagggtcattgtacgacgacggttctacgtatggttctattaataaggcccaagcatatacccaagattcgggcgccaactaggaataccttgtaatccctaaatttaatagcattgaacaaatctagtagtcctgtaaatattgtttggtctgactcgtaacggaaatacaggtgtcaaaagtgtggaactaataagaagggaaatgctatatccaaagcatatgaaacaaattagaacagtaaatgcgggttgtgacattttataacgctttccttttctagatcgatttatttttagcattctttccctaatatgctcgtaacgcttgcacatttcctctttcccctggcagataagattttgcctgatgacaacgacaaaaccacatacagagtattgggactgcttctgcttggcattgttaggatttattccaagaaagtggaatacctctgccatgaatgcaatgagcttcttggatcatatggatcagcacattgcaatgaactaagtatcccaactggaggagcaacaaatagagtttcaaagcaagcgaagaaacctgttcgcgcaagaagattagttgtaagacaagaaggtgcttacaaggtaaaaatacctatgcaagctgtgcgaacaactagagcagaaacaagagctacttcacagataactgaagttcgagacacacatgctacacctgatcttccaactttcacaatacccaaaagatttgagcttgactcttttgatttggggattcctgaagataggtaacaggttttggtcctatactagttttattagcttgttgcttaaaattgtggtttctgatctatttttaaaactttctttgtagggatgatgatgacgtggatcatcaccaattgccacatcaaggtagaactgctgtgattgatgtttttaccactgctaagaaaccattttatttacgttctgcattcttttgtataggtaccatgttggaagatgagaatcaccatacatcctgtttgtttgaggtacactgctctctcctgtattgtccacaccacttaccgacacatgcatgcacaaaaaaaaaaacttgatcaaggggtaggacgtcgtcgttgacttagctttaaagaaggtgcccactgaaaccttgtgcagcgatgtggacagaactgtggcacccaggatttgagccctgggtgggcgtcaccttactgggtgctctaccactgagctacacactccatccaacacatgcatgcatacacgagctgtatttagtaacatctgaaatgaagaaatggaaaaactaactaatggtatgcatactagataagaaacacctggtattgctaagcattgatatagggtggccaggtgaatgtgttatccagtgatcccaaagtgaggtaggctcccaggtagccgaaagtactactccctccatcccaatggtaggtatttctagcgttcaaatttgtcccaaaatgtagctaattctccacctacctcgtcatttgaaccaagcacagccatatcccgttaaatttctgcacctactttctcttctcaaccgatcacaaccttccaccattcaaccgcacctattttcttaattcccgtgaaaacctctagaactgcttacattttgggacaaagtactgattaggcaagcactgtagtttttgaaaaaaaaaaggactcgagtccgctaatgctttgactggcatataccaagtctgtgaataccagtgtgatgctggctgcagtcctgtaccttgtgctaattattctgttcaacaatttagagaactgctacaggtgccacttgtcagttgctgaggggtttagggggttagttctgtaattgtcttattttttttagaaaatgaaggagagctgcgcttcatttcattaagaaaaaacaaaccacccatacaaccaagggctcacgagcccttcacacatctacaaacagcaccacacaaggtgatacacgaccaaaaaatcaccctacaacagcctagtgcccttgggttagcgaattacacccaggttttcattttttcccgtgttatttataaataataccacataattgctactcctttattaattattatccaataaccatgtcttccttttgtttcgtatattatctgtttgggaaactaaagccttattttggtccaatgaacagtcttataagatgatgacatgctcatacgctgatctagactctgcctgcattatgccagtacgcgtgtaagtatagagattactgtctcaatgatgctaaaaaagattatctgtaccgaatttctgaatgaagcttcaatgcagcactatcccaactgaaatgatgagtgtcattagtgaagtcaacagtctactatgcttgagtagcattgggggtgaacctgaaaatcacaatgctgaatctgcttgctttacaccagtgaaggagtaagtatatatggtgtcacatttctctctttacagtgcgcatacttttcctctgttgccgatgaccttttttttttttctggaacagtattcttccacctgagatggtggatatgatggctgaagtaaatgatccttcagataaaagcacaagggggaaaaaacctcaaagagaattgaatagggatgagaatgggaattctgcttgccacatccctttgtcagggtaagtaaatgttacttttgtggttttaccatattatgattttaatgtcacatcaatttttttttacttaaacatttttgtgaaaaaatagtgcattgatgctgaccatatttattggtacagaagtaaggaagtgcaaatccctgaaaatattgtggagaatgtgacttttccaagtcgtgatgcaaattgtcccacaattgaagaatcagaaaatgggtcactgcatggaactaacacaaatccatcatgtgatggttttgaggaacccgggtctcttgaacaaccaactttgcgctgtaagacaaagctaatcaatgagctgtcaccttccactccggagcccatgacagagggtggcacaggtttaatttttgtgataaaaattcctcttctatttgtggtcaatattatgcttaatttgtgatgtgtgggtttcactgatttattcagggctaccctgctctcctaaatttatggttactacaccagctaaaaaggagaagcaccgggtgactagaaaacgaagaaggggattatacaataaagattatataccaacagatagaggagacaaacggaaggttagaagaagaggaacatgggtattgtatgatgaaaatattgttctaccaaatgagtaagtagagcttctagcttagaagctcttccatctgttgcactacctattcctgtttgatcttttaggtatcctaggagctggtttggcaaacttaggctcatcttatcagcttaagcagggatttgggattctttgatgaatctaagttctcagcttcttcttcttccttttttttttttgctaagatatttaaggctcaaggcaaggtactgtaagttatgaagcctatagcctcataaagaattataagctgagaaccaagatgcttggttggctggccctgaggatgtttgtgttgtccctggattcaaatccttaaaacatgtgctctcattggttctacctgtttgcagtgggaaccagcgatcatggctggggtgctagcctcttgttcccgcactttatttttgtttgggggctcgggttaggtggtaggctgcagtgccttactattttttatgtgatcaatgatcatgtagtata

SEQ ID NO: 2013 - DNA, 3679 bp, Oryza sativa
tgatgctaaaaatgtaaaaggtgaaagcattccagatgaaccaagaaagagaaaattggatgaattgacagatagtgtacaggcaactgttgggttacactgaaagtgcacagtatcacaatgatgaagactatagatttaatgacgatacagtcaaagaaaaggatttctcaattggaggacatgaatctcattcaacagaactgcaagaaagattgaatgcattgaaaagtaaaaatccacagctcgacgaggcattggatgctgatatagatagtatggaagaggtaacactgtctacattaaactcttttataaaattcttttgaaaatatctggttttgtgtgcaaaatgccatgcaaacaattcatttgttaatgtatattttatgcaaatgaatcatttgaaaattgcatctggcaggatactcatatggatgaacaacatgctagagatgaaggtactcttttacaccctatactagtttttatttttcctgtacattagatctttgtttttgccaagttctactgacattgttattttgcacaggtttgctgcgttcaacaagaacaaggtggctaatgaacttgtcctgtttcttttcatttcttttcttcatgttgtcgttaacctataacattctctaaatgcactaattcaggactgtagcaaggtacttccatcaactactcgtggaccagaagtgccaacaacggaacaattctgtatgccttggtcaagcactcgaaggaacgaaaagaaaaacttcagcaagattcttctatgaaactctggtacattttctgtacttatttcttggacacagtatctgcatgagttttagttgctttttcactggagaatgactggtcttgaggatcccatcttgtgtattactgatctatttcagttctacgcaagaacaatcttccttgtgataaaattaatatgtgcattttttagtgcaattcatgtgctttacttgggaaatatgcaagcacttctttggttccatttccgttctgtttatcaaaactcaaaagttgtttgtttgtttcatattttcaactcctataagtataacagaggccctatgatccttacagcaatttgtattgtttatatcgtcgtttgctctcttctgcagatcctgaagagtggtagtctcatagaagtcaatcaagagcagacttatggggacatcatagtctcagcgactccgcggctcgaggcggcattgcggagtagtgagaagcaatgacttaatttgacgcaacatgttcattggtagttttcgggaaaaagagatcccagcttcccaggagcgtttcaccttgttttatcttctgtagcatgtttatgatggtcagtcagatgtatatacttagttgggcgcatgtagcgctagatggttaggaacatgtagagatgttagttgtttcccccttttttttcccctttagatggatagcttagttatttataataactttaacagttgtaaattgcagtttcctatcagtgttagatcccgtgttcttttcagagtttttgatcgtgcgtgtttggttcagttgtatatgtgagtttgccaggatgttgtctaatctggaaatgatgcagctgggaacagtttggaagctatgatgggaacagcgagccatggtgatttgaaggtactgtagttgggctcagttggaatgtatcattttggtgtatttaactaagtttaataaagctttcattatcttaaaaaaaagatactgtagtcaaagcagtagcaaagcctcttgaaggagctgatgagtcccacacagtcgccgtcgttcttcgagcttctcgctgttccattgtgaacttgagaagcttatgcttttcttgattttttttaattcttctttctttttatttgttaagtagatgcaattctatttgtcgaagagcggttgaatctacatactgctgaatgtccagttttagctgaatcaacaaattcaggattagctgaattcacagttgaggtatagatgaatctaggtgatccaagagcggagcagctgagccgtgctcggtgctccacagttctttgtacagcaaagcatgcacggaaaatgcatatagcaggtgcagatcttgtcaatctacactcattttcctgcatcgctgagccaggaaattcgacggtgaaaattggtaagatcctggcacgattggttgctcagcgtcagccggagcgcctagcgttaaatgggccgaaatacccacacgacccacgaggggcgagcgacaggccgcctagtggcccaagtaaatttcgttttatgccaccttttattattgaagttttactttatgccatcattatttaatcattgttttcaagcatatcatcagctgataacagctctatccataccctttttcccagttttttttttaaaaaaattctgttagctcctctatagttgtgacgagtagttttgtataacctatgtaaaaaaaacctagctatatatatggagatatgtatgtctagatatataatcatggtttgtcttttttttatatgggaaagctcttattagactagcggcactggctgggagcggtttgctagttagaccttgtttgattaatccctatgaggctatgcttggttaattcccaagagggagggagttgagcggatttatcccatacctattgtggcgtgaaattattcctcctcaatttcctccaattctcttcaatcactctaaaccaaataagaccttacttggctggaatcgatttcccagttatttttctgtgcactcttgctcttatgtttttttagtgtgcctttttatgtttttcttgtattcatgtatggactaccataacaatcctatttgtgtcgcagcaggcgtgcttactgcctcaacgggtaaaaggaagggatcaccctctcaataagatggcgatggtgattctcaagctgccaaaataatgagaaattcaatcccagaccttcctgaggtaccgaggcattgagttctgatgatgcaggtttagattgcaagcttattatcaccatgactccacttatccaaaaaaaaggacagacaagattaatttagtgctacgatttcttactgaattagtgactgtcctctctgcaaaggctgctaacatctccaacacatcttccagaatttgattcataagtgggatgctttcgtacaacttatagctaatttagtgcttcctccgtttcaggggttaagatgttttaactttagtcaaaatcaaactgcttcaactttgatcaaatttataaaaaaacagtaatatttttgacccaagataaatttataataatgataatttaattattaatttaataaaactattttggttatgtaaatattattatatttgcctataaacttagttaaatttaaagtagtttaattttgacaaaaatcaaaacatcttataagctaaaacatagggagtacaaaggatgctttggtactacaccaaaagatcacaaaatgaactttgaaactataagactaaaaaaattaaatatttgcttataaatataggagtaaattttacaaaactatatgttttatggttcaagttacagaaaaccacacatattttaacacttggtacttaagtatatat

SEQ ID NO: 2014 - DNA, 13354 bp, Oryza sativa
  unsure (1)..(13354): unsure at all n locations
ttgtgaaacaacactaccaaaatatatgtacttaagtgtcaagtatcaaagtgtgtgcgattttacaacttggaccataaaacgtgtagttttgtgaaatttattcaaaacataagtatgagcgaacgacggggcagttcgttttcaatcgagctcttgagaggaacggagaaagcaatttgaggccgttggatccatgatcaatgcttcagatggcacgagaatcactcgcctctctctcacctcttcttcctcagctccgttccctacttccctccctctccggcgtccgccgccgccgccgccgccgccgcgccggcacaccatggcggcttcgccgtgagctcatcatgagcttcaagcacggctccgactccgatatctccctcccgcaccaatgccagcctcctccctccgcctccgggccctccttgggtcgccggcaccgctccccgcgcgcgcgcttctcgccgcccacgccctcctgctcacgtgccgagcctctgccgcgagagattccgcgccctccttggcgcaattccgccaggccaccttcgcctccgcggccgcgcgctcctcctcatccgccgccgccgcctccgccttccgcgcgctgctcctcctccgcccgcgctgcgcacacccgttcaacgctctcatctccagcctcacccatgcgggcgacccctccgcggcgttccgcgccttcgcgctcctcctcgtcgcgtccggcgcgggcgcgggcgcgcggccggacgggtacacgctccccgcggcgctcaaggcgtgcgcgcggctgggcggcggcctccgggagggctgccaggcgcacgcggtcgcggagaaggccgggttcctggggcgcgtccctgtgcagaacgcgctggtcacgttctacggtgcctgcggccagtgtggcgacgcgaggaaggtgttcgacgaaatggcagagcgggacgttgtgtcatggaccgcgctgttgtctgcgttcaccaggggaggtatgttcatggaggctctcggggtccttgctgagatggacgttacaccgaacgaggtaacactggcaagcgtgcttgtcgcttgtggaaatctggggacggcacgggctgggaaggccgtgcatggatggtacttcaggcgggagaaggagctgaacctaattgttggcaatgctctgttagatatgtatgtcaagtgcgagaaactggatcttgcaaggagggtatttgacatgcttttggcgagggacattgtttcatggacggttatgataagtggcttggtgcagtgcaagcgtcctagtgaagcattggaggtgttcaatgcgatgcagatatcgggagtgaagccagacaaggttgttctttccactgtcctctcagcttgtgcaagcttgggcgcactggagtctggtaggtgggttcatgagtacatagaacggaagggcatcgagtgggatgtgcatgtggggacttcagttgttgatatgtacgtcaagtgtggatgcttggacaccgctgtttccatcttccaagagatgcccctcaagaatgtatcttcctggaatgcgttgatcaatgggtttgcattgcatggtcgtggcagggaggctcttgactgctttgacaggatggttgcatcaggtttgcaccccaatgaggtcacttttataactgtccttggtgcatgttgccactctggtttagtgcaagaaggccgtcagttgtttgagttgatgacaaagtcctacaagctctcaccttgggaagatcattatggttgcatggttgatcttcttggaagagtgggctcatccaggaagcatatgatgtaattaaagccatgcctatgagacccggtgtgttcacatgggtaaccctactaagtgcatgccaagctcatggacgaatggatttctcgcagcagattcttatgcatatccatgagttggagtcctctgggaatgggatttatgtccttctctccaacatgtatgcagtgagtgatagatgggcagatgtagggaaggcgagagggttcatgaatgagaaaggcatgcagaaggaaccaggatccagtgtgattgaggtgaatgggaagacctgtgaattcttagttgggcaacagaaccatctgtatatggatgatgtacgtgcaatgctttccatacttatgaagcaaatacatctggatggtctctagttctttaggatttaaatggttattgtgttctgccgagatcatcttgctgcttgtgttccatttggacaaatgatgatcaacgattcttggattggttactatgtttgcatttacactatttattattcctaagctaatgtgaggattttctggtactaaagcttagcagtcaagtggtctgcctaacagtgaaatccgcaagtcagcatcgtgatcagactggcaaatggaggaatagacctgacagttataagccattggcataatattgagactgctagagtttccactatgcacattattgcaccaatagttatgcaaagttctcagtaagcctaggatgctttcttttttaaagaacatgacgtgttatcagttgcattcttcaatgatgcactcaatttgttgctttgatagtcgcttttgaacatgacatggacaacagttgttgggtgcagaatcagtaggatttcgttcctgaagaaccagataaagtgttctccaagatgagatctgaagctaaattcattcgtaaagcaccttgtttagtgcctggatacgtatcaaaggtagtagttcttaaatgaagatacattaaaaggtccaccattgaccagcacgttgcgatgtgcctgaccccattcatcttctcacatgaatatcacctcttcttgtagagggctatgaatgatcctgacttttatctaatgtaccgtctgcctccacatccgttctccctctggcaattgaagaacactgctgccacaggaggtccaagattatacagtgcggaaaaatctcttgtattgaaatttggtctccatcctggtgcataaatagtctgttgtacatattggcgaaataatataaagacaaaacgatgtatccctgcagttggttttgggctttcataactgacaacttcatttcctgtaataaaaattgttaaaacatgttaaagtcagttcatatgagtattgctctcagcctctcaaacttaaaagttctatgcatgaagtatggacatccattggtcaagtttaggttaataaaaaaatagcatagggatgctcatgttgagctcagtgcagtcagatcagacaagtttatgacaatcatagttaaaagaaattatttccatgggttgatgtcgaaggcaggacgatctgctgtttatcatctgaaatccaggtatgacattggtgtatcgttatccttcagatttactatatgctcttatagtttagttttagtgtttattaaatgtaactacaaatgatacactttgctagttttttatttttaattatgttgtcatctggaccagcacgatatgtatttgctttaaaatcttggatgacttgatgccatcaaaacattaaattcagaaaagaaaagaataggaataacccaccataactagcatttgccgattctggaatgtctgtcaccaacctgtcacatgcaaataaccataagaatagcttttgattttgtatttgtcacgtcacacacaagtggagaagtagaattgtataaaccaatttaattctgaaatgtttcagattttaccaatgaaggtattctctttttgttgggttgcttggacttggcgagtcaggatccaccatctcctaaaagcaagttagcgtgttacttctagggaaaaatataactttttagttaaataaaacattatcattccaagcaaaggataaaaactttgaatttgagggtataaggtccatgaactgtgcatctcagttacttgtgttccactaagattatatggccattgctttcttaattgacacaacccagatacaaggctctccataactttgatgcttaagaaaattaactttctataacactattattttgttagcttcaatggttgtgtcactactaatgcatcttcatgattctagcaaagtacagttaattttttaatgcatctaatcataatgattcagattcctatacttcatggctgacgtgcataattttgatccacaggcagcattcaaatatgcaggtatatgtgctgacctatcaaaagcaaacagaatatctttgtttacacgaaataaagaaatagaggtgcaaaggtctttttcaatccacccagtcacacagatgaagttgtacaacttacagaaagctgagaatatttgcttccagtgttctatacgtactgaacactaatagcacatgctacaggtatagcactctacacagttggatggggctcgtgtaattaggcacatgcttttttccccctgggctagatgccaaatagtattccttatgaactcaatattgttcaatgcagtaatgaggatttggacttaccagagtgtaaaggttccttatgtcgcggccagcaatttcaatccttggttcatttgctacctgtgacggtttgagctcagacccatttgttaattccttgttgttgtataggaccttgagtgatgctgatttgttgaatgggtctaagatatccccaacaacatgtcctacgacaagtgggtcccttgacatggctagtgaagattgatgatcttcaggagttgagcaagaagaggctgtgctaagaagctaacttgagcagaaatgttgaacttgggtgaactgatgagtgcaggtatgtgccctatatatactcacaatctaagtgctgaaggcattcgtggtatcaggagttgttagctcctgaagacttggaatcttaactttaaggcgtaggcaggtgtactgtattatattggttgccatcactggaaatattgtggtatgtccactctcatagcctacataaaaataaggagtgttcattgctattccacatcgatgaataaaatctgctgaccactctcacttattccctatatctgcaaccctagacatgatacgctcctgctgaaaagtagattgcctttggacttgtcttttagattgacacctcatgtttctcattctcaacaagaactttctgtaactcttcctcagtaagagttgtaggcaaatgggataagtaagcatcagccccctggtagggcaatacttgccaaggttctatacttctatctccatactgtagacaacaagaagttagagcgtacctactatttgatggcattgcagtgaggatcatttctcaatataaattacaaaagaggtttcttgagcatgattggttgggaatattggactgcaacaataaaaaagtgctagaggattttcttgacacttgttcactgtcttctaccaaatcaataattcctgtcttcctttatagcagttcttttatcaagtagatgcttgataagcaaattagtggtacagctgtgtggtttatttcagtgcatgccgacatctagaattcagaatcaagttttcgtcattcaaagattataggttagggtgggttcttagataatgatgacgatggtaaattggctttatttgatctacaacattctgttattcactgctctccaagtatgtctatctaaagttctaaacatattagtcctgttctttatctatcaagcgagattttgctcaaagactaaaacagccttctttcggaacaaacattttggcatgttttgaactgtcacaatatctgctctattgtaacaaaatttgaaaatccaattttcttttattttaatatgcataataggtggtgcagtcaattataatataaaatcagtctgctattttttttgtccaaaatatttacccttttctgtgtctctgtagttctatgatctcacccccccgagttcaagctactacctaaaacaccagtccaagtcacattccaagggcagtaggccttctagaatcattttataagttgcttgacacacaatcactcatattgcggaactgaacatctaaactcacttgtcagctgttctcaagattcaaactttcacacgaaactcagaatttcacttaagggctgttgacagtacgcatattctgctaataaactttctatagaagtttattgtactctgtacatctctattttactagttttcctgatggaatatgatctctgacaaataggtcagaatgcagcttcttacgaatactcctaggggggtgcatttgccttttgaaatgtctgccgctctgtcttccttgctttctgacagaatatgatttgtgtaatacaacgtcctaatcttcttatcatgacaggaatatgcctgcggagctgatggactctacataaagcggacgcagaaagcagagatagataaggcaaaggcctactacatttattcttgaccaacaggggcccgcggaatcccattttattcctgtaattcgcaccaaagattttatgtcaatcacgcctcccccttctgatgttatgttcccacttgcagaacgcaggccttgagctgtgcatcgaggaatcaagccactggttttctcagtcctccactcctgctggcacctaaatgtctcatcctattaagcattttgcaagataaactccaggaaggtaatttcagttaacatttatttttctcgaacgcgcaaaagaagaactgcacatcattatattaagaggaaagaaaagagttcaaaaggacccaaacaagcccagtagggcatggtttagtacaaaacggcttgccaacaaaaaaaaaatgctaatggtagttacccaggttgctcaccaaatatttcatttgtggtcatggcttcttttaggaggcggctggagggtagcaggaaaggcaaagagctcagttacgtggacgaagcgaacgtcaggttgagagttggaatccatgccccgaactgtcgctggcttgataatcttgactggagaacaattgaacaaggcagagaacaatgcaccatccccccttcacgtgggcgcatcccattcgtcgcgtgatcgataggacttgcagagggggggccgtggtcctcgccgagtcgccggcgccggattctctgtgaaaagaggctgcaaaggagattccacaaggcagaaaaatctgccggaaacggcaacatgatcgtgctgctgctctcgaccaccgtcgccatcagcccagttgatgagggcaagtgtagtacaaaacctcagcgcctgcccgctgccattggcttgctttgggtcagaaagcaacaccaaggtttttgggtctttcagatcagaaagcaacgcaaaagactggctcttcggatcagaaagcgacctctagtgtgtgctttcggaattcagatcagatatatgcgtcgacgacacttgcttcatcgagtgtatgcccttcttcttcttcagcactgttgcagttgacctgtccacataacacattccatggatatcaggccaggcctaccgtgtgtatatctgatgatggactaccagcatatcggttggcccaggtaaaactaggcatatatcgcttgtttacatagcttcatctgaagcctccatgatatcatccaatctaattttttgtatcaagttctatctatcctaacactcgtcaactccaataccgcgggtggcttgatagttgatacatatcctgatatcaagcagattgcgggaacaaacaagccgaaatntacgatgatctgttgccttttgttattctgctacgcgttcgtattgcggctgacatatttttaaggtgatgtatctggatcagtgatcacatcaagaaaaacagttgcgaggtcaaaagagaggagcagcttggctgtggaagaacttatgcctcgtcgtcgaataagacaggagttttgtaggatgcagaatctatgccccggaagaactagattggtaacaataatgtgtataaatgaaacgatttcatatttttcacaatgttagacatatgcgtgcaatatttatttgaaacttcaatcttctgaatatcctgataacacgattcaactacataaaagtatcagtttttactgattttcttcaccgggtttttctgctattatgcaggcccattttatttattacgagttctttttattgacagctcaagcatttttatacaaggatgcattcaggttcagaatgctgacattcttttctgtatgtatcaatacgttgtcagctaagcgttcattttctccctgtcgacattatggggcagcatatcatatatattctcagcataattcccagcaacgtgctcaagactcatgtagcaagactcaaattggcgcctccgaaagcataacctttctgaagcaatgtttgattaaaaaaaatttgctgaactaatatagaaacgattagtccgcacagcactggcctgctcagtacgtctgcatcatgatctgcccaaagatcttatgcgaccatgataatggtcatgaaccatacatagtgctttgtgaacttcacaagttgatcaataaatacatttttatgaatctatgactatgatgcaacagccacttgatgtataatccacccatttcctcaaaattatcaactactacaacagtgcatcagaatgcatctatgcaggcaccaagaaagcatatccataacgcaaaatttacatttagcagtaaacccatgaagaaattgaactctactagaatgcatctatgcaggcaccaagaaagcatatccataatgcaaaatttacatttagcagtaaacccatgaagaaattgaactctactgattttcatagtttcccaaaaggatgtatattccatgcaatggtgagccagtcagctacatatgcttactatcccccgtctcaactgcaaattgaaatcagaaagattagaattctgcacagacgcatggttttctttttttcttcaagaaagcatcttcacattctcctattttgccctcgacaccataataaatgcacaactggatgaaaggaaatatgaaccacaatacttgtttgatccaatatatattcaataacagccatacagaacttttaaattaaaaggcaaccaatatagcaacatgtcatatactactagtgttgaaggcattgcagctgcaggtagattctaggtatggtaaaaatatggtactagtatgctaaaactaattatatagtagcaaattggggaaaaaaattctgggcattaattaacttccaaaaatcagttggatggcacagattaatgtttagcaaggcatgaaaaaccttctggatcaaatatgaagctaccagagtgaagtaagatggcaggcatagctggtgaaggatcttaacacaactcaccttataggcattttctttgtgatataaatatagaggttctataaacaggactgaagtccgtgacatgctgagatcaaggactcagacggtacaaactggtcaacaaaatgttgtcaaacatttaactgtgagataattacagttgataatatcagttcaaatatcattcaaataatcattaaaaatttgagaacgaacaaaaaggctgatagtatatctccattactctatcctgaagaagaaatttaaggaaatagaagggtgaaaatatcagttaatttgatgaataaagaaactatgaaactttgagattattttcagtcaaatgccttttgtataaccatcgttgccttatatacaaatgttgaacttgataaccatagcgagattcctttgtggctttggccatctgaagatgaatcagctatccctaaataaaattgaaagaaaaataaagggtcagaaattacaaaggcaaaggagttcataaacctaaaaaattgcctgcccatattgaaaaaataaggtttatgcatacatggtacatcttttcatgcaggattgttcattctgtagtgttattccatggcctccgagttatttttcttgagtcatcatgaattgcactttaggtctctgagtcaccacatctcgcaacaatcttgagatacaagaacatgactccttaggtggaagtgttgtcatttgcatgatttatgatgcagtaagacaaaacagctctagcctccatgaaaagatttgttaccctgccagttcacaccctggtccaatacccaatattaagtagtggtacaatgcaaatcacccaaaggaaaaaagaaactgaagaaacctattgtaataaagctcaaaatgtgaaatggtcatattaacaacaaattgtggaagccgttagcagaaaatactgtactgatgctcttatgtcaggatctacgattcataaaggtgtatcaaaatcaggagtgtaattgtgcacaaatatgctgcatcaacaaaatgctgcccttacccaaaatacaatacaaagaaggatatttaagcagatcagtataccactattactgaatcaagtgcaattctctatttgtaaaaaataataatgcaaagtaatatttcagtctagagctgctcaacaaatggttgaatagcttacaggcatatttcataaaataacactgtcaaatttaataggtgagtgtctacatattacagcagtcttgagattacttgctgatgctgatactgtgaaagaactaaatgaatcccctaagtcaacctgtggttctatattcttgccataaccaacaacaataacaacaaaggtaaatagaaatatttgagtggtatatgaaagaagtagaccaacctcatgacatatgccatagcacaactggagggcttcgtcccacttttttacttcaactaatccctttatgaggcaaacaaagacacttaactcaggtacaaagcctctccttgtcatttcactatacaatcgaaatgcttcctcaacttgagatgctaaacaaagtgcctggatcaatgaagcgtacatgtcattgtcagtttttacagatgacggaacttccatcatctctttgtgcaactccatagctatctccagcctgccagctttggagaaacaatcgatcagcattccataaacaggtgcaattggtactgtgccatatgattccatctcctccagaatacccagagaagcgataaagctcttgctgaaaccttgaattgcacaacggtatccttgtaagtactttggccagtaagtctgcttcatttcaccaagcagtaaacgagccttatccaaaaggccagcagcacacaagtggtttatcagaactctgtacgtaacataattgggagaacatccttttctgctcatttgtgtaaaaaggtcaagactcagatcaatcttgccagctttgcctaatccatctattagagcagtgtaagttacaacattcggactgcatcctttctcttccatcaatgacagaagctttagtgccttctcactttcacctatcctacaaagaccatcaatcatagctgtgtacgtaacaacattaggagtacaagaatcctttaacatctgagagagaactttcattgcaagatcaagtcttccatccttgaacatcctgtcaatcaacgaggtgtacgtatgtacactgggaaggtacccacactttgtcatctgcagaaatacctcctgagcactgtcaatttttccagctttgcaaaagccatcaataagagcatcgtacacaatgtgattgggctcgcaaccagaagataacatagcatctagtaattcatgagcatggtccactttgtgagctttgcataaaccatctactagtgcaccatatgtcacaacatttggagcaagtgtgtgtctgtcctcacatggaaagtaaaaatcagaatcggcgctatcagaagttccaattaatttggcatagacttcaaaagccttactgatgttgcctgctttacagagaccatctaccaatgcaccataagtaacatcatttggacgacagccagcatcaaccattcggtgaaaaatatcattagcctgaggtacctgcttagctttgaggtaagcatgaataagtgcagtatatgtcaccacagttggggagcaacccacactcctcatctcctcaaacaaccactgggcttgttcaatgagtccagctttacaaaagctgtcaatcaaaattgtgtatgtatacacatcaggagttacaccgaccatcttcatctcttggaacagaaggaaagctttctctaccttagtagcatggcagagaaaagtgatcaccttagagtatgtacttgtatcagggacaaaacctttcctcatcatctcctttatgagctgaaatgccttgtcaaacttcccgacaccacaaaggcatcgagcaaaattggcaacgttaaccttattaagaacacaattagcagccagcatctctccataaattttctcagctaaatccagcaaatcagggcttggtaatttctcctgaccacatatacttccaataaaaatattgtacacaacataaccaggagggcaaccacaagtagtcatcctatttaaaagtttataggcatacgcataatccttttcattgcaataactatgcacaagggaattaaacaaggatggatttggattgcagccctcagtcatcatcatattaatgatcctcttgcaccagccaagctgtttctttttcaaaaatcctgagagcaacgtcctatatgtgaccacatttggaatacatgagttgcatcgcatcctatggaggaatgacatggcctcgtcaaaatacgatgcctccatcagcccgctgatcatatgtgtgcataatactgtatcaagcttgaaatcctccctctctatcatgtctagtgcatcagcccaccgcccctctttgcacagagcgtgcgcaaagcacccaacggtgaaccggtccatgcagaaccccgactcggacatctccttctgaacccggaaccccaagtccacctgccccgcgctcgagagcacctggaccagtgcattgtaggtcaccttagacggcctgtacccaaagtccttcagcctcccgagctcctccagcgcctcgttccacatccctccgcggcagcaccgccgcactagcacattgagcaatctgccgagcacctcgcggtcctcctccccaatctccctaagcagcctctcggcatccctggcgcggccgtcgaaacccaacgcatccgcaagggcgtcgtagcatgcgcccgtgtggctgtacccaacctgccgctcggcc

SEQ ID NO: 2015 - DNA, 10363 bp, Oryza sativa
  unsure (1)..(10363): unsure at all n locations
cggttgcggtgacggtggggcctggagctccgtccatgaaggtttgaggggagaggggattaaaccttaggaggggcactcccgtaaatatcttcgtaagctggtagtggggcccactctccagtgggagaagggagtgtttctctcgctgagccagtgagccccaccacccgaagctacagcgccacacttccctcatctctctctctccctctccctctcctcctaggggggggtaggcggcgctcccatcgcctgagcggccgcgcaacggtagggcggaggcgccggcggtggctcagccgacggacaccgtgggttggccctctacgacgccatcagcccggctcaccagcctccgctgacctttaccgctccacagaccacagcaaggcagcaagaggtaaggatttttgaaacgaatccctttccagttctcacagtccgcttgccaattattgttgatctgaagctgaattggtcactgaatcaatggtagagtttgagatttcagaaatgtgagtttgagaatttgaagtatttgtgggggaaaaaacttgttatggttgtgcgtttcatgtatgaaacgtttttttaactgaacaactggctgcaaaatcgtacattcgccactactcgtagcatctcatgctacctgtttgacgtatttgcgcagcggagtcgacactgccaataggagttgctctggtgagattcagctttttgaatttatcggagactattgctctgatggtagttctgtgtggtacaaccgtacaaatagcctgaagtagttaagtgttttcatattctctgtgtttccctgtgcaatggtaggtgccgtgctaggaaagttgttagtgcctcgtaattgcctttgcccttttaccatacctgtgaatgacgatggtgtgttcaggtttgaaccaaccatactgcattaatgctttaggcttgaggatttaaattacattgaacagcttggagtcaatcacgttttgagtacattggaatgccataaaccactgtatagtgtatagtatactgccgtagcaaacaataagctattcccatgtcaggatgtttgatggctgtctgatggcaaagtattttcccatcaaacggaatttggaatgcctagcaggctaatgcatcccttcaatttggttttgaggcatattgtagaattatcaattttttgcattgtcactattttcatcgtctgttccttcagataatccattgatatttctgttagtcgttgtgttcattctttctattgttttctttctttcttgacttatctacttttatctgcaaacttgtgcctctcacacaacagcagaatccctaattgcatatctgtgttttattgaaatttttatgttcatgcagtgattggcacttttcaatggcatgtgcttcaaagacaatctctattggttttgccaacagtggtctatatggagaggcaaggctactgtcgccaagctacaaaaactacccaaggagatcctcttacaaatttatcaaagttcgtgcagtacagggaaatgatggtcgtcgaaggctagttgatataatccgaaccatccctgaactctctagaaactatttcagaagccggtcaaggagagctctttttggtggtatctcacttctgggaggcttttatgtggcgcagacaatatctctgtctttcggagcgttgggtgtgaacgatgtcatagcagcagttgtgtgtgtcctgcttactgaatacgtaactaagttctactacagccggcctaaggttaccttcccatttgctctcctcaacaacttcaagatgggtttcacatatggcctgtttattgatgccttcaagcttgctagctgacctgcaattcttcctattggtgctttgacatgttatgttcttgaatcttgaaaaacagcaaagatggtgaaaaaatagcatgcccccacgatgttatttatgagacgagggatctatagttcggtggctttcctcagctttgttctcctatgtgaaggcaggcttgttgctggtatagtttttgagttggtggatagattttcaaagattggtccacatgtgggtatactgtagtgtgatgataacaactatttattttgagattcagatcacatatgattgaagcccggtgtgtacatatgcaaatttcaagccccccggtcccgatcatcaaaaaacagctttcgtgagggtgaaagaaactaaaagcggggtttttttttttggagcgggggagaaatataatccttctcatttgaaaacaaagccctctcctttatntttacctancccacccacacccactaagcaacaccacaacaaaacaataacatgtatcgtatatgttagttttacagtaccacaagaacaaaactgacaaaacctcctctgcctcgagtaaatttcattgncagcaactacattgtttttcncctccccaccaccaccacccccgaaatgtttcttcttttaatgaggaaggacgagtaccaaccttgtgcaaagcaccagcccccacccgggagcaaacaattgctcatctcatatttttctgccctgctccaaactttgttgggctcacgaccagtttatcctgtctcacgttgatatgggctcatgtggctcatcgacctatgtctgctttcctcaacgaatatcatctataatcagtaacttgtaccatcactgagtagtatactgtatggcaactgatattttcatgccataattggctaaacattttcttatcactttagatcaactgatcaatcatgccaaggtaaccttcagattacattacacatcaggttgttgccaacattgagcaaatggtagacatggaactgtctccctcttttctctttaacaacagtagacagggatagatggctagtggccactagcaacacatgctgttgcctagctgagctcagctcatctttacctccccactgtgtgtccagccaccagcttaccgaaatgtcagagctatcctctccacttcctagtggccaagaaacttctcctcttatagagagatcaagggagtaaagagacagagagaaccaagtgttttgtgttgtagaccacactcccttttgcaaagaacacacacaagattcctaatcgtctcctctccttgctttgttgttgctatggtttgccaccatcacaagcaaccttgtgcattagttagatccagaattccagatctctcacttctttctcagtaggcaagcacataatcttgtatagggtagtatatttatttgttttcattgctgtttctgttgctctcagtccatatctgtcagtgggtcagtattgcatctgcctttttttttctctctctcttcatcgatctttatagatttgtttgggtgatgcctgggcgcagtggtttatcgatctcttccctgccttgtgctgctccgatcgatgcccgtgctgattcttgataatatacaacgcaggaatcgatcgataagcctctgcatccagatctcactttttgtttatgcgtatgagccggtacaggttgcctctttgttcttgttttatagggatataatcactgattgatatatttcttgggagtttagtttttgttctatgtgctagaagtatctcttgatattggatagcaagatttgccccttttcttaaaaaaaaaaagtggatagcaagatgctgtcttccaattaacccgccttgtgatagtttctcttgttattttatcatatccttaactgctgcgtatgaatatatacagctcgattaatggatcgttttttgtacaggcaatagcttgctttagcttaacaaatatcctcatattgctgctgccacttttgcaagcttgttttgtaaattacatttggatagttggttatgcatttgtgagttgtgacaaattacataaagttatggatgatgtattgatgttagaatagttgcctccaattgttgcttactccttttttttctttttgaaaccgaattattgctttattattggcatgctcagaacatattccactctattcatgagtgaactaaaatcaggacaggatcagaaaatcatagtctgcatttctgcaatgaccttgtatatcctttttgcctttgagctcgggtcctaaattccatgctgtatattgaacgatctggacttcagtactcctaaatgactggctgttgagtttattgcatattctgaagaaatatcagaaagcaatttgagtggcaacggtatatctacgactacttgcatttgttggattttctcttgtataaattgtcttgtctccaaaaagcattagtaggtggttgccaacattgttctgatgttttctgctgttctgatattctttgcagagaaagaaatttctactgtttgcccttttagacagtacttaatgatgtttgtttttggagaggaactttggagctatatatttgctgcttaaaactcaatcgcatgatgcttcttttgatatttctcaatttaaatggctacatatatccagttggatatagaggctaggtagaagtatcgttctctaaaaaggaaaaatgatgcttcttttgatcctttctgctgttcggtgagacctcgtgggcctcttccaaatgtttgcccagttaacctcggctatgatgcaatcctgaagcccatccatatatggatcgcaaaggataggaataagttcactttagatcccttaatatgaaagcgagttcgactttcattcttgtcccgcaataccatatacaatgggtccctcaactatcaaaaccgatgtaatataagtcccaaaacggtttagccggtagtttcagctgacgtaaacgcctatgtggttaatttgactcggtcttcatctgacgtggcacatgaatcaaaatttaacaatttaaaaattaaaacaaaatatacgggtccatataacagtcagtaaatttaattaaaaatagtgggatgccagtgagcctcacgtcctccacctgatcctctctcttatctatatcctctcctccggaagggaagatgccctcttcaagaggggagaatataaagaagaagagaggatgaggtggagaattagggcccattggcatgtggctctcactattttttaatcttattggtcaactaacatatgagtccatacaatttgttttaatttttaaattgttaaattttatttcatgtgcaacgttaataccacgtcagataaagaccaagtcaaattaatcatgcaaatgccatgtcaactgaaaccgctgtccaaaccatcttgggacctactccatctatccctaaaatacaaatctggacatatgcatgtctagattcatagtagatgtgtcacatctgatattaaattggtttttataggaggggagagtatattgaaccagttttgatagttgagagatccgttgtatctggtattgcggtttaaggacgaaaatcgaacttaatgtcaagttaagggacctcaagtgaacttatccatttttatgtttgatatgtaagcgacccatttttatgtttgatatgtaagcgaaccaaatcatttggtttcccctgcggagtacagcacagctcagctgattgcaaatttgcacaggcttagaaatgtcaagagcatgccctgtcagggtttgactagcttatattcctccctcatctagaaaatttgaagcttggagctacatcttctcccgaacaatgctgaattgctgatataaaactcagttcaactctgttattctatactagattagacatttttactgcagttgtttatatctctgctaggtaagcaaaagggccacgggagacatcaacctagccaacggggaagcaaatggcctgggtaactaatagcgtttttcgataatagactaatttttatgtgtcaacggctatcgatagaggaaaaggcagcggcggagcccaggcaggttcaggtggctctattgctgatcttacgcaagttatcactatagccgctccttttgaacagtgaaattttatatgattttcacgtgatctagctcaaatcctataaaacttctccctttcttaaggaggcttacaagtttaaagtagctatctccccgaatttgaatacaaattgacagaattattatgctcgcaaaatagaaaccgacacgaggtttaggccaacgaaacgttttatgctgcggtagccaacgagtagctagaaaacgcgagtgtgaaaggcacgcccgaattttccccttgttttaaaaagggggatttgattttatgtgcagctgtgaaccaacttggactgtatttagttcagtgcaaagtttgaattttaattgaaattaaagatgatatgactgaaaaattgtatgtgtatgacagattgatgtgatagaaaaggactgaagtttagatccaaactttaaatctaaacacaaccttgccgttgatttgagctaggttggtcttcgtgtgaaattgggtcagcgtcagcgtcagagtcagatcacatcaagatatcgaccttaaacagtttgcttgtttgtgtatgggcagaatctaggctgagggcgacaaggatgtgtggccctccaaatcctaacggtgaattgacgacagagtactcttgtcaaattgcgagaaatttgtgcaggcattcagcgtagtaatggtccaaaaacgtactccaaatagagactatgctaattatctttacaacgtactacgagtagctaggacaaagaaaccaaggtactcgtaacttcgttgaaatataatgcaacaaaagttcaaaagaaagcaaagaaagctcgtgcattttagcgcaggctttagacacgtactaagtgcaaatgccgaacgtgacaccacaactctacatacaaacgctcccgtatgcgtcttttgttgacttattagacacggctttttcgatatatatcgatggagagacgtgcggtgtgggcaggccgacagggcggtgtatgtgacacacgcgatgacgtcgatcccgtcgtccccagccaggcagccatgatcgatccagcgtttttgcacacgtacgcgccaaaagagagagaaagaaagcattttcaggaggcaaaactataatattcggccggtcatagaggcacagcgggggtgtttatctattggtataaagttttagcgtgtcacattagatatacggatatatatttaaagtattaaacgtggactaataacaaaacaaattacagatttcgcctgtaaactacgagacgaatttattaagcctaattaatccatcattagcaaatatttattgtaacatcatattatcaaattatggagcaattagacttaaaagattcgtctcacaatttacacgtaatctatgtaattagttattttttcgtttatatttaatacttcatgcatgtgtttaaacattcaatgtgacagagtgaaaatttttgccagtggatctaaacagggccatagtaagaggcaaaagatttcgcattatacgtatgtcaaaagttttgtcttcatttttttttattatggaaactttattaaaactcagtcaaatacaccaagataatacatttcaattaagcccgctcccggcctctgcataagatgcatatagccacacacaaagaaagacctacgaagacccctatgacaaaacagaaatattagtggctatcaatccgtagactagatcgccaaccatactcttgagtaaaaaaaaaactcttgtgccacctggtccaacatcgcgataccactacaatagtatcccgaagacccggtttatggaggatagcccagatgcgaagccaccggatgattaaagtaataatctgcaattcaatattcattatggagtatttttttagccataaaaacataaaaatatgtcattcaattcgtaagggcataatttcatcggatttttcgttttgctatttctgtagttgaatttgaacatgggacttcacacataggtgtttaatactattagaagtacgtacacaagttttccttttaattttcggtgatatttgctagttcgttgtgcataaaaatgcatttaaaggttgtgtgggtaggatactattggagaagtgggagcccgggttcccacctccaactgctcagggctctaaagatctccaaaacaggccacgtggggctgcatcccgctagtcacaagcgggactaagagttcagtctcttaattttgtaggctgcgccctaagatcgggtgtaagcccaaaaaaggccccaagctcggtcttctgttgactgctcagggcctctggcataccataattgcaattagacttgaaccgtcattccctcacgtcgcacggttgatctcgtatttaatgcaaaggatacgaatccggcagctatacgtggggtggatgacaagactacgcataatgcccgtgaaacaagccatcaacactcctgaattaccggggcatgggctgtcaagaaatgggattgattgtcacgtcgcttggccgggccccagaagacacggtgcgtccagcacactgtagcaggcaagtgaatccaccaagcgtcaccagcgtcctagtcacctaccctagctaggccacgcatcgacatgaggaggaggtgcccgggacgaccctgtcacactcaatgctagctccaccaagggagctcaggtgggagctagagagattcattgcgggcactatttgtaagcatgtgataagacttcacaggtctaatttcttcgggtgtcccatttgtaagtgacgaacactacggtattcccagcgaagtcaactataagggcatgaccaaggcgacagatgaggggatcgaacttcaatagctctagcgagaaaaagtttcataccctgtaagagagtcataaaaggagatcgagagaaaaacataacatgaataggatattacgttttgagtggactcggacatgtataaactgcttgcctctctttgtctcacgcgaccataacttgcgtctgtacatctattccctggccgaatcaactaaaaggatttatctgctactcgctattggagcttgggctatcatagacagattcccatacactcttttattttacttttttttttcaaaacatgtgcagttatcgtacagctacagttatatacttaggcacaatcaatttctaccgttgtatatatacgaaatgctatatactctagatacggttaatttatacggagagtaccttcatatacggttaatttggtcagttgctatcgtcagtacgtacgacatgctgtactggatcagtagttatattgcctacccttctagaagttgcggcgctattcaattcgcgtaaccgtagtttgacctgcgttaataaaattttctatcccgaatattccatgaaggaacacttccgcatacatcatggacttgtaggtttgatctccctctatcgccttggccaccaagcaattaacaagcttgcgcgcagtgcaaggaaattacttctcctaggcgaacaagaaaaaacaaactcatgctgctggtagagatgattgattagttattcttcggttcttcaggtgttgaatggttcaaagaatgacgagaaaataggatttcgagttcacgtgacgattgtgctagttacagtatcagggaaactgcacgcactcgttttctggtttgccgtttccctccccacctatagctagcggttgaactttcagcaacaaatcatattggtcagtctttaccagtaggagtacgtacgtgactactacgtgtgggatgattagcatcctgtctgaatcattgatttcgtgatacgctgttttaaatttggctgtgtttagatctaaagtttggatccaagcttaagtctttttattatatcaacctgccatacacacatgacttttcagtcacatcatctctaattttaatccaaatttaaactttacgctgaactaaacacaacctttatacccacccggacattaaaaaaaaaaaaaggtactactacttcccgaggaggaaagaaccgccgcccgccgctcgggtcgggtcggccggtcccccacgcccgcgcgcaaaaacaacgggacgaaattaagctcacacacgaccttgtacgttctttttttcttgggaggctcacaaagtcacgatcggtgcttggagcgtgcgccgctagagatggcgcgcgcggcaggtgacaacacatcggccggccggccggccgtcggcccgtcgcgcgatggctttcacgcggatgtcacggagt

SEQ ID NO: 2016 - DNA, 20731 bp, Oryza sativa
ttctattcgctcaaaaaataagttctgatttttatatatcatatcagataggatcaggggcggacctacggggtgtgccaggttggcactggcatatgcaattttttttgaaaaaacactagacgtagtatgcaatcaaaggatataaaaatagaatcttatcagaaaattatcatggtttgtctggagatcttgtaatcgtaaagaaatcaaatcagggaagaggaaaggactaaatgaagagaaacaatggggccaaaattcttccatcagaattagatgttttcttttaaaaaatatatatagtggagcgatcgttagaatggatacacccactgtaatttttctgggtccgccgctggataggatgtattttttcccttggaagatggaatggaaatttggatgtgatcctctacttatagagtacttagaaccggaaccggtgtagagtaataaaaggaagtgatagttggaaaactattctaatccctcgaggggatgttccctcgtttgctcaaaaactatctaaacggttatgaaaaattctggaaaaatttgacaacattcatacaacacatatatacaacttcacaaaatcttaagtccaaactcaactcacacgtcgagatataaaaaagacaaattcagcgtatgaatattagcgtactgtttatatctaaatttgtctttttttgtttctcgatgtgtagatcgaatttgaacatgaattttggtggactagtaggtatcattatactctatattgtcaatttttttttagattttttcacaactatttgcatcgaatttgaaagaaaaaggtatattaggggatatcccctcgagggattagaatccactcccgtgatagttgtactattggaaccgaacaccagatatgctaaaccataatattgtcagtcaaatagtctcgttatggtattataaatttgtatcaatatatgtaactatcagagatgattcaaagtaaaaaagtataataatttaagtacttcatgacaatgttctagcatcaacactgacaatatacaaggattaaacttaatgttcatttcattattatgcgtattgatatagcctttttttcgaatatttgggtgaaaacagtatatcacggaaatagaataaactctccactatttccgtttccatttacagacattactatatcagaataaataatggtagaaataaaaaaataaacagcaggtgatctggctaggaaattccagattattttcatttctgaaccacatatgcgtaaattgaggtccaattattatttgacatcatggtccatgtaacatttacccaaaagaaacaatgtgtcattgtcctagagcagtaatacaagcaatgtggtaagcttctgtggcaaaatcatcaactttcgcacaagatcacatgcttgtaagttgtaacacaacaaaaaaataataatccacagcaattaccaggtgaagaccgggcctacacgcaaggatttgcccggaggcttggccgtcgcccctccacaagaggatatatagccggatgttgccgtgcactcttttcagtattgcccgcggatcacagcataagcatcaccgtaatccgtaataagagcaggtacaatagcagctatataagccagctataaacatattttaaaaagataaaggaagagagagaagagcagtgggctacagaactgtagccagctgcagcacgggctccaaaatataatgtgtgtatgacaagtgggactaaatattaatagtattgtaagccaattttggatgaattaactattatattaactatagatgatttggagctaaagcacgcacgcacgtacgttccccgcatccccgggctcaaaacagcgaataaatcggccccggcaattcaggtagcacacacgacacgagaacgacaaaagcaaacatggcacggtaatctcgtccacacgcaggcggatgcatccaatccaatccaaaaacgccattggaatcggtgctgcgggcaaagaaagaatagttggtggcgtcggaaccgagtacgtattcgattccacatcgatctccaccaccctaccaggccaccaccacaccaaaggcaccaacaacttccacagatgctaacgctgctaacccccccccccccccccacacacacacacacacacaagcgaacaactaaccccgtcaatctcggacaagctgcattgtgtagcaggtcgatccccatttcagccgctcacgccgccccggtggccgggcgatgtttcacgcgcggaagctgcagcgcaggcggtgatcgagcgaacggtggtggaggagccaaaatttacgacgccaccaaccgcgcgggcatccgcgcatgtgcggccgcgcagtcaccactttactactgccccaaaacacttgggatccccagtacgatgtcagtttatggaagcctgatgagaaattgagaatgcattcaagcttggtaccatcacgcatttggtactggagcagcgaccagtggagtgggtgctgatgagtgaatccgagggctcctctctcggcgtgccaatggagagagggacggtggttggccaagtgggcaccctccctgagtcccggaaaactttcactgcgtgggcagctcaaacgcatttgtcagccacatggagcacagctatggtgtcccagagggattttactacggtgcattttgcaggagtaaaaaagagtttatataaacctttttttttgccagaaccacgtcgatatagaacggtataaaccttgaccttttaaagatagtgagtataagccttaacttgccaaaccaaactttagacatggtacactttcttaatcagttgtttgagttaacgtatggctaaccatatttttcatgtgacccacgtgttaaatacaccttttctttttctcttaagcttgtgtaagggtggctatccatacttcttgtgacaagtcagtaagtcacaccttatctgggtttaacaaagttaaccatcaatcaagcgaccccagtacctcatttccagccatggattatgttttctgtttgcataggtacctcattgatggcgcaagggcacttcaaagcatttactactttgagagaatgttgcagaaaaatgtacaaaaccgtgaccatttctattactcccactgaaaggaagtaacaggtattaacatcaatggctacccaaagcgaaatggaacacatggatggacacaacattaggccaattttgctgttcatcattccttatgtacactcttcagtaatcccctagcttgcatcgttgcacggggaaatgtatccaacaaagaagaaaataaaagggaaaggggaaaaatactatacagactgtactccattaaacacaagagcaaagtcgatttatgtactccaccgcgccgtactttgtcttaattatgtctattactaatagagacccccataataattctagtccatagaaaaaaccaaaatagctatgtaattttccatttttaagagagagaacgctaaaaaagaactcaataaatacgctcagaaaaatacggagaaatcgccttctttggacggatctctcctctgctcgccatcgccgacggccagagttccacctgcctccggcgaaggcttctccaccacacccgctgcggccccgccgtcattggccgcgaacacctcgttgacgaccttctcgacgtcgagcacctcgccggcctcgtcctcgtcctccggcgggggcgggatgaacggcgggcgcgccacgcggaggatgcggtcccagtcgacgccgttgaagaacgggtgcgccttgatcccgcgcgcgccgatgcgcttctcggggtccttctccaggaggcgggcgatgaggtcgcgcagcggcgtcttctcgccgacgagctccggctgcttggagaggacgcggtagaacgtctccttcctgttcagcccccggaacggcgtgcggccgtagagcatctcgtagagcaccacgcccaggccccaccagtccacggagaagtcgtgcccgctgccggcgatgatctccggcgccacgtagtcctccgtgcccacgaacgagttcgacttcgctggcgaccgcacgccagcggcggtggaggacgacgcggtggtggccgtcgaggatgaggacgaggacgacgccgaggccgtgcgcgaggtggacgttggcgacggcgagtccgccgacgcggccggcttcgtggcgccgaccgaacagaacgggaagcacgaggccgcccccggttgcctcttgcccttcgcgcggttcggggacggtgaactgggcggaggctccggcatggaatcagcaatcgttgcgtcctgctcctccggtggcggcggcggcgtcgggagcctcgtggagaggtcgaagtcgacgagcatgatgtggccgctgtcctgtatcaggacgttctccggcttgaggtcgcggtacacgatgccgaggctgtgcagatagtcgagcgccagcaccaactccgcggcgtagaagctgcaatcagaagcaacaatcaacaacggcgaggtggttagttaacccattcgtgcgcgggtgggtggcggagaagcggcgatggccaaacgggggggatgcgagaagcgtaccggatgacggagtcggagaacatcttctcggtctggcggcgccggagcgagttgaggtctccgccgccgcagcggtcgatggcgaacccgacgacggcgtcggtggcgaggacgccgcggagggaggggagcagcgggtgtcgcagcgacatgagcacgtcccgctcgaaccagatccgccggtgcccgtcctcgccgccgctcccgttcttcttgtgccgcgccgcctcccgcgagaccgccttgagcgccatggaggcctcctcctcccccgccgccgcgggcacgacgtggaacacgacgcccttggcgccccggccgagcatggacaccgccctgaggtcccccaggctgagctcccgcggcaacgccggctccggaggcgagggcgccatcgccgccgccgccatggctggcgaaggaccgcgccgatcgatcgatcgatcgaccaaccgctcgtggacgggagagaggcagtgaggaggggaggagaggatccgagtggggtcggtgcgcgagggaaagcaggggaggggggagcgtgagatattgggggggattatttgcggtttgattcgaggggattttatgcggccgccggcttccttggaggcgaaggcgaaaggcgagaagcgcacggtcacggtgtggttgagaaaatttttgaatggccgcgttttacttggattttttagtggtggtgttacggttttgaggccattgagggcgctgtgtcgcgtggaccggaatcatcgtctggtgcgatgcgaagtagtacaggggtttgtgatgtttgcaatagaaaaggggaggaaattgggggaaatcgggtggatttcgtcaggtctacctgggactgcggttgggggcctcgtcttgcgcggattttgttggtctttgtacggcttctagaagggccgtttggtcagaggcacgactacagtgcccagaaacttttactgctccgtacattcttttcactctagaagggcggtcgtcgaacccgtttaaattagcttactgcacccaaaatttattcagcttgtaaatcgcacataaaatttaatttttaaagcttaaattggattcaaattttataaatcgcacttaagttgtttactttatttttcgatatttattttttaaattgctaagaacacatatataaaaattttgtttacgaattacatttagttgtttgttgaatagtcgttacggcttattatgagtataagcgaaacaatcattgtgttaaaagttgaagggtatcagtgatatccgattataacgattttgtaatggaggttagaattaactaagttactcctaagtgttcattcaaaagatggaagaatgtgttttctttttttttacaggtatagctataattgttttgtgtgggttgcacctgacgggtaattatagagctatccatgtttcaatgcaataaatcacatgaatgtatttgctctctttttttttggaaaactgaatgtgtttgcttcatatgtgctaggttttggcgcacagtttttactagtgacgttatagcatttcagcaatcagagccaaaaccgtttggttagcctctaattcgctagaactagagcacggagctaataataagaataccactaaacttttataacatgtaaaagaatggatcaacaataatgtaaaaaagaatctacaaagaagaaaaaataatgttatgaaaaaggaaaatctagaaaggagaaaggcgtcattcacaccgatttgttttgcgtgtgagcttgctcctctagactctagctaatcgtgagcacacgtgaagctacgtcaacatctttagtagcaataaactcgtactggtttgaagtgtgaacactcatttttctaactaaaatttccttatcattggttgaaaatccaaacaaggtttatttaaacttttcatgtgtttcttgcacaacaaactttgtacccaaactgaccaggcagcagacctgctgttcagtagaaaaataaaatgtgcttaagaatctttacgtcaacattattcgcgtcttccagttctccatagcctgcagcttcggtgccttccgggaaattctaacatccatggatagcaaagaatgagatcgattttcgttccttaagagacacattcttttgttttaggtatgctatataaaaagtttaaaaaaatagagaaaatataacatattacgtgtgcccaagcttttcatgtacgcccatgtgcataacaaataacaaatatcaaaaaaaaattataaaaaggtatactcgtgatattaatgataaggaatttctggtggggtgacgtggaaaataaacgaagggttcattggatttcttgggagaatctaattttaccaaaatacatgggaggcttaggtttcagggaccttcgcctttttaatcaagcgttgttgagcaggcaagcatggcgtcttattcagtatcatgacagtctgtgtgcaagaatcctgaaggctaaatattaccccaactgtgagcttattgatgcagtgtttccggcagatgtttccccaacttggaaagctgttgagcatggtttggagctgcttaagaaggggttaatatggaggattggagatgggaggaaagttcggatttggaaggatcagtggatacctcgccagtcgtccctcaaattgtcgccacagaatggaagatgcaggcttaggtgggttcatcagctgatcaatcaggatacaaactcttgggatgctgacctaattaaaaatgtttgctctccccttgatgtaaatgaaatcttaaagattaaattgccacatcgtggaatggaggacttcctggcttggcattttgagaagactggagtattcacagttcgcagtgcctaccatctagctttgcacaaccaactgaaggctaatgaactgggttcgtccagttcgtcgacaagtggagaacgcaaaatatgggcaagcctttggacagctcctgttccacagaaggtaaaaatttttgcttggagattagctagagaatgccttgccactatggagaaccgaaaaaagcgaaaactggaaattgactcaacttgccgtatttgtggccttggcggtgaggatggttttcatgctgtcatatcctgtactaaagccgcggcactgcgatcgctgatccgggaggtttgggagctccctgacgagcgttttctgattcggtcaggaccggactggctgctcattatcctggactcaataaacgctgaaagcagggcaaaatttcttttactcttatggagagcctggtttctcaggaatgatagtgtgcattgttctgggaaagcttcagtactagggagtttgttattcctccagagcctttgggagtccctgtttatgagtacaagccaagggaaggtagacgataaaggcaaaaaacctgtgatgcagtctcggctcagttctccggacagccatgaaaggaatcacactacgactatgggatggacccccccccccccccccggccgatgggctgggttaaagtaaatgtggatggctccttcattcagagttcggaacctgctagtgctggatttgtcattcgtgaccacactggctcagtactgctcacttcctggagaattatcagccattgtggatcagcggaagaggcggaagcgactgcatgttgggaaggggtgaatctcgcagctgagtgggtgaaaaacccgttaattcttgagacagactgtgccaacttggtatctatgcttacgagctctggatttgatcgagcgcagctctgccatgtcctccggagtattaagttattactccaagctttgcctgattttcgtgtgcagaggattagaagggaatgcaatagagtagcccatgatttagctaaatttgccatgcgtacgaaccattcagctgtttggcgtatgcaggctccttcttgtgtttttggggctctggcaaatgattctaatcacattgatgagtaatcaataaagcgttcccttcccccgcaaaaacacacacacacacacacacacacacacatatatatagtcttaactttcaactcactatattttaacggtaagaaaataattttttttgacaattttaagagtatatacctattgaaatttttttttgttctatatatatgataaatttgaagataaaccttacatatagatgtaatactactaaaagtactataacttttcatataatttttatagaatttttagtgatatttgttagttagcatgtacggtgtgtgcacgtgaaggtttatgtgcatataataaattctaaaaaatattaagatagattaatatatgatatatcaccaacaacatataagtttgaattcgacctatacaattagagaaagcaacaaatttaaccataaattatgtgttatatttatagtcaaattcattatttttatttctgtttgtacaagttaaatttgaaattgtattttgtaaagtgatatatcacatattaatatatcatactaatcttttaaatattttttagatgatacgtaaaaacgggcgttccctttgagggactaataaagttttccagcaaagaactccattaagttctgaacagtgctcccagaaaaatgggggagaaaaatgcacatgtcccataagttcagtttcttgttggctagctgcaaaaatttgttgatatatttatgatctgataggaacagcttgaccgaaccaatgatgcggattaagcctcactaacccacaatttagactactccctccgtttcacaatgtaagtcattttagtatttcccacattaatattgatgttaatgaatctaaacatatatatctatatagattcattaacattaatatgaatatgggtaatgctagaaagtcttacattatgaaacggaagaagtagaagaaacaggtgccaaattggccacgcttgttgcattgggtgactggttatactgtggaatgtggatacagttcgaagttggatgtcatacgtcccagcattactacggcctttgtgtactactcatttttcttataaggttaattggttagctcaattcgtcactgttggtaactaaagcacgatgccaatataatcaacaatgcgttttattctattgagaacactcataatttctaatttcttttgacgggtcccgtacgtaactttgtgtaattcttttattctttttctattaatatatgaggcaaagcttttaccgtcctttcaaaaaaataatttttatttctacctagttaggatacacatcgttaaatccactcacatccactgatccacaagttttgcaatagtaaaagaagtgtaaaaggactatcaattcgtaaattagattaccacccatgacggaaagaaaaatgtaatttgtaccccttcatattttaattttaatgtatgacaccgttgactttttccaacatttgaccactcgtcttattcaaaaattttatgtaaatataaaaatacttatgtcatgcttaaagaacatttgatgataaatcaagtcacaataaaataaattataattacataaattttttgaataagacgaaaggtcaaacgtttgtcaaaaagtcaacggcgtaatacattaaaatacgaaatacggagggagtactgtttataataggtgaatgaattgaaacaaggggtttgttggtgagtactttgtacgtgcagggtggccggcacgacagtacgtcgtttgtggaattgtaggcctttgccttaaaagcgaatggattttgagacatttcagcaataccggcgttgcattctccgtaaaatatctgtctgaacatgcaaattaaagcaaaatgcacgaactagcagagaacaatcccagagcagcgatatggtattttctctgtaccattcttgtttaattacgccggtaaattaagcaccgacagtacgcgtgtgctactttttcctgacttttctcttccggaaataacttttgcttttaatagcactagtactacacttgaaaaaattagtaaaaaaaaagcatataaacaagaaagagcgaattatactatggccttgtttggatcctccgggctattaaatagcccccaagaatcttgctatttaggattattaaacgtatattaccgataaaaccgattccataacccctagactattttgcgagacgaatctaataatctatattaatccataattagtggctgattactgtagcatcacggtagcaaatcatagattaatatacctcgttagattcatctcacaaaatagcttaggggttatggaatgagttttcttagtaatctacgtttaatactcttaaatagcaagattctaaagagctatttaatagtccggaggatctaaacaggaccatatatactgggtgaaggtgaattcggacgcggggtttgacaagctcacgtcaacagggagcagtggggtggtgatacgagaccattctggtgttgtacaggcagctgccgctcgatggatggaacgtgtcccggatgccctgactgctgaagctttggcggcgaaggaagctctagagctagcgatggaagtcggctgtgatcgtgtgatacttgaagtcaactgtgctgagttgaaggtattctggaggacagtgaaggttttaaatcatgcattgccgggatctgtttcgacatcacagagcttgctaggagttttgttgatttcaaagtagaatgggtgcctagggaggctaactcagtggctcactgttgttcgagccttgtgtcttctgctgagcgctccatgttctggtttgatgatatcccggattggctagagggattagtttctattgattgtactcctatgaacaattaatgaaagctctgtgtttggtctcaaaaaaaagaattatactatatacctttataaatttctttttcgatttcacaaagacacgtactactacacaagtgcattaaccccactgaaactcacacaaatgctcccctaacccatctttaaagaaacgagaccaatgataattttttttgtctcactgaaatctacaaactctttctcagaataaattcatttttcatccattctacataaatcaataaaaaaattagtagagtaccctcaattttaccaaattctaatataattatttcctactttatctagtttttgtgtgtttatctcctaattttaaaaacttcaataaaacgattgtttaaaattcaaattattttagaacaaataagagagtgtaaatataatattattttagaacgaatgaagtaatcctttgagagagaaaaaataataagagagaaagacttttgcgtcggaagcactacgtggtgctcgttttacgtcagagatgagggcaagattacgcatatatatactgtatttcgttgtgggttggtgactctgttcgatggagactaaaaaagttcttttttttttcttgttatgcatgttgtcatgttgaggagtagaaataactaatcttttatagatagcgcgatgagatataattcaagctaaaaaaaatactactccctccatcccaatatattaaaacctaggatcggatgagacatttcctagtactacaaatctggacagacatgttttatccggtcctaggttttaatatattgggacggagggagtatcagtttgatggtccaaataggtcagcggccactggcattatccctctttattttaaattcactgaaagacatgcgtgccctgtacaatagcagtgcgtgatcatcagatggtccaaaagcagttcagtgcttctcgtctgccagaatatccgatctgagtgtgtgattgcatttttaattgtcctcgtaagcaaattttaaaaaggggcatattcctgacgagaaaatttaaaaagtgcacaaagttggtttgcttcttatttaactcatgtacttgggttcgtccctcggcaacaagagggaaatcatggattcctcatgatcaaaaaaatattcacgttcttcatttctatcatgtggctggataacaagatcaagatggcctttacaatattgagcatctcacttgcttttctgctcggtcaaattattccatggagcactgatggatcgtgtgcctaacaaaaataaattgtaaaatagaaaaggtaattacaagtggaaaagtgccaacttttgttactagatcgatcggcaagatattgtacacagtacactcctccggaagtggcgatctaaagtttcgctttgccctatcagtgtacgctcctttccttgcatttctttttcgtattgcgcttgtgttgtgcccgcaaattgaacagtggccattctatgggtgtgtttagttccacgctaaaattggaagtttaaagaaaaaagttgaaagtttatgtgtgcagaaaaattttgatgtgatggaaaagttgaaagtttaaagaaaaagttgggaactaaaccagacctatgactcaacagttgacgcactgatcgcacattggcaatagctttatctcccccacaaaccaatgagattctttacaaaggaggtacaaatcacttgaaagccttggagatatttttctctcttttttttagtgatagaagatgtataaggtcatgtccaatgcatcaccatgaagagtgatatcaagcctcccgattggagcgtggtctcacggtaccgaacgtgacctatagaggttatagttttctccacgcgccttagctcgaagacatggttggggtcacacattgggggagtccaaatccctgcgatgcgattggtcacgagaagaaagagaaatggtgaaggagaggagaggagggcctaccaggcagggactaagtcaattgccaacgagctcgttcgcattgacaagatcagatctaacgctagcgagctcttccatgccgacgagttcctccgctctgcgcgcttgtccatacttgagccactgtggccaccggactcgtcgctgtcctcaagctacggtagccgcggggctcatgatcagatctagcgaactcgtgaccatatccgccaaactcgactagagaaaggagaggcggcgctggattcggcaaactcggccaaatctgtcgccaacacctagagagaaggagaaaggagatgggggatatgttggaggtggaaaaggagagcagtgtggcggtggaagaggtgagcgttggacagagagctgaggaggagaggggtggaggtgggcaatggagtggcaaggtgatggatgcgttgagcaaaataaccagtgggcagagaaatggtgaaaaaaaggggaaaataaagtgggaggggctgacagtgggaccgtatggaggctaggggtacatatatgtagtactttttttcgttgttgtaggttctaaattataaaagttctagttagttcaatagtaaaaaatcacaaggaccgatacacaaatacttatgggctgaaacataaaatacaattgattgtggtctccattgtggctagagtggtttttgtgtgatcttatcctatgtgacacgttgacaccatatatcagtggttttcattgtacatgtcttaattgtactacgacaatacttatatccatctttttcttgacttaaaataatcttttggctggggaggagaagatgatcagctcgtgacaaatgctagacatttacaaaagtagagagggtggaaaaggaggagacaagagacgtctgcattcttgactggctatcctatacttacatcggaaaccaattgtggagatggaaagcgacccttgatgctcaagttggatgcagggccaactcagcctctctatgaatgacaaggacttgtcaatggccatcaggcgcatgatgatcccgtttttgtacatgcaggattgtactcaagtaaagccgtggtttgttctgaacttttttttttcaaacttctatcatttttatcacatcaaaactttcctacacatataaatttttaacttttccattacatcgttccaatttcattcaaacttctaattttagcgtaaactaaacacacccaaagttaaacatggtcatgtcaaccttgaaatgaacgaaaactgaaatggcattttgcatcttgcagtgtggaatttctgagtagaaatatgaggcatgggtggtcttgaaggcaccatatgggtgagcaggtcaacttggccaaagtagccaggccatggcaggtttcctccctagcatatcaccgcatcccgtcagcagggcagcgatctgcactgcccaaacgtagcggtggccggtgagttcacgttgtcatctccaaagtcacccataaactgcaacctgccctgcccccatctcgcaggaggaaaaaaggcgacggcgaaagagactccaccgaaatccgcacactggtcaccaccaaaccaccactgctacaactaactgtgtggcccgcgccccgggtgacaaaggccaaaccgccaaaccgccaaaccgcaccgcaggatcgatctcacgctgagacgctgagttgcaaccccacgcgacgcgcgcgggcgattcggctaaccgctaaccacaccgaccgagcggtgtgcccgtgtgcgcgcgcctcaaccgattcccgagccagagagcgaacgcacgggagggagagtgaggtgaggcgaggcgaggcgggcgggtgtggctcacggttccattgattagccgctcgcgcggcttcgactttggaggcgttgattacacgattgatcggtggagagcaacagggagctacgtgtactaactccttttccagccgccgaggtcgacgatgattgagcgggttcggggagccatgtttggctcgttggttggttggcggcgtcggcgatcgcagcgggtggtcctctcctcgtggattttggcttgacgacgtcacgacgatcgataatcggattgactcttggaaagcgcaagcgcgcacaggggcgcgtacgttccgtcgtgccgtccccctctcgcgtggcagcgtccgtcgctgcggatcgctacgcgtcactgtggattctggcacgcgagcagcgtgactgcgtgagcggagtgatatatcgatcgacgcccttcggagtacaccattgagatttttgatggaaatggcccgcttggtcggaggaatcaggggtgtatggaccaccgacccctattccactttgagttgaaacaacttgtttggtttcatgagagaggacatgctatatcccgttctctaatatagtaacttgtcatctctgtgctaataagaaattagggatacttcctgcctcgctaaatataagaatgtctactatttaagccaaagataaattatttcgatttagttatcaatactagttattttggtggaggtgtctgtagtgacttcgttaatcttaatttatattgatccattatttcgaatgcgctcatagatatatgtttataagagtgagcgtgcacgtgttgtgagcgtctatgtttatactatatctgtacaaagaaataggttaagagggaagatttcttttcaatcacctcattggttgaatttttaaattgattagattctcctaaatacctgattggttgaaaaatacttagatttttttgtcttgtaatccgggataaatttggatcttataaatgattatatttagaaatggaagaagcacatatgaaatcaagtcaataaatcttaggatggtcatatcatgaaccatctacgcgatttcaatatgatactaaaaaactaactatagacaagcaggggtgagacttgatggcaattggggcttgccggcttggggctcgaggactaaagttaggtccttaaactcattgaactcctaccagcatgtgataaatatttttgagatataaagcatctctagacgctggcccgtttccggctccacacatgtatacatgctataagaggtaacagcaggcaaatgggggagacatgctgtgtgtactccctcggttttattttaattgacgttttggacaataacacggtctacaagatacatcttttaccttatttttctattataatatatataataaataaatgcatgtttacttttattatagtactttaaaagacaaatatatatatgttgttctagttcctttaaactaaatatttttaaagttattgatggtttaagttataaaagtttgatctcaatcttatccaaaatgttaattaatatggagccggagggagtacttagttgcacactgtagctggagcgtacgtccagctacagatcatcaatgcccaagtgtcgttccaaactgttcctgattccgatccgctaagtcctggtgcaccgctgtcgttggaacgatgcatttagtgcctaacaacacgtccatgttccaggtaagtagcagcatcaagcaacgggagacgaaagctaatctgtgtctggccacgatgtcgtcctagctctatgactgaccaccacttctatcaagtttgaaccaattgtgtgcgtgcgtgtttgggtgaagaggattaatgcgtgtgtccggattagcttttatggttagcaccagatggtattcatttagcaacctaaccgacagtattgtggccaagctggtagctacatggaaagcaagcagtaccatgaatcagcactgtgtatatgtggcactaaggggatgtttaattgatgcctaaccttgccataactaagtttaggctagttgtggtatggtggcacaagtgtgacttagaaatagttgaccacaagtgtggtatacttagttctaaatttgagagcataacatatgggtctcaaagttaagaaagtgtggcataacacaattacggcagcaaaccaaacacatgcgtaagaaactgtggaatcactaaagtgtggcgtggcaaagtgtggcaaccaaccaaacaaccatttactctcgcaactgtctcagtgtgcacgaatcattcaaataggataagcgagaaacgctaaaggtgagtgtttttttttttcgcgatagatgatgaatgaaactgagtttatatgacaattatttgatcgtgcaaacaaatgaattaaatattataaagttgataatttgatctataaaaatgttttacaaaaatcgtgccgttggtatcttacataattcgtgttggtgcgcgtgataagatccaaacagatcgccacaccataaaccagttggactctgtgattaccacaacaatcatgaactattaacagaacgaatatccgaactttttcgtaaggatcggaaagatgagcttagaagggcaagggagagaatggatattgttctggaaggacaaaaaaaaaaagtactactcacaaggcattgccaaggtaggcgattgtcgattggcaattagcaggaaaattggaggatttaaagggttaggcaattggcatcatgtggaggtaacaaataaatgcacataagcttgaataaacaggggcacacggttggaaaatcctaataagtttgcgcacaagccatatattaatcaacaaacatcatcagactgtatacctttacatctctgaatgaatgcagtattggataagaaaatgctggacagtggaaaaaaaatgtcgtaaccatcttagttgatctcggtgttaaatattcacatttaaattttcacctgtcaatcagtcaatctagctaacacgtgtgaatatgtacatcatgttaacttgcacaaattaaaaaatggatatgaacaagcaggaatggctgcagaataaagaatgagaacaaaccgctactatcagggtgtaggcctgcactagatgatcaatgtacacgcacaaggcattgccaaggtaggtaggtagatagaaataagatgttgctttgctgtatatgaagtcgtcagatttcttttgatccatgcgtccggtgcctgcctagccagtctaggactgtcagtaagctcagcggaatgtagagctgtcgtcacagagatctcatgtaaacagacataactgctttccatagaaatatgctggcagcatgtgaaaattttgctccttcagtcttcagtgaagctgcattgctcctaaagtggcattcatatacattctctctatttgctttcagctgtactgagaacaactctatcctggactcctggtcagaccaaacgttctaccggtgaatcaggacaacttgctgccgtttgcgcttccagaactctctgcattgcatagtgacacctaaaatttaaaaagaacagtacattagaatagctctaggtttttaggataaatcaatgcaaatgtaacggcaactgagtgagcatgcaactttcttgtgcgcagataaaaggcgagtttgccaaaagccaactagcaaaggcataccattgaattgtcaacagctgttgaaaataaatggttactaccgcactccaaaggaatcatttttcaaaaaaggttactaactcaaatcaacgtgacattacaagaaaaccccagtctagaaatggagttcctattcagagtatgaatacttcacacgagaaatcaacaaaattatatttgacatgacagacaaacacgcatacttgactgagatgcacattaaacataagaacacaatagggactaaccatcagttcttcattcattctttgtgtgttgttttgttgtcatatggtccaacaaatttttagcaacatagccatggaaaaggtactagcaacagtacattggctactatacaaggtactccctccgtcccaaaatataacaacttttagcactcggaatttgtcccaaaatataacaacttctctatcaacattctctacccaaacaatcacaacccttccaccattcacttttcccatctacttctacttctcaatcaatcataacatctccccatttaattctacctatttttttaataactgtgtccaactctaaaactttttatattatgggatggaggtagtacctataaaatatgctgtattatgtgtgcatttcttataattaaatactgttcgaatcttacctccatggtaggtgatccgtaaacatcgaaggagtaacggcaagatcagtgaagttctccctttttgcaaaaaaagctttatatggtggttcacttccctgcaagctccagcatttccaaagagggaagaggcttcttctttgccgctctatatgaacaactaggcctggaagaaacatttcaggaggctcaactggtatatccctataagatgtgtgacgctgttctgaaccagaatcgagcccatgaagggaaattgtctgggcatcacaatcagtatgtagaccctgagagctcataacatctatggatgaattagacccattatacccattgatgccattttgcaaaattgggaggtctggctcagaagtacaaggtgcatcctggtgaggaaaccgtcgttcagtagatactgccctccctgtaatagtgaaaatgaattcagaaagaaacttgttgaaaattcaaatgagattaaaaaaaggttctgaacagcatagaagattgattcgagtcatcagttcttctatatttgtccaaaaggaacaaaagggtaagataaaataatttccttcaaatgtgtggtgcctagcactatagtcctccattatgccaccatcaggaccattatcatgatacttgttaacattcaaaattctgcgagcaagtttctgtatcattgctgtatcagctggagagttatctgaaagagcccttattgcagcagaccgcagcctcagaattgagttgattgaaaggcgagaagaaaactcatcattgcacacaatgctggaaaggaagaggaaacgaatactcaaagaagttaataaattgtcaagagggcaacacacatgaattgaaaccattgataaatgaattttgtaattgattcttagtttagtcttacgttgtaaccaattgcgaacagg

SEQ ID NO: 2017 - DNA, 1206 bp, Oryza sativa
ttccaagaactgtagcaacagacacccctaaagaatgcccaacaactcgaattttatatccatggcattcactgccttcccccaccagtgcaggaagaaatccaactgttagggatgacgaattatctgggttggcattgtgacaagagaagagcagattagccactatagtcatttattgtacttaaattaacaatattaacacacacattgcatctaatcttctaatatgaggtactagtttcctaaaaacaaagagtacatattctgctgcaaacagtcaaatattgcaatatcagacaacaaacagtaactagactagcacctcctgtgcagtcgttgagttgcatgaaaagctccctggcggactctagaattccaccatgtccataatgcggaaaggtagaaataactctctcccttgtagttgcaggtaactgttcacatctgaagaattagcagtgtcaacaaaacagattgtggacagtagatagcacaataaaatggccagcatataggtttgctccctgaaaacgttgcacagtttctaaagtggtccctcaacctcatgaactaattaattctcatccttctatcagttttacttcaagatattatacactcatacactgtactaaagtaggtcaaatagggatgcaagagtatctggtttggctgacccatttacccatcctaggccatttacttcacaaacaattcgaggatgaacaaagtggactgccaaattaaatggaatgtgaacagacaattaagtaaggtagatcaactggacaacttacgtccatcactagatcaaattatctgatttgattaccagtaacataaagcttgggtgtacatgttggggactttgacaaatggtgatatttcagatgtattttcctatgaaccttcaatagaacctccccattataatcatatttaccacataaactccaattgattaacacaataaaccctataatatgcaattgaacggtacaaaacaacttgcattgcatcgtgttccattgaaaaactgatcatatgatggcaaaaatattcaaaactggcaagtaaagttaattagaaaattagtattattagctccaaaaaaccagagtttaaggatcaaaataattaattttgaaatttcaaggtaaatcattttgggattggtcatggtcttctaatcatgtgaatgct

SEQ ID NO: 2018 - DNA, 8415 bp, Oryza sativa
  unsure (1)..(8415): unsure at all n locations
ttcagttccacgaactccaataacaactgtctttttgtcatggaggaccacgacaaagtaagcagcttccctcttgctctgcatacataaaaagaatcaaatcaagttcaatgattttactgaaaaaccaaccgtgctatgctctttatcaagtatggctgggtttcaatgcctcccttcaactgtaagcatgtctaatgtaacaacaaaatcagcacagtacggcaaacatatttggtcatccacattactctcaggctctcagttcgttgcattcccagagggcatgtatgaggtaaatgtggcaatgtgtgcgttgggcaaaggcctcaccagccaggagccatagatagtgaactggtaataacatggctagggaggagaatgagcaggagggctgcaaaggtggtaaagcatgatagagccttcaatacatgatttgcctctattgactaaaacatagggatgcttatctcttaacctctatttatgcaggcccatttgcctgggtcaccaagcatggcatgtatacatgtgccgcacatgacacagctacttaaggtatgtgaagtacattactgcaacctaaaggatggcttactttaaccaattcaccaaataacgtcgaaatgtacataattaggtacaggcgggatccataaagtagatatcaactatgagctaaagtaacattaacatgtggcaggttacaaatgtcacttggaacgattgcataattggctgaaatatatttttcatcattgcaattttagtttataaattccaattttatccaaactcgtgttacctggcaaacacggccccgtagaagtgctgcagctggtatgtgaacaaatcgaaggaaagcggcagcatgccctcgccaccagttgtcaccatcaagtgcagggcgcctgcatgaagaccaatatgtggatgtcatataaggcaagaacagcataagatgttcaaacttatctcaatgtaacagttggtccagttcaaggaggattaagcaaaataaaaatcaaatttagcttgcttcacattttaccgaacaaaatctccagctgaactggccaaaaagaggatcatcaaccataggggtatttggcaataaacacacaactgagaagtataagagagttcaggagatataccttctgcgcgaccatggagttaaaacaccttgtctgtaaacccatgcacatggaaacaaaatagggtttctcccaacatcaaggagaggtccctgaaataataccacgtcaaatgcaattatacaaggaagggaggtattaaacttgttccagttagatagtgtttccaaccgtgtaacatgcttcagcaaagggatgaaggatagcagcttcttgcataaggttcagtggcgcttccgtaaggtcagtttgcaaatgaggcaaattttcatttttctgtaatagtgcaagccctaaaacatgcaccgtaaaaatggatccttagtatgctctcaatatagtgacaataacaaggaattccataaaaaaatcatatgtgatgcttgtacactcataacagtttacattatactgataaaatagtttgtcataaagtgacacggcaatacaacccatgcggagaatctggtcctgtttagtcaactatccatggtaacctaaccgctagcaggcaactactcaaagtagaaaagatgaaagcatggtgctatgtaatttaactccaaacagagcagcactttaagctctgtactctttttgcatattgaaatttccgtggtctatcaagtaaattgcaccaaacccatctatatcctatgaagaatgacttatacatattcatttaaacatctgaattcacaatatatgtattatagatttttgcaatgagaggggtttcatcgggaacactgtattactgtcttacaatttactcacctccaattttctgtgctaaatagattcctctctagattttgtacataagtcatgtttttaggaggtggacagattgcacacatatgactacaagtaggtggtaacaaaaacggaagtttatgttggagttctgaatggtacaattgagcctagtagaatttactcactgcttattgaaaacctaaacacctacatagctgtgcacgtctttagaaggtaagtgacaaaatttagaatattcatgtcatcatgtgtgttggcatcaaatttaattttgaaagtccaaataggacacagaacatattcaatgtgaaagcaatgaatcagaaaactgacctgctaaaagttccaaatgtcctgtcccagaagcacgatatgcaaccaaatcacccagaagtcttgccacagagtaaacctcatcctcttccaatacggttctgcatcagtatgtaagacaactagctcatataggtaaataaatagtgatatttctcagcataaaaagaataggtagtgacctacagatactttgcacgccctaggcagcataaagcttctcgaattccatgatcgaacacttccctgtaatgagctttccatgccatgtcatgtgttgcatagaacgacctccaccttaatatatcagaacccgtgaagcattggacaacgaccacaacccaggaaagaataagaaacaaagcaattaatgctcgtttcgagacatgatcagcttcatcctgtcctagattgcgagcaaggcaggccaattattgaacagaattgatggagcaggacaaaaaatcataagcaagtaggcagtggataaaatactagtgccatcaaaacctatcataatttagtactatattaagtaaaggcaaaagttattgacactttttacccatatttttttttcatttggaaactctaaggggagaaggctccagtaatgtttatgtataaagtttacttggcagaaagatttcatctaacaaaggttcaccattcacagctgaaatgcactacagatatatgacaggatctgatcatctgactcaaacataccaaagaaacaggaagtggctcttctttcatttgaaatatctctgacaatgacaagcatgagataaattgccccaaccaattgcattgcacccactgccatgccgaatctagtccaccacaaccagcgtttatacctcacctgttgagcaaaacaaaacagaaatagcagtatgataaataagtgctcagtagaaattctactcttcttacacctactctagcttctatggcagaattcaaatatcccatcagtacccataaagaatattctgagccctcctcactgatacatcttaaaggatggtatccagattacagatttataatgctatgctagagagttaagaactatgaatccatgatcctcactgatatatcgtcaacaatattctccagatttataatgatattaatgcgtgttgtttattgtaaaaagtttatgattacctatatcaatagattaaatatgattacaaagttaatgaactcaatttgaacaatgcagaatgccaacaagtggcaggaaaacaattcaaatccacaaatatgatattagattccaattcgaaatcttaaccctaaaccctcatgtcaggtctctgtgatctaataaaaaggtgctcaagctcacggtcacagtgtaacactgagtcgcttcatagtgtttggctataagcacattgtcctccagccatatgcatcagataaaagctcttaataagatgtattcgcagttcatctaagcttaatacgctgtatcttagcaccattgacaactcccgtcagttacacgcatttgcattaactcgcctcaaaattctgataaatggtgaaatcaagtccacttgttcagattgatcgtgtctcaaataatcccgtattgtaaccatacctagacaaacaaacaaaaaaatgcgttggtttatccttgaacggttgaaccaactgaaatcaaagcacaatttatcacgactttacgatacgtcagagttaagccgagcaaatcacccaactaaagtggcctaagctagccggcaaggagctcgagttctcaccctgatctcgtggcgcgcaacggcgtcagcggcgaccgacgctgcggcctcgtcgaggtggcgcctcgcgatggcatccgccgtggcgtgctgcgcgcgcgcggtgccgatcatggcgagcacgcggatccccgccagcgcgggcgccgcggcgagcgcgagccccccgccgcaccccggtgggagcacgccgtcgatgaggtagagcccgagcagcagcacggccacgttgaggcccccgacgaggaacgagaccacccgcaccatcccgagccggaaggaggcggcggccgcgccagccgacgacgacgccgccgccaccgcagcagcggccacggggtcgccggcgcccgccatggcggcggccgcggcggccctccgtcgggatgcaggcggcggcggcggcgaggagggggcgcggcggcggcgggggaggagggggaagaggaggcgacgaaggtgggggaggagagcgggggacgaggcccgcgggtggcgaggatggggaggaggggctttctaggcatctctctcacccggccgcggcggcatggaaacggagagggtcgcggcctcgcggtggnttggaggcggccgcggaaatagaaacggggaaggctttcgggtcgcggtcgcgggaggtggattcgggggcggacgagacgactagaggagtcgcgcggcgtccgccgcccgctgtttgttctggtgcgcgagctgatgttatgactggcatgtgacaactggtttaaatctcctcctttttttttctccttctgaagctgtcccttcggaattcgcttttttagatctaggcttaaatattcgtggaccacgtgagtacttgacgttcattctaagcaatagtctctctttgtatactcctgcaatactttgtttgttgttactagcaaaatacccatattttactatggttatttaaatatataatatttgcttgttcgaaaaataaatatttgactatttcataatattaacaaatattattggccaatttgtaaaaattgcaaaaggaattatgggatactgggttggcagtggcagatccattgtcaccgctactaatacttcatccttcccagattctttctaaattgatcatcatataagtttatgcactaagactaaggataatttaaatcacatcaatcaacacacccattcttccacagagcatgcgtcgattaaaaacccatgccaattacaccctatcatgcacacagtctctcatattgcatcaattgtatttcgatgaaatccgtgttcatgcagttatatgatgagcaatttaagaaattttggattctattatatgatgatcaatttgggaaagagggagtatctttttaaaaggagtacataattgagattttgaaatgagtcggctgctaagggtccattcgatttaaaggatttttggaggaaaagtgaatgattcaaattaatataagtaggaattaacactattcactcatttggaatggagggttagggtataagagaagtggaggatttttccctttgccatagattttataggcataatataggaatctaaacatccactgtaacctctttttttttcttttcctttgttaggtccaaggaaaatcaatactcaagtgactataatttaacaacaacataagaaagtttgtttaatttaagaaaaaagttcaaatgtcctccaaaactttgtctaacaccctgaacattaaaaccaaacatccaatcccctaaattctacaatacccttcatattatcctccgaggtggttttagatggtggtcttccgtatttctaagcttaaactagtggtttttaaataactaatataacaaaattaggtatcatcaatataggttgtcagtttataccatacagtgatgccatactgctgttatgttggtacttgtgtttttaagtgagagcgaacaagtggtaaaatgaaatatcaaagtggagatctcatatatgtccaatatgtatatcatgtgatcaaactgattcaacttatatacaaattagataaaaataaacgctatccaaaatcacccttggggttatataaacaatattgtaaagtttagagggttgtatatctggtttcaaagttcgggtgctagatgggctttcaatcgaagtttttaagaaaaggttagtgcaacgtggaatgtatagacacgggagaaagatgggttaattcgctctgccaccatatcgaaatttttatgacactaattttttttggtgtagtagaagaccaaataattcaatctaaaactttgacctattgcgaagtgagcgtagttaaactggttaggttcccttgtgatggaaccaacccacctgagttcaaatcctagaattgacacggctaattactttttcggtggtagacaacgaggcgagataaggtgtgcgtgtgtcttcatagagttgactgtctaattatattttcggtggtatacaacgtatctcgaggtagggtgtgcgtgtatctttatatatgtgagtctcatagagttgactgtctaattatattttcggtggtatacaacgtatcctgaggtaaggtgtacgtgtgtcttcatagatgtgtggtatacgacgtattccgaggtagggtgtgcgtgtatcttcatatatgtgagtgtcaacgaggcgaggtaggatgggcgcctgcctctgtactgaattttggtatgctgaagcttagatggggatttggtaaagcgtcaaactaattaaaatcagcctaatacatcaatgccacttacaccaacaaaacattttgttatgaagtaaaatgattaaaaaaaacagtgatcctaccaataccagccaccctgtttcccagctttttctgtgagagcaaggaccacgtttttccaccttatatatcacatactatctagtcacaaaataatgtcattttagactctaatttgataagacgtaactttaaccaattattttgtttacagaaattaagaaaaattacctaacataaaagtatgtcaagtgtttttttaccaaaaaaaagaaaaagactttgatcgttgcttaattataatcttccctattgaccaccaatatcaccttccctatctatttgagttggctagcttctactccctcgattttaaaatataagattatatcttctggaacaaaaggagtaactagacaagtcaaactggtttaatttggactttaccttcaggtaaaaataccatctgatagtaatctttcctccattggctgaaatttaaaacattttaaccattttgactatatgatctgcatatataattcgtttttcagcttgccaaaagaacttgtcaaccgtttctaaaaaaaaaaagaacttgtcaaccctatgaacgaattaaacttctagacaatactattcgtgcttgacggcttattttgccgcgagccgttcaaaggaaaaacaagagtggcacgtccctggtatatcgccaacgccaattccctgtcgaacgaaacaggcgcgtgtgggccgcggcccatacatatcatcgcgtcgcgcctcgagtttgaactcgcgcgcgtcgtacgtacgtgtacgtggcatcgtttgtctcggctctctcagagcatctccaacagcctctccaaatctaactctccaaacacctatatagccaactctccatttgatttggctagtcaaactagttgttcactccaacagcctctctatctaccctctctactttgactctatgacgccgggacccatatgtcagcatctcccttcttctttctccccttccttcccctttttctcttttttctcgcgttggctggaagcaggcggcgccgacaagctgggagcgagcggacggcggccgcggccgcggcgcgcgggggccaacggccgcggcgagcgggggacggtgggccacgccgcgcgggggacggcggccgcgccgagcagagggcgggtggccacagcgagcggaggccggtggccgcaccgtgggcggggaacggcggcggtggcgcgtgggggccaacggccgcaccgagcgggggacggcggcggcggctagcggagacggcggccgcgccgcacgggggccggcggcggcggcgagcacctcctcctcgtgctccttccgtcggttgtcgtgtggggaactggggatggtggagatgggttgtgtggggcccaccattggctagctaaatagagtggccaaatttggctagtagagggagggttttggccagccggatggctatcggttggagaggctgttggagcatgattttttattagaatggctaaaatttagcttggaga

SEQ ID NO: 2019 - DNA, 4897 bp, Oryza sativa
  unsure (1)..(4897): unsure at all n locations
ggcgagcgcggtcacctcctgagcgcgcgccgtgccgaccatggccacgatcctcaccgccgccagcgcgaccgccgcgccgaccgcggcctcctccctccgcccgcagcgctcagtcacacccacccactcggccgccgccccggccgccgcgaccgccacgttcacggccgccagcgccgcggacatgcggcgcaccccgcggatccggaacggcggccgcatggtttggcgcacgcgccgcgagatcgaggagaggcaggccgggcgcgcgcggcgccgttctctgagtgcacgcgtgcatgtgcgggcgcggccgggcgacgtttttgtagcggcgcgcgcgccgcgcgggggtgcgaggcgtgcgagcggcatcagccaggccagccaggccagtaggacgacggttctttgcttgggcgacgccgaggcagaatagaatattagtatcacgtactgtacattgttttggccctgccaattggacgaggcgtttgcttgatcaggggtgcattgcatgcatgactgcatgccatgatgcattggccaacgtaaatgccaagccggagggtgtggcagtgtgtgcagtgcactcttggcaccggtacgtccaggcaggcaggagatgctgggagggcgtggctggcagcctggcactggcagctgcccgggcttcgcgtcggtggttggaggctgcttggagctcgcggagtcgcgggaagtgaggcatctattctaccgcgcagtgtcgccacaaaagctggaaagaaaaggaggaagcgtctttctttatctccgttggggcctcggggccgaggagacgctgacatgttagccccagtttagttagatccatgccggtttagcggtttaggaccataccggtttaatacaatagatggatgggccagcccgcctgcctattccattgaaatagtcctagtactaccaaaaacacagcccgttatccacagatggacgacttgagcagcccatttggcccaaaaacctattgagattactcctagtactaccaaaatcataacgaactgttggaatcgaatcacttcgccattgaaaaggtttctaaaaaaacaaacgtcaccattgaaaagggctggtgctgaccacttgatctacgtcggaacttggaagaacactgatacattgatcaaaaatagataaattaagacactgataccaaaaagatctaactctgcaaattctccaatactggcaagttaaaattagggtgtcgatgccattagctgatggcagctacacaaattattttctttttgtgtgacacgtcggtagcttgcgaatctctgcttatggatctattaatccagttgcgtcgctttcaaggtctcgtcaacctaattaagagcaaaacagtttgaagttcggctgtgccatcatgatataataataatctttgcgcattccgtcatagaaaaggggatatagtattatactagccggtgtcgttctttgttgatctgccttttcagatggcacgcaagggtaactttcgtaagggattctttcagctgaattcgcataatctatatatttcctttctttgcatgcgtttgctaggttacgtgcatgctgatgcttgtctccgtcagctccgatcaatctcgtacccttttcccttactcccccccccctcccctcttctctacaaagtgcaaacaaataatattcgatctctggcccaagctttctttcatttgcttggcttagaatttaaggtttgcatctttcagtgagccatgattccggcgtaccaatcacatatcctaggacgttcgaggacgacgcctccatatgctgcttggcccagttctccgaactttaacttttccatcactggtggagaaatgctttttagtcccggttcgtaaccccggacaaccgggactacgaatccgggactaaagatcgctatctttagtcccgggtgaaataaccgggacaaaagatcgatctttagtcccggttggtaactccaaccggaactaaagataaggtctaccaaccgagactaaagagggaataacagcagtacagatgggcatctttcttttttttcttttttattttctcccgaattaagtggcatgcatatccccaaatcccaaatcaaattaacatcccaaatccacatcacaaatctttaagttacttatacacataaatcaaatacatcgcaaatcctaaaaaaaatacacaaatcaaattacatcacaagttctacaaaattcatcgcaaatacatcacaagttcacatcgcacacaaatcaaatagatcacagaatcatgcaataaatcacaaattttaaaaaaaaaagaaaaaaagccacagaggcgccgctcggccggtcgctgtcgcctcctctccgcaccgccgcccgccgccgcgcaggccgccgtgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactctcatcagcaggatccgcttcatcttcttcagcaactgggggggaattatttatacagagcaagggtgagtacgggagtactcagcaagccatgggaaataagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgtaatgtatcagtctttaaaatttaaacaaggttggcacccggccaacagctttttcaacggccacccgggccaacaacttttcaaacggccacccgggcctagctcatcccatcagctgcagatttttcaaacaccgaaccccttttcacacagcaatttcacaagcagtagtcaaacaaaactacgctaggaatcacctcacatccgcccatgaccgtgggcacggctgttcgaacagtttgttaacctctgcaaagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgctaggaagcccaggggtcctccccgacaccaccccggcgaatccacatgtctctcggcatcaaggctcccctgataagctagttactcagccaggggtgtcccattccacccatgtggtcatacttgtcttatgtttggatgaaattccaaggaatcggtccttaagtgcgagagcgggaaaccgtacacccggtacgtttcccggtccgcggttttggaaattcatttagttcgcaagcgccgacccaggtgtcgggttttccaagtcttttgtaaaactccagttttacccaagttattactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtttcgggctcggaaactatacgcaaaacgggacaactcaacaaatggcgaaaataaagccctattaatgacctctaagcgtgccattagatagatctcgagatttgagaaattttggaatttgaacggagtcaaacggatttacggttgggaagatattgaatttctaagattattggatttttggtctaaaggaaaaggatttaattaaatccttttttttggaaaagaaaaagaaaagaaaaggggagagggagggaatatagacttccctcgggcggctagggcgcggcccgagagaaaggacggctcggccgagcttaacgggccggctggcccaagaaggcggcccagagcggcccaagacgcgcgcgcgcgggagggaggagagagagagccggtggaccgggctcaccatgcgcggtcccgggtgggacccgcttgtcagcggctcggctcaccgtgcggagggagtacgcggctcatgcgcgcgggtgggggagggacgcggtgcacgcgcgcggttcgcggtggacgcggatgcggcgggcccacgcgcagcctcacggctcgcggtggaacgcgcgcatggggagggactgaccggggtcggctcgacccggtctaggctgagctggcgccgacgtggcgcctacgtggctgccacgcgggccggcgggaggtagacgcgacccgaccgcgaatggacggcgggcggcggcggcgaacggcggaacgaaccccggccaaacgggccaaaacgagcccctcgggcggttggttgttattaagggaaaagaacccacgggttgggtttggccaaaggnnnnnnnnnnnnnnnnnnnnnnnnnnnnnnnntcatggactactg

SEQ ID NO: 2020 - DNA, 1671 bp, Oryza sativa
  unsure (1)..(1671): unsure at all n locations
nnnnnnnnnnnnnnnnnnnnnnnnnnnnnnnnnnnnnnnnnnnnnnnnnnnnnnngtcatgttatactatagttatatacctagtctagtttaattacttcctccatcgtaaaataagtgaatttctagttttttctttaagtcaaactatcataaagttgaattatagcaatcttatactagataagagtattaagtatttaccattctaattaaatgagtaaactataaaattatatttcggatttaatgatgctcattcttttttttcggggaagagggaatatatcactcaatcataatgttctcccgcactaaatgcgagataaaattacaactttcccccaaccaaaatccagagaaggattcagctctagccttatttgccaaataatggctgataatattcttacttcggcatattttattaacagagataaccctctccccaaccaagagcaactttgctcattcgatatcctattttttttttaaatgtgacaaaaccaggatatacacatatttgggactgagggagtatatatgtcatagaactcaaaaaggaaaaaaaaatacatatatcgatacatcgagtttataaagtgtgttattttttcatgacaagtttgcaaacactggtactagttgtattaattaattaatcaaatttgcattatcttacaacggggattgagtcgatcgaaggcagttacgtaacgaaatgttgaaaacagtgtgtggcgtatacgtacggcgcctacaagtgtacactagctagaagggcacagtgtcctagatcctctcttctcccaacttaaacagatcttgcagtatctttgcaagatattgatgagggacgatagagcaaggtttaatagtatagccatctactaaactccaattcatctatagccagtctaatagtcattcgtataataggtacatactacactattaatatctgatcccacctgttatacacacactgcgtcttggagttcgtgctacagctggctacaaatctatagcccgatgctcttctctctccttatttatcttcttaaaatcctgctattgtacctgctctaagcatgcatggcgatgaatcggagaccaggaatgcaagcaagctagctagacttcgatcagctcaattatattggccgtacatatatgcagacatcatcgtcgatatggtggttacattaatttgtgctgttctgcagtttgatcaagacttggttgaccccgttttaaatgtgaaattttgtacgtctgtgccgaatttttttagataatttgcgcctcaatgtacacttgcttcacaaattcgagttagtctctgtactttggtggccaaatccagggaatagtggctgactaataagtgtctcttcttgagttctttcctagcatatactccagatgacttaattaggtttagctcatgtttttttaacttttagtctatgttgcgatgcgcttcaaatctttttttatacacatctaatcagtggcggagccaagataaaattatagtgagggcttctcagccttttaggccttctaataatctcagacaaaatctattttagccctcttccaatagatatatggatttaaattttaggggggtgttaatagaggctctaatgattcattagggggtag

SEQ ID NO: 2021 - DNA, 3959 bp, Oryza sativa
ccccccagcccccacgctgcctccgccactgcatctaatgcatatgttttataccaaactttcaataaaaaaagaaataaagttttttttcttcaaaatcctctggaatacttgtcttgaaatcttgggcgcactccaggaaaaaagatggagtaggaccaaatcagttctttttactcaaaacttaatttatggctatttgattgtctcgagatttgggcatacgagagcttgcttcgctagccagctggtatacaaaatacatataagttgcattctaattactatagttacatgtgaaagctttaaaaaactaacggatattgtatagctactctatttgtaagttaaagtgccttggaggtaaaggttgttcaaaacttaaaaaatatgctccctttgttcttagcttttcttttttaaaaaagtcaaagaaaatgatttgtgtttccagcctctatcgttaggcaatcaatttagttcggactttaatttaaaatatttaaaagatacgaggttatgtgacaagggaaagcatcctatatgcacataagctttctcatgtatatatcgtgcacatcaactaataaatatcataaaatattcttaaaaaatatacatatactttcaatagtactacatatgcgtatagtgtcacatcttcaaattcattatacacagagagagaaagaattctgacatatttatagtcttaaaactgtcaaaattccttttttaggctggaatataatgaacttaaggttaaaactttacacatagatgtaatactattgaaagtatatacatattttttttaatttattgtgatatttgttagttgctatgcaatatgcataagaagcttgtgtacacataatacatatacttccatgtgacaaaccccatctcccttcaaagaaatgagttgaactaataaaaagacatcacataaatttctataacagaagtttataggaactagctacgtacaccacctaaagtaggacgaaagactcttgatcatagatttattgcaccactgcataaagtatcctgcaaccctgtaataacaccatagatccagagtgaaaccaggtagaagaaatggatataacatttattgttggatagatcattttaggatgcatgcaaagtcgctaatatactgaatttttttgagagatttgaaaacaatgttagtagatttgtcaaaaaaaaatctttgatttacttgtacttttatttttttttatgaatatatgaataggaaaacaatgaaccaatgatcaatcattctcgctggaaaccttatatatgttctgaacaagtaaaaaattaatgcagagtatgtaagatagggagaaactattgaagcaattacttttctctgcagagtatgtaaaaatgatttttggcatctaccattcagatccacatgcaagcctgtgacttgtaaattaaaacgactgaggcgttttaaacttaacttcgcttgatttttcaactatacttaattgaggacctccattgttgtgacacgtgtataattacacgtagccgtccaatgtcgtcatttgggagattcgctgaggtatcgaagtctcttgactggctccaaaaatacgccttcatctgtatctcccatgatgacgaactactaagagataattaagctaggctaatcagtgcctactaaatttaattgacgtcctggacaggtactaggatttttcttgctgatatatatatgaccacgttaacttggtcagttatatcacacttcaacagtaaaaattttcaaaagaaaatgtcgctcctcgatcgtacgtacgtataaattttgactttttaaccagtttgtaacaaattccataaaaattccaccaacatcctcatcttatgtgttctatcaatttttattgttaaaatttatgtgtatttgtaaggatgagtatgcccatatgcgtatgtttatatgaatatctacgtttatactatattttaagaaaaatatcccccacagtaaattgatttttgcgaggcctcaacgagtagactaagagcaggtataatagcaggctataaaccagctataaacataatttaaagagataaaataggagagataagagcagcgggctacatatttgtagccagcagcagcacagactctaagacgtatgtgtgtataacaggtgggatcaaatattgattgtgttgtatatgtttatacgtaactattgtatgaattagctattaagttgattatagatgatttggagccagcagttagctatactattaaacttgctctaagtgttagagattaatcaagcagatatgatgttaatgaactgatgcatgcaaagccagaccgatcgatatcatatcgaaggtcatgatcatcaatatatgatccgaggattaaacacaaaactcaagatctcattaggtacaaggatcattagtgacaccgatcgatgaaccatcagaagaagccttctagcttgtttgacacggccaattttaacttctccagatctacgaagataatcgaagatctaatcgtgtaccgttgacgatctctcatgctgggactgtctgacatactattatataacgaactcgattatcatctggattaatacgcgagatttcagatcagaccgaatcgctcatgatgacgatgaggaaatattttgcttgacatgaatggcacgagtttcttctgtgtttttatgacagctggttcagaaatattgacttaagttgggatcgtaggaagaagtaggcacaacgtttttctggttggatggcactgccagtcacagctgcggccacattgtactaatcaatgtactggtcctatgctttgcatcaatgtagtccatttgtcatgcacatgtaaaaacaaaaataatatttttccccacaaataataataataattttgattgcaaatagtactacgtcatattcacagttaaatttgacattgcatattaatttatgaaatatatatcatgtattgatctatatgtcaatttttgttttagattgttttagctttttttacccatgtaaaaataagaagatatccctcgagggatgaatagattttccgcctgcatgactacattgcattttcatggaaagggtggtgattgtcaatgtcatggcaacttgggagatatcttccattgatcgtaaagttgacaattgttagcaagcaaatttagcttctttcaatgaactggtaccctcatgtatatgtatatatacctgtttggctgccttttcttctagattacaacacttttgccggccattgcctgcacaacaaggtcaaaggagaaagatgtatcaaatatttgcaagttcgtagggtatggggaattttttaaaattttgaatgtttctaaataaattaatgattactcctacttactaacttcctgctatttctgaacgttggcacgccagtgtgagtgacaatcacgacaataatgccgcggctatgatggtttggccacaaaactgtgggcagctcccaccatggcgaggcaacatggtgtgtatttcaaagtaatttcgaagtaagtttcgtgtgtgtgttttctttaaaaagcttaaaaaaattcctaagctatgtatgcacatgtatagctagttgatgccacttactctcttctcttctggcgatacatatttaggcccactttgattcaaaggaaatttataggaattttaaaggatttcattcctataggaatttttcctatatatccctttgaatcaaaggaatgaatcctatgggatcctatgaaattcctatggaatgcctcttcccatgcaaattttggaggaaatttaacatgagtttctacctcattttaagaatcctttgagtctttctctctcctcaaattcctgtgttttttctacggctcaatcaaacg

SEQ ID NO: 2022 - DNA, 24399 bp, Oryza sativa
  unsure (1)..(24399): unsure at all n locations
aggaaaaacacatgaatggccgtttgattggaccgcaggaaaaacataggaatcagatgagagagataaactcaaaaaaaatttaccaagaggttagagtggatgttaaatttcctacgtttttcctctagaatcataggaataggaaagtttcctacatttttccttttctcatccctacgaatcaaaggcataaatagtgtagattttcaattcctttgtttttcctttatttttcctccaattcaaaggaggcttattaacatttaggatgagacttaatcaaaattcttggtcaaaagaaacagatttgatcaaaattttgacctttgattatcaatatatataactactcaaatgcttagtttaaaaataaaagaaatggtacgtgttgcctcggaaagcattgttatcatatcataaacttattagattttataaactaatataaaattgatgatagaaaatttaaaagctttaacccaataatatcctaaacgtgaaatatttatgaccagaaggagtaatagggaactcttttttcatcaaatagtgggggacatgtgttttactcctccctcggttataactataaatatttctagaattcaaattttgtatcacaatacaagcatttgtgtgtggattcccatgattctcattacttcaatgattcgaaaatcaatccaagtatgaagtatctaagcaattcaaaattcaaaaattggcaaatgaagtaactaaaaaggaatcatttgatctaacctctgctaaataatttagaaatccttatattttggaacggatggagtactagaaaagcattagcatttcttgtagacgatgcatctagcatcttattttcaaattcgcattcatttcattcatcccgtgatgtctttctctattatgttttttttataaataaaaaatataatagagaaaaggatctgagctgagcccaacaaaataaaagaatcagagctgagccccaaaaaaatagaagattcagaggattaaaattattaagaagttcgcaatcttcacatctctatatgtgcgactatcagttcatatactactactaataagtgaactcatcacttgccaaaaagaaaatgtcaactcgtcaggtgtagtgacatatatatgcagggactagctagtaacacgttgtgcagtgcaaataaactactgaaaattaagttttatgcaccgaatttgacaagttaacttaattaacaaatctacattaatagccatggtcaacagctgatggagcatctccagttctccaccgtgattaattggctcaacacagaaaaaataactgcatactgtattaacataagggcgttggaagatcatatttttccaaggaacacaatttagttaagtttcagtttataaggcattgaccgtaaccgttccaacttccatttcttgaggaaatgacttcttcaaataataactcaggggagatgtaccacatctataagttacttgtccacaatttatccccatattttatcacgtcttccaatattcaagagaaaaatatttgattacttgttccttgagttttccataacatgtttttttatgttactcagagatcagaaaaatgtaccatttatgctattggttagaactcattaggatgtagtcagttaaaatatgtcataattttgaattcaatcaatcattgagaagaagaaaattagtccaataaatcatatcccaaagtcttgctgagtgctgacacaccataaacaaacttataacgatataaaaagaaagaagtatctattccttgcttttttttatttatctatatttccaattaagatgaataacatgtatagcagcactaggaaattcgtagtcaaccagtgaaacgtctgataaacaatatgcctgtattatactttgttaatctccagcagtttgactacatttgagattatactatgaatgaatagtaaataatttccttacatatataactatatgatccttttcttcatcatgttggcaaataaatgctaatctttgtacagaggatatcattttcttgtaccaatcagattatttatcccagtctaaatgaagggaaatagggcttgaaagtgtcagatgggcagaactcttggttatgcatctcttgcagagaccaagagccggtccttccattatctagatagatgtgcataagcgataagtctagtgtattgactagaaaattagcgtgccacattatagcccgtgtgtacttgctaagtagttttcaaaattcatgtctataaaaggttggtaaatgaaatattcaatggtgttattaaccgatgcaacaagttaagctaaattagcttccatggcacttatgctaaaaaaaagtaactattaccctttaagaacaaaaaaagtaactattaccctttaagaacaatcatcaaaaactggataaaaccatagataaatatatatttacatgaattcactaagaaaaaaagcctgatactaccatagttgtatacagtcttttttttaaagaatacagtcgtttccggtctagcttctagctacggcacaaagaagaaacacaacaatgtagttacacaaaaaaatttcagaaccatagtctttcacatattttaaatccggaggtcatgatttcgagcaccttgtaggcggcaacaatttatatctttggtatcttgcatatccctagaaatataaggaggtgaacacaaattagttggacctatactgactatagaaggagatcaagagcaagagacaaggttaagccagattgttctggtgggctagtggcacagcagcaaaagctatcagagacatggcagtaaaactatgactatttttagattgaaacagcagttccagatctaaaggaaaactattgtttgtcaattgttagttcttattatgggtgcattcaaatgataatggaacaacctgttgataggcccatcaaagtgataacatccacccaacagaacaaaaaggatgggggagagggatacagagaaaaaaaaaatctctttaggaaatattttatctttatatatttgtcagataatcgcaaaattccatgttcagataacactatattttttccatatatagagaatgtggatagaaatataacaagctcatgatgtattaacttaagaatgtggtcatcatgaacagttgcaatcgatcgcaacttcaaaatttctgaagtaatactcaggacaatcccttgaatagaacaattgcaagttgcaatgagcgcactaaccaattatgatgcaaatgtcagtaaattgcgccacttttatagatcattttcttttgtcaggaggagaagtactctcgaaataaactactgagcaggattgagaccaaagaaaaaactatgtatcaatgcagaattattttcatgattataaatgttattagaaagggtattcagaagaaaaaatcaaacttgagttttgtcaagaaccattcctgattatgttcttctagcgcattaatatttcttttccagattatgctaactgtatatatactaatagctctaactcatgtataattcgattgctgctacgatggaatcagtaatacataacttaactcattagtaatccatataagagtttcataacttagcatcaaattctgcaatttctagttgtgtgtttctcctggatttctgcagaagtagtatagtagcaatagagcaattaatacactatccaacaaaatagtcctaactgtgctatcaaatgcaactctaagaaagaacaagatatattctttcttggtcatttcatcgaacaccatgaatgcacagttcgcactacaaatcagcaaccacacgttcaggaaaataaattgaacaaacattacactgtagcttgctcaccactgccggccatggcgacgaccgataagcgcgctctgctggccgccgagaacggccatggcggcggcggtccagtcaccgtgtcgttcaacaccaatgccatcgtcctgctcgccctcctcgtctgcggcctcggcgcggtcgcgctccacgtcgtcctccagtgcgcgctccgcgtcacgccgtaggctgggatccctgtcgttggctcgccggcgccgttaccgggagcgggaggcgtcgagatgagatcgattggaaggggaagaggcatgaggtcgatcgacccttcaggagaggacgagaagctaacctttttgcattttactccttcgctagatcatattttacattttagcccttcgcgggaagagcgtatgcacgaaccacgcagcgccacgtggcctcgctaatcgcacgctaatctgcatagatttcgatatatagagatagagatggcttgtccgctattgattagcaaatatcatatgtatttcccatagaattgcacttaatactattatattatcactttcagtactaggattattttatataacacacatgaaatacatttccttgtcttactaaactaacagagaagaggacattgtagttctaaaaaaaaaaagaggacattgtacctgaaaatgggcctccatacactgtacatgaaaatgggccaccaaaattctgctcggcttgctacctcactatcttctggaatgacctgtagcactcaaaagaaaacggataaaaaggatatacattagcaacacagcattcagcaatgcggattcttgatatttcagtttgattcaaacagcaagcaaacacactacagctaaaacagatatgacaaacaaaagaaacattacagattagcagaactacatgcttttcagcatcttaagcctccaagcagaaaagggtactacaatggtgtggatataagatattgtgagcaaattcagaagtcaggaattatattatggaaccaatacaagattaccaaccctgatcaacagaagttaacagaccaacccactacatccaaatcatactaacagcaaaacaactttatacaagaaaaaccttcagatcatttttctccagataatgtgagaaattatagtagtagtagtatagcatcccaacaggctaccgggtgtcaatactgtctgactaaaatgcaggcaacatttacgcaccaaaactgaaaaccattttctccaaaggatggaggatgtattatcaaaggtatatgcatacaacatttttcattatcgatatcaaagaacataatatggtgatacaactcagaagctgctacaaaagtacatgctcaggaccttatgcaacattctatggtattggggaagtaatatataatctataagatttgacccagcaggccttttccatgctttctcaaactgcatgaattgggctgttgtttctcttatttaggtcaggtccagccattggtgggttcacatgaaaagctgattgtcttgtatttgtcggtccagtaagctgaagggaaagagcagagggttctatggagttagagctgccgtcacctatggtaagcttggacatgccaacaacctcatcagccttattgatcacctcctttccattcactggagtgggctttaggatttcatgatttgtgcctgattcacccacattagcaacatttggaggccaaagagttagtggaacaggtattaatgccgggtagaatgttggcattgtcagaacaaatttagtcttgaaaggtgcagcatggttcatctccaagtctagtgctgctagtgaaggttctgtgaactcagattcctcatgcttccttagctgcaaatccgacaggtgtctagcaaactcaggttccttctgtttcacaagatgtgatattggcaattgatttgagcttgtggcttcgtcttgagtactatggagcataagctgttctacgaccactggggattcgtccatgggctgcaggttgaagatgaaattcgaacataagatggtcgtgatatagaaatatcaggacacaatttaacatatatggagataatagacacctcctgtctcaagcgaaaattgcaagcaaaaattgcataccatttctgggaccatgtcaaacaagcttgacctcctcttccttcttgatgagtttgtctgtctaatgaagtacttttgagcatggctagccacctgagttggtgtcctggaaacaacaaaattacgagagatcccacgccagtctcctttaccaagcttctgcagacccattagaaacattctatgctcttcttcagtccaaggtgtacctgaagcacaacatcagcccttgagttgaaactggactgaaaaatcccagatggtttctgtgaaaaaataatccacgaccccatttttttagaggaaagatcattatattgatagtgacctggctttttcagagagccaacagtagttcaacaaagaggtaaaaccaactcacacaccgagggttacacccactggatcattccagctacggagtacatgacaagctcagccaaaaaacacactggaactgcagggaccagcactgtagcatactccctctaacaccagaatactccccattcactagcatgtattcattacaacaaagacaaagcatcaatcactacttttgagcttgactacaatctcaagctttgggtttcttactttgtttatatataataaccatcaaccttgatgcatctcaatctagtgagtttaatattagatcagtaatgctattctctgtagaataatatgcatgagtctataattgattcatctgattccatctcacaaacaatggacactccagaaccacaataatagctttgtaaagaagaaagggtagataagtttgccttctattcagtactactccctccgtttcaaaatgtttgacaccgttgacttttaagcacntatttgaccgttcgtcttattcaaaaacttttgtgaaatatgtaaaattatgtgcctacataaaaatatatttaacaatgaatcaaatgataggaaaagaattaataattacttaaattttttgaataagacgaacggtcaaacatgtgctaaaaagtcaacggcgtcaaacatttcgaaacggagggagtaacatagttgaattctgggtatgcataatctagaatctctgttcaccaagatcaaccgctcaagcagcaggtttttccagcacaagaaaaatatgaaaggggaaaggaaaataactttgcctctcatcattaatacgattaagctctgaagctgcccaacttggatgtacatgctgcaagtcctccatagaaagtatggatatagactaaataatacagcatagcacttgtggtggacactcacggttcaaaggcctttcaatttttaaccatgtaaaaagaatgtccagaaagcatgacaaataactattggcaaattcattgccataaagttttacagcagaatcagcatgatgctgtcatgtagtagggacaggtgcttttgtttcaactaaagatgttgctcatacaagggaactccattgtgagttcccttttgagatttgttcttaattcttttagatagatggcttcatcccataaccactagcgccagctgattcataataatcaaaacagactcaggctctagcttggtctataagtaaactaggaattgcccctacagtttctttgaagccaagtgccagtaaagtctcttctacatgtaccaaaaaaatagcatatcactaccaaaccaaatacattaagaaagtacatagtgcacacctaggactggtcaaaccaactggaaaccaatgtggctagattccattaggatcaggtgattaaattaaaggtcaaagagacgtggggtccttagcccgggccagtcagtgtccctctcggaatgtgatctatacaggtcttcttgcgatgcacatgtgcacgtaacttaatcagatgggaaaagatatttagctaggttgattagtgtcggccattctggacggttcctatagattgcatcttcagcaatgatagcggccataccttgagtctagcgaacaaaatagggaggcgtgactattaaaacatgtctccgaattcattacaagaagatagcttgatcttctctacaaaattgtcaatcatttgttaatttcttgaatcaaattgggtctttaactctttgatatcaaaaggatacatctttttgtttctgttgatgattttccttatctttaatgttgctatcttggttgcataaaggatccgtgaaagtagaggaacataccacataccgacaaattaaaaggaacagtacattatgcgattcaaccacaaaattttgttttccttgcgcacaagttgcgatacctgaagcaatcgaactagaatattttatttcacaaaaaggaaacccatatttttccttgtcttggcagcaagaaatgaaaatagaaaagattcctaccgctcgctgagccgagcgtgctccatgaggcggtaggtgcatggaacgcgacgcgttaatcagaagcaaacaaacgcaaaacgcagcatttctacttgctcagttgattcaccaagcagaagagtatgaacagcgcgcagctgtacctctcgtcgccgcatttcatttcaccgagcacgcagctagcatggacaggatgcaagctagagtgtatgtttgaacggaattacagaaggaagaagaaagaagaaaaaaggaatctaacctttcttccgctcgccgcggccattcgtcgagcaggaggcgtgcgtggggtcgtcggacgcgtacccggccgcgccctctccccctcctcctcctccccttcccgttcccgccggcgacgaaccccctgacccaccgccactcccgagcgacgacgcgatgcagctcatgctcgcgctcttcttcatcgccacctccggcggcgacgtgagccgcacgccgaacagcctcaccccgcctccgcctccaccgccgccgcgggcggggcaggtccgcgcgttgtggccgttgttgctgcagtgcgagcaccgcctcgtcatcgcacacgcaccgtgacaccacgagatcaccaaaatgcgtcgcctcgtcgaccctcgccgccgccgccgccgcgcgcggtgggttttctccttctctatctgtcttcttgttcttttccggggaagatgatatttttggccacttaaaaagagcggcgagttgaagtgaaatgacggaaaaggacatgggctgcggtggtggggggcgggggtattttgggaattggcggcttagctgtggccacgagatggacaggaagcgacgggggcgagcgtttcaccggcgagtgaagcggaggaggcggacacgtggcgcctcccgccgccgcctacgacaaagtacgacgcttaattaaccacagtaaaactgcctacggcccgtactcgtaaacacaactttaactttttatttctataaaaatatttattgtaaagtgatatatatacttttataaaagtatttttttaagataaatctattcatatattttttatatttttaaactcaataatttaagagatattcatgatttatattcctaaaatttgacttaaacattatcttaaacgacttcctttataaatatagagagagtactttctttgtaaaaaaaactaacttctgaaaatgagtctgaaaaattatttatctaaacttattcctaaaatgttattttttttaatgaatggtgcattactctgtcttaaaaaaaatcctacctacgaatctagataatacgttagattcataaataagattagattttttttatggaggggtaggtagctagcttgatcacaattaaaacggtactccctttggttttaaattggagtacaaaatttttaagctttggctagtctctgtttcttaaacactttaattaatattgtacgttttagccccttcatcccaaaactctctccatttcttttttatttggcattgcttagttaaaaaggaatgaagggatatatgcatttttagattcttagcaaacaaagtgttctaatctctacagatagagctagctacttaattcttcatttatagtgagcatgtttcccaaattgctaagcggtgcaattttttaaaactttctatatgaaagttttttaaaaaatataaataagttaatttgtaagtttgtaataattgatacttaattaatcatatcctaatcactcaccttgttttgtgtgcgaagaaaactctgcaaccaaacacaccttcgaacgaagcctaagtttaacagaagatagtttcttttagtcattttagtggtaaaattttgaattctgaatagcttatgttccctttccaagcatctcactggctgaaaatgcataaattccatgcatatattgaaatcaatgtcccagaaaatgctatattatgatataaattttaaatcttaaacatacttatattttgaaacatagggaatatcgtaaatataatcagaaaaagatactatatatacatactaatttattcttatagaacttttacaaacactaatgtgtatatagtgttgcaagtacatctaattaaattctctataactctcatattttatatagtaaaattaaatggttgagattattgtttggaagagttcttttagtttcgtgtagaaaaccatgacgactttcattaatagtagttttgatacgattaatatatagtcaaccgtgacaaatacatattaggatatactagtaacaattgtacaatgattttacatttaattagcatattgacttcttgattttaattaaccgcggctgttacttgctcctgcatcttcttcttcaccaagacaacaacacacctctgaattaattatacagtagattctgccatattcactgcatctcgttgtgtgatgaaggtattgcatgcattgcatggagatctcggaatgaacgatggctagctagctacaactccagcttaattaagccattgacttgatgatagttcatacctaggtatagcagcagcagctttttttttcctctcctttttcccctatttttctcgacgccgtgaacgcacgtctcttatcttgtcgtagataaagaagaaaagaagatccatctatccatccatgctacgaaacagaattagaaacgcgtctctctctctctctctctgacttccttgctagcttctcctaccactatgaactatcctatacgctatagctactatcagatcttctattcatgaaagtcatatgatctttcttttttagtttttagatatatttatgagagtgtgatattttttttatatatatagataataatatgagtgagatttttggatgttttctcttctccatccatctcttccattgcatccatgcatccatgccaactaattatactcactagctgctagctatctagttcctgtctacagaaaagaaaaccttatcttcctctctcagcagcttcgtagcaagctcacaattcattcattttatgcatgccatggaatgttccagaaacgtacgtgaacctcatggaaaattacacgacctgctgtgcagtcaatacgtatgtaatacacgctcgtgctattactttaactcaccgctggaatattattacaggattaagggagcacatcatgttcaacttgcagaaaaaaaactgacttaatcggctccacacaccccaattcttcagataaaacaggtataaattaccgatttatctctctgcgtgtgtactgcaaattcagatatataagtgttagctcaagagcataaacatgttcttgcatacttttgactctgaattatttatttttcttcagataaaaagggggcaagaaactttcggtatctgtctgaaagagctagctagctccaaagtctccaaagtaggtcaggaacctctctgcaactttggagcatctaggatagcaactcacttgctcactccagacgtccatgtcgttttcataatcttctatcttttattttggatctcatgtataatctgaactctgtatgcactacgcaaagtgcctgcatgctgcgtctgtcatttattttatcttatcttctctgcacaggtgttcgttcctagttaaaattgacagtttgcaagctagtagtaaacaaatgctaatcattgagacgcaaaaaggctcagatcgatctcgatcgagcaagtagctagggaatcgagattaattactgttctaaactgcatccgctgtatcattagtgcgctgcagaatctgatttgctgtcaggagcgttcagtttaccggtttcagactttcagtgattctgcttgttatattctggcttagaagagatgctaaatcaaaaggttattatatgtgcagattttgtcttctagttccaagaattgccgaataagtaaacatagtttaattaatgagtgaactgattgatggttaccgaaaagattgggatgctaattcgatcaacagctcgatcccctgtagatacagttgcatcaagccgaatatattacacgaactgttttacaaaagctataacattcagtgatatttgttccattaattgtcaaaaggaacattgatttgtcaaatcaaaaggggggcatcagttcatcactgaagcatgcatgccttcacttaaattagttctcatgtatatattcagttcaggaagcccatatgcatcttttctttatccatgtgcaggccggtttagcaaagcaaacaactaaagctgggtcagctactgggcaagtgtggtcacgtgttctttgccttatcaactaaggcatggactgatcaaacccatgaaatgataaaacgcatgtgcttttgcagttgcagtgcctgttcttttcagcttttcagtaataggaaaaaaaaagatgagatttgaagggagagacgtccctccaaatatttttttaaaaaaattataagcgtattgaggattgaacacaggagttcagagttgaaaccacacatgacacaatcgagtgcatctctagtagtagaaaaaataaaaaaaaatatgaaggaaagagatggagaaagtgcggtgtatgtgtgcgattgctggagatttcggcccaggtttagcccaatgatacaagagcgacccaatttgccaaaattatgaagcccacctagctatatccaggtttacaaaatgcgataaccacggttattattaccgatgaaaatcagcgaaattcgataaaaaattgccaaccatttaaattttgattttacatctttctgggctaaatgcctgtctacagctagaagacctgcttggccagaaaattggccacggcgtcgaggatgacgtaggcacgactgtggtgtcggatcgctgtcatgagctgggaaactgttttaacaaaacagctcgagtggatatatatacccatttattatatgtcatctaaattgttatgaaaaaatagaaaaaatatgaacaagatagatcaatatataatatatcaatgcacaaatatgcaagttaaaattcaacttctacaaattgtaacaaaaataacaaacaaaactcaaattactatatgtatatttgcaattaaatttgttgtttttgttataacttgtagaagttgaatttgaacttgcatatttgtgaagtgatatattacatattgatcaatgtttttgaaaaattttcgtaaccatctagttgacatgcaataaacgggtgaacgtccactcgaactagaatccatctccgtcgtgagctctccctacttgctgtacttgaggctgaaagccgttaggggatgacataggggccccacactatttttttaatttatgtgatgagtggtttgccatgtggactcaacgaaaaccgtctaaaaaacaattgagggagacgtttgaaaaggttttaatagttagtggggtgaggatatccggtttttagagttaaaaggataacagtaagattttggcattctaacctatattgagggactcaggttgaactttttgcaatccgaatcgatttgatagatcgagtccgaattgtagcggattctcaaggcccgcaaccatactagcccactagtccgagttgctagaatttgttgactttcaggcccagtagaatctggagatttcaacacgagctaagcccaaaatattgcggcccaaatctttcagctcgatagactggccccaaatggaaaacgtccactttgactcccttaaaagtaggccgaatctaattcatacccctcaactgaaaaaccaaatgaaaaaccagataagataactcctcgaactattgaaaccagtgcaatttgactcccttagcggttttgaagggtggttttgctgatgtggcgctgatgtggtggtgttgaccctggtcttcatctcatgtgacgcctatgtgacaataaaattaaaaaaaatctgagagacccatttgtcattcaaataaaaaactattgtggagcccacctatcttcctttctctctccaacctttcttcctcctccctctctctctctcccttgtctctctcttttctttcctcttccgtggtgacggcggcgggcggcgctacccctgcagagacagcgggaaatggctcccactgtcgggggggggggggggggaggtggctggcgttcgggggcgtcagtgccgtccgattttccggcggagagcttcgacgaccggcggaagaagcaggtgttcgtccgtggccggatgcccagcgcggccgccgtcgccgggtacgtggtcctgtcggtcatgtccaccattgttgtaccgcgcctctacactgagctgaagtgccaccacgtcgccgtcgcctgcatcgtcgcgctggtgctcgccttctgcaacacgtacgtcaccagcgtcatcgacgtgaacatcgcgaccaccttcggcaaggtggtggtcctcgcattcggctcgtgggtggggctcaaggacagcggcgtggtcaccgggctcgccgcctacggcgtcatcgtggcgaccgtctccaccggctccgacctcacccaggccttcaggacgggctacctcaccctcacctcgctgcgcgccaccttcctcagccaggccgccggcatggcgctcggctgagtcatcaatcacgtcatcttctgggtgttccacaacggcggcggcgacggcatcgccatgctctgatccgaagaaatttggtgtcctgctcctgcgcgtgagcgtaacgacgtcaggaaattgctcccggatttggagcggattcttgccttgtaggaagatcctaacctatcatatcttattctacccgagctttgcgagcgtttcctgaaatcttcctgtgcatcttcaagaagtcatttatctctttccctaaaacgcattcggttccaaattaaggctgacttgtataaacgctactataagcccgtaataacacggtaattcttgtttggttcaaaatcttgggtaatgagtagtagcaagctcgccatcacgaggagacgtccgcgggactccaccaggtagcggacaactcggatactgctcgcctcgccggcaaaacgggtccacctcgacctcgccgtccccggccatcttccccgcacccccgcgccgtccttggcctcctcctgcagccgcacccgtagtcccgccccccgccgccgccacgaagaggaaagaaaagagagagaagagagggaggaggaagaagggttggagagagaaaggatgataggtgggctccacaatatttttttttatttgaatgacaagtggatccctcatatatttttttaattttaatgccacttagacgtcacatgggatgaagagcaggtcagctctaccacattagcgccacgtcagtaaaaccactcttcaaagccgctgagggagtcaaattgcactggttttaatagttaggagagttgtcttatctggttttccggttgatggatacgaattagattcaggctatttttaagagagtcaaagcggacttttccgccccaaattgcatctgtttttaggtgggctagctactcgtctgaatcatggatgctaaagattagcagagggatcaagcacactaatcacgttcatttgtgtcggaagacacgacaaatcaatttttgttgattgttattatccatcgccacgtgcagagtgacgtaacgtgaatgcacaggagactggtgtttggcgtagcagcatgtgattagttagttagccgtcgggattgtctacactactgctgatataatagcaaacacgaatatgtaaattcgaattcatatgtcaaccactgttgtcgcgtcagcaatattgcataggatttgcatccaaagttggtgatgaacaagcctcaggtacaccctggatcctagagtatttggtactacaagcagatgcagttttcgtttcttacttttgcaaagtcggaaaaaggaggagagtacttttggggttacaagtcaacatgagtcaacactactagagactgcgcacatgacaaaggtgacagataagagagaacaaagaacaaagaaagttcccctgcccatccatagttgatcagattcggacgtgacactaaaattcacaagaagaaaagaaatctataaagttcttaataagtactgctagtattctctctattttataatatacatatattataaatcgtttgtctttttcctattaaaactttgttaagtttaataatacctttttaaaatatattttgataatatgtttgttttgtattgaaaatactatttatttttcgataacttgatcaaacttaaaaaatatttgattagcaaaaagaaataaaataatttataatataaaacagagggattaataaagaaaaagaaaaacacaaatatcaatgaaataaccaaaaagaaaatccagaaaggggaggaatttttcttggcccaaacaccctgaccgtccgaggccaccaagaaagaaagagagagatccctttttgctttgcgcttttgcaaacccttttccaattcttcttctttgcgcctctccaaccttcctccgtatatatcaatcatcgcccaactccagctcccaactcccttccctctcctctcctctcctctcctcatccggagacgccacgccgacacgcagctgcgtgtgcgaggaggaagaaacccagaggagcagcaggagcgaagcaggaaggaagcagaggagagggaatccaaggtgagggagggagagcatggagtgctccatctcgaggacgaatctgaattgcatcagcctgggtgacccggacaccaagaaatcggtcgcgctcctcaagcaggtcttcttcccttcttggaattcgcgattttctttaggctgtactactactctggatggatggatggatggattgtcttgacactctggataggatagcagaaagcctggagctttcttcgttgagaattacgatcatcgctaaatttcccatctttgtgttactgctatgctagtttcttatctgtacctgtccagggttgtttttccacctccataaaacgttcttcgattttatttttctaataacaacaaggtactctagcatctaggaatctgcgtgttacaaccgtttcttttttttttttgggtccatgtagcagttcattgggttggtccgtagaagtagatttctggatttcagctatgtgcatcggttcaacaaagaaaacgtgtcctttgttattgtttactctgcttggtttagtagagttatttgcactgatttgtgctaccctttgtcaactgttgctttggcctggatgctaatacctcgtccttagcatgattgcaccttaaattaaggattagtagtactaaagatttgctgaggtgagatgagagtgacatgccatggcctgcctctctgatctactatccaactgccatggaagcaccactgaagactggcttctccgaccttccacccgatcctgggcgatcccggatcgagccagatattgcctggaggcccttctccctatgtttgactcatcctagatgggttcacacttgtcgattccggtcaaagaaaaaagctttttcacggtcccatcacaccaatctacgcaacttgcagtcgtcgagcttggatggaccatgttcggtgctacttgtttggtgtagtcatatcattacctggatttgtactacattcattttcgatcacaattccccactgtgcaaatttgacctcagtttctgttacatatgcccagttttagaagaatatcaaagtacaacgcgttgcgtggaattattctagctgtaccattacattagttatctcatctattagtcagttaatctgtgccatttgtctaaactattaatgttcatcttacctataggaactgaatgagaataagatggcactttgcagtcatatgcataaacttctaacatcatagtattatattcctagttctactaaaactgtccaaggactaccatttgtgccttgagaaacattttacaaggttagaagctgatatagctaagttttctattatcgtcagatgaaaaatatagcaactgaattacatgttctatcagtgctgtaagtgggtcattaggcatgtctttgatgtgaactttcagacttcattgtcactgtgctctgctggttctatgtattttaatagtttttaaccatattttttcctaaacaaatgtttcatccttcttcataggcatgtctggattcaggcttcttctatgtggtggatcatggaataagccaggagttaatggatgatgtttttgcccagagcaagaaattctttgaccttcccatcaatgagaaaatggagcttctccgggatgagaagaatcgaggctatacacccatgctagatgagattcttgatccagaaaatcaagtgaatggtaataatatttaactcctgcatgtgttgtttattattaaaattgcatgtcatgatgtactgacatactcttggttttgagattattagcaagctattaaaattggtagcaacagtacctcccaaagaaaagttgataaaaaaaaatgttatgcatagacagctgccttgagtaaacctcatttcattttctacagttatgtagtttttcctgctccaggtttcatactattcatacttgtgcattttcaggtgactacaaggaagggtattatataggtattgagataccagaagatgatccacaagcaaacagaccattctatggtccaaatcagtggccatccgatggtgagttgtctttcttctgttattagaaaaaagaaaagatctcttccaaaactgaatgctaatgaataaaatacacactgtctaagttattccatctatactatgctgttatgaacaacagtgcagtgaacaatatatacatgtcgaacttcaccagctcaactattatactcacttcgttacaaaatataaggtattttgattggatgggacacatcttatatccaaattcgtagtaccaagatatctctcatccaaccaaaataccttatattttgggatgaagtgagtatgttggtgtggcagtaaatccaccgaataagcttagcatccattagaagtactaaccctttgatctacaattcttatactttggtacttgataggaaggaaagttcctcggaattgcatggttttatttacttattttgcaaaattttcccttgcattatttcagaagtattgccaagatggaggaaggtgatggaacagtatcatagcgaggccctgtaagttttggacatgctgaacacacaatcaaattacactttgctatatatggatcagttcaacaattaatattgtcaagtgatcagtgatgatcaattaggtttaaacacttatcaactagccgttctctaaacctgactttgcagcaagttttggtgatgctctttttgtatgatttattactgtaatgatttgatttgcattctaatgaattcaggagggtggcaaaatcaattgcaaggattattgcccttgctctaaacctagaagaggacttctttgataaaccagaaatgcttggcgagcccatagccacattaaggctcctgcattatgaaggtggacaaaaaacaggtcatgcattcttgccgttcagtattttattacacaagaaacataacgaattctgtcgtttgatgttccttttttcatcaggtaaagtatcaaatcctgcagagggagtttttggagcaggtgcccattctgattatggcctaatcactctactggcaaccgatgatgtagttggtctccaagtaaatgcatcttgaatcgacaccttatcaaatgtttcattgattttcgtgacttctaataaaatggtagttttccatctgaattatgcagatatgcaaggacaggaatgctcagcctcaagtatgggaatatgtagctcctgtaaaagggtgagcttgctaatctaatcacttagcaatatttatgccaaattctgatttctgtgttggcagtataaaattgggatgtatcaatcataaggtattctacggcctatgccaactgttagtgaagatccttacatgttttccctctattttccagaggttttattgtcaatcttggcgatatgctcgaacggtggagtaactgtattttcaggttggccaaaccatcccttaaagcatgttctttggagtcattgtttttctttaggagaaccatcttggtgtcattgttttttttactaactgttactgttctttattataatacggctgtctgcatacctgtaggtcaaccttacatcgagtggtcttagatggacgagaacgtcattctgtaagtttcttctcatacataaatcttcatacaagatgagctaactcgttaacggcgctgcaagcctctacaaatcttacaaataaatcgaatggctttaattactccttttccaattcttcaaacagattgcgttctttgtggaaccaagccacgattgcgtagtcgagtgcctgccaacctgcaaatctgaatcaaatcctccaaagtaaggacacattccctttgatgatcacaattcagcccatgtccataaccattgttcatcttcaccggggcgagaaacataatgtgtgttccattgtccaaccaggttccctccgatcacttgctcggcatacctatcgcagcggtacaaggatacgcatgccgatctgaccgcttacagcagcaacaaggcctaaaaggccaagcgccattttgatctcatccaagctctcagctgtacttaagatgtacaacctgcaataataatcccttaggatggattgatggtgttctatactaattaaattaatcccagtgtacctgtaaccccagtctcatagtgatatagtagtatactagtgatagtacattgttcatgaagtgaggagtgagcagtggcatctgtttttgtactaccatatgtgtgggtgagctccagggctcatgcttttcgctgtcgatttcccatctgctttggggcagatatagctttcgagttggatgtgtggataattctggtgtctgcatctgttttttggatggttggtaggttggtccggtccccgtttgtggttgtggccgggatatgcgtcgtgaacgcgtggctgcgtctcacgccaggaactgtgcgaaatgcgtagcgtcacggtgtcatgaggcgtcgagatctgggtaggaatctgccctttcttttggatcaataatttccagttgcacgctattgagcttgtggtgtgtgcgagagtaaacggaaaggatgactacaagtagaattgacacttctatttgggaatttaccgtgtacagtacttgcatgtgacagcgatttcagggtcactaagtagtagaattgacacttctatctgggaattcgatcagtagctgtcgtagttatttcattgatgtacacttctatttgggaattcgatcagtagctgtcgtggttatttcattgatgtgctgcaaatcgtactgatcatgcaaacggctcgttgcttcaaaggataaggatgttcaattttgattagttatatctctctttctgttaggtgccttaataaatgcttctggtggtagcagaaatcaaacaggtcagggaagggcttttgctgttggggaaaataggagatttgcggcccattacaatggggactaaaactatgtgcttattgcactcattataatcgatctaaagaatgacaaacactggtggtacacatggagattgcttccataatgttacaactgatgatttatatagacagataaaatgccttgcagcagcagcaacggcgacaatggcaacacaacatagcagtatctctactgcattggagacgagcgaacggagaaggctgcgccgtcgttgagaggcagcaagctataataggcgccatctttgtcgatgcagcacgcatgccacttcatcttgtatgaaccctgaggaaattcagacacatccagcaggcagctagagaatcccaccccactgtcactcgcttcgaaacgcgcaaatgctgtcaccatatccttctgctcaacatggaccttcttcctccttttcttctccctcttctttcccaaatcatcctgtacgaactgcataagcttggtattaagaccaaccattccagcagttttcttgcgtatctcaaactgtttgcttcttgttcctgttacatctaagcaggaggatgctgagcttgcagctaaaacgcagtatagcttcgagatatcaatgtcactcctctctaacacacatttccactgcaagcaaagggtcagggaaagctggaaactacttggtactgatatcccgtctctgttttctggatttgaatcatataaatgaagttcagcaccaaagcaaggcctgcatgatatatagtaaacaagttaaccattattacagatctccgtgaccgatgcattactgaaacacaaatttcagagaggaatggtgagatatacataaaataaaactctgtgatcatctacctaggcacatgtggcttctgaaaaaaaaaattaagttatccagcatggtgaacttctcatccacaactaattttaagagaacaacatgcatacgataccttactctgaagaagtatttgggtagaacaaatggcaattccataaccctctgcaaaatgttggacagaaattgcatcccttcatgcaaaggagatacactgtcctctccagtcgctattcctctggtgtccccacgtaagcgaagcaaatatgccacagcaaacttgcaaagacgataagaatccttttccagaatacctgaacaattcattcttgtgacaatctgtatggagtgcacttcatcacaacaaatgggcattaattgttgcagttgtgaaacaatttggctatcagtcctatccactctttcatgtaaatcttgtacaactgaagcatgagaaaacctctctggaagcctgcaaggctccacactactatgtacctttgagaaatccacagaaaatgcaatacaaaatgccagaagtgagcacatgaaagcaagcctggctatgctagaaaaactttggtgatccatgtccccatgggatacagcaagcagatcataactatgtgccagttcacttaatcctaacgaacgattcaccaaagcaagtaattggctgttattatgctctctaggtacacttgaatggtctccaatagcatcatgatgagattcgtctctctgatcagttaaatctgcagtaaggataccaagaaaatctgctaggatctcaagaaacgatgccctgagactaataaaccacctctggaaaaacagctcatgacttgaagaggtgtttgataagaggggatcagtagctaagaacgttctgctgcaaatatcggtaatctttgcttgggaaccatgcaactctgaagagtcagcaagactactgtcaacatttgtttcaacccagtaaaagttctcatgaagatcgcaatctgttttaagctcattgaccaacttaatgatagctgaagggaaaagcagtagcttcatctcaatctctccagctgaaataagcagcaatgatttgaaccaaaaactgaaagagcctgacccaaaatcatctgcaagttttctgaagacagacgacgccgcaaaccagaggccttcncgacaacagtacataaaaaatctataggcatcccaatacctctggtttctgaaaagcatttttgttatccgaattgcacacaactcct

SEQ ID NO: 2023 - DNA, 33463 bp, Oryza sativa
  unsure (1)..(33463): unsure at all n locations
acttgagtgtccaaagaattatattatgcactatagatacttccttcttgctactaaattcagcggggtcgaattttaacttatcaaaatctgttcccatgtgagaagccttcatactagcagatactggcttgacaatatcatttgaagtgtcaagtacttcacgggcagaatttgtttgaaatgattcaacattggcaacagaaacttcggagcaatcactgtcatctagtcgggctagttcttttatcaggcatcttagtttatcaagagcaacagcagcagcagaagggtagcacacaagaagttttagcatactgcttaacatagatctgtacatcttgaattcagaggacatataggtatgtttccttattgtttccttgtttccagtgcttattatttgattgaccagggatatattatgatttaccattgatgttacatcttatgcacgaatttgtcctccgcattttcaactgttgacaggaagttgctggtaatcccttgacacccattgtatgtcaatgatgaaccttcctgagtaatcatgttctgatgtgaccttgtttgctgaagaaaacataaggtgccagcaataactttaagagcagtaccttgcattctccaggaagagaatgcaaagaacttcagcagccagaacaagcttagatagctcacaagtattgactaaatgaacaatnggagctttgcacagactatcttgaaagtttttataatcaatcagatatantgaggaaaaagagatgtctagacagcacgaacagtaagaccttagtgttcaccttttgaagaaccataaatgcttttttcttacaatcaagtgggaaatcatcatcatcaattagctgtaataacgtcccaaaaacagtctttaaaacaggaaaatggcagatgcttccgtgaaacatgaaacataaacatttcaatgacacagtcttcatgcaatgagaagattcatgctccaggaacaataacagcaattccacctgaaatagaaaaatcgaaataaagtttacttttaagtcaattcacaaaggaaacagagagcattggtattaatgcccccagcttctcagcaagagggtaaaaatacatagctagtaattctaaaagaaatttgaatcacctgattcttgattgtcatctctaattttaaaatgtgactaaggtgtcctttagtagcatgccaatcacaggaaatgacacaaggaaatgggatgcgattaatagcatcttcagatgtttgagaaaacacgaatcaggttataaagtgccaagcattcgaaagaaagagagtatatttacttctataaacagaaaacacatgcatatgattattgcaaagtgaactaaatgatgtaacacagaacataattgcagcgatgagttagaacaaattaagtcaaatacatatgctaccaactagtggattacactacctgattgcaaaacagaacaactgatttggatgccaatcttgaaagtgacaagagcatgtcagctttgaaattatcttccaacgtgcccagaacgatctgctttccaacctgtgacatcaagagtgaaaatgcttctttaaaatgtgatgaaaacaactgcaagaaaaaaaatcagagatcccacctaagattggtgtataaagcaaaatatatcattagtcttttatgttctactactccatttcagaaaactagccagttttattggtaggtccaatttcacaagataaagtcgacagatagcatcgagactatcatcacatatttacctatttcatagacttattttttcattggatgttttcagagctttggtcttcacattaacccgtaatgcaaaaactaacttacatttgtactccctccattcctaattgatcatcatattacatgagtgcaccaagaccaagaaaatataataactctctcatgctacatttactttagcaataaacttgatgcatgcacaatccccactattttctagccaatagcaaatcaaaacacttgtgtgtatggatgcatgaatcaatgctcatttaccccaatgcacaaataacgaatagacttaatgaatgaacacaaatacgatgatcatttaggaatattttcaaaaaaattatatgatgatcaatttggaatggagggagtaataactaacaacttaggtgttcaaggactagattactattgttgtaaatcagagcaatgtgtagttttaaattttctttccttgatgattccttggagtatgtgcacatgattggtaggcatatggagtattgttaaagcaatgaatccgtaagagtgagaaagcaatgtaaatgttgggcaacttaagagtaaataaaaaaagattaaaaaacgaagttaagcaagaaacacgtatatccatgaacacctcatgaactctatggataacagccaacgtacagtcaagcttggggaaaatcttaatcgctgccatgataatttgaggttgtgatgttggtgaagaaattaatcttcgaagtgattcaagtgtaatgtatgagaaatccactgatagcctagaaaaacaggcagctgcaaacaaagccgctttgacctgccagatgataaccataataccataataattaggtgagttgagaaatcccaagccaaattagatggattattgaggttattacaacctgtagcgcattggaggaagagaaggtggagaggatgagagagcggaggtggaggctgtggtgggcgaggtgggcgaggcatccgaacatccgcagcgcgagagccctggcccgcgggcagccagcgtcgtaggcggccttgaccctcgcgagcaccgccacctgatgttggggttccgccgccacgcatgccatggtcatgggcagcgagccgtcgaggccgaggaggaggagggcgcggaggatgcgggcccggacggcgttgtcggcggtggcgaagtgggtggcgaggcggaggaggatggtgtgggcgaagaggcgcggttcggaggggaggacgcccaaggcggaggcgaccgcgggggggacggcggccggcggcgaggctccgagctcccggagacgcggggcgacggcgtcgacggcgcggaggcgcgtggctgcagggagattgattatttgagatttaaaaaaaaaagaaagtgaggtgagggtgaagcctccatggatggaggggggtttactctactcaccggggtggcgggagcggagagccctgtcgaggtcgatgctccattgcatggcggacgacgccgccggtaacttgtccatcgccgccgacgccgacgccgacgatggcggcggaaacctctttttgtggagaggcccttgtgtttgtcttgttttacgggttcctctccttttctctagtggccgataggggtggaaacagtaccgaaatttccgggatttccggctgttttcggtttgaatcgaccgttttaatcggtatcgataattattggagttgtaaatgaaaataataacatatttcgaaaatagtagcagaaataggatagagatttttctaattatttggtcagtaaccgtatttgtataataatttccgttaaaatttagagaaaattccgaaagttccctggcggcccggccagcccaacccattgaaaaccaatgaataaagaaagcctagcaggcttgcagcccatcagggagggaaaatgataaggggaaaacgttgttaaccctagcacgtagcatgtggacttttctgaactttggtctttttcaacttatcgatattgaaaaattgttgaactttgtttatattgtttgtcgaacttattgttatatcattaatcatcatatattcatataatggtattacgtggagtgttatggtgcaagaataaaattatgaagtccccttcatgtatagttaaatatgtgattatgccacacccccattgtatccgacgtgaattttttactttcaaccagcatcggttaccgatccaactgtccagcttccaatatagcaatatcatcgatatgctatcgctttcgggtctaccatttcgattccgtttttgagaaaaaaaatagaaatgaaaatttcagaccgttttcatccataatcggaggagatggggcatccccacccttacgcgccggcggagcttcacctaccgggcttcgtgcctctgcaactgtctgccctaccttgccacctccatcttcgtcctcctcgccgtctggctcatctccggtacgctgtttattccccttcttccctcctcattctgcaaccgtccccaaatccaatttctctctggaattcagagtatatctttgatttgcttcggagtaccaagaccggcttgccgatttcccatctgctttggggcagatagctttcgagtgggatgtggtggatgtgtggatatttctggtgtctgcgtctgcttttggatggttggtcggttggtccggtccccgtttgtggttgtggccgggatgcgtcgtgaacgcgtggccggcgtctcatgccaggaaccgggcgaaatgcgtagcgtcacggtgccttgaggcgtcgagatctgagtaggaatctggttttcttttggatcaataatttcctgttgcactactgagcttgtggtgtgcgagagagtaaacgccaaggatggcatgttgcaactggctagtatatactccatgtaatgtaaatacttgcattggacagcgatttcagggtcaattcaagtagaattgacacttattttgggggattagatcagtagctgtcatagttatttcaatgatgtcctgcagatcgtagtgatcttgcgaaggtctcgttgcttcgaaggatgaggatgttcaacttcgattagttggatatctctttctgttttcctgtcttgatgaatgctgttctaaaccatggtacgttggcattggggccctggtatgttctgtttctggaagtttgaagaggtcgaacagggcagggctttgctgttggagagaagactgtagagatatgctgcccattacaatgggagctaaaactatgttcttattgcactctttataatcgatcaaagaatgaaacactggtggtacacatggagattgcttccataacgttacaacaggtgatttatatagacagatacaatgccttgcagcagcaacggccaacggcgacaatggcaacacaacatagcagtatcccctactgcattggtaggttttattactgcaaaatttgacctccgcggcgttaccggtagctgcggtatacgggggtgtacatgcagctctctgcgtatttctccagatccctgggttgaggcagccgggtcgccagtcctgcacagaacgattggccgtgtcagaggccacggttttttggcacaggacctggatggtcgtggaaagtgtgactagagtaaacgacataccaagttcataggcttttgcagccacgcttgcggcaatgcgagcagaaatctttctgatgtttgtgaagggcgggaagatcgatcccttctcaaagttctcctgagtggcctgatcagctagtgtttccgctgtttacgagaatggaattagttctggtgtagtactgcggtacgcgtcataactgtttcggatttgagcaaacattcgactgagtacttacaggcagctagaagcatatcctcgtgaacacggacagctccagagattacgacaccgaggccgaatccagggaaaatgtaggcattgttcgactgttgtgaatagcgaatcaattagtaacagtcaatttctattttggctttgctgtctcttggaataagtatttaagcaaggaagcagtacctggcctggcacatgtatctttccattgtactccacagggtcaaacggactgccgctggcaaatactgcacgaccctgcaaggatacggatggatcatcatgagttatgcattatcacgttttacaaaatcatttttttgtgctaaatatgcatagcacgatgtctctttagtaaaagttggtagtcaaatggcataggatttaaaacagtgagttcataatgccagatgctcaacaagtacagatttgcagctcacctggctccaattatatgcttcttcagcagtacactcagagtgtgatgtggggtttgacagagagaaaatgacgggtcgctgcattttgggatttccaatatcagaagttagccaatcatctggtaaataccacaaagttacaacttgacgacaaagatgtccaactaacctcgttaaaggaagccatggcctcaataacttctttagtaaaagttttgccaactccggatgttccaatcagcacagtaggtttgatggactacagaaagaataggtaaacattaaccattaggatacaagaaaacaagcataaacagcacaagtttcggcaaaaccatcagctaataattgaataaatcttggatgtgcatcagatgaatacctggacagcatctaacagtgtcgttacaggttcatgctcatgtgcccaaggctttttaaatgcctggagggattcttttcgtgagttaacgatcaacccctacaaaatagcacaaattgtatggtgttaaaactgttggatgcagaggtgaaatgttgcattaacagcattctattccttttggttctatacctttgaatccagcagccaaaccttcttgcggcactcctcaattggagcctttgtctgaaaaccaattgagaccagcaaagttataagccgtaagtaccataatgaattattataacagtacagcagttagattgtgaaacactatattacctgttttgaaatctcaagagcaatgagttctgcaataccagttccagcctgcatgcaaatgcatcatgttatgtgtttcagggattacgtcatgtttcaacagttgagcaaagattacaataagccgataagagaaatcttgaccaacctcaccagcaccaaggaacaaataagtgtgttcagccagggttccaccaaccacctttagtgatgataaaagacctgcaaggaccacagatgctgttccctgcaatccatacattttggtttaatttagagggcaacaaacagaacagtggaaatttattctataagaatatattgtggtgaaactaaaaatatcatggctcaaacaacacaagtggttcatttacctggatatcatcattgaaaacaagatgactcttgctgtattttgcaagcaaatcaaatgcgttgtgattggcgaagtcctcaaactggcacaaggaagattcagtttcattagcccttatattatgtctattatgaaaacaatgaaaagatcaaataataaaaatatattttactatgaggctggggcagacctgtatcagaactttctcaccatagatttgcttaacggcactcataaattcttccatgagctcatggtactcctgccatcaaggacaagacaaggttcagatcttaagttgtcaatttatacaacaccttcattactccaagcaaaccctttttggtggtaccttgccagtagcacgcctttgccggagcccaatgtagaattcatcattcaacaattgctcattgtttgtaccaacatcaatcgtgataggtaaacactacaaagtaaaagtgcaatttgcaaattcagatgatttggctgttttacagttttctggtagaaacagccgaaaccataatgtaatggatatgaatgcttacagctgacgggcgaactcctccaagggcagtgtacagagaaagtttaccaacaggaatacccattccctgtaggaaagatcattgcaacaacaataagtaaagtttctgaagtaagcaactaatcagacaatcatacctgacaacccaaatctccaagccccaaaatgcgctcaccatcagtaacaacaataacttgaatgtttctctctggccagttccttagcacatcaagaacctttcccctagaatgcacttccagtcagtccaaatcgaataggtagagagaataaaatcaacacactattcttggatattcaagcaaagctaggcaaacatacttgtccttcaagctgacatagagaccctgtggttgtctaaatatgctcccatacttctggcaggcctcacctactgttggtgtatacaccacagggagaagctcctccacattatcaatcaaaagcttgtagaagagcctctcgttcctctcctgataaacacaaaggtattattatcatatcttcaacatgctgttcctccacattgcccaatgcccagtcatttttgttaaattgtaaatcattcaagaagtcatcaggtaaaaaagattaatttggattacctggagatccatcatggccatgtaacgctgcaaaggtacactgtactggcgaagattatgcatgatcttcttcacctgcacaaaacattaaggagggcttaaaataaacgccacagagtgataaacaggttatagttgcttattgatgtagctcgtacttgaagatcctgagacacaactgccggaggaagaaggccacgtaagtaatgagcatcccgctccttctcactaaaggcaaggcccttgttgtgatgtggatccctcaaaagggtgtaaccactgttgcacaagatcaattacatcagcaactccatttcagcatggtgaacgaaataaatcagttctcagtgcacaaaattatggccacttattcgtatgaaaaaaaaactgccaggccaacattctatagtagcacgattctccttatgagtgcctaaattggtgttttgcagtacttgctgtaagttactgttctcagctgtattttacgatctaggtgataattattgttatataactcagcacatgtgtgttaaatttataattaatttccagctaaatttcattgtcaagggatggcggagaaaacaaagacagacaatattggcatggcatgggccagattagaatataccccacccacaggagtgcaggaaatataaaaagctactagtagaagaaaacaatcaaatctttttttctcagctacccgggacctactcaaaatccatccaacattaacccagttcagattactccagcagtataaattatcaaaaaaaaaaaacaccaacagtaatattctgcgaatttttttttttgaaaccgatattctgcgaataaaatgaatatactgtaaaaaaaataagaaccgtataatccgctgacttgaggcaagaaagaagaaaacaaatttgagctgaactgattgtaatatgtttcttcgtgaggagaaggctgcggtaaattacgcaaacaaacaaatgaaagggacagattcagctttggcaactgccacacgacaaagaaatcgactggatcaacacaaattcgagatttagcacgattcgagcaaacaagcaacaaaacaaaccgagctgcgagaaggcgacgcatcctcacttctaggcacgtcaaaattccaaaacggattagaatatttatcacgcgggcgaaaccgtatacctaacccagatcaacgcgcaagctgagctaaatcggcaaaaaaaaatccccaaaaaagtgcttcagatcgacgcatcgtaacgtccgccgcgaccccaccaagatccagcccccccacggcgatccgatccgattcgagcaccgctcacctcgcgacggagaaggcccatggcgtgacgggcacctcctcggtagccatgtcctcaaccccgccgccggccgccgcaacctcctccttcttctcggtctccgccgcggactccatcgcgaccgcctccaccctcctcggcgccgccgcacggaccctcaccgccgcggccctcctccgcacctccctgcagctcgtgcatccgctcccgctcccgctgctgccaccctcgccgcgcttccactgcagaggcacaaaaacacaaacacgtcacgctcgttcgttcgtatccccccccccccccaccccaaaaccccccaaaaccacacaagcaaactcctcgctcgaggggagtacgtaccagcggggaggcggcggcggcggcggcggtggcggcggcgcgcgcggacagcatggcggcgaggtcggcggaggcggtggtggttggtggggcgcgtcgcgtcctcgcgtcgccgatggctggggggaagaggaagcgagcgcgtgaggggggtaatgggagggaggaggccggtataaaaaaggaagggggttgcgttgcggagggtggcgcggcacacgtgacgtggacgaggccgtcgggtcggagtgttttacggtttattttattttacacgcgggggggaggggtatatgtggtgggttgtgcgcggtgtggtgcggtgatgtttccgcacgcctcgccggaccgggccacccggtcgcatgtcgcagtcggcgacgctcgctggatccagtacgttgtatttgcgtccattataaggttttgcataagtcggctgtgggtttaacttaacctaaacttgcggctctcacgcacgaataatctatgtattttttaataaccgaataatctatgaaaaggtaaagttatcgcactattttacttttttaaaaaattacacagcacatgctcgcacactaacccctatgaacacacacgtaaaccctgcatctatgagcatctttgaagactgagccggtaaatcctgaagattgacaaagtcaccacgggcgtctcgtcctacccttgaaagcacaataccgttaaatcctggaaaattcgctcccatgaaaagtcgagcccagcaccattttacttggtgatgcacaaatagagtagtgagattcatatataagtaaaaatgattttggtttagtatatgtatgtactctacgattgtatagttgatacaatgatattctgcgatatattatctgattatggataaatggcatctttatatcttctacgttttatatctctttgtatggctgacttgtaatattatcttggtttttagttgggggtatgtgttactaggtttattttttagggacgaagagagtgcatataaatgtataatagggtttattagtcatcttgataagccaatcaccaatataaaaatccatattccacgtctatttattactatctcgcgtataccttgatagaattaatctccatactcgacaataccattgccggctatatcccgtcgacatcattttcctaattcaattttttgttttgttcaactagtagttttcttcttctctcttaaattatcttatatgtaactttttttcttcctttcagaaactttaaaggcccgaggagaaagggaacactgagcgtaataagtgaaacttacggtaagtcggtaagtcgtatttcttgtaatggaactttgaggcataagatatttaaaattttcactcgcaattaagagggaacaaataatctttgggtctgccagattaacactagttgaattcaggaaaattgcaaatggatcatcatttttttacgcaaaaaaatatatgaaataagtttttttgaacgagaatgttcagaacaacttgaaactgtcccatagtcatagcctcacaggtctgcactgccggcatagagtacatcgaacacatcagatttatttgcttgtcacttgtccttgtcatatggctcgctaatcacctgtaggcacagcacatgcctatcaataattatgagctggttggttagaatggagcaaacccaagattgtggctccaaatcaccgtgtaattaagctttggaatgttagttgaaccgtggaccatatggccatcagcgtgtgtggttgtgtggactttgggcgtcaagccagtacacgtcgaagatcgaatcgtcgtgtgtcaattcaagccacctttggttgagcactggtaatatgtggtcctgatcactactgattccatcacacagctatatatgattccatcccacagatttgggggagggggggggggcataaaaaaagaaggcacttgccttttcctatgtgaaggtcggagtaggcatgacgatgggttgtttggttagtagctaactttgccaaaccacaagacatgtaggatcatatgactaaaaagtgtggcgagccacagttgtgataatgaaccaaacgattgtctaaaaagttatggcataactatccttagacatggcaaattgaagatagcaaccaaacagtcccgtagtatgtcttatagcggacgagaggttttcaaacttccatccggcttctactagtagtagaaaataatttgaaccattgatctcatttgatcgaaggattcggatctatttataatatcaccctactagttatccgtagaaacaaggagtggcgttattatataaaaaaaggtacataggggtataatcgttatttggcagggactattttttttattcgatgaaatataagtaatgccaacgcaatggataaccacatatcgatctagaaaaaaacataaatgaacaagttatacatattcactatattagtaaattattgattactcttaataataataaatagttcagattatttctatggtaggataatacttttcttttgcggggtactggtagagtaatactaataataagagcagcagagaatcgctgaaagaaaaaaaaacagcttcgccatacatatttgacagtaagtatatgcaaatttacaaatgcgttttgcatgactacttttactgacacggcaaaaaaacataaataaatcttcacataccgctacacttttttgcatgatactactacagctacatcccagcatgttccagcatggcgttcggggcccaattaagagcgaccggacggatcggcctagaaccaaaacgagcagatctagttccagttcattcattcgagagggcgcacacgcatgtggtggcgtatcaaaagcgtggatcggatcgatgcatcgacgcgcgcatgagcgtctcgtcgatcggctcgtcgtcgctggcgtgccacggtgccagtgctgttggctatgggctcatgcatggccaggtgggaagtgcggccaagtgggagcagctagcaagcaagtggtggtggtgtgcgagagtacgagcgtaccactccagttaggccacgggaaaggaaattcgagcgggttactgtacgattaccacgtgccgtaattttctctgttttaaagcacgatatagttcgggctacctgttactcgttccgtcctaaaatataataatgtccagatttatagctaaaatttattatatttgggacagagttccgtaaaaaaaatgttccgttaaaaaaatattttaggatggagatagtaaatcgtagggtaatggtaaccccatcccaaataatttgttaaaactcgatttggagtgcatttgctaattacggttccctttggtgtgctacacgattttttattattgtgcatatgaaaaacgaggcactccattcaaaatttgcgcaagagttccgtcaaaaaaaaagaaattgcgcaagagaaaggtgggtcttctacaattttgctgctgccacgctatttgactcatgcacagtgacctcgcgttttatggacacaatatcccaccccaattaaattgcccgtggctcgtgggggtcacacgacacgaggagagagagagagaggtgtgtgtcagtgcgatgtcgcagtctcgcagaaatctcgcacaagcgtgctactcgcttgttctaaaatatataaaaagttttgagattaaacacaattattagaaaaatatataaaattaaaataaaataatattataattagttgaaaaatgaggataaatgaaaaaaagaatgatatggaactgtgattggttggaaagaaaataaagttgttatatattgaaataaattaggagtaaaagttaagctctgtttagattccaacctattttttagactcgatcatatgaaacgtttgaacatatgtagagcctttgggagtccctgtttatgagtacaagccaaggaaaggtagacgataaaggcaaaaaacctgtgatgcagtctcggctcagttctccggacaaccatgaaaggaatcacactacgaccatgggatggacccccccgccgatgggctgggttaaagcaaatgtggatggctccttcattcaatgttcggaagctgctagtgctggaattgtcattcgtgaccacactggctcagtactgctcacttcctggagaattatcagccattgtggatcagcggaagaggcggaagcgactgcatgctgggaaggggtgaatctcgcagctgagtgggtgaaaaaaccgttaattcttgagacagactgtgccaacttggtatctatgcttacgagctctggatttgatcgagcgcagctctgccatgtcctccggagtattaaatttttactccaagcttgcctgattttcgtgtgcagaagattagaagggaatgcaatagagtagcccatgatttagctaaatttgccatgcgtacgaaccattcagctgtttggcgtatgcaggctccttcttgtgtttttggggctctggcaaatgattgtaatcacattgatgagtaatcaataaagcgttcccttcccccgcaaaaaaaatgcatgaaatattaaatatatgctaaaaaataactaataatacagattgtgactaatttgcgagataaattttttaaatctaattgctccatgatctgataatatggtgttacagtaaacatttaataataatatattaattaggcttaataaatttatctcgcaatataaaagcgaaatttataatttattttattattactataaatttaatattttaaatatatgttcatatatgtgatttgatacgaaaaaacttttaaacccttatctaaagacagccttttggagtagtactctccccgcaggcggtgcgcaagcacaagcagaagcaaagcggacgcgtggcgcgaaaggggggcgcgcattcactggcgcgccgcggcgagtagccccgcaaaggggtgggcccctgcgccgaccgcttctcggtccccctcccaatcctcccccctcactcaccgcgagcccccaaaccgaaggacactgaccaatggtccccacagggaaaagtggcccacacggcagcgaccggatgaacgcgacgagaaggtacgaggcgggggcggggccgggagagaaaagtggacaggagttggggagttgaggcctcccctgggtgccgccctcgcgcctcggcctcgcccgacgcgaccggtccacacgtgatactggacttccctttctctctctccgccgttgcttcctccgctgcttcttgtttgttttgttttgtttgtagcggtggatggagatggatggtagtgctagtgcgttgcgtaggcccgtacgtgcaggaaatgggcaatactcctcctacgacgatgctagtactgcagtttcgtccgtgacgattactcgttattattcctaccgtcctacgcactcctactcccgtattagtactagtattaagactcacaatgcatggatttcacatttttcgagtttgcctcggccggcagggggcggctactgataccacatcacagccactcgatccatgcatgcaccgatcgaatcccagggaaaaccacacacacatagagatctcgatcgggcggtggcacagtacgcaacgtgctccggttttgttgggtccccgttcgtacgatctttcgcgcacgcggacgcagcgtgcgtgcaccgcaccagtccctcccactctggtttcgcattgatccgttttgatcggtcgcgcttccccgatcgctacatatgcacgctgcccagcagctctctgtaaaggctgctgctagcgttaaatacaccaaaactgcctaacaacaaattccaactactcctacatccccaaatgatttatttcttctttttttttcttctactttttatttgaggaaatatcgcatggttaacttgttactccctccgtcccataatataagtgattttgatttttttcttgcaacatttgaccactcgtcttatttaattttttttgcaaatataaaaaataaaaagttgtgcttaaagtattatagataataaagtaagtcacaaataaaataaataataatttcaaaaaattttaaataagacgagtggtcaaacgttgtaaacaaaaactcaaaatccttatattatgagacggagggagtagttccctactgcaccgtgctcggagaattctgggctccatcttttgacctaaataagccaaagtcaaattcaaaattaattttgaacttgatttgaagacattttcaacacagtttattttatgttggcttttaaaacgttaagaacatacatatagaagttttactgttttattattaggaaatgtgggtaactgatgaggctgtctgatgcaaagtggtcgctgtttcactttgtgattttacatctgctgtcgtctcttctgcactgctgacctggagtgttggtcgctgcatttgcatccgacgaacgctgcgtgtatgctactccatgtttctgcagtttcagctggatgcctggatcgctatcagagtcgagtgggtttgcatgattaattgcgagaggcacccatcgttttccccggtgcagccaaggattcccctactgagctcgctactgattcgactagatcctcttaattctcatcgcttaatgtcgccgaatccaattattgccaaaaaaagataaatcatcattgcatctgtgaaccttattggacacccataggcaaattcgatggaggagttagcaaggccaggagcaaaaatatgtaagacaagcagggatatccttttcctcgccgtcgaaagaactattgtatgagtattacaaaaaaacttaaaagaaaaaaatgcgacgaatatgtgctttggtttctggttagaggctcaacaacaatcaactgaatctttcccggtccacccaacaaaagacctgaaaggtgcctgcattaatttgtttatcttctcttttctgcagccgtgaatggacaaatggagatggaaatgaggcgtaggagtactacatgcagatgcagcttcacacgagatggaaaaattagctgctgagtgcgtgctgactggacagccatcgatttcgatatgtacacatgacgacgagaccgattctgctaaaccagtcagcgcatgtgttccaggaagcgacttttttatttttatgtgaaacgacagtgtccagcttcagtgacgcacgggtcacgcaaactatgaatctgacatcttaaaacttggcgactctgctattaattgattattacgtgaagatacacgcgattcgccgttcagttttgtacagatactgcccaatatacaaagttggtcatcactcaccagcttaatcagtcgaccaccgatagccagccagaggagaattaagtaatttaatggtgaaagatactagcagctgatctcctggtaacagttcattcaatctcatacaggccattacatcatacaataccagctactaacatgtgcagttagcacaagagaaagatcatgatcagtggatgcaaataaagtaattaaagcacacgactacacgagcttggtgttaatttatggggggcaggagaatttcgatcttgagactgctgctaagtcttaaactgcactagctgccaatggcttgagacggcagagtcaaaatctatggacggcgaggagagtttttgttggggggtttgagcacagtacagcccggacagcccatcaggcccacggtttggagaccattttgtagtgggcttcgtcacagagcatgaccgttagtaggtcctgagcatttaaaatggggacgttgattgagaactgccgttgcaaattctacctgcaggtagcacactgaaaagccgaaatcatgcactgaattcgtaggattcttttctagtcaagatacagattttatctcgattatcaatagcatgctttttaaactattaaacggtacgttctatacgaaaactttctatatatagaagttgcttttaaatatgaaatatatccatttgtcaagtttgtaacaattaaaacttaattaattatatgctaatagctttctcattttacgtgcatcaacttaacattcttaatcagtttcaaacaccacagttacgtacacgtactactccattagtggtactccagttaggctcacgtcgcttgtatgtactactcccttcatctcataatataaggtgcccacacattttaagattttacattcaaaatattttgaccaatatttagtacaatatgaattgaattttacttgctaaaaattatatcattgaaattgaattcacatttgaatttactttcatatgattataattttgttactataaaccttatagtatatgagtaagacaaacattttatggagaccgtgttaagttcgaccatgtcttatattatgggatagagggagtatgatctaatataccttatacgcttatgcagactacacgacacaatctgcgttgatcttaatatattgaagtggtggatttatgtattttagactctgctgaataaactttgccggacagtgaactgtagtcacgaatacatcagcatcggtcgccaattaacgagttggtgtcaactttttttttttctgggtgggttgggatcagcttttcgatctgatcaatctcgcttgatgagttgcttcctggtcatggcgttctccaatctcagtcaggactttaggcaaccatataaattgccacgatccatctcaaattccatcacgaaaacctcaacatgccttccaaattgaaggcactcgttaattaagcagtagtgctaggaatgatggaatcgagtgaccaatcaatagtcaattaggacctgtttggtacacctcaaacttctaagtttaactctaagagttgggtttggagtggagttgtggagctgcctaaacccagctccacaactctagttcattttgtgagagagctctacccagctccactctcattttttggtggagctgtaactgtttagctgagctccagctcttaagctgtgataatcaggcctaatggcatcacacaactgagagagcgagagagccactgtgtgctggcgcggcgcggagatcgtcgatcgatcgagatggtgttcgtcagttttgtgcacgcatgaacaagtccatctgcgatgctgcggcccactatagcatagcatacacaagttgggccgggcccatctctgttttctttgggaatacacgaggggagtcccgtacatctcgtgatcgatgttgatgaggaactgcatcaaagcatgcaaattctacatgctaacatactgacaaagtctgaaattaaagccaaaaatcataagttgcaggttcggcaattgaggcattgacgttcgattcgaacaaccatgcatataaactgcctcacatctactaatctcatctcccatcgcctcaaagctcaatgctctgatagcgttcccgtggaggcggacgccgatcgatcaaggtcaccgaggagagagaggaggagggtcggaatttaattcaccgaagcccaccagctgatgaattgctggtcatggcgttctccagatgccgctcgtcctccgcgtcggtgtactgttcagcatgttagcaagcgagaatcatgaaatgtatccgacagaattgtcagaattggaattggctctttgtttgagtagggatcggagttttgttctccgaccaacaccccagtttgcgtgggctttgtaataatggcgcccttcgatcatctctgatcgagcgggccttgcacacacccggggcacaactgtcaacactgttgctctggaagaaatagaaaacgatacgagtgaaaatagaacagacaaatccacacatttcaaatcgacaagaaacctagatgcacatgtatttctaatttcatgatgaaactaggcggtgcacgtgtcacggacctggatcatctccaatacttattttggtgtgaaggaattgtggccaaactgacctctcgttcttttttcgcaggaggttcggagtttctttttccgaacccctgccttacatattatatggacaatgtgagggtttggagttttgttttccgaccccagtttcccgtgcttcttgtgatcgattttgatggacaactgcaccatctatcatgaaaattctacatgcttgcatactgaaagtctgaaagccaaaatcatataggctcaaattgcaggttcgggccattgacattcgaacaatcccaaattatatctactatatatccacgcaaaacggtgtgggggaatgatatagcgaaattggtatacaagagacagcaatctggaatttggtaaagttggagttttaagctttggtggtggttcgtgctcttcaaaattgaaggtctgtatatgtatattttatcctccactgattaaatttttgcatgacatctaggagtggcaacggggcgggttagagatggtttgggccagaacgccaccaccgagtgtgcgcgtgttatgaacaactatgttcatactgtattttttttttaaaaaaaagtgcatgatagtgaactgtagcgacgaatacatcagcatcgatcgccaatttaccagtatactttttttgtttttttggaaatcccatcttcccattctcttcgatctcgatcgcatcatgagttgctggccatagcggtccttccaaaaaccttttgatggtttttccagacaggtaagatggcatttcgctggagatgaaggagagcccctcagacatccttctggcagtagaagagcttcctttgttggaataaccggtacaatctagtagaaccttcttcttcatgtgcaccttgatcatccacgttgtggcattggggtcagcagtgtggtagcgctcgttcaacaagaagcaaacggcgtaagggttttccatatcaacaacggggaattcaggtcggacatttggaaggcggttttcagaatcgagttcccaaagttgggcagcatccaatgttgcatcttctcgccatgtctgatcctcgtgccacgaccacagggtgatgctgaagcttctgctgctgctgccgccatgttggttaacattgacgaacttgatgccatggtgggtggcacacagactacgggaggcttgagggcatcctcgcccacgatcaatgtcagcaactggatcgaccggaagtggcacgtaccatagaacaggctccggtgggtcaacccttcctggatgttctacattggcgacgatcatccctgctaccaagtagtccacccagatcatgtagcgatcgtggcacgacaacaccgcatcagtcgtccagcagcacaggtgagcgagggcgtcgccatggcggatcggcacattcctgaagactctccagtcgtcagagccagaagcgaagaggtagacgttggtttcggaagattggcatgatcttctctcgagctcagccacaacgaacgacgaagaattcttgctgccgcaggacaaaatacatgtgccttccctgctcatgatgcgcgggcggatggtgtctcccctcctccagtaggaaacgggcagccgcgtcaaggaggggtggtggttgctgctgctgctgcggctggcattgtagacgaagtagtcgatggcggaagggcgagcgtgcttgtcgggggagacgatctggaacaggacgacgttgccgtgcgcggcgatgacgtatgggtaggatgtggttcccagcgacgggcggggcccctgcggccagtcgagggtgaggagggaggtctccggcggcttcacgagctcgaaggagacggagatctggtcgccgccggaggtgtaggagaccgccgacgtggtgcggtcgcggtcgtcgcggcggaaggaatccctccgggcgccgtaccgattcaggatcgcccaggtcgaggtcggattggaggcgccggcggcgtcgtccaacgatagggttgaggaggatcgcttcagcggccgcccgggaatctccgtctccttggtcggcgttggtccgcgacgggatgcgtcggccctggcccgcgaaccgtcggacgatcccttgcgccgcctgtggctgggaatccgtgtccccgtccccgtctccgtctccgtggtggggatccgcatggcggcggcggcggcgagggttctgtgtttggttcgcgaaagagaaattaaacaaaggcgagacgaacataaacttggctcgttggaggagtatttgggttggggaaagtcgggttaaataactcttcagtgcaacccgattcggatacccgagtcggggagggagaagcgcgataggcaggactcatccaagtcgttagatcgaaacatccaacggtcaaaaaaaatccaagagctcattgctcggactcggatatgctgtgttcgggaggtaactctccagctcccgcgcacgcagaacggaacgactcgtattttgttataattcattaagtactattaattttattaaaaaatagattaatataattttttaaagcagcttttgtttaaaaatcttttgtgaaaaacacatcatttagcaatttaaaaagtgtgcgcgcgtaaaacgaggaatgtgacttattctatgctgtgcggagtcatggcctcatgggtctaggcggttcgtgtttggatcctaccctctctatccaaatatataccaacccaagaccaaatttgacgtatcataggcctacaaatctaaacatatatattcaggttcgcatttctcaaatccagtcgtatgttattatatatcacgatagagtaagattgcacgattgaaatttctcggggtgcgactctaatctaggtaaaatttttagcgcacataaaacgagaaacctcattagctgacgattgaaatttttattatttgtgtgtgcaactgacatgtgggtcccacatgtttttttttcagatctaattgccatgtaagcgctatgttaatgacacgttaggcaaagacttagtcaaaagaagccacgtaggcgttaaaaccggacacaatacggccgatggatcttatttaaacggttttgtaagttggggacctgttttgcaatgaagtgatgaaaatcggaatgggcgaaaaatagagggacccaaagtgaacttattcctctcctgaccgactcggactctcccaacctcccagccaggcccagcaattgcgttggcacttggccacttggggtcacccgtatccgtatcgggttgcactgaagagtagctgggactgtctatccatttgagagatggatagcaaaatcgagagtggtttatcttcgcctcgcctttgttttccctttcgcgcaccaaatacgtcatggccgcgcacgacgtgtgggtaggatgtggttcccaccgaggggcgggtctgccattgcttgatggagttagaagacagtagcattttcgtcaaaaaaaaaaactaaaaactgcatggatctaattaaccttcttttttttttcggtcattgcaaactttcatcgtccgattgtgaggccatacacgagagccacacgtcgttgccctagaagaaataggaaaaatatacggatgaaaatggaacagaatcgcatatttcaaagagacaagaaaccaaatgtgcatctaatttcaagaggaataagttcactttgacttccttaaaagtggtccgagtctaatttataacacttaaccgcaaaaccagatattttgacttctaaactgttaaaatcggtacaatttaactccttcaatggttttggaggacggttttactgacgtagcgtctacgtggcgatannnnnnnnnnnnnnnnnnnnnnnnnnnnnnnngtggcacttacgtgacaatagaattaaaaaatatgcgttggacccattagtcattcacgtaaaaagaaatgtgggcacaccctgtctccttccttcttcctcttccctctctccctttctctctctttctctcctcttcttcttcccctagcacggtggcggcggcgacgaagttgcacgacgcgtcggtgcggcggaggtggggcgcgaggaaggaggagaggcggcggacctggcggtgcgcgggggtgccgaaggagggagggcaatgcggtgagaattggagggggcggcgcccaacggcgggtgggggagggggttgaagggcgacaaggtcacagtcggagtggaggagggggtgtaggtgctggttgttgcgtcggcggcggcgacatggaggtgctcttcgagctcgtcgcggttggaggagcggagctcaatgctggctcgacgacgacggctccaccgacagcgtctgcggtcgtgcggaggtcgacgacggctccaccgccagcggcaggttctggagggtgaagaaggtactcaacctggggttagagcagcggctacgcgattccatcgccatcgtccacgacttcgtgaacgcatcatctggtagcggcaggagcagatccgccgctggtgccaacctacctccctcgtttcccccaaccccaagtatctccgccgccagcgccattctccactgacgccgtagctctatggccctctccgatggcggtgactgcctcgccccagcttgacggcctgcctcctcctatggctccggcgctgccattggtgccgacccacccaacttctaccatgctcgagttgaggccgtgacggaggaggagcaagagtggacgcctcggcctcgacctccctaggtcccgctggccgacgcccctctaccgccacccagctgacgcgacgccgccgctcccctcgttgtcccatcgtcgctgctgtgtagaagaggatacgtgccagcctgccaggggaggagaggagggggtgaagggaaagaggaagaagagagtgataaggggaagagggagatgacatgtgggccccacatgttaagtcagaccgggtcaaagcgccacgcaagcgaaaccactatccaaaacagagttaaattgtaccggttttaatagttgggggagttaagatatcgagaatacgaattagattggagctatatttaagggagtcaaagtggacttattccatttcatgaagctgggtgtgtgcacgaacacgtccatcaagcatttgagctgctaagcggcgaagatagctgtagcaggtggccgcttggctggtcggcacgaccgcgaccgttgggctgccaccacatggcgccccagttaagcttaggagtaagtctatcttcctctctcatttcttccccatggtcgaatccgatctttcaatcgtaaaaccgggtttaatatctcccttaccttcaaaaaccggtgtaaatcgacttccaagacagtatttagtccggttttagcttatgtggcgtccacgtggcagtaaaatttaggtggggcccacatctcagttacattatttatttctcctctcctccctcgcaggcagccacggagactgaaggggactggcacggcggaggggactaaagagcctacgggtgcggcgcgtgggccgctggtccgtcgcggacggagccagaacgtcgccgctgcgaccaccacagagaggtgcgcaggtgctgactaatcgcgatgcggccgccatcgctgtcgcggccactagccttcccgacgctggactcgtcggtggcgttggcatcctggggcacggcgtcggggaccaagacctcctcaacctctttcttactcgagctctccccgtgcgtgctcatctccgctgccatggcaccgccgctgtcgcagcaacaaaacgccgtcatccgtgctgtccatgtcgccaacgtccggatccgcaactggcacggcgcgctgctgatggagactaggcagttcctctccaacgacaggcacgctctcggagaatatgtgccctggtgagacccaggacgccggacctcgggtggtggcagcaatttttggagtagctcccagccgctgctcccacccttgctcccctgcaagctcgccgatgtcggccgccgtgtacctccccagcgacctcggtagccggggcggagaccgacgggtgcggcgctggggtcgcggaccgcgcatcactggttcgatgcggacgaagccggaacgtcgccgccaccgcgacctcctcaagctccggcatcctccatccggcattcgcccttccgcctccttcccgtacgtcggtacgtggccggccggcgagctccttcccacgcacgacgcggtcggccgcctggcaagctcctgcaccgtgcgccatcgtcgttgccctgcctctgtgttgatggatggtgaggaaagaggaagagatcaaagagagagagagagacagggagagaggtaagggagatgggatgaggtggaggccgctgacaaatgggtcccacctgatgacttgccgtgtcaaacaccacctcggataaaaccgcctccaatacaacagttttgggagttggggacccggttttgcggttggggaagcgattgtaacaagtgcatgagttgagggaggcaaaatagacttattcattaagcttattatgagcctgatatccagagaaatcgtacttgggcctcattttggcctaacaagtcatcatcagacagcgaggcagatgctcggcgacggcaggcgttagcctgagcagcctccgcctcgatggctctagagattctgcggaaaccgccgccgcttgttctcaaattatgcgagatgcaggtaccatcgctttgatgatgattgtagtttttcccaaaacctacttttctacctcaaaacgcgagacatttgcgacgatcatagagcagcacctcacgtgcgacgacaatgcaatatacttcgtacacgcataacaaaaatgactgtaccttcttcataagcctgatgttctgataattgcctggaactgatacaatgttcaggggttgtgagtagtatcagatagataacagggatttatggttggttttccatcgtagaggtgagtacgagactacgagaggacagtcgctggctgccgattggtgagagttccgtgaagtgcattctttacatttcatcacatatccaacaaaatagtgcatcgctaagaaaagaagttccagctagttatagtttactgatggacgattatgcagttattctgcctcactgctcatctggaggtatcgccatcaattccctagctttcctacaaaacatttggacgaataaaatgtcagttataacaacccaaagcgtaaaattgacccaaagaaggaagaatggcatataaaaccgaaaagaacagtcgagtgttgagttgcttcagttgcagtaaatgtgggcacaagcacaacggaatatgctagtactaatggtcatgttccctgcgcaaccacatttttatttggaaggcatactcgagagaaacggaagattgccttagttccctctcaatctcaacattccccgtatctattttttgcgcatccatgagagcatcacacgcatgtttgtactcctggttttagagtaaatcaggacacggaccataatacatggatcacaatacgttagctgcagtgagtcttaccttgggtagcatgtgagctgcaccctgacgatagcgagcttttgcccagttaggccgcatcattcagcatttgtaagcatcagatagagcaccttcagcatcacccatgagcaatctacagatgctcctgtttgcgtacaaaactgcagtcggtccgtgagcaagcctatgctcaagcatcagataaacaaatcattcccaagcttaagaataacgtacaaaaactttataacaacaataattgattagcgttaacaatcagaaataaggtgcaagaaattaccagatcatatatttttgctgcagcgccgtaattcttctgcttgaatagcaaatctgcctgtgccttcaaaacgacttttctactctccttctgatgttgatcctaaacacaacgtaaacaatagtatcctgatgcaatctgaagtaaacttttgaaattttgaataatagaacatttatttaggatgatttccattaataaagaaactaagcatctttatctccaacattcttcatgatttgtggttagtcctgtggcattcttatgctgtaatttaagcgtactcgatgatatcgataactcaaacagaactctaattttgatcagttgcagaagtcactaccactcaagtatagctctaattttcatcatttacataagtcacaatatgtgatacttacaagggaaaagtccccccccctctgatttatgtttcacatttgaattaacaacttaaggtccaaatttgactttctaagttgctgacaatcaagtcaacagacagatgggctagatgtattattatatatgaagagctcaagatgccacttatatttattattaaaatttgtatgtggaccagacttttaaagtcaggttattaagtactccagcgaaattgaagacttcacaactactccaaaggctgaaggacaaaacgggtttgttctacttcaaaggaatatgtatgataacaaagctaaaccagtactattaagacatgatccttctatctagtactattaaatgccattgatatgtaagctaacccagttttacagcctaacaacttaacaagcatcagagaactacgtgaagtggtgaaatagagctctgcaatgcaaagtgcatggtaagcaacacgaaatatgaacagagagcatagcagtatctttagtacaaaaagatcaaaagtgtgtaactgtataaaatgtaccattggctttgtatttgacttttgcatgagcgatattccattgacactccagtttgggacatttggaattgaagaagtcaatggaaatagcatttcaacttcttccctgcaatcatgtaatgcagcgctctattggcaaccaacccaactgcacaagcacaacaaaatgaagaaaagtcgcttcatacagtgtaattcagcaaggaacctaaaacaaacaatattggtgaaatcagtgtatggcctattatcacaatctgtggctttcaagtttcaaccaaacgactcattacgacccaaaaaaccatggtgttaggttcaaagctggccatgggatttttggacattgatatgaccttctatcaaaatggtcttttggatataggctggatttgagaactcatcggttactgaaaggtcatccatgctttgcacaactcgtaagatatacttacacatacaataatataaacgaacacaggttcagataatccataggaaactataaaatatgcaaatgataagtgcaatgtttttgttaacttaagccctgttcggatgtgataaggatgaagattaaatatggggtacgtaaaacgagaaaaccattagtgtatgattaattgagttttaattattttaaacttgaaaatggatttattttatatttcaaagcaacttctatatataaagttttcacacgaaatacatagtttaacaatttgaaaaatgtgctaacgaaaaccgaagtaaaatctgtatcttaatcataaagtaacatgaccttagtcaaaacagcctcaacttattgctaaaataactccctaaaataatcagagttgtaataaaacacacaagaatcacagacttatagaccagagtggagaaccaataactgactcagaagaatagaaaacatacatcatcaggaatattagggtttgctccagccttcagaagaaactgaatgaagttagtatagcctccttgcgacgcagcaagcatcaaaggggttacaactgtacccttgccattaacatcagcaccagcctgagaaaagcattgtgcaatagaatatttagctccataagttcatggaacaaatgtcttgagttagcaaaattaaaacaccgcattagttgatcaaatatagactcaataaaacactgacctttatgagtagcttcatacacttcaatgatcggtagataagggaactcatcaggggactaccggctccattattgacaattacgttagactgaaagcagaatataagaatttagcctcagtacaaccagaaaaatatgtgaaagaaaaagggaagcaatataatgctctaacctttttttttctgattaatgtttgccactttttataagtctaactgttgaagttagcaactttcgatgttgaaagaattaaagttgcattatgtgcatattttacagacttttaactaaaatagaaaaaatatattacacatgaaaccataattattataatcagagttcagatatatgtaatgccacatttacacaaatttcatgaagccaaactgaagttactgcattggaatggaagagattttagtggacatttagtgaagtcaatatcaaaccagaaggtcagcaatgagatagatggaggtacaaatatgccatgatgatcctaaagcatttcaatcattaagagatgagtagataaaagagcaggataatagcttatataagtgccatgaattgaacacctaaattctcatgctctttcccaaaagaacatcagccaaccttatttagagcatgccaaatggcaattttaggacttggaagtattactcaaaggtcagcggtataataataatcacaacgcaggtggaagatgctacgcgcgcggggtggctgtgtcgatcaggggcctctgtgaggcgcactacacaggttaagtagcacgctatcctaactctcatcacaataattcatttcataacaaaaaaaaaaacaatcctttttaagacctggaaatcccatatgatctaagatcctctataaaatgtctaaataaaaaccaaaatgatagattatgcactgcagtatctgagaatgggtcaatccaagcaaacagaacagtcccatgcaaacacgcatcagtgtacatcagctaatgagctaactatctaagtggaaaacaaaacaaacatctagctatcaaactagcagtgaaaaaaaaaaagaagaggaaataagaaatagtagcaactacatgcatctgccttgtgatccaacaaaatcttcagtgtcttatccttgccattgttagcagcatgaaagagtggtgttccaaggccacagtctatgtcaacaggtattccttttgaaagcaagaactctgttaccttacagcatcctgcaatgaatgagatgggccataaatcttgggggaaacaaatactatataaattgagttatttgaataaacatttaccaatacaatggacaaatcacaatagattgcatgtgagatgtgagcgagtataaacagagcaaaccaatacaactttgagtggtgatatataaactaaaagtatctagattagcaacacaataaaagataactgtgacgacatggttggattaaatgtaatctattaatagtaatgcagtatcgtagaatcttgtacaacaatataattggtaatataacaaggaaatggatagtgttcatatcaagggagacctgtgccagcagcatggtggagaactgtgcatcctctaacatctgcttttgttacatcaccactatgatcaagaaaatactccaccgtaggaacatcaccagactcagcagcggccataaacggtgttatatctgtaataaacagcacatcagtacacttggcacattatactgccaaagcatagacatggcaaccgtcaatttcacgaaaggatggtacagttagataatgaccttcttttccagcaatattcacgtcaccccccaattcctccaccaagaacttgcaaacattcagatggccctggcatgccgcggcgtgcagcaccccaatcccatgcttgttaagagctaagacggcatctagggatgcaagcgggccaactcgcaaacctacttatatgtaaaataagtgataacccgtgtgttttcacgtcgtggtccgatttgccgcacttagagatgcaagtgggtcgatccataaactcatttatacgggttacctactaattttgcctataagcgggttcacgggttgacccgcttgcaaccctaagtctttcctttctgaatcccaaggctctttataaaaccttctcccaaataagaacaaaaagaaaagtcatcacagtgaggaagataatctgaaaatgaacagattaactaggtagaacgtgaaaagaaaagcgacgaaaacgtgcaacgtgcaagaacctcactgagtcatgtgaacctataccttgtgacttgaaaacatttgtgtagagtactgtctgctacacatcacacattagcacttgggagaggtaattgtaatagaaagatgatcacaacattgtcgcatttatccaatgcaaggacttgctacaataaaagcctcagtcaggtcttgcaatttctagataagatggcatgcatctccagtaatccatagacctggctgttaattccttcacgcagggtgaaaaatccacgcagccataacatcaccgaaaataaaataaaatgtgggaaattcccaaaggcaacagcaacgcagcaagcgcccttccttcaaaaattccatggccaaattaattagcagtactacagccatcgccaagcgttccacacaggaggaatcacccaaacctaagggaggaaaatcacgcaacaggcgcatgcaaaagggggccaatgcgtagacgcatcgatcggggaaggggatcgacgcggcggagaagaacaaggggaggaggaggaggagaggtagtagcaacctttgaggcgtccgaggttcccgtcgaaggccgccctcaggcctcaggagagcgctctcacctgcgaacaaaccgagaaatcgccattagagcacatggccgaggagctagcaagccgatcgagctaagaggagatgcggggagagggcgtcggtggggcggcagtagacgaacggaacggcgccgccatggctcgcctcgccgcgaggagggaggaagcttgcaggaggaggagcggagtgggtggtgggttttgctcgtccaccacgacgagggcgagggtttggcggtgcacccgtgccccgtggactgtaggcctgtagctctcacgggtgtaccaagaccaggttcacggagccgtttgctcggtacggagaaagcggatagataggtagtctatgacatgggtggcccgcttacaggccagtactaccggaaaaaggaaattagtg

SEQ ID NO: 2024 - DNA, 18796 bp, Oryza sativa
ctcctcgaatgccctagttaatttgaagccaaggttattttttgaattttttaaacttaaatttaaagttgatcttacgatgttttcaacgtagttttttttatttgctcttaaatcgttaggacatatatctacctataaaatattttttcctaataagctaaaataattttcattagagaatatggacaatcgatgacttcccgtgtaacaccaagaggccttatgacaccggtcaatatattgttttttgagctttggctaaataagtaaaatagatagatgcagcctacacgtcttcctaactctttgccttcttcaagacaacgccaatgcaacgtctgcttctgaaactagcgttagtgagtttttttttcttgcccttaccagccaaaaaaatagccaacttccgatttgattttcatcttaattttgttctaactcactcaccaagctatccacctgattaatttctttaaatagtaacaattaattaaggattttttatttgagaacaacgattacttagataacaattcaatttcatctagttacatagcattcttctattacttttcatactcgttataagtttactacaggatgtaattaattgttgctatgagtgttgagttgacactgataccctcaacctaaaatcctggttgaggagcatgaggatgatgacgcccaggctttaggcgtcggtcttggcacccgccttagcttcttagctgcacattataccatcagaaatagttagcgtaattatcaagtatgcagattttcagctcataaggataaacccaagaaatgcagcgtgagtgtggagcaaatttgttcagagacagaaagctgaataatacgttaatactttggttcatgaagaagtcgaaatgtgtcttcttcaaattcagagacagacagttgttaaactaaagtctgaaatgcgtgcactgaaaaatgacaagggctcatggagagaaatatcttctataagtcctaaaagattctacaactatcctttccagaatgcacccatcccatcaaatggacttgacagcttgtcatggctgttacattcagatccttcatggaagttgtgtcgtagcagtgttggaatacctgaaagcagagaaacaacacaatcttttaatatacctgaattgcatttggttatatttggtttcctaccaacatggagacaaaatgtgaaattatagcgaagaagtgtctgtttggattgatgccctatcaaaattttggtagtgccaaatcttgagcaactttggtagggtgaagttaaaaatatttatttggattgaagccaaaatatgactataagagacaagtttatggtcaaagccaattttttggcaaaggtagtgatttaatagagatgtttggtttgctaccctaccataattttggcaaggtaacaatccaaactagcccttagtagcaatccaaaaaggcccggacactaattttgatttggctaaagaaagagccagaaaagcaaaagctacatcagacattaaagcacaagagagcagcggacaattcagaaaaatgtgttcttaccttagtgctcaattttacattttttggagctttcctttttggtagaatggcttttctttcttttcctgggtggataatcagacatgctgctgctggaagaacttgaacacctccgagattttctctttctgtgactaactgaattccttctctttcttttcctgggagagggactatacgagctgctctctgacgacgattcatcggagctactgtctgacaatgagtcagtaacataggaccccaaagcaaaacaagtccttaacctacagaagaaatttttatattaaattagttcaaactaacctacacaaaaaaaagttaaactaattgaactgaaatgaaatatacgtacacatgagttaaatcaaactcatcttcaataaacttaaatacagcttctgcaagaaagtctcctagatattttgggaccattagctcaataccactatcacattgaaaccattggtaatgttctattttggaatccacgaacacatgaatctgcaaaagaaagcttcatgtcattatttcctttcctctttcttttttgaatcagaatcgcaaataggaaatctaggaacgttctggaatcacaatcagaaacaagagaagggcgagcttacccaggaatgttctggtgcatgagtattgtaatttctcaccaaatgaaatgcactcatgccattggagccgtatatgatgttcctcttctgtccttccaaaatcactaggcgaaacaaatgcttagacatcaaagtattgcaccaatcttctgggactgtgcaattgtctgcaacaaatctgaagtacattttctctctgtcatcccagccatcatagcatctcttaatttgatacaccaaatttactcggttcagagaaggtatcaaagagatatgatagtcaaaagcaagctgctgacgcactgtgaaaacatcgacagctaaagcttctaactttccaagaaggtgcttcaagtacggaggatgaacattttttttgacaaacatttctcttatcatcgaagtcaacttggtgcagtcactgttcatcttgcttgagttgaggcctttccatggctttttcttgattctgactctcccatgaacaacaatcaaaccatccatgtcaatgttcccattccatgtctttccagctacaaacaccgatgtaaataagtgtatcaaactggagagaaccaaacagcccaactcagtgagttccttagttcttgagttgtccggaagttgaacttcccttaggaactcatgcccatgcttttagaaaaattgtgatagtgttttaaattttcttcgaccgtggaactttcttctaccatgaactcttctgcttccatgaaacctctgtccaccgagaagcctaccacacatatatatatttgaatccttttctataccatacgatgataatggtattcctgcttctaacgtgctcatctggtacacgaagaaggatccagaaacatccagcgtcatccttttctatacttcttgtttaaaaaggaccacatttttgcatgtatcaatctgcagggataacgttccatggggatgtttgacaaaaacctggataaatatgataaatatcttgaagttaaaaacatatgatgatatcttaaatacattgcgcatttaagtaattaaaaggaggtatcaggaatcaacattcatattgcatttctaataataaggatacaatacaacagcatttattcatacagagcaaagtagggggattttggcaacacttacttgtgtttttcccataacagatgaaacatttggaggtttgaccccataagatgcagtgggtttatcataaaggccaaccttcgactccacaacctacagatgggaggtgaaaaaaaatgttaaaataagaattaattgatagtacaaggaaatatagttaaatagattaatttatggccaattttgtaaatttgatgcttcaaaaccataaagccaacaccatttgtaataaaaggaattcgaactcaataaaaatgaactaaactactacataaaaaagatcaatcaaattcaaaatgagttccagtgaaaagcttataagtaaattggacaacagctattaaaggtaattgaaatgtttgaagtagctgtgcaggtaaacttacatctttactttcttggatatcatattccctgtacaagtacaacagctgcatcatcaaccttgatatatacattaaaatgaacactagcaattctgtcattttttttttattttcaatgttttacgtagcaacattcattacaatcgttcaagtcatggaaacttaatgattaaagcaaagtgaaaaatggtaacagacaatgaagcccatggttccctcattttcctccatgtgaggaaaatagcatatgaacagcaagaagacttgactaatgtggatactgcaaagcctcaacataatatagatccagcaacagacggctattacagatcacatatctaaaagtggaaggctgtaggagccatcgaaatacagtggatatcagcattatgcagaaatatgcctcaaccagaaaatttatgggttaaatgtaacaacaatatcagagctcatcgggtgctatacctataatggttttgaataatgagcagcctattctcctttgagacaaataagcaggatttgaatatgccagctaatcagattgcgattcaattaaatgtcagtcataataacccaaagtgttacatggactcaaagatagaagagtggcatataaaaccaaaaagaaaagtttgagtgttcagctgcagtaaatgtgggcacaactacatcttagtattaacacatgttccatgcacaaccgtgattgtgtttggaaaacatgctcaagagaaacagaagatgatacctttgttccttctcaatttcaacgctcccaggatccaatttttgtgcatccatgagagcatcccacagttgtttgtactcctagatttagagtaaatcaggacacagaccataatacatgatggatcacaaaaaggtaagctgcagcgaatcttaccttgagtagcatgtgacctgcactccaacgataacaagctttttcccagttaggccgcatcattcgggatctgttaccatcagattgagcatcttcaccatcacccatgagcaatctacaaatgctcctgtttgtgtacagaactgtggttggcccatgatctattgtctatgctcaaacatcacataaacaacgttatcattcccaagcttaagaagaatgcatgaaaactttatttcaacggtcaatgatttccattaatttaatgcaatccaaagtggatatttgaaagtttgaatagcagaacatttatctaggatgatttccattaataaagaaacttagcatctttatctccaacattcttcatagttttgtggttaggcctatggcattcttatgccgcaactcaagtgtacttgatgtcagtcactcaaataaaactctaattttcacaataacataaggaaacctgtggcattaaacaatatttagtatggaaagactgaaagagcattactgtacataaatacataacgtaccattggccttatatctttgactttcgcatgagagattattccattgacactccactccgggacatttggaattggggaagtcaatggaaatagcctttcaacatcttccctgcaatcacgtaatgcagcatgctccacaggcaaccaacccaactgcacaaaagaatgaagaagtcatttcatacagcgtaattcagcaaggaacctaaaagacaccaaaattggtgaatgcagattaaattcagagtacgacaaattatcacaaaatgtggctttcaaccaaacatctccatatgtcccaaaaaaaaccatggtgtgtaggttaaaagctggccatggcaattttggacattgaaaaggccttttggatataatcttgatttgtagcgtcattggtcactaaaatgttatccatgctttgcacaaacttttctgtactcgcaagatatacttacacatacaataaataaaggacataggctctgataatgataggaaactacaaaatgcacctttagaataaaatattcaaatgataagtgcaatacaactagcatagtcaaagcagcctcaacttattgctaaaataactccctaaaataatcagagctgtaatcagaccagagtggaaaactaataagtgactcagaagaacagaaaacatacatcatcaggtatattagggtttgctccagccttcaggagaaacttaatgaagttagtatagcatccttgtgatgcagcaaacatcaagggagacacaagtgctcccttgccattaacatcagcaccagcctaagaaaagcattgtgcaatataatatttagctccacaacaaatattttgagttaacaaaataaaacagtagcggtagttgaacaaatatagactcaattaagcattgacctttatgagtagcttcatgcacttcaatgaacggcacacaagggaactcatcaggagactacatgctccattgttgacaattacgttaggctgaaagcagaaaatgagagtttagccttagtaaaagctgaaagcagaatatgtggatgaaaaaggaaataaatataatgcttgaactgcactttttttcctgattagcatttgccactttttacaaattcaagttagcaatttgcgctgttgaaagaattcaaattgcattatgtgcatattttacggatttcttattacaataggaaaattcatattacacatgaaaccaataattatattcagagttcagatacaggtacaaccacagctactcaaatttcatgaagccaaactgatgttgctgcattggaagagattatggtggacatttggtgatgtcaatatcaaactagaagggcggaaatgatgcagatgaagttacaaatttgacataatgatccaaaagcatttcatttattaagagttgagaagctcatagagcaggacaatagtttttattattggtgtgatgaattgaacacttaaaattccatactctttctccaaaaatcatgagtcaaccttacttagagcaggccaaatgacaattttaggagttaggataatcctcgagggtaagatatataataatcacaataatgcatttcataacataataaagaaaaatcattttaagatctggaaatataacttttaaatcacaccatcatatgatctaagatcctccataaaatgttaaaagtggaaaaaaccaaaagtatggattatgcactgcaatatcttggaatggttcagtccaggcaaacaaaacagtcccatgcaaacacgcataagtgtacatcagctaataatctaagtggaaagcaaaacaaatatctagctatccaaactagcagtgaaaaaaaggaagaggaaataagaaatagtagcaactacatacatctgccttgtgatccaacaaaatcttcagtgtcttatccttgtcatcgttagcagcatgcaagagtggtgttccaaggccacagtctatgtcaacaggtattccttttgaaagcaagaactctgttaccttacagcatcctgcaatgaatgagatgggccataaatcatggggaaacaaatactatataaattgagttatttgaataaacatttaccagtgcaatggacaaatcacaatagattacatgtgagatgtgaccaagtatatacagagcaaaccaatacaactttgagtggtgatatataaactaaggctcccatcggttgcccatttggccaaaatggcttatttggcttattagaaaattaaaattaatttataagtaaaacttttgtatatttgttcgtagcgacttaaaagccaacattaacaaaaattacgttaaaagcatttcaaaatcaacttcaaaatcaagttcaaaaattcaaattttggcttattctttggctgtttaggccaaatgatggggctataatagtatctagattagcgacacaataaaagataactgtgacgacatggttgaattaaatgtaatctattaacagtaatgcagtatcgtagaatcttgtacaacaatataattgataatataacaaggaaatggatagtgttcatatcaagggagacctgtgccagcagcatggtggagaactgtgcatcctctaacatctgcttttgttacatcaccaccatgatcaagaaaatattttacagtaggaacatcatcagactcagcagctgccataaacggtgttaaacctgtgatgaatagcacattagtatactcacacatcatactaccaaacgtagacatggaagccagcaaactcacgaaaggatgataaaagttagataatgaccttgtgctccagcaatattcacgtcaccccccaattcctccaccaagaacttgcaaacattcagttggccctggcaagccgcagcgtgcagcaacccgattccatcatttttaaaagctaagactgcatcctgggcctttactttctcaatctcaagtctctttataggcatagcaccttctcccaaagaaaaaccaccgaaaacgtcattacactaaggaagagaatggacagattaagtagttatagcctatagaagcttagaacatgaaaaggggaatggctaatgtgtgcaattggaaacaacctcgttgagtcatgtgtgttagaatttcaatggttactctcattgagaagaggatggcactcgagatggggcaattttctggttttcttcattcactaaatacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgctgccatgtactcggcctcgcagctggacagggccaccacctgctgcttgattgactgccagctaacgaggcactcgccgaggaaaaagagaatcccgctcgtgctcttgctggtgtcgatgtcgccggcgtggtcgctgtcgctgtacccaacgaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagctgccgtgaattcgccgccgttgtcggtgcgcagcacgcgcagcttgcggccgcactccgcctctgcagcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcgaagtggaggtgcccgaagcgctcgtgccactgccacgcctcgtcgtcccgacgagcggcgaggcaaactggatgtgcgacctgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcacagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttatggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcacggtcccttgggccgccgccgccgccgtggaggtgggctgctgcccaccgctctgctcgctcccgtgccctttcctcttgccagctcctcaagctccctgtcagcggtgatgtcgccggcgatggacccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcttgcgctcttttgctgcggcgagctcggcgtcctgctgacgccgagtgctcgaggcgaccgaacgccgagaccgagcgtcggacatggcgcacctccggggggctgctgtgtggagagggggaagggaaaggggaaggaggggcaaccggtgctgctgctgctgctgctggctgagagctcaaccgagcttgggaaggggtggaacaagagatgtttagcctacaggaaggtgtggctctgataccagatgttagaatttcaatggttactctcattgagaagaggatggcactcgagatggggcaattttctggttttcttcattcactaaatacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaggcaccacaagaccaagaccaaccagccaagacttattcctacaatgtgcacctataacctgtactttgcgacttgcaaattaacatttgtttagagtacctgactatacatcatatatccacacttggagaggtaatataatagaagatgataacaacgcgaacgcgctgccacatttatccgacacaagtgcttgctacaataaaagcctcatatcttgcaatttctagataatataagtgtgcaatatccgctaatccacatgcccagagggttacggccttcacgcacgataaaatccaagcagccatagcatcacggaaaataaaatgcggcaaattcccaagaacaacaacgcagctcatgcaaaatccatcatacgaccatcgcaagcgcaacaacgagtacacaagcgtcgacacacaaattaaacctatcggaggaaaagaaacacacaggagcatgcaaaaggggggcatgtatacagacatcgatcgagtgggatcgacgcggcggagaagagaggagaagaggaagcaacctttgaggcttcccaggttcccgcagaaggccgccttcatgagagtgctcgcacctgcgcgcgtacaaagcgagagcgagagcgagagagatcgccgttagaagaattgaagagagccaaccaagaggttagcggaggtgcgggatctggacgtaccggtgccgtcttcggtggggctgaggtagacgagcggcggcgccatggctcgcccctcgcggcgaggagcgaggggtgggtggggaggaggaagcttgcaggagaaggagagcgaaatgggtggaggggggttttggcctccctcttgcttttgcccccccccccccccgtccacgacgaatacgatggggtgtgggttttgcggtctactggacccggtgcgcagagctcgtgctcgtgtcgtggggacctgggtgtaccaagacccggtgcatggagggagccgtttgccagttggagagacaaggccggctacgctcacgctcactctcgcaattagatagtcaatgacatgtagtggcccacggacatggatttttcacgatttttttgaaaaacttatctcataaatagaattttgaacaaacttattctatatatggtctttttggctactgagtcgctgtcgccgcccccctaccaccgtggcggccgatattgacatggcagggggagcacgccaacctctctagtgcaccccccctcgccccgtccctcgggggctcccttcttgcccaagtctgaatgccactcttgcttgctcttgctctctctcacctctcctcaaattcactcaagattatattagtaagaggcttcctatttttcgttgtttttgtttttcgtatagtcgaaaaaaaaccaaaaaaaattgctacaggaccatgcttatgtgttgttttaatcctaagatactacccaaactcacttttgggggaaaacacttcataaaacgtggtaatttgccagtggacaccgcgcgattaaaataatgctttctggttgaagtggagagagaaatcgcgtgaaatgtcaaaaatacccttgggccctttgaagaggagagaaaaatcgcgtaaaatgtcaaaaatgcaattgtgcccacatatcagctctatctcttatctctcttctcatctctctctctctctatatatattctctctcagaggcgcacggggcggtgtcggtcgcggcggagatgacgaggacggcggccgacggagcgaagcagggcatcggctgcggctggcgtgagcggcgcgcaccctatgggaagtcccgggtggccggacttggccatttccacggcatccacggcgaggaaccggatggtgttcaccgactgctccaccacctccgccgccgccagctgctgcgcgcggagggcggtcggtggtcggcggccgacggcgaggcggacgcgggtggaggggcggtgtggacccccgtttttataacaggaatcaatcgtgtaaaccgtaccatttccctggatcaagtagtctggtacacacgaattcatagctggaataccaaatgctcatacacgagagtctagtacgaattattacaacataagcccgcgggcattgtttaaatcatcagaccgagcggtctggaatacaaccaaaagcagagtttagataaggcagcggaattttaggcagcggcatgccattgccacaggcaacgaccgtactaagacctactggacgccatcgtcttcgtccccctcctgatagtaggcataaggatcttccaaggcttcatctcccgcttctgattaattttataattgcaagggtgagtaccaaccgtactcagcaagccaccacatcaatgatgcacatgacaggggaattcaaaggatggctatggttcttttgccaaagcaagttttgtaattctttttacaagcctaagacctagcataaactgaccaagttttaataccagtgttcatattaaacaatgacggttctgtccaccatccattgtgatcccaaggatagcttcccgccattgattcgttatggttttctgaggacgtccacattcccgcctctcaggaagtggctccatcagcataaaaatcatcatgcaatatcccatcccacacaagttaaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttttcatcctcatgcactctaggcgtacacggtttctagcagtgagaggagttttggcgcacccgggaagggaatactcacacatgcattaagttataattatgttttagattctcacatggcagtcctaccgatggcgacaccactgtagacacccgcctcgcggtcctaccaatggctgccccaccgtagagcccctgcctcacacatcaagaaaccactatgcatggatactgcctccgctcagctatctaatccgctaggtctatacccattcgagaagtacggttgtacgggggtcgtttcatgcttaacttcatggctcggtccttaactgactggggacggtactagccttttccagataccacccagatcctccgtccgcctcagtcgaaaacagttgtttaattttatttctcctttcacaaatcatgtcatcaatatcatggcaatgtggcgctcatgtcaccacaagccgcatttcaattaccttcccacaggtaattgcccaagcatatagcatttgataaatatgagtagtatgcctgattctagaatagcatttctaagcaattgtcatagttgactaaggactcatacgtaaacatggttacaaagatttaagggtaaacaataatcaaggcatggcataatcacaagtaggatattcatcattgcatgcaattttatttataaacaaaacaatttcacaattaggatcaacatgttcaaggaatagtgatgacttgccttgctcaaagtcttgcgggtcttggccttcgcttggatccacggctccctcggtctctatagttacgtgcgaaaattgatttgaatttcggttagaattcaaataagaatccaaataaatccaaatgaaagtcgaacgcgaaagtcgattcttttatattaactttactattcgcgaactagggcaaactccacttcaatttaaactatgttgcgagaagaattattttgttgtcatgagtttttaatttaacctacccgagcaacatatcatttaataggttagaaatttctatcgcgagctaaatgtcggacggaatcctaaaattatcttataatattacacgttttaatttagtttatgactaaacaattaaatataatgtacgtctaaaaattcctagcgattaagtccgaatttctaccgtgaatcgattatttatagagattacccaaaaataatccacaataatttacgggaattcatacatttgttcaattattaattacatctaaattaatactgtgaattgatttcttatggagagtactaaaaataatctataatctatagaaattcatccatttatatttacattaatcctatacttaagagttagtattttaggtatttaattagtaaaatttcatctaactatacttttattaaccctataattaaattctaatatttgtaaatattttaaatttccctcttaatttttctttctctctttctttccctttttcctctcctctcttttcttttctttttctttctctccctttcttttcttttctctcctggcttcctcctcccttcctctccttctctttctcggctctccctctctttctctcggctctctctctttcccacccgagcggtggcggcggcggactcgagggaaacggagggcgactcaccggcggcggcagcggcgatgacggcggcagcgacggcggcgcacggtggcgcgagaacggcggtgcgggcacggaaacggtcggcgcggcagcacgacggcggcggtgcggcggcactacgatggcggcgcggcggcactacgatggcggcgcgacggcgtgaaggagtgggtggtggagacggggagaagggggggaatagtgaggcttttataggggaagggagagagat

SEQ ID NO: 2025 - DNA, 9785 bp, Oryza sativa
ttttccaataaaccgattttagagtgtttctcatatgaatttgattccgaaattcttaatttttgcataaatgaagttttaccccatatttatattattctaactaaagattcacctaatttaatatcactcatattttgtttatataattcatttgaatttttaattaaagttaattctcattccatcgtattaaaatttaattgttgttaatatggttgcgataacattttatttatttccaaacccacctaatctttattttaatttatattttaattatttatttagcccacttgatttttagggtttattcctagttaatttcctcccatttgtgatcgatgaaatccgaaatcaaaatccaataaaatcttcgaataaaattggcatgatgcaatttatttaaaaagtttttttttgaagatctgaatttttggagtctttgattttgttggtcgaattttcagaatgttacaggcggccacggaggagggggaggacggagccacgcccggacgcggcggcgggcgaggtaggagcttgcatcgtcgtcaccatggccgcgacgcttctcggtgaacaccatccggcgggcatggtaggagcttgcgtcgccatcgccgtcgccatggggtgtgcgccgctctggccagccgccgccgccgcggctctcgcacgccgctagctgtcgcctgccccgcgctcgctcgccgccgctaccactctgctcgaccaacgatgccgctctgccagccgcacgctcgtccaccgccgccgccaccgccccgctccacttcgccggccgccgtcctcgccatctccgccgcgaccgacgccgccccgtgggcttctgagagagaatatatatagagagagagatgataagagagataggagatagatctgacatgtgggccaagggcattttttacatttcacacgatttctctcacctcttcaaccgaaaagtattattttaatcgaagcggatccactggcaaattactacgtttatggagtgttttctcccaaaagtgagtttaggcagtgtcctagggctaaaacccataaacagtgtcgtgtagcaaaatttgccattcaaattagtacattgttttttagcaaaaaaaatgctacaggacatccaaaaaacgtgttattaactaggagacatcataaacctgtatttgctgtaaggcatcgtaaaaaaactagcaattagctgctggacaccagcatgattattttattatttttaaaggaataggagagagaaacaattattaaagaccagtgtgcccaatatgggccccactgtgagcatgtcctcctcgtctcgctctggcggtggcgcgtcgtcgcgatcacagatgcggcagcgggcgagcctgggaggagtggcggtggcgatggcgagcaagtgcaggaggagtgcggcagcgggcgagcgccgtgacgacgggcggagcggcggcagcaactggcgaggttgaaggcggcgctcgcccgcaaaaatataaagcagattaatcgtccaaacttcagccaccatcgttaccacatacgtgcattttgcgtgtgtgtatgtatatcgagccttgtctcaactcaagaccgggcaaatggctccatgaaccgggtctacctacacccgccccacgagtgcacccagtctagtgcaccggaaaaacccacacccttggttgcgtttccgtacgaagcgactaatgaaggcctgttgtagttcccaaatttttttctcaaaaatatcacatcaaatatttagacacatatataaagcattaaatatagattaaaaaactaaggggctgtttggttgatggctataagttgccacactttgccatacttgaggttagacaagtttgaccatgttaggtgagtgtttggttggcttccacaagtgtggcaagatttctcttttgtaatctaggtcccacatgtaaatgtctctaaaaagtgtggcatggtttcattttgttggctagagtgtggcttggattttgatggcctcacctttgacaagtttggctaagaaagcatggtaaacctaggcaatgttagtatgtgaaccaaacagcccctaattgcacaaccaggtgaaaaatcgtgagacgaatcttttgagcctaattaatccatgattagccataagtgctacagtaacttacatgtgctaatgacgggttgattaggttcgaaagattcttctcgcggttttcagataagttataaaattagttattttatttatatccggaaactctttcgaaatccagtaaaaacatcttacgtaacacctagcaattttcttctcgcgaaataaacagtcccgaagtaaaggaaggccaaacaccgcccacgggccacgggcccacccacccccaacgcaacgctcctcgtcgtctcctcttgctccccaccccaccccaccccacccgtcctcctcgcggcgagccatggcggcgccgttcgtccgccgcccgaccgatgacggcaccagcggcaccagttcgttcagccttcccctgccgcacctctcctcgtagttcgatcgtcgcggtcgcgcgttagtcggggggcttgctcctcggcctgtgtctaatggtgatttctcgctttgttcgcaggtgcgagcgctctcctggggcggccttagatgggtacctcggacgactcgaagggtgcttcctctcctcatcttcgccgtgtccatcccacccgatcgatctgtgtaggcatgatgggaaactattctaaacatatttatttacgtgccactataatgattataatttttctaaaagaatttaataagataaatgtgatagacctactttaactagctgtaatttaatttgttttttttctcgttggacttgtaaaagttgaatacatgtttatggagtgatatatcacattttaatctatcttcttaattgtttcataaccatttagatagcaaatgaggggatgccccttttgcatgctcctgtgtgcttttccgcccttaggtttgagtgatgcttgtgtacttgtgttgcgtttgcatcgatggttgtattgttgatttgaacatggaaggaaaagttttagcctagctgcgcttcagcatctagcactctcgttgccttcagaactttgccacattctattttccgtatttctaggttctctagatggatttgatcgtttgtgaaagcttttaactgtttaattcccaggtccatgaattaccaacttatcttatctagagattgcaagatttgaggcttccttgccttcgataaatgcgacaaatgttgtgattatcctctattacatttacgcctccaagtgtgactgtttgtgatgtgtagtcaggtagtaatctgaacaaatgttttcaagttgcaaagtacaggtttacatagacgacccagtgagtgtataggtgcacatgactcagtgaggatattgcacattacacatatttgttacttttcttttcgtgttataggtagttaatccgtccattctattcctcaatgagatgacgtttctgtgtttttctttaggagaagatattataaagagccttgatatggggaaaggaaaggcccgagatgcagtcttagctcgtaaaaaggatgggattgggttgctgcatgccgcagcatgccagggccatctgactgtttgcaagttcttgatggaggaattggggggtgagtgggtgacgtcaatattgctgaagcgttctggtcattatttatcttactctatcacccttttgcaaaatcagggttgccatgtctacgtttggtagtatgatgtgaagtataccaatgtgctgtttatcacatatgtttaacaccgtttatggcctgtgctgagtctggtgatgttcctactgtgaagtattttcttgatcatggtggtgatgtaacaaaatcagatgataaaggatgcacacagttctccaccatgctgctggcacagatccccctcaatatccagttcattcttatatatattaccaattgtattgttgtacaaggctctataatactgcaatactattaatggagtatgtttcaatcacagcttcaccgtaatcatttcttatgtccttgtatttatagcaaacgcctgcaaataaaccatttctctcctcctttattaatgaaaagaggagtcctcctgcccttcgaaaaaaaaggtaatcatttcttatgtggcaatctagatacctttagtttctatatatcaccactcaaagttatataagtttgctctattatacttgatcacatgtaatctgttccaagttgtttattgtaatggtcattgtttattcacataacccaatttctatagtatctctctcccaggatttatagctcatctcattcacgctcaggatgctgtaaggtaacagagttcttgctttcaaaaggaatacctattgacatagacggcgattattatacatcttgacctttagtaatactcctaagtcttaagattaccatttggcatgctctaagtaaggcttgggtaatgatttcggcggaaagagtgaaaacttgggcgttcaattcatgacactaataaaacctatcctgctctatgagctattcaactctaaatgattgaaatgcttttggattatcatgtcattgtttgtaccttcagtaacttcattgccgaccttctcattttatattgacatcactaaatgtgcattaaaatctcttccaatgcggcaactccatcttggcttcatgaactctgaactcgtttttaagaattggcaaacgatgatcagaaaaaaaaagttaaagtattgtatttctttcctttttctttcacatattctgcttttagcctaacgtaattgccaacaatggagcctgtagtaccctgataagtgctcttgactgctgttcgttgaagtgcatgaagctactcataaaggccagtgtgttatcgagtctgtatttgttcaactactgctgtgcttttattttgctaatcaaaacatgatccacaatgcttttcatgatctcaggctggtgctgatgttaataacaagggtacaggtataactcccttaatgtttgccgcgttgcaagggtgttatacttacttcatcaagattctcctggagactggagcaatccctaatattcccaatgttgtaagtatgttattcttggagttctgttacagctctgattgttttaccaacaagttgaggctaccttgacttatccatagacaatccttagccatagagatagctttcatgaccttccatatgaacattttataccaacaatgcacttttgtagatttctatggattattgactcctgtttcttgtattttattgtatgtgtaagtaactaagtatataatattgtgagtggaaaaagtttgtgcaaagcatgaatgcccttatagtgatcagtgagtccacaactacagcctgtttctactgtttttccctttttgtaagaaagccatgtcatggtgtcaatgtccaaaaatctcacgccagcttttaactacatgccatggttttttgggacataaggagttgtttgttcgaaagctgcaaacaaacaattccaggtttcaccgattttggcatttttaggttccttgctgaattatcttgtatgaaatgaaatgactttctcccttctgttgtgcagttgggttggttgccagtagagcatgttgcatcatgtgattgcagggaaggagttgaaatgctatttccattcacatccccaaattccaaatgtcccaaactggagtgttgatggaataatttctcatgcaaaggtcaaccatacaaagccaacggtaagttatatatagttgcttttttcatactccctccattccataatataaggcacaaccactttttctagatgttccataatataatgcgtgcatgcatgtaggcaattaactatgaccccttctccattaaattattacttttttaaatcctccactctcatgttctctaattctattggatgcatgcattgtatttattaggatgatccaaactacaagatgataataattattttcttggtctttgggttaggggtggttatgccttatattttggaacggagggagtactaaattttgtttaatgctatgctctctgcacatattttctgttgcttaccatgcactttgcatcacggagctctatttcccgtctcatttatgtggttacctgatgcttgttaggctgtaacactggtttaacttacatatcaacaacagttaatagcactaaagagaaggattttatgtgctctgttatcatgcatgttcctttaaagtagagcagaccctttttgtccctcggctttgcgagtacttgttaaaccttcaattttgctagagtacttgataacctgactttaaggtctgttccaaataaaagtatttattaataaatataagtggcatcttgagctcttcataaataatatattgggccatctgtctgttgacttgattgtcagtgactacttggaaagttaaatttggacctcaagttgtgaatttgagtgtgaaaacgaaaaaggggtgcttttcgttattaagcatcagatattgtgacttctgtaaatgataaaaattagagttctatttgagtgattgatatcatcaggtacacttgaattgcagcataagagtgccacatatgcctaaccataaaactatgaagaatgttggagataaagatgctaaatttctttgttaatggaaatcatcctagataaatgttctattattcaaacttcaacctttcaaatttccactttggattgcataagaatttttcattgtttaggatcaacatcaggagagtagaaaagctattttgaagtcgcatgcagatttggcatttaggcagaagaattacgactgtgcagcaaaagtatatgatttggtaaatccttgcaccttatttctgatggtttagaagtaattttactctgccatttgttaagggtatagatgtgacgggtagtattgtaacttcacatctataccgtatcagcctagatcctaaccctagcagccttatccctaacaaaatacccttcacatctatacccttaacaccattatcttgaaacctgtgatgtcttagaaggttgcttgttaactgttgaaatacagttttcgtgcgttattcgtaagcttgggaatgataatgttatttatgtgatgtttgagcatagactcgtggaccaactgcagttctgtacgcaaacaagagcatttgtagattgctcatgggtgatggtgaaggtgctctgtctgatggagatgccgaatgatgcagcctaactgggcaaaagctcacatgctactcaaggtaggattttctgcagcttattaccttttcgtgatccatgtattatggtctgtgtcctgatttactctaaatctaggagtagaagcatgcatgcgatgctcacttggatacgcaaaaattggatcctgggagcgttgagattgagagggaacttaggtatcatcttctgtttctcttgagcatgttttccaatcacaaatgcggttgtgcacggaacatgactgttattattaagatgacgttgtggccacatttactggagctgaacactgaaacttttctttttggttttatatgcctttcttccatctttgagttgatgatggcaacgtgcattggctgcatgcatttaactgacatttaactgcatggcaatctgatttggctggcatatgcaaatcctgctcgtttgtcttaaaggagaaaggcagctcattattcagacatttcagtgcccaatgagttccgacattgtcattttcacccatttttctcgcatgaaggaaaatgagggaaccgtgggcgtcattgtctgttatcattttgactttgctttaatcattaagttttcatgactagaacgattctaatgaatgttggcatgttgctatgtaaaacattggaaatgaatgacagaattgctagtgttcattttaacatatatatcaaggttgacgatacagttattttacatgtatatatcaaggttgtaatgtatatattccaatccgccagggttgctgacgttctgaagaccttttgtgtctctcatttcgttttaaggttcactttgtttcaaggtttgcaaattcgtttggtacacctctaagcaatagctatttcagggttttaggtttgcgaattcgtttgctattttagaaggcttggtgtgagtttcatcagtttgctagccaaagttcacatttgctctggaaggaacagtgcgcactatggaatcatggattgattgctagtcacttttcacatcgctgcatacggctcgtgtcctgataagcacggcaatgctaaaaatgcatattttcctatgatatgaatcgcattgtaatgatttttcatcggctgcgctaaaagcgactcgctcgagtctggaaggcaagggcatacaaatttgagaaacatgcgaactggttcgaatgtgacttttcagttcatgtaaagctgttcccatctgtgaaacccatttatccaagatcccaacattttgttataaatttatcacaagtcatcacacgctcaacgcaatacgcaatagggctcgagaaaaaaaggaagcggaaagaaaagaaagaacgagtctaatgagaagcacgagatggggagagagcgtctctctcctaattcggatcccttcgccgagattgtgcctcaatgcctcagctaataccacttgtttactcgagtaatcaagtagagcaatacgactgtttgctcatatagtactcaggttgagcagtgccccagcaacaaaaatataaaaataatatggacatgcgagacaaaataatatagcatacaatccatccataatcctgttttagattatacgagcaaaaatacataatttaacacaactacgaggtgtcatagtctgccaactacgaggtgtcatagtctgccaaatttctttccgaacatctataatttagcctaacatgcaggagctcacatcctggtcgttttgatgcatccaatcttcaaactggtaagacgattcctgaatctcctgtcatattcctagcttatcaacctcctgcctgaagttaagattcagagaaatggttagattaacaaaacaaaaataataataagagttcacgattgcggagtctctttgagaagatgaaatagaaacatataaacaaacatcgatttttatcatgctttccataaactgtactagcatggtttatagcgggatccaggaccaagtaattaaaaggttcaagaaacgttggtggtgctaaatacctaaatcctaggaacaattctatattcatctaacaatcatgcaagccctgatcaagcaaccacgatgtccatattgtctaaacatatttgggcagaaaaattcacttcgagttcagactagtaagattctgcaggacatgcaaccccaagaacagtagcagttgtgcataataaagagatggtaggtgaacaggcatttcgcaaaccagacatgaaattaccttttgatggtttttctagacaggtaagatggcatttcgctggagatgaaggagagcccctcagacatccttctggcagtagaagggcttcctttgttggaatatccggtacaatctagtagaaccttcttcttcatgtgccc

SEQ ID NO: 2026 - DNA, 1084 bp, Oryza sativa
tcaaatacaaagcacttccctagttagatgtaggttagacttcccgttcgagaaacttttttttctacctgccctcaatttatgcacgattaatgaatgccacctgggtggaagcgagaggtggaaatggaaggtcttattcggaggtgggatctctacctgatagttgcattgccattcatgatgatcccctggcattcgtccattcagccattcaccattcacccattcaactggaattttggttgaatgccggaattgtgtccacaaattgcggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaa

SEQ ID NO: 2027 - DNA, 1188 bp, Oryza sativa
  unsure (1)..(1188): unsure at all n locations
tcggttggtcacaccaccgttgatgggcatcgtcatttacaccgccggcctgcctcagtcgccgcgnactggtgtcaccgcctatacggtcggttggtcacaccaccgttgatgggcatcgtcatttacaccgccggcctgcctctgtcgccgcngagtggtgcctccgcctacacagctggcttattatgccgccgctgttgggcgtttacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcttattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgctgctgttgggcatctacgacttcaccaccggcctgcctccgtcgccgccgactggtgtccccgcctatacggtcggttggtcacaccaccgttgatgggcatcgtcatctgcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccaccggcctgcctccgtcgccgccgagtggtgcctccgcctacacggctggcctattatgccgccgctgttgggcgtctacgacttcaccaccggcctgcctccgtcgccgccgattggtgcctccgcctacacgggtgggctattatgccgccgctgttgggcgtctacgacttcaccgccggccttgcttcgtcggcgtcgagtggtgccttcggctacacggctgggctattatgccgctgctggtgggcgtttacgactttaccacgcgcctgcctccgtcgtcggcgactggtgtcctagcctatacagacgggtgatcacactcaccgttgttgggcat
